(12) United States Patent
Baram et al.

(10) Patent No.: US 12,258,599 B2
(45) Date of Patent: Mar. 25, 2025

(54) **METHOD TO INACTIVATE A MUTANT ALLELE OF AN *ELANE* GENE**

(71) Applicant: EmendoBio Inc., Wilmington, DE (US)

(72) Inventors: David Baram, Tel Aviv (IL); Lior Izhar, Tel Aviv (IL); Asael Herman, Ness-Ziona (IL); Rafi Emmanuel, Ramla (IL); Liat Rockah, Rishon LeZion (IL); Nadav Marbach-Bar, Rehovot (IL); Michal Golan Mashiach, Ness-Ziona (IL); Joseph Georgeson, Rehovot (IL)

(73) Assignee: EmendoBio Inc., Wilmington, DE (US)

( * ) Notice: Subject to any disclaimer, the term of this patent is extended or adjusted under 35 U.S.C. 154(b) by 649 days.

(21) Appl. No.: 17/090,814

(22) Filed: Nov. 5, 2020

(65) Prior Publication Data
US 2021/0130804 A1 May 6, 2021

Related U.S. Application Data

(60) Provisional application No. 62/931,655, filed on Nov. 6, 2019.

(51) Int. Cl.
*C12N 9/22* (2006.01)
*C12N 9/64* (2006.01)
*C12N 15/11* (2006.01)

(52) U.S. Cl.
CPC .............. *C12N 9/6448* (2013.01); *C12N 9/22* (2013.01); *C12N 15/111* (2013.01); *C12N 2310/20* (2017.05)

(58) Field of Classification Search
CPC ...... C12N 9/6448; C12N 9/22; C12N 15/111; C12N 2310/20; C12N 2310/315; C12N 2310/321; C12N 15/113
See application file for complete search history.

(56) References Cited

U.S. PATENT DOCUMENTS

| | | |
|---|---|---|
| 2011/0023143 A1 | 1/2011 | Weinstein et al. |
| 2018/0155688 A1 | 6/2018 | Seet et al. |
| 2019/0024086 A1 | 1/2019 | Lande et al. |
| 2019/0264232 A1* | 8/2019 | Hou ..................... C12N 15/113 |
| 2021/0155929 A1 | 5/2021 | Baram |
| 2021/0363547 A1 | 11/2021 | Baram |
| 2022/0387515 A1 | 12/2022 | Baram |

FOREIGN PATENT DOCUMENTS

| | | |
|---|---|---|
| WO | WO 2018/085460 A2 | 5/2018 |
| WO | WO 2019/217294 A1 | 11/2019 |
| WO | WO 2020/112979 A2 | 6/2020 |
| WO | WO 2023/281083 A1 | 1/2023 |

OTHER PUBLICATIONS

Deng et al., Genes Genomes Genetics 6:205-207, 2016.*
Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Singh et al., Current Protein and Peptide Science 19(1):5-15, 2018.*
Sadowski et al., Current Opinion in Structural Biology 19:357-362, 2009.*
Mullins et al., Hypertension 22(4):630-633, 1993.*
Houdebine, J., Journal of Biotechnology 98:145-160, 2002.*
Phillips, A., J. Pharm. Pharmacology 53:1169-1174, 2001.*
Gardlik et al., Med. Sci. Monit. 11(4):RA110-121, 2005.*
Wang et al., ChemBioChem 20:634-643, 2019.*
Nasri et al., Haematologica 105(3):598-609, pre-published Jun. 27, 2019.*
DbSNP reference SNP report rs1057520110, Sep. 21, 2022.*
Hequet, O., Journal of Blood Medicine 6:55-67, 2015.*
Makaryan et al. (Curr Opin Hematol 22:3-11, 2015.*
Zou et al., GenBank accession No. RHS40773 Sep. 6, 2018.*
International Search Report issued Mar. 31, 2021 in connection with PCT International Application No. PCT/US2020/059186.
Written Opinion (form PCT/ISA/237) issued Mar. 31, 2021 in connection with PCT International Application No. PCT/US2020/059186.
Arun et al., "Spectrum of ELANE mutations in congenital neutropenia: a single-centre study in patients of Indian origin." Journal of Clinical Pathology, Aug. 31, 2018, vol. 71, iss. 12, pp. 1046-1051.

* cited by examiner

*Primary Examiner* — Delia M Ramirez
(74) *Attorney, Agent, or Firm* — Potomac Law Group, PLLC; Jamaica Potts Szeliga

(57) ABSTRACT

Methods for inactivating in a cell a mutant allele of the elastase, neutrophil expressed gene (ELANE gene) gene having a mutation associated with severe congenital neutropenia (SCN) or cyclic neutropenia (CyN) wherein the mutant allele is selected from the group consisting of the ELANE mutants set forth in Table 1, the method comprising
  introducing to the cell a composition comprising:
    a CRISPR nuclease or a sequence encoding the CRISPR nuclease; and
    a first RNA molecule comprising a guide sequence portion having 17-30 nucleotides,
  wherein a complex of the CRISPR nuclease and the first RNA molecule affects a double strand break in the mutant allele of the ELANE gene
the method optionally further comprising introduction of a second RNA molecule comprising a guide sequence portion capable of complexing with a CRISPR nuclease, wherein the complex of the second RNA molecule and CRISPR nuclease affects a second double strand break in the ELANE gene.

8 Claims, 5 Drawing Sheets
Specification includes a Sequence Listing.

OMNI-50

On-target g35 5' AGTCCGGGCTGGGAGCGGGTGGGGAGCA (SEQ ID NO: 31231)

On-target g62 5' GTCAAGCCCCAGAGGCCACAGGGACAGA (SEQ ID NO: 31232)

Off-target g35 5' AGTCCTGGCTGGGAGCAGGTGGGGAGAG (SEQ ID NO: 31233)

Off-target g62 5' GCCAAGCCTCAGAGGCCACAGGGCAGCA (SEQ ID NO: 31234)

METHOD TO INACTIVATE A MUTANT ALLELE OF AN *ELANE* GENE

This application claims the benefit of U.S. Provisional Application No. 62/931,655 filed Nov. 6, 2019, the contents of which are hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide sequences which are present in the file named "201105_91192-A_Sequence_Listing_AWG.txt", which is 6,022 kilobytes in size, and which was created on Oct. 14, 2020 in the IBM-PC machine format, having an operating system compatibility with MS-Windows, which is contained in the text file filed Nov. 5, 2020 as part of this application.

BACKGROUND OF INVENTION

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit(s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Gain-of-function mutations are generally dominant negative mutations. An example of a dominant negative mutation is haploinsufficiency where one allele is mutated and loses its function and the single wild type allele left does not generate enough protein to be sufficient for a specific cellular function. Other examples include dominant negative mutations which have a gene product that acts antagonistically to the wild-type allele.

Neutropenia

Neutropenia is defined as a reduction in the absolute number of neutrophils in the blood circulation and commonly diagnosed by measuring the absolute neutrophil count (ANC) in peripheral blood. The severity of neutropenia is characterized as mild with an ANC of 1000-1500/µL, moderate with an ANC of 500-1000/µL, or severe with an ANC of less than 500/µL (Boxer 2012).

Neutropenia can be classified as congenital (hereditary) or acquired. The two main types of the congenital condition, commonly of autosomal dominant inheritance, are cyclic neutropenia (CyN) and severe congenital neutropenia (SCN). Cyclic neutropenia is characterized by fluctuating neutrophil counts from normal levels to zero while severe congenital neutropenia (SCN) is characterized by very low ANC (500/µL) observed at birth, maturation arrest of the myelopoiesis in bone marrow at the promyelocyte/myelocyte stage, and early onset of bacterial infections (Carlsson et al. 2012; Horwitz et al. 2013).

SCN may be diagnosed by measuring a very low ANC in the blood and examining bone marrow aspirate to identify myeloid maturation arrest (Dale 2017). SCN is usually diagnosed before age 6 months, while diagnosis for CyN is generally raised during the second year of life, or later, and the main clinical manifestation is recurrent acute stomatologic disorders. Bone marrow examination is often necessary to rule out malignant hemopathies, determine cellularity, assess myeloid maturation, and detect signs of a precise etiology, with cytogenetic bone marrow studies now crucial when SCN is suspected. Antineutrophil antibody assay, immunoglobulin assay (Ig GAM), lymphocyte immunophenotyping, pancreatic markers (serum trypsinogen and fecal elastase) and liposoluble vitamin levels (vitamins A, E and D) are also of interest in assessing SCN and CyN (See Donadieu 2011).

SCN can be autosomal-recessive (HAX1, G6PC3), autosomal-dominant (ELANE, GFI1), or X-linked (WAS) forms of inheritance or occur sporadically (Carlsson et al. 2012; Boxer 2012). Cyclic and congenital neutropenia are most frequently caused by mutations in the "elastase, neutrophil expressed gene" (ELANE gene)—the gene for neutrophil elastase. "ELANE gene mutations are identified in 40-55% of SCN patients and males and females are equally affected (Donadieu et al. 2011; Dale 2017). Mutations in the ELANE gene are associated with autosomal-dominant and sporadic cases of SCN (Carlsson et al. 2012). To date, more than 200 different ELANE mutations have been identified, which are randomly distributed over all exons as well as in intron 3 and intron 4 (Skokowa et al. 2017). More than 120 distinct ELANE gene mutations related to CyN and SCN are now known, for example C151Y and G214R particularly associated with a poor prognosis. (See Makaryan et al. 2012; see also Germeshausen et al. 2013 for a comprehensive list of ELANE mutations related to CyN and SCN).

ELANE encodes neutrophil elastase (NE) which is involved in the function of neutrophil extracellular traps (networks of fibers that bind pathogens). Some studies suggest that the product of mutant ELANE acts to disrupt neutrophil production in the bone marrow and cause neutropenia. These studies indicate that mutations in NE initiate the unfolded protein response (UPR) leading to cell loss in the process of neutrophil formation in the marrow (Makaryan et al. 2017).

Current Treatments

Granulocyte colony-stimulating factor (G-CSF) is considered the first-line treatment for SCN (Connelly, Choi, and Levine 2012). G-CSF stimulates the production of more neutrophils and delays their apoptosis (Schiffer and Klein 2007). Overall survival is now estimated to exceed 80%, including patients developing malignancies, although 10% of SCN patients still die from severe bacterial infections or sepsis (Skokowa et al. 2017). Although G-CSF therapy is successful in preventing mortality from sepsis, long-term treatment was identified to be associated with an increased risk of developing myelodysplastic syndrome (MDS) or leukemia in SCN patients. The most common leukemia in SCN is AML, but acute lymphoid leukemia (ALL), juvenile myelomonocytic leukemia (JMML), chronic myelomonocytic leukemia (CMML), and bi-phenotypic leukemia are also reported in the literature (Connelly, Choi, and Levine 2012). It was previously demonstrated that patients who had a robust response to G-CSF (doses≤8 µg/kg/day) had a cumulative incidence of 15% for developing MDS/leukemia after 15 years on G-CSF, while an incidence of 34% was reported in patients with poor response to G-CSF despite high doses (Rosenberg et al. 2010).

Hematopoietic stem cell transplant (HSCT) is an alternative, curative therapy for patients who do not respond to G-CSF therapy or who develop AML/MDS. However, patients with chronic neutropenia who undergo HCT are at increased risk of developing infectious complications such as fungal and graft-versus-host disease (Skokowa et al. 2017). Moreover, HCT requires a matched related donor for successful survival but most patients will not have an available matched donor (Connelly, Choi, and Levine 2012).

SUMMARY OF THE INVENTION

Disclosed is an approach for knocking out the expression of a dominant-mutant allele by disrupting the dominant-mutant allele or degrading the resulting mRNA.

Embodiments of the present invention provide methods for knocking out expression of a mutant allele of the elastase, neutrophil expressed gene (ELANE gene) gene having a mutation associated with severe congenital neutropenia (SCN) or cyclic neutropenia (CyN) and allowing expression of the functional protein.

The present invention provides a method for inactivating in a cell a mutant allele of the elastase, neutrophil expressed gene (ELANE gene) gene having a mutation associated with severe congenital neutropenia (SCN) or cyclic neutropenia (CyN), wherein the mutant allele is selected from the group consisting of the ELANE mutants set forth in Table 1, the method comprising
  introducing to the cell a composition comprising:
    a CRISPR nuclease or a sequence encoding the CRISPR nuclease; and
    a first RNA molecule comprising a guide sequence portion having 17-30 nucleotides,
  wherein a complex of the CRISPR nuclease and the first RNA molecule affects a double strand break in the mutant allele of the ELANE gene.

The present invention provides for a modified cell obtained by the methods of the present invention.

The present invention provides for a modified cell lacking at least a portion of one allele of the ELANE gene.

The present invention provides for a composition comprising modified cells and a pharmaceutically acceptable carrier.

The present invention provides for an in vitro or ex vivo method of preparing a composition, comprising mixing the cells of the present invention with the pharmaceutically acceptable carrier.

The present invention provides for a method of preparing in vitro or ex vivo a composition comprising modified cells, the method comprising:
  a) isolating HSPCs from cells obtained from a subject with an ELANE gene mutation related to SCN or CyN and/or suffering from SCN or CyN and which subject has a mutant allele of the ELANE gene selected from the group consisting of the ELANE mutants set forth in Table 1, and obtaining the cell from the subject;
  b) introducing to the cells of step (a) a composition comprising:
    a CRISPR nuclease or a sequence encoding the CRISPR nuclease; and
    a first RNA molecule comprising a guide sequence portion having 17-30 nucleotides,
    wherein a complex of the CRISPR nuclease and the first RNA molecule affects a double strand break in the mutant allele of the ELANE gene in one or more cells,
    optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally
  c) culture expanding the modified cells of step (b),
  wherein the modified cells are capable of engraftment and giving rise to progeny cells after engraftment.

The present invention provides for use of a composition prepared in vitro by a method comprising:
  a) isolating HSPCs from cells obtained from a subject with an ELANE gene mutation related to SCN or CyN and/or suffering from SCN or CyN and subject has a mutant allele of the ELANE gene selected from the group consisting of the ELANE mutants set forth in Table 1;
  b) introducing to the cells of step (a) a composition comprising:
    a CRISPR nuclease or a sequence encoding the CRISPR nuclease; and
    a first RNA molecule comprising a guide sequence portion having 17-30 nucleotides,
    wherein a complex of the CRISPR nuclease and the first RNA molecule affects a double strand break in the mutant allele of the ELANE gene in one or more cells, optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally;
  c) culture expanding the cells of step (b) wherein the modified cells are capable of engraftment and giving rise to progeny cells after engraftment; and
  d) administering to the subject the cells of step (b) or step (c)
  for treating the SCN or CyN in the subject.

The present invention provides for a method of treating a subject afflicted with SCN or CyN, comprising administration of a therapeutically effective amount of the modified cells, compositions, or the compositions prepared by the methods of the instant invention The present invention provides for a method for treating SCN or CyN in a subject with an ELANE gene mutation relating to SCN or CYN in need thereof and which subject has a mutant allele of the ELANE gene selected from the group consisting of the ELANE mutants set forth in Table 1, the method comprising:
  a) isolating HSPCs from cells obtained from the subject;
  b) introducing to the cells of step (a) a composition comprising:
    a CRISPR nuclease or a sequence encoding the CRISPR nuclease; and
    a first RNA molecule comprising a guide sequence portion having 17-30 nucleotides,
    wherein a complex of the CRISPR nuclease and the first RNA molecule affects a double strand break in the mutant allele of the ELANE gene in one or more cells, optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally;
c) culture expanding the cells of step (b) wherein the modified cells are capable of engraftment and giving rise to progeny cells after engraftment; and
d) administering to the subject the cells of step (b) or step (c)

thereby treating the SCN or CyN in the subject.

The present invention provides for a method for treating SCN or CyN in a subject with an ELANE gene mutation relating to SCN or CYN in need thereof and subject has a mutant allele of the ELANE gene selected from the group consisting of the ELANE mutants set forth in Table 1, the method comprising administering to the subject autologous modified cells or progeny of autologous modified cells, wherein the autologous modified cells are modified so as to have a double strand break in the mutant allele of the ELANE gene, wherein said double strand break results from introduction to the cells of a composition comprising a CRISPR nuclease or a sequence encoding the CRISPR nuclease and a first RNA molecule wherein a complex of the CRISPR nuclease and the first RNA molecule affects a double strand break in the mutant allele of the ELANE gene so as to inactive the mutant allele of the ELANE gene in the cell, thereby treating the SCN or CyN in the subject.

The present invention provides for a method of selecting a subject for treatment from a pool of subjects diagnosed with SCN or CyN, comprising the steps of:
a) obtaining cells from each subject in the pool of subjects;
b) screening each subject's cells for an ELANE gene mutation related to SCN or CyN, and selecting only subjects with an ELANE gene mutation related to SCN or CyN;
c) screening by sequencing the cells of the subjects selected in step (b) for a mutant allele of the ELANE gene selected from the group consisting of the ELANE mutations set forth in Table 1,
d) selecting for treatment only subjects with cells heterozygous for an ELANE mutation set forth in Table 1
e) obtaining hematopoetic stem and progenitor cells (HSPC) cells from the bone marrow of the subject either by aspiration or by mobilization and apheresis of peripheral blood; and
f) introducing to the HSPC cells of step (e):
one or more CRISPR nucleases or sequences encoding the one or more CRISPR nuclease;
a first RNA molecule comprising a guide sequence portion having 17-30 contiguous nucleotides containing nucleotides in the sequence set forth in any one of SEQ ID NOs: 1-31117 targeting the mutant allele of the ELANE gene, and
a second RNA molecule comprising a guide sequence portion targeting a sequence in intron 3, intron 4 or 3' UTR of the ELANE gene,
wherein a complex of the first RNA molecule and a CRISPR nuclease affects a first double strand break in the mutant allele of the ELANE gene in one or more of the HSPC cells and a complex of the second RNA molecule and a CRISPR nuclease affect a second double strand break in intron 3, intron 4, or 3' UTR of both alleles of the ELANE gene in the one or more HSPC cells in which the complex of the first RNA molecule and the CRISPR nuclease affected a first double strand break, thereby obtaining modified cells;
g) administering to the subject the modified cells of step (f), thereby treating SCN or CyN in the subject.

The present invention provides an RNA molecule comprising a guide sequence portion having 17-30 contiguous nucleotides containing nucleotides in the sequence set forth in any one of SEQ ID NOs: 1-31117.

The present invention provides a method for inactivating in a cell a mutant ELANE allele, the method comprising delivering to the cell the RNA molecules or compositions of the present invention.

The present invention provides use of the RNA molecules, the compositions, or the composition prepared by the method of the present invention for inactivating in a cell a mutant ELANE allele.

The present invention provides a medicament comprising the RNA molecules, compositions, or the compositions prepared by the methods of the instant invention for use in inactivating in a cell a mutant ELANE allele, wherein the medicament is administered by delivering to the cell the RNA molecules, compositions, or the compositions prepared by the methods of the instant invention.

The present invention provides for use of the methods, the modified cells, the compositions, or the compositions prepared by the methods, or the RNA molecules of the instant invention for treating ameliorating or preventing SCN or CyN in to a subject having or at risk of having SCN or CyN.

The present invention provides for a medicament comprising the RNA molecules, compositions, compositions prepared by the methods of the instant invention, or the modified cells of the instant invention, for use in treating ameliorating or preventing SCN or CyN, wherein the medicament is administered by delivering to a subject having or at risk of having SCN or CyN the RNA molecules, compositions, compositions prepared by the methods of the instant invention, or the modified cells of the instant invention.

The present invention provides for a kit for inactivating a mutant ELANE allele in a cell, comprising the RNA molecules of the instant invention, a CRISPR nuclease or a sequence encoding the CRISPR nuclease, and/or a tracrRNA molecule or a sequence encoding the tracrRNA; and instructions for delivering the RNA molecule; CRISPR nuclease or sequence encoding the CRISPR nuclease, and/or tracrRNA molecule or sequence encoding the tracrRNA to the cell to inactivate the mutant ELANE allele in the cell.

The present invention provides for a kit for treating SCN or CyN in a subject, comprising the RNA molecules of the instant invention, a CRISPR nuclease or sequence encoding the CRISPR nuclease, and/or a tracrRNA molecule or sequence encoding the tracrRNA molecule; and instructions for delivering the RNA molecule; CRISPR nuclease, and/or the tracrRNA to a subject having or at risk of having SCN or CyN so as to treat the SCN or CyN.

The present invention provides a kit for inactivating a mutant ELANE allele in a cell, comprising the compositions, the composition prepared by the methods of the instant invention, or the modified cells of the instant invention, and instructions for delivering the composition to the cell so as to inactivate the ELANE gene in the cell.

The present invention provides a kit for treating SCN or CyN in a subject, comprising the composition, the compositions prepared by the methods of the instant invention, or the modified cells of the instant invention, and instructions for delivering the compositions, the compositions prepared by the methods of the instant invention, or the modified cells of the instant invention, to a subject having or at risk of having SCN or CyN so as to treat SCN or CyN.

BRIEF DESCRIPTION OF THE DRAWINGS

FIG. 3A: Activity assay of OMNI-50 RNP with different spacer lengths (17-23 nucleotides) of guide 35 (Table 4). FIG. 3B: Reducing amounts of RNPs (4, 2, 1.2, 0.6 and 0.2 pmol) with spacer lengths 20-23 nucleotides were incubated with 100 ng of DNA target template. FIG. 3C: Activity assay for OMNI-50 as RNP in U2OS cells: RNPs with spacer lengths 17-23 nucleotides were electroporated into a U2OS cell line and editing levels (indels) were measured by NGS. FIG. 3D: Activity assay for OMNI-50 as RNP in U2OS cells: RNPs with ELANE g35 sgRNA V1-4 were electroporated into a U2OS cell line and editing levels (indels) were measured by NGS.

DETAILED DESCRIPTION

Figure 1:
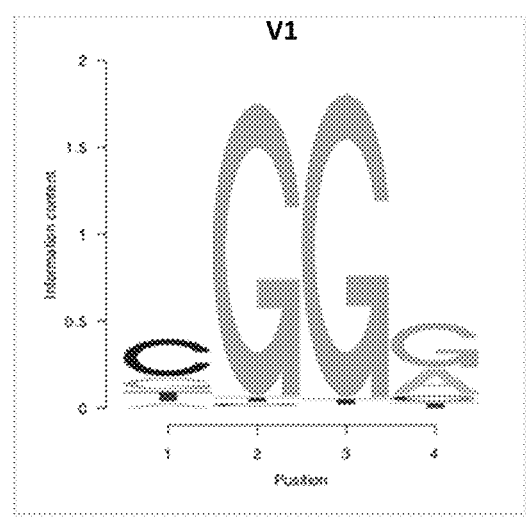
FIG. 1: In-vitro PAM Depletion by TXTL results for OMNI-50. The OMNI-50 nuclease was challenged with two versions of sgRNA with targeting spacer (T2) and non-targeting spacer (T1). The PAM logo is a schematic representation of the ratio of the depleted site. A table with the tested sgRNA version is presented for the most depleted reads with their ratio comparing to the non-targeted library.
Figure 1:
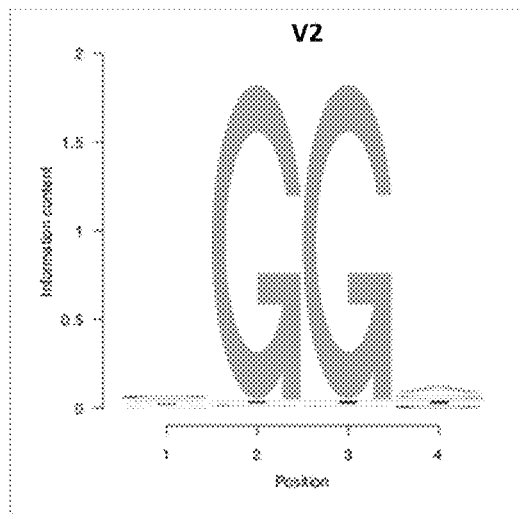

Embodiments of the present invention provide a method for inactivating in a cell a mutant allele of the elastase, neutrophil expressed gene (ELANE gene) gene having a mutation associated with severe congenital neutropenia (SCN) or cyclic neutropenia (CyN) wherein the mutant allele is selected from the group consisting of the ELANE mutants set forth in Table 1, the method comprising
    introducing to the cell a composition comprising:
        a CRISPR nuclease or a sequence encoding the CRISPR nuclease; and
        a first RNA molecule comprising a guide sequence portion having 17-30 nucleotides,
    wherein a complex of the CRISPR nuclease and the first RNA molecule affects a double strand break in the mutant allele of the ELANE gene.

In embodiments of the present invention, the guide sequence portion of the first RNA molecule comprises 17-22 contiguous nucleotides as set forth in any one of SEQ ID NOs: 1-31117.

In embodiments of the present invention, the complex of the CRISPR nuclease and the first RNA molecule affects a double strand break in the mutant allele of the ELANE gene, wherein the mutation associated with severe congenital neutropenia (SCN) or cyclic neutropenia (CyN) in mutant allele is targeted for the double strand break by the complex of the CRISPR nuclease and the first RNA molecule.

In embodiments of the present invention, the CRISPR nuclease and the first RNA molecule affects a double strand break in the mutant allele of the ELANE gene, which mutant allele is targeted for the double strand break based on a sequence of the mutant allele at the mutation associated with severe congenital neutropenia (SCN) or cyclic neutropenia (CyN).

In embodiments of the present invention, the CRISPR nuclease and the first RNA molecule affects a double strand break in the mutant allele of the ELANE based on the nucleotide base of the mutation associated with severe congenital neutropenia (SCN) or cyclic neutropenia (CyN) present on the mutant allele of the ELANE gene.

Embodiments of the present invention further comprise introduction of a second RNA molecule comprising a guide sequence portion capable of complexing with a CRISPR nuclease, wherein the complex of the second RNA molecule and CRISPR nuclease affects a second double strand break in the ELANE gene.

In embodiments of the present invention, a composition may comprise 1, 2, 3 or more CRISPR nucleases or sequencing encoding the CRISPR nucleases. In embodiments of the present invention, introducing a composition to the cell may comprise introducing 1, 2, 3, or more compositions to the cell. In embodiments of the present invention, each composition may comprise a different CRISPR nuclease or sequence encoding the CRISPR nucleases or the same CRISPR nuclease or sequence encoding the CRISPR nuclease. In embodiments of the present invention involving two RNA molecules, the second RNA molecule may form a complex with the same CRISPR nuclease as the first RNA molecule, or may form a complex with another CRISPR nuclease.

In embodiments of the present invention, the second double strand break is within a non-coding region of the ELANE gene. In embodiments of the present invention, the non-coding region of the ELANE gene is selected an intron or an untranslated region (UTR). In embodiments of the present invention, the non-coding region is in intron 3 or intron 4. In an embodiments of the present invention the UTR is the 3'UTR.

In embodiments of the present invention, the guide sequence portion of the first RNA molecule comprises 17-22 contiguous nucleotides as set forth in any one of SEQ ID NOs: 1-31117.

According to embodiments of the present invention, the guide sequence portion of the second RNA molecule comprises 17-30 contiguous nucleotides containing nucleotides in the sequence set forth in any one of SEQ ID NOs: 1-31117.

In embodiments of the present invention, the second double strand break is within a non-coding region of the ELANE gene.

Embodiments of the present invention comprise obtaining the cell with an ELANE gene mutation associated with severe congenital neutropenia (SCN) or CyN from a subject with an ELANE gene mutation related to SCN or CyN and/or suffering from SCN or CyN wherein the ELANE gene mutation is selected from the group consisting of the ELANE mutants set forth in Table 1.

Embodiments of the present invention comprise first selecting a subject with an ELANE gene mutation related to SCN or CyN and/or suffering from SCN or CyN wherein the ELANE gene mutation is selected from the group consisting of the ELANE mutants set forth in Table 1, and obtaining the cell from the subject.

Embodiments of the present invention comprise obtaining the cell from the subject by mobilization and/or by apheresis.

Embodiments of the present invention comprise obtaining the cell from the subject by bone marrow aspiration.

In embodiments of the present invention, the cell is prestimulated prior to introducing the composition to the cell.

Embodiments of the present invention comprise culture expanding the cell to obtain cells.

In embodiments of the present invention, the cells are cultured with one or more of: stem cell factor (SCF), IL-3, and GM-CSF.

In embodiments of the present invention, the cells are cultured with at least one cytokine.

In embodiments of the present invention, the at least one cytokine is a recombinant human cytokine.

In embodiments of the present invention, the cell is among a plurality of cells, wherein the composition comprising the first RNA molecule or both the first and the second RNA molecule is introduced into at least the cell as well as other cells among the plurality of cells, and the mutant allele of the ELANE gene is inactivated in at least the cell as well as in the other cells among the plurality of cells, thereby obtaining multiple modified cells.

In embodiments of the present invention, introducing the composition comprising the first RNA molecule or introduction of the second RNA molecule comprises electroporation of the cell or cells.

Embodiments of the present invention provide for a modified cell obtained by the methods of the present invention.

In embodiments of the present invention, the modified cells are further culture expanded.

In embodiments of the present invention, the modified cells are capable of engraftment.

In embodiments of the invention, modified cells are capable of long-term engraftment when infused into a patient, giving rise to differentiated hematopoietic cells for at least 12 months after infusion, preferably at least 24 months and even more preferably at least 30 months after infusion. In a further embodiment, the modified cells are capable of long-term engraftment when infused into an autologous subject. In a further embodiment, the modified cells are capable of long-term engraftment when infused into a subject without myeloablation. In an embodiment of the present invention, the modified cells are delivered to a subject in sufficient numbers that, when engrafted into a human subject, provide long term engraftment.

In embodiments of the present invention, the modified cell or cells are capable of giving rise to progeny cells.

In embodiments of the present invention, the modified cell or cells are capable of giving rise to progeny cells after engraftment.

In embodiments of the present invention, the modified cell or cells are capable of giving rise to progeny cells after an autologous engraftment.

In embodiments of the present invention, the modified cell or cells are capable of giving rise to progeny cells for at least 12 months or at least 24 months after engraftment.

In one embodiment, the cell or cells are stem cells. In one embodiment, the cell is an embryonic stem cell. In some embodiment, the stem cell is a hematopoietic stem/progenitor cell (HSPC).

In embodiments of the present invention, the modified cell or cells are CD34+ hematopoietic stem cells.

In embodiments of the present invention, the modified cell or cells are bone marrow cells or peripheral mononucleated cells (PMCs).

Embodiments of the present invention provide for a modified cell lacking at least a portion of one allele of the ELANE gene.

In embodiments of the present invention, the modified cell was modified from a cell with an ELANE gene mutation selected from the group consisting of the ELANE mutants set forth in Table 1.

Embodiments of the present invention provide for a composition comprising modified cells and a pharmaceutically acceptable carrier.

Embodiments of the present invention provide for an in vitro or ex vivo method of preparing a composition, comprising mixing the cells of the present invention with the pharmaceutically acceptable carrier.

Embodiments of the present invention provide for a method of preparing in vitro or ex vivo a composition comprising modified cells, the method comprising:
 a) isolating HSPCs from cells obtained from a subject with an ELANE gene mutation related to SCN or CyN and/or suffering from SCN or CyN, wherein the ELANE gene mutation is selected from the group consisting of the ELANE mutants set forth in Table 1, and obtaining the cell from the subject;
 b) introducing to the cells of step (a) a composition comprising:
  a CRISPR nuclease or a sequence encoding the CRISPR nuclease; and
  a first RNA molecule comprising a guide sequence portion having 17-30 nucleotides,
  wherein a complex of the CRISPR nuclease and the first RNA molecule affects a double strand break in the mutant allele of the ELANE gene in one or more cells,
  optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally
 c) culture expanding the modified cells of step (b),
  wherein the modified cells are capable of engraftment and giving rise to progeny cells after engraftment.

Embodiments of the present invention provide for use of a composition prepared in vitro by a method comprising:
 a) isolating HSPCs from cells obtained from a subject with an ELANE gene mutation related to SCN or CyN and/or suffering from SCN or CyN wherein the ELANE gene mutation is selected from the group consisting of the ELANE mutants set forth in Table 1;
b) introducing to the cells of step (a) a composition comprising:
   a CRISPR nuclease or a sequence encoding the CRISPR nuclease; and
   a first RNA molecule comprising a guide sequence portion having 17-30 nucleotides,
   wherein a complex of the CRISPR nuclease and the first RNA molecule affects a double strand break in the mutant allele of the ELANE gene in one or more cells, optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally;
c) culture expanding the cells of step (b) wherein the modified cells are capable of engraftment and giving rise to progeny cells after engraftment; and
d) administering to the subject the cells of step (b) or step (c)
for treating the SCN or CyN in the subject.

Embodiments of the present invention provide for a method of treating a subject afflicted with SCN or CyN, comprising administration of a therapeutically effective amount of the modified cells, compositions, or the compositions prepared by the methods of the instant invention Embodiments of the present invention provide for a method for treating SCN or CyN in a subject with an ELANE gene mutation relating to SCN or CYN in need thereof wherein the ELANE gene mutation is selected from the group consisting of the ELANE mutants set forth in Table 1, the method comprising:
a) isolating HSPCs from cells obtained from the subject;
b) introducing to the cells of step (a) a composition comprising:
   a CRISPR nuclease or a sequence encoding the CRISPR nuclease; and
   a first RNA molecule comprising a guide sequence portion having 17-30 nucleotides,
   wherein a complex of the CRISPR nuclease and the first RNA molecule affects a double strand break in the mutant allele of the ELANE gene in one or more cells,
   optionally, introducing to the cells a second RNA molecule comprising a guide sequence portion capable of complexing with a CRISPR nuclease, wherein the complex of the second RNA molecule and CRISPR nuclease affects a second double strand break in the ELANE gene in the one or more cells so as to inactive the mutant allele of the ELANE gene in one or more cells thereby obtaining modified cells; optionally;
c) culture expanding the cells of step (b) wherein the modified cells are capable of engraftment and giving rise to progeny cells after engraftment; and
d) administering to the subject the cells of step (b) or step (c)
thereby treating the SCN or CyN in the subject.

Embodiments of the present invention provide for a method for treating SCN or CyN in a subject with an ELANE gene mutation relating to SCN or CYN in need thereof wherein the ELANE gene mutation is selected from the group consisting of the ELANE mutants set forth in Table 1, the method comprising
administering to the subject autologous modified cells or progeny of autologous modified cells, wherein the autologous modified cells are modified so as to have a double strand break in the mutant allele of the ELANE gene,
   wherein said double strand break results from introduction to the cells of a composition comprising a CRISPR nuclease or a sequence encoding the CRISPR nuclease and a first RNA molecule wherein a complex of the CRISPR nuclease and the first RNA molecule affects a double strand break in the mutant allele of the ELANE gene so as to inactive the mutant allele of the ELANE gene in the cell, thereby treating the SCN or CyN in the subject.

Embodiments of the present invention provide for a method of selecting a subject for treatment from a pool of subjects diagnosed with SCN or CyN, comprising the steps of:
a) obtaining cells from each subject in the pool of subjects;
b) screening each subject's cells for an ELANE gene mutation related to SCN or CyN, and selecting only subjects with an ELANE gene mutation related to SCN or CyN;
c) screening by sequencing the cells of the subjects selected in step (b) for a mutant allele of the ELANE gene selected from the group consisting of the ELANE mutations set forth in Table 1,
d) selecting for treatment only subjects with cells heterozygous for an ELANE mutation set forth in Table 1.
e) obtaining HSPC cells from the bone marrow of the subject either by aspiration or by mobilization and apheresis of peripheral blood; and
f) introducing to the HSPC cells of step (e):
   one or more CRISPR nucleases or sequences encoding the one or more CRISPR nucleases
   a first RNA molecule comprising a guide sequence portion having 17-30 contiguous nucleotides containing nucleotides in the sequence set forth in any one of SEQ ID NOs: 1-31117 targeting the mutant allele of the ELANE gene, and
   a second RNA molecule comprising a guide sequence portion targeting a sequence in intron 3, intron 4 or 3' UTR of the ELANE gene,
   wherein a complex of the first RNA molecule and a CRISPR nuclease affects a first double strand break in the mutant allele of the ELANE gene in one or more of the HSPC cells and a complex of the second RNA molecule and a CRISPR nuclease affect a second double strand break in intron 3, intron 4, or 3' UTR of both alleles of the ELANE gene in the one or more HSPC cells in which the complex of the first RNA molecule and the CRISPR nuclease affected a first double strand break, thereby obtaining modified cells;
g) administering to the subject the modified cells of step (f),
thereby treating SCN or CyN in the subject.

Embodiments of the present invention provide an RNA molecule comprising a guide sequence portion having 17-30 contiguous nucleotides containing nucleotides in the sequence set forth in any one of SEQ ID NOs: 1-31117.

Embodiments of the present invention further comprise a second RNA molecule comprising a guide sequence portion.

In embodiments of the present invention, the second RNA molecule targets a non-coding region of the ELANE gene.

In embodiments of the present invention, the nucleotide sequence of the guide sequence portion of the second RNA molecule is a different nucleotide sequence from the sequence of the guide sequence portion of the first RNA molecule.

In embodiments of the present invention, the first RNA molecule further comprise a portion having a sequence which binds to a CRISPR nuclease. In embodiments of the present invention, the second RNA molecule further comprise a portion having a sequence which binds to a CRISPR nuclease.

In an embodiment of the present invention:
a. the CRISPR nuclease has at least 100%, 99%, 98%, 97%, 96%, 95%, 94%, 93%, 92%, 91%, 90%, 85%, 80% identity to SEQ ID NO: 31123, and the sequence which binds to a CRISPR nuclease comprises a sequence selected from SEQ ID NOs: 31151 to 31160;
b. the CRISPR nuclease has at least 100%, 99%, 98%, 97%, 96%, 95%, 94%, 93%, 92%, 91%, 90%, 85%, 80% identity to SEQ ID NO: 31124, and the sequence which binds to a CRISPR nuclease comprises a sequence selected from SEQ ID NOs: 31161 to 31170;
c. the CRISPR nuclease has at least 100%, 99%, 98%, 97%, 96%, 95%, 94%, 93%, 92%, 91%, 90%, 85%, 80% identity to SEQ ID NO: 31125, and the sequence which binds to a CRISPR nuclease comprises a sequence selected from SEQ ID NOs: 31171 to 31181; or
d. the CRISPR nuclease has at least 100%, 99%, 98%, 97%, 96%, 95%, 94%, 93%, 92%, 91%, 90%, 85%, 80% identity to SEQ ID NO: 31126, and the sequence which binds to a CRISPR nuclease comprises a sequence selected from SEQ ID NOs: 31182 to 31189 and GGAUUAUCC.

In embodiments of the present invention, the sequence which binds to a CRISPR nuclease is a tracrRNA sequence.

In embodiments of the present invention, the first RNA molecule further comprises a portion having a tracr mate sequence. In embodiments of the present invention, the second RNA molecule further comprises a portion having a tracr mate sequence.

In embodiments of the present invention, the first RNA molecule further comprises one or more linker portions. In embodiments of the present invention, the second RNA molecule further comprises one or more linker portions.

In embodiments of the present invention, the first RNA molecule is up to 300 nucleotides in length. In embodiments of the present invention, the second RNA molecule is up to 300 nucleotides in length.

In embodiments of the present invention, the composition further comprises one or more CRISPR nucleases or sequences encoding the one or more CRISPR nucleases. In embodiments of the present invention, the composition further comprises one or more tracrRNA molecules or sequences encoding the one or more tracrRNA molecules.

Embodiments of the present invention provide a method for inactivating in a cell a mutant ELANE allele, the method comprising delivering to the cell the RNA molecules or compositions of the present invention.

In embodiments of the present invention, the one or more CRISPR nuclease or sequences encoding the one or more CRISPR nucleases and the RNA molecule or RNA molecules are delivered to the subject and/or cells substantially at the same time or at different times.

In embodiments of the present invention, the tracrRNA molecules or sequences encoding the one or more tracrRNA molecules and the RNA molecule or RNA molecules are delivered to the subject and/or cells substantially at the same time or at different times.

In embodiments of the present invention, the method comprises removing an exon containing a disease-causing mutation from a mutant allele, wherein the first RNA molecule or the first and the second RNA molecules target regions flanking an entire exon or a portion of the exon.

In embodiments of the present invention, the method comprises removing multiple exons, the entire open reading frame of a gene, or removing the entire gene.

In embodiments of the present invention, the first RNA molecule or the first and the second RNA molecules target an alternative splicing signal sequence between an exon and an intron of a mutant allele.

In embodiments of the present invention, the second RNA molecule targets a sequence present in both a mutant allele and a functional allele.

In embodiments of the present invention, the second RNA molecule targets an intron.

In embodiments of the present invention, the method results in subjecting the mutant allele to insertion or deletion by an error prone non-homologous end joining (NHEJ) mechanism, generating a frameshift in the mutant allele's sequence.

In embodiments of the present invention, the frameshift results in inactivation or knockout of the mutant allele.

In embodiments of the present invention, the frameshift creates an early stop codon in the mutant allele or the frameshift results in nonsense-mediated mRNA decay of the transcript of the mutant allele.

In embodiments of the present invention, inactivating or treating results in a truncated protein encoded by the mutant allele and a functional protein encoded by the functional allele.

Embodiments of the present invention provide use of the RNA molecules, the compositions, or the composition prepared by the method of the present invention for inactivating in a cell a mutant ELANE allele.

Embodiments of the present invention provide a medicament comprising the RNA molecules, compositions, or the compositions prepared by the methods of the instant invention for use in inactivating in a cell a mutant ELANE allele, wherein the medicament is administered by delivering to the cell the RNA molecules, compositions, or the compositions prepared by the methods of the instant invention.

Embodiments of the present invention provide for use of the methods, the modified cells, the compositions, or the compositions prepared by the methods, or the RNA molecules of the instant invention for treating ameliorating or preventing SCN or CyN in to a subject having or at risk of having SCN or CyN.

Embodiments of the present invention provide for a medicament comprising the RNA molecules, compositions, compositions prepared by the methods of the instant invention, or the modified cells of the instant invention, for use in treating ameliorating or preventing SCN or CyN, wherein the medicament is administered by delivering to a subject having or at risk of having SCN or CyN the RNA molecules, compositions, compositions prepared by the methods of the instant invention, or the modified cells of the instant invention.

Embodiments of the present invention provide for a kit for inactivating a mutant ELANE allele in a cell, comprising the RNA molecules of the instant invention, a CRISPR nuclease or sequence encoding the CRISPR nuclease, and/or a tracrRNA molecule or sequence encoding the tracrRNA molecule; and instructions for delivering the RNA molecule; CRISPR nuclease or sequence encoding the CRISPR nuclease, and/or the tracrRNA or sequence encoding the tracrRNA molecule to the cell to inactivate the mutant ELANE allele in the cell.

Embodiments of the present invention provide for a kit for treating SCN or CyN in a subject, comprising the RNA molecules of the instant invention, a CRISPR nuclease or sequence encoding the CRISPR nuclease, and/or a tracrRNA molecule or sequence encoding the tracrRNA molecule; and instructions for delivering the RNA molecule; CRISPR nuclease or sequence encoding the CRISPR nuclease, and/or the tracrRNA or sequence encoding the tracrRNA molecule to a subject having or at risk of having SCN or CyN so as to treat the SCN or CyN.

Embodiments of the present invention provide for a kit for inactivating a mutant ELANE allele in a cell, comprising the compositions, the composition prepared by the methods of the instant invention, or the modified cells of the instant invention, and instructions for delivering the composition to the cell so as to inactivate the ELANE gene in the cell.

Embodiments of the present invention provide for a kit for treating SCN or CyN in a subject, comprising the composition, the compositions prepared by the methods of the instant invention, or the modified cells of the instant invention, and instructions for delivering the compositions, the compositions prepared by the methods of the instant invention, or the modified cells of the instant invention, to a subject having or at risk of having SCN or CyN so as to treat SCN or CyN.

Definitions

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The "guide sequence portion" of an RNA molecule refers to a nucleotide sequence that is capable of hybridizing to a specific target DNA sequence, e.g., the guide sequence portion has a nucleotide sequence which is fully complementary to the DNA sequence being targeted along the length of the guide sequence portion. In some embodiments, the guide sequence portion is 17, 18, 19, 20, 21, 22, 23, 24, 25, 26, 27, 28, 29, or 30 nucleotides in length, or approximately 17-30, 17-29, 17-28, 17-27, 17-26, 17-25, 17-24, 18-22, 19-22, 18-20, 17-20, or 17-22 nucleotides in length. The entire length of the guide sequence portion is fully complementary to the DNA sequence being targeted along the length of the guide sequence portion. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

The term "targets" as used herein, refers to the guide sequence portion of the RNA molecule's preferential hybridization to a nucleic acid having a targeted nucleotide sequence. It is understood that the term "targets" encompasses variable hybridization efficiencies, such that there is preferential targeting of the nucleic acid having the targeted nucleotide sequence, but unintentional off-target hybridization in addition to on-target hybridization might also occur. It is understood that where an RNA molecule targets a sequence, a complex of the RNA molecule and a CRISPR nuclease molecule targets the sequence for nuclease activity.

As used herein, the term "targeting sequence" or "targeting molecule" refers a nucleotide sequence or molecule comprising a nucleotide sequence that is capable of hybridizing to a specific target sequence, e.g., the targeting sequence has a nucleotide sequence which is at least partially complementary to the sequence being targeted along the length of the targeting sequence. The targeting sequence or targeting molecule may be part of an RNA molecule that can form a complex with a CRISPR nuclease with the targeting sequence serving as the targeting portion of the CRISPR complex. When the molecule having the targeting sequence is present contemporaneously with the CRISPR molecule the RNA molecule is capable of targeting the CRISPR nuclease to the specific target sequence.

In the context targeting a DNA sequence that is present in a plurality of cells, it is understood that the targeting encompasses hybridization of the guide sequence portion of the RNA molecule with the sequence in one or more of the cells, and also encompasses hybridization of the RNA molecule with the target sequence in fewer than all of the cells in the plurality of cells. Accordingly, it is understood that where an RNA molecule targets a sequence in a plurality of cells, a complex of the RNA molecule and a CRISPR nuclease is understood to hybridize with the target sequence in one or more of the cells, and also may hybridize with the target sequence in fewer than all of the cells. Accordingly, it is understood that the complex of the RNA molecule and the CRISPR nuclease introduces a double strand break in relation to hybridization with the target sequence in one or more cells and may also introduce a double strand break in relation to hybridization with the target sequence in fewer than all of the cells. As used herein, the term "modified cells" refers to cells in which a double strand break is effected by a complex of an RNA molecule and the CRISPR nuclease as a result of hybridization with the target sequence, i.e. on-target hybridization.

The term "non-discriminatory" as used herein refers to a guide sequence portion of an RNA molecule that targets a specific DNA sequence that is common both a mutant and functional allele of a gene.

In embodiments of the present invention, RNA guide molecule may target the ELANE mutant allele based on the mutation associated with severe congenital neutropenia (SCN) or cyclic neutropenia (CyN).

In embodiments of the present invention, an RNA molecule comprises a guide sequence portion having 17-30 contiguous nucleotides containing nucleotides in the sequence set forth in any one of SEQ ID NOs: 1-31117.

It is understood that in any of the embodiments of the present invention the guide sequence portion of an RNA molecule may comprise 17-22 contiguous nucleotides set forth in any single sequence of SEQ ID NOs: 1-31117, or in any single sequence from the above groups of sequences.

The RNA molecule and or the guide sequence portion of the RNA molecule may contain modified nucleotides. Exemplary modifications to nucleotides or polynucleotides may be synthetic and encompass polynucleotides which contain nucleotides comprising bases other than the naturally occurring adenine, cytosine, thymine, uracil, or guanine bases. Modifications to polynucleotides include polynucleotides which contain synthetic, non-naturally occurring nucleosides e.g., locked nucleic acids. Modifications to polynucleotides may be utilized to increase or decrease stability of an RNA. An example of a modified polynucleotide is an mRNA containing 1-methyl pseudouridine. For examples of modified polynucleotides and their uses, see U.S. Pat. No. 8,278,036, PCT International Publication No. WO/2015/006747, and Weissman and Kariko (2015), hereby incorporated by reference.

As used herein, "contiguous nucleotides" set forth in a SEQ ID NO refers to nucleotides in a sequence of nucleotides in the order set forth in the SEQ ID NO without any intervening nucleotides.

In embodiments of the present invention, the guide sequence portion may be 20 nucleotides in length and consists of 20 nucleotides in the sequences set forth in any one of SEQ ID NOs: 1-31117. In embodiments of the present invention, the guide sequence portion may be less than 20 nucleotides in length. For example, in embodiments of the present invention the guide sequence portion may be 17, 18, or 19 nucleotides in length. In such embodiments the guide sequence portion may consist of 17, 18, or 19 nucleotides, respectively, in the sequences set forth in any one of SEQ ID NOs: 1-31117. For example, a guide sequence portion having 17 nucleotides in the sequence of 17 contiguous nucleotides set forth in SEQ ID NO: 31118 may consist of any one of the following nucleotide sequences (nucleotides excluded from the contiguous sequence are marked in strike-through):

```
                                    (SEQ ID NO: 31118)
        AAAAAAACCAGACGCCGGCC 17 nucleotide guide sequence 1:
                                    (SEQ ID NO: 31119)
        A̶A̶A̶AAAACCAGACGCCGGCC 17 nucleotide guide sequence 2:
                                    (SEQ ID NO: 31120)
        A̶A̶AAAAACCAGACGCCGGC̶C̶

17 nucleotide guide sequence 3:
                                    (SEQ ID NO: 31121)
        A̶AAAAAACCAGACGCCGG̶C̶C̶

17 nucleotide guide sequence 4:
                                    (SEQ ID NO: 31122)
        AAAAAAACCAGACGCCG̶G̶C̶C̶
```

In embodiments of the present invention, the guide sequence portion may be greater than 22 nucleotides in length. For example, in embodiments of the present invention the guide sequence portion may be 23, 24, 25, 26, 27, 28, 29, or 30 nucleotides in length. In such embodiments the guide sequence portion comprises 20, 21, or 22 nucleotides in the sequences set forth in any one of SEQ ID NOs: 1-31117 and additional nucleotides fully complimentary to a nucleotide or sequence of nucleotides adjacent to the 3' end of the target sequence, 5' end of the target sequence, or both.

In embodiments of the present invention, a CRISPR nuclease and an RNA molecule comprising a guide sequence portion form a CRISPR complex that binds to a target DNA sequence to effect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek (2012) Science). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via base pairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See U.S. Pat. No. 8,906, 616). In embodiments of the present invention, the RNA molecule may further comprise a portion having a tracr mate sequence.

According to embodiments of the present invention, an RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Eukaryotic" cells include, but are not limited to, fungal cells (such as yeast), plant cells, animal cells, mammalian cells and human cells.

As used herein, the term HSPC refers to both hematopoietic stem cells and hematopoietic stem progenitor cells. Non-limiting examples of stem cells include a bone marrow cell, a myeloid progenitor cell, a multipotent progenitor cell, a lineage restricted progenitor cell.

As used herein, "progenitor cell" refers to a lineage cell that is derived from stem cell and retains mitotic capacity and multipotency (e.g., can differentiate or develop into more than one but not all types of mature lineage of cell). As used herein "hematopoiesis" or "hemopoiesis" refers to the formation and development of various types of blood cells (e.g., red blood cells, megakaryocytes, myeloid cells (e.g., monocytes, macrophages and neutrophil), and lymphocytes) and other formed elements in the body (e.g., in the bone marrow).

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

According to embodiments of the present invention, the first RNA molecule or the first and the second RNA molecules targets at least a portion of the promoter and/or the start codon and/or a portion of the UTR of the mutant allele of the ELANE gene.

According to embodiments of the present invention, there is provided a method comprising removing an exon containing a disease-causing mutation from a mutant allele, wherein the first RNA molecule or the first and the second RNA molecules target regions flanking an entire exon or a portion of the exon.

According to embodiments of the present invention, there is provided a method comprising removing multiple exons, the entire open reading frame of a gene, or removing the entire gene.

According to embodiments of the present invention, the first RNA molecule targets a mutant allele of the ELANE gene, and the second RNA molecule targets a sequence in an intron present in both the mutant and functional allele of the ELANE gene.

According to embodiments of the present invention, the second RNA molecule targets a sequence present in both a mutant allele and a functional allele of the ELANE gene.

According to embodiments of the present invention, the second RNA molecule targets an intron.

According to embodiments of the present invention, there is provided a method comprising subjecting the mutant allele to insertion or deletion by an error prone non-homologous end joining (NHEJ) mechanism, generating a frameshift in the mutant allele's sequence.

According to embodiments of the present invention, the frameshift results in inactivation or knockout of the mutant allele.

According to embodiments of the present invention, the frameshift creates an early stop codon in the mutant allele.

According to embodiments of the present invention, the frameshift results in nonsense-mediated mRNA decay of the transcript of the mutant allele.

According to embodiments of the present invention, the inactivating or treating results in a truncated protein encoded by the mutant allele and a functional protein encoded by the functional allele.

The compositions and methods of the present disclosure may be utilized for treating, preventing, ameliorating, or slowing progression of SCN or CyN.

In some embodiments, the method of deactivating a mutant allele comprises an exon skipping step comprising removing an exon containing a disease-causing mutation from the mutant allele. Removing an exon containing a disease-causing mutation in the mutant allele requires two RNA molecules which target regions flanking the entire exon or a portion of the exon. Removal of an exon containing the disease-causing mutation may be designed to eliminate the disease-causing action of the protein while allowing for expression of the remaining protein product which retains some or all of the wild-type activity. As an alternative to single exon skipping, multiple exons, the entire open reading frame or the entire gene can be excised using two RNA molecules flanking the region desired to be excised.

In some embodiments, the method of deactivating a mutant allele comprises delivering two RNA molecules to a cell, wherein one RNA molecule targets a first mutant allele of an ELANE gene and wherein the other RNA molecule targets a second mutant allele of the ELANE gene, or the second RNA molecule targets a sequence in an intron present in both the mutant or functional allele.

In some embodiments, an RNA molecule is used to target a CRISPR nuclease to an alternative splicing signal sequence between an exon and an intron of a mutant allele, thereby destroying the alternative splicing signal sequence in the mutant allele.

Any one of, or combination of, the above-mentioned strategies for deactivating a mutant allele may be used in the context of the invention.

Additional strategies may be used to deactivate a mutant allele. For example, in embodiments of the present invention, an RNA molecule is used to direct a CRISPR nuclease to an exon or a splice site of a mutant allele in order to create a double-stranded break (DSB), leading to insertion or deletion of nucleotides by an error-prone non-homologous end-joining (NHEJ) mechanism and formation of a frameshift mutation in the mutant allele. The frameshift mutation may result in: (1) inactivation or knockout of the mutant allele by generation of an early stop codon in the mutant allele, resulting in generation of a truncated protein; or (2) nonsense mediated mRNA decay of the transcript of the mutant allele. In further embodiments, one RNA molecule is used to direct a CRISPR nuclease to a promotor of a mutant allele.

In some embodiments, the method of deactivating a mutant allele further comprises enhancing activity of the functional protein such as by providing a protein/peptide, a nucleic acid encoding a protein/peptide, or a small molecule such as a chemical compound, capable of activating/enhancing activity of the functional protein.

According to some embodiments, the present disclosure provides an RNA molecule which binds to/associates with and/or directs the RNA guided DNA nuclease e.g., CRISPR nuclease to a mutant of the ELANE gene.

In some embodiments, the method comprises the steps of: contacting a mutant allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutant allele of the gene of interest which differs by at least one nucleotide from a nucleotide sequence of a functional allele of the gene of interest, thereby modifying or knocking-out the mutant allele.

In some embodiments, the allele-specific RNA molecule and a CRISPR nuclease is introduced to a cell encoding the gene of interest. In some embodiments, the cell encoding the gene of interest is in a mammalian subject. In some embodiments, the cell encoding the gene of interest is in a plant.

In some embodiments, the cleaved mutant allele is further subjected to insertion or deletion (indel) by an error prone non-homologous end joining (NHEJ) mechanism, generating a frameshift in the mutant allele's sequence. In some embodiments, the generated frameshift results in inactivation or knockout of the mutant allele. In some embodiments, the generated frameshift creates an early stop codon in the mutant allele and results in generation of a truncated protein. In such embodiments, the method results in the generation of a truncated protein encoded by the mutant allele and a functional protein encoded by the functional allele. In some embodiments, a frameshift generated in a mutant allele using the methods of the invention results in nonsense-mediated mRNA decay of the transcript of the mutant allele.

A skilled artisan will appreciate that in each of the embodiments of the present invention, individually, each of the RNA molecules of the present invention are capable of complexing with a nuclease, e.g. a CRISPR nuclease, such as to associate with a target genomic DNA sequence of interest next to a protospacer adjacent motif (PAM). The nuclease then mediates cleavage of target DNA to create a double-stranded break within the protospacer. Accordingly, in embodiments of the present invention, the guide sequences and RNA molecules of the present invention may target a location 1, 2, 3, 4, 5, 6, 7, 8, 9, 10, 11, 12, 13, 14, 15, 16, 17, 18, 19, 20, 21, 22, 23, 24, 25, 26, 27, or 28 nucleotides upstream or downstream from a PAM site.

Therefore, in embodiments of the present invention, an RNA molecule of the present invention in complex with a nuclease, e.g., a CRISPR nuclease, may affect a double strand break in an allele of a gene 1, 2, 3, 4, 5, 6, 7, 8, 9, 10, 11, 12, 13, 14, 15, 16, 17, 18, 19, 20, 21, 22, 23, 24, 25, 26, 27, 28 upstream or downstream from a target site.

Where the target site (e.g. a pathogenic mutation) is within the PAM site, it is understood that the RNA molecule may be designed to target a sequence 1, 2, 3, 4, 5, 6, 7, 8, 9, 10, 11, 12, 13, 14, 15, 16, 17, 18, 19, 20, 21, 22, 23, 24, 25, 26, 27, or 28 nucleotides upstream or downstream from the PAM site. Accordingly, an RNA molecule is designed to target a nuclease, e.g. a CRISPR nuclease, only to an allele containing the pathogenic mutation.

In embodiments of the present invention, an RNA molecule is designed to target a mutant allele in the ELANE gene, wherein the RNA molecule and/or the complex of the RNA molecule and a CRISPR nuclease targets the nucleotide base present in the mutant allele of the ELANE gene In embodiments of the present invention, the RNA molecules, compositions, methods, cells, kits, or medicaments are utilized for treating a subject having a disease phenotype resulting from the heterozygote ELANE gene. In embodiments of the present invention, the disease is SCN or CyN. In such embodiments, the method results in improvement, amelioration or prevention of the disease phenotype.

In embodiments of the present invention, the RNA molecules, compositions, methods, cells, kits, or medicaments of the present invention are utilized in combination with a second therapy for SCN or CyN to treat the subject. In embodiments of the present invention, the RNA molecules, compositions, methods, kits, or medicaments of the present invention are administered prior to administration of the second therapy, during administration of the second therapy, and/or after administration of the second therapy.

In embodiments of the present invention, the RNA molecules, compositions, methods, cells, kits, or medicaments of the present invention are administered in combination with Granulocyte colony-stimulating factor (G-CSF) therapy.

Embodiments referred to above refer to a CRISPR nuclease, RNA molecule(s), and tracrRNA being effective in a subject or cells at the same time. The CRISPR, RNA molecule(s), and tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

According to embodiments of the present invention, there is provided a method for inactivating in a cell a mutant allele of the ELANE gene, the method comprising the steps of:
  a) selecting a cell with an ELANE gene mutation associated with SCN or CyN wherein the ELANE gene mutation is selected from the group consisting of the ELANE mutants set forth in Table 1;
  b) introducing to the cell a composition comprising:
    a CRISPR nuclease or sequence encoding the CRISPR nuclease, and
    a first RNA molecule comprising a guide sequence portion having 17-30 nucleotides,
  wherein a complex of the CRISPR nuclease and the first RNA molecule affects a double strand break in the mutant allele of the ELANE gene and not in the functional allele of the ELANE gene in the cell;
  thereby inactivating the mutant allele of the ELANE gene in the cell.

According to embodiments of the present invention, there is provided a method for inactivating in a cell a mutant allele of the ELANE gene, the method comprising the steps of:
  a) selecting a cell with an ELANE gene mutation associated with SCN or CyN wherein the ELANE gene mutation is selected from the group consisting of the ELANE mutants set forth in Table 1;
  b) introducing to the cell a composition comprising:
    a CRISPR nuclease or sequence encoding the CRISPR nuclease, and
    a first RNA molecule comprising a guide sequence portion having 17-30 nucleotides,
  wherein a complex of the CRISPR nuclease and the first RNA molecule affects a double strand break in the mutant allele of the ELANE gene and not in the functional allele of the ELANE gene in the cell;
  and wherein the method further comprises introduction of a second RNA molecule comprising a guide sequence portion capable of complexing with a CRISPR nuclease, wherein the complex of the second RNA molecule and the CRISPR nuclease affects a second double strand break in the ELANE gene;
thereby inactivating the mutant allele of the ELANE gene in the cell.

According to embodiments of the present invention, there is provided a method for inactivating in a cell a mutant allele of the ELANE gene having a mutation associated with SCN or CyN wherein the mutant allele is selected from the group consisting of the ELANE mutants set forth in Table 1, the method comprising
  introducing to the cell a composition comprising:
    a CRISPR nuclease or sequence encoding the CRISPR nuclease, and
    a first RNA molecule comprising a guide sequence portion having 17-30 nucleotides,
  wherein a complex of the CRISPR nuclease and the first RNA molecule affects a double strand break in the mutant allele of the ELANE gene;
  thereby inactivating the mutant allele of the ELANE gene in the cell.

According to embodiments of the present invention, there is provided a method for inactivating in a cell a mutant allele of the ELANE gene associated with SCN or CyN wherein the mutant allele is selected from the group consisting of the ELANE mutants set forth in Table 1, the method comprising:
  introducing to the cell a composition comprising:
    a CRISPR nuclease or sequence encoding the CRISPR nuclease, and
    a first RNA molecule comprising a guide sequence portion having 17-30 nucleotides,
  wherein a complex of the CRISPR nuclease and the first RNA molecule affects a double strand break in the mutant allele of the ELANE gene;
  and wherein the method further comprises introduction of a second RNA molecule comprising a guide sequence portion capable of complexing with a CRISPR nuclease, wherein the complex of the second RNA molecule and CRISPR nuclease affects a second double strand break in the ELANE gene;
  thereby inactivating the mutant allele of the ELANE gene in the cell.

In embodiments of the present invention, a complex of the CRISPR nuclease and the first RNA molecule affects a double strand break in the mutant allele of the ELANE gene and not in the functional allele of the ELANE gene in the cell.

In embodiments of the present invention, the cell comprises a second mutant allele selected from the group consisting of the ELANE mutants set forth in Table 1.

In embodiments of the present invention, a cell with an ELANE gene mutation associated with SCN or CyN may be from a subject with the ELANE gene mutation and/or afflicted with SCN or CyN. Accordingly, selecting a cell with an ELANE gene mutation may comprise selecting a subject with the ELANE gene mutation. In further embodiments of the present invention, selecting a cell may comprise selecting a cell from a subject with the ELANE gene mutation. In embodiments of the present invention, introducing the compositions of the subject invention to the cell may comprise introducing the compositions of the invention to the cell of a subject afflicted with the ELANE gene mutation.

Accordingly, in embodiments of the present invention, there is provided a method for inactivating in a cell a mutant allele of the ELANE gene of a subject, the method comprising the step of selecting a subject with an ELANE gene mutation resulting in SCN or CyN wherein the ELANE gene mutation is selected from the group consisting of the ELANE mutants set forth in Table 1.

Accordingly, embodiments of the present invention encompass the screening of subjects or cells for the ELANE gene. A person having ordinary skill in the art would readily understand methods of screening for mutations within the ELANE gene in the art, by way of non-limiting examples, e.g., sequencing-by-synthesis, Sanger sequencing, karyotyping, Fluorescence In situ Hybridization, and/or microarray testing. In embodiments of the present invention, mutations within the ELANE gene are screened by exon sequencing.

In embodiments of the present invention, the subject is or has been diagnosed with SCN or CyN by measuring the absolute neutrophil count (ANC) in peripheral blood. In embodiments of the present invention, SCN is or was diagnosed before the subject reaches the age 6 months. In embodiments of the present invention, CyN is or was diagnosed between the ages of 12 and 24 months, or after the age of 24 months. In embodiments of the present invention, SCN or Cyn is diagnosed by one or more of recurrent acute stomatologic disorders. In embodiments of the present invention, SCN or CyN is diagnosed by bone marrow examination, preferably the bone marrow examination is a cytogenetic bone marrow study. In embodiments of the present invention, SCN or CyN is diagnosed by one or more of: antineutrophil antibody assay, immunoglobulin assay (Ig GAM), lymphocyte immunophenotyping, pancreatic markers (serum trypsinogen and fecal elastase) and liposoluble vitamin levels (vitamins A, E and D). It is understood that any diagnostic method may be used with any other diagnostic method.

In embodiments of the present invention, a subject diagnosed with SCN or CyN is screened by Exon sequencing to identify an ELANE pathogenic mutation in the ELANE gene. In further embodiments the subject is screened by Sanger sequencing to confirm heterozygocity of at least one of the ELANE gene mutations selected from the group consisting of the ELANE mutants set forth in Table 1. In embodiments of the present invention, the nucleotide of the mutant allele of the ELANE gene is determined using BAC bio. In embodiments of the present invention, appropriate guides are selected according to Tables 2A-2C. In embodiments of the present invention, the guides selected are introduced to cells, e.g. PBMCs, obtained from the subject and reduction in the pathogenic ELANE mutation in the cells is measured by, e.g. Next Generation Sequencing.

It is understood that the CRISPR/Cas9 gene editing system enables targeting the nuclease to a target site in a sequence specific manner to address disease-causing mutations. Hematopoietic stem and progenitor cells (HSPCs) have therapeutic potential because of their ability to both self-renew and differentiate (Yu, Natanson, and Dunbar 2016). Accordingly, embodiments of the present invention apply genome editing to HSPCs.

In embodiments of the present invention, an autologous therapy and utilizes autologous CD34+ hematopoietic stem cells from patients diagnosed with SCN or CyN which are edited with CRISPR/Cas9. In embodiments of the present invention, CD34+ cells are isolated from bone marrow or peripheral blood mononucleated cells (PBMCs) following patient apheresis.

In the case of dominant negative (or compound heterozygous) indications, such as SCN or CyN, the strategy is to edit the mutant allele and avoid cleavage in the non-mutant allele or other off targets by targeting the mutant allele sequence.

Embodiments of the present invention may include the following steps:

- selection of a patient diagnosed with SCN or CyN identified as having a mutant allele of the ELANE gene selected from the group consisting of the ELANE mutants set forth in Table 1;
- selection of a therapeutic strategy based on the identified mutant allele of the candidate patient;
- obtaining HSPC cells from the bone marrow of the subject either by aspiration or by mobilization and apheresis of peripheral blood, optionally, the HSPC cells are processed (e.g., enriched, stimulated, both);
- introducing into the HSPC cells (e.g., by ex vivo electroporation) a composition comprising:
  - a CRISPR nuclease or a sequence encoding the same (e.g., mRNA),
  - a discriminatory RNA molecule that targets the mutant allele, and
  - a non-discriminatory RNA molecule targeting a sequence in intron 3, intron 4 or 3' UTR, which is common to both the mutant allele and the other allele,
  - thereby editing the HSPC cells to knockout expression of mutant ELANE allele; and
- introducing the edited HSPC to the candidate patient.

In embodiments of the present invention, CD34+ cells may be isolated from bone marrow or peripheral blood mononucleated cells (PBMCs) following patient apheresis. Bone marrow or PBMCs may be collected from the patient by apheresis following HSPC mobilization. In embodiments of the invention the apheresis product may be washed to remove platelets and a CD34+ cell population may be enriched via purification using, e.g. a CliniMACS system (Miltenyi Biotec). In embodiments of the present invention, the selected cells may be prestimulated ex vivo, e.g. with a mixture of recombinant human cytokines. In embodiments of the present invention, the cells may undergo electroporation. In embodiments of the present invention, prior to electroporation, stimulated cells (e.g. CD34+ cells), the CRISPR nuclease mRNA and gRNA may be preincubated under defined conditions. In embodiments of the present invention, the cells are electroporated ex vivo with the CRISPR nuclease mRNA/gRNA mixture or with a preassembled RNPs (Ribonuclease protein of the CRISPR nuclease protein and gRNA), followed by cell washing. In embodiments of the present invention, the cells are suspended into a final formulation. In embodiments of the present invention, the cells may be resuspended. In embodiments of the present invention, the resuspended cells may be filled into bags for infusion. In embodiments of the present invention, the bags may be frozen using a freeze down step in a controlled rate freezer and/or stored in the vapor phase of liquid nitrogen. In embodiments of the present invention, the product may be administered by intravenous (IV) administration to a patient.

Dominant Genetic Disorders

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of dominant genetic disorders such as, for example, SCN or CyN. In some embodiments, the dominant genetic disorder is SCN or CyN. In some embodiments, the target gene is the ELANE gene.

CRISPR Nucleases and PAM Recognition

In some embodiments, the sequence specific nuclease is selected from CRISPR nucleases, or a functional variant thereof. In some embodiments, the sequence specific nuclease is an RNA guided DNA nuclease. In such embodiments, the RNA sequence which guides the RNA guided DNA nuclease (e.g., Cpf1) binds to and/or directs the RNA guided DNA nuclease to the sequence comprising at least one nucleotide which differs between a mutant allele and its counterpart functional allele (e.g., to a pathogenic mutation). In some embodiments, the CRISPR complex does not further comprise a tracrRNA. In a non-limiting example, in which the RNA guided DNA nuclease is a CRISPR protein, the at least one nucleotide which differs between the dominant mutant allele and the functional allele may be within the PAM site and/or proximal to the PAM site within the region that the RNA molecule is designed to hybridize to. A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the protospacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for *Streptococcus pyogenes* Cas9 WT (Sp-CAS9); NNGRRT for *Staphylococcus aureus* (SaCas9); NNNVRYM for *Jejuni* Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

In some embodiments, an RNA-guided DNA nuclease e.g., a CRISPR nuclease, may be used to cause a DNA break at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015-0211023, incorporated herein by reference.

CRISPR systems that may be used in the practice of the invention vary greatly. CRISPR systems can be a type I, a type II, type III, or type V system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Cas12a, Cas12b, Cas12c, Cas12d, Cas12d, Cas1 Od, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csz1, Csx15, Csf1, Csf2, Csf3, Csf4, and Cu1966. (See, e.g., Koonin 2017).

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangiurn roseurn, Streptosporangiurn roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis aeruginosa, Synechococcus* sp., *Acetohalobiurn arabaticum, Ammonifex degensii, Caldicelulosiruptor becscii, Candidatus Desulforudis, Clostridium botulinum, Clostridium Finegoldia magna, Natranaerobius thermophilus, Pelotomaculum thermopropionicum, Acidithiobacillus caldus, Acidithiobacillus ferrooxidans, Allochromatiurn vinosurn, Marinobacter* sp., *Nitrosococcus halophilus, Nitrosococcus watsoni, Pseudoalteromonas haloplanktis, Ktedonobacter racemifer, Methanohalobiurn evestigatum, Anabaena variabilis, Nodularia spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina, Francisella* cf *novicida* Fx1, *Alicyclobacillus acidoterrestris, Oleiphilus* sp., *Bacterium* CG09_39_24, *Deltaproteobacteria bacterium*, or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., SpCas9 D1135E variant, SpCas9 VQR variant, SpCas9 EQR variant, or SpCas9 VRER variant may also be used in the context of the invention.

In embodiments of the present invention, the CRISPR nuclease has cleavage activity when used with an RNA molecule comprising a guide sequence portion having 21-23, or 21-22 nucleotides and may be derived from any of the species recited above. A specific example of a CRISPR nuclease which has cleavage activity when used with an RNA molecule comprising a guide sequence portion having 21 nucleotides is described in Mojica, F. J., et al. (1993). A specific example of a CRISPR nuclease which has cleavage activity when used with an RNA molecule comprising a guide sequence portion having 22 nucleotides is described in Kim, E. et al. (2017). Mojica, F. J., et al. (1993) and Kim, E. et al. (2017) in their entirety and/or for the specific description CRISPR nucleases, are incorporated herein by reference. In such embodiments, the CRISPR nuclease may be engineered and/or non-naturally occurring.

In embodiments of the present invention, the CRISPR nuclease has greater cleavage activity when used with an RNA molecule comprising a guide sequence portion having 21-23 nucleotides, compared to its cleavage activity when used with an RNA molecule comprising a guide sequence portion having 20 or fewer nucleotides, and/or 24 or more nucleotides. In embodiments of the present invention, the CRISPR nuclease has greater cleavage activity when used with an RNA molecule comprising a guide sequence portion having 21-22 nucleotides, compared to its cleavage activity when used with an RNA molecule comprising a guide sequence portion having 20 or fewer nucleotides, and/or 23 or more nucleotides. In an embodiment, the CRISPR nuclease has its greatest cleavage activity when used with an RNA molecule comprising a guide sequence portion having 22 nucleotides.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from *Acidaminococcus* and Lachnospiraceae have been shown to carry out efficient genome-editing activity in human cells. (See Zetsche et al. (2015) Cell).

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to one or more of: modified bases, modified sugar moieties, or modified inter-nucleoside linkages. Non-limiting examples of suitable chemical modifications include: 4-acetylcytidine, 5-(carboxyhydroxymethyl)uridine. 2'-O-methylcytidine. 5-carboxymethylaminomethyl-2-thiouridine. 5-carboxymethylaminomethyluridine, dihydrouridine, 2'-O-methylpseudouridine, "beta, D-galactosylqueuosine", 2'-O-methylguanosine, inosine, N6-isopentenyladenosine, 1-methyladenosine, 1-methylpseudouridine, 1-methylguanosine. 1-methylinosine, "2,2-dimethvlguanosine", 2-methyladenosine, 2-methylguanosine, 3-methylcytidine, 5-methylcytidine, N6-methyladenosine, 7-methylguanosine, 5-methylaminomethyluridine, 5-methoxyaminomethyl-2-thiouridine, "beta. D-mannosylqueuosine", 5-methoxycarbonylmethyl-2-thiouridine, 5-methoxycarbonylmethyluridine, 5-methoxyuridine, 2-methylthio-N6-isopentenyladenosine, N-((9-beta-D-ribofuranosyl-2-methylthiopurine-6-yl)carbamoyl)threonine, N-((9-beta-D-ribofuranosylpurine-6-yl)N-methylcarbamoyl)threonine, uridine-5-oxyacetic acid-methylester, uridine-5-oxyacetic acid, wybutoxosine, queuosine, 2-thiocytidine, 5-methyl-2-thiouridine, 2-thiouridine, 4-thiouridine. 5-methyluridine, N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3)u", 2'-O-methyl (M), 3'-phosphorothioate (MS), 3'-thioPACE (MSP), pseudouridine, or 1-methyl pseudo-uridine. Each possibility represents a separate embodiment of the present invention.

Further non-limiting examples of suitable chemical modifications include: $m^1A$ (1-methyladenosine); $m^2A$ (2-methyladenosine); Am (2'-O-methyladenosine); $ms^2$ $m^6A$ (2-methylthio-$N^6$-methyladenosine); $i^6A$ ($N^6$-isopentenyladenosine); $ms^2i6A$ (2-methylthio-$N^6$isopentenyladenosine); $io^6A$ ($N^6$-(cis-hydroxyisopentenyl)adenosine); $ms^2io^6A$ (2-methylthio-$N^6$-(cis-hydroxyisopentenyl) adenosine); $g^6A$ ($N^6$-glycinylcarbamoyladenosine); $t^6A$ ($N^6$-threonylcarbamoyladenosine); $ms^2t^6A$ (2-methylthio-$N^6$-threonyl carbamoyladenosine); $m^6t^6A$ ($N^6$-methyl-$N^6$-threonylcarbamoyladenosine); $hn^6A$($N^6$-hydroxynorvalylcarbamoyladenosine); $ms^2hn^6A$ (2-methylthio-$N^6$-hydroxynorvalyl carbamoyladenosine); Ar(p) (2'-O-ribosyladenosine (phosphate)); I (inosine); $m^1I$ (1-methylinosine); $m^1Im$ (1,2'-O-dimethylinosine); $m^3C$ (3-methylcytidine); Cm (2'-O-methylcytidine); $s^2C$ (2-thiocytidine); $ac^4C$ ($N^4$-acetylcytidine); $f^5C$ (5-formylcytidine); $m^5Cm$ (5,2'-O-dimethylcytidine); $ac^4Cm$ ($N^4$-acetyl-2'-O-methylcytidine); $k^2C$ (lysidine); $m^1G$ (1-methylguanosine); $m^2G$ ($N^2$-methylguanosine); $m^7G$ (7-methylguanosine); Gm (2'-O-methylguanosine); $m^2$ 2 G ($N^2,N^2$-dimethylguanosine); $m^2Gm$ ($N^{2,}$ 2'-O-dimethylguanosine); $m^2$ $_2$ Gm ($N^2,N^2$, 2'-O-trimethylguanosine); Gr(p) (2'-O-ribosylguanosine (phosphate)); yW (wybutosine); o2yW (peroxywybutosine); OHyW (hydroxywybutosine); OHyW* (undermodified hydroxywybutosine); imG (wyosine); mimG (methylwyosine); Q (queuosine); oQ (epoxyqueuosine); galQ (galactosyl-queuosine); manQ (mannosyl-queuosine); preQo (7-cyano-7-deazaguanosine); $preQ_1$ (7-aminomethyl-7-deazaguanosine); $G^+$ (archaeosine); D (dihydrouridine); $m^5Um$ (5,2'-O-dimethyluridine); $s^4U$ (4-thiouridine); $m^5s^2U$ (5-methyl-2-thiouridine); $s^2Um$ (2-thio-2'-O-methyluridine); $acp^3U$ (3-(3-amino-3-carboxypropyl)uridine); $ho^5U$ (5-hydroxyuridine); $mo^5U$ (5-methoxyuridine); $cmo^5U$ (uridine 5-oxyacetic acid); $mcmo^5U$ (uridine 5-oxyacetic acid methyl ester); $chm^5U$ (5-(carboxyhydroxymethyl)uridine)); $mchm^5U$ (5-(carboxyhydroxymethyl)uridine methyl ester); $mcm^5U$ (5-methoxycarbonylmethyluridine); $mcm^5Um$ (5-methoxycarbonylmethyl-2'-O-methyluridine); $mcm^5s^2U$ (5-methoxycarbonylmethyl-2-thiouridine); $nm^5S^2U$ (5-aminomethyl-2-thiouridine); $mnm^5U$ (5-methylaminomethyluridine); $mnm^5s^2U$ (5-methylaminomethyl-2-thiouridine); $mnm^5se^2U$ (5-methylaminomethyl-2-selenouridine); $ncm^5U$ (5-carbamoylmethyluridine); $ncm^5Um$ (5-carbamoylmethyl-2'-O-methyluridine); $cmnm^5U$ (5-carboxymethylaminomethyluridine); $cmnm^5Um$ (5-carboxymethylaminomethyl-2'-O-methyluridine); $cmmm^5s^2U$ (5-carboxymethylaminomethyl-2-thiouridine); dimethyladenosine); Im (2'-O-methylinosine); $m^4C$ ($N^4$-methylcytidine); $m^4Cm$ ($N^4$, 2'-O-dimethylcytidine); $hm^5C$ (5-hydroxymethylcytidine); $m^3U$ (3-methyluridine); $cm^5U$ (5-carboxymethyluridine); $m^6Am$ ($N^6$,2'-O-dimethyladenosine); $m^6$ 2 Am ($N^6,N^6,$O-2'-trimethyladenosine); $m^{2,7}G$ ($N^2$,7-dimethylguanosine); m2,2,7G ($N^2,N^2$,7-trimethylguanosine); $m^3Um$ (3,2'-O-dimethyluridine); $m^5D$ (5-methyldihydrouridine); $f^5Cm$ (5-formyl-2'-O-methylcytidine); $m^1Gm$ (1,2'-O-dimethylguanosine); $m^1Am$ (1,2'-O-dimethyladenosine); $\tau m^5U$ (5-taurinomethyluridine); $\tau m^5s^2U$ (5-taurinomethyl-2-thiouridine)); imG-14 (4-demethylwyosine); imG2 (isowyosine); or $ac^6A$ ($N^6$-acetyladenosine). Each possibility represents a separate embodiment of the present invention. (See e.g. U.S. Pat. No. 9,750,824).

In embodiments of the present invention, the CRISPR nuclease has greater cleavage activity when used with an RNA molecule comprising a guide sequence portion having 21-23 nucleotides, compared to its cleavage activity when used with an RNA molecule comprising a guide sequence portion having 20 or fewer nucleotides, and/or 24 or more nucleotides. In embodiments of the present invention, the CRISPR nuclease has greater cleavage activity when used with an RNA molecule comprising a guide sequence portion having 21-22 nucleotides, compared to its cleavage activity when used with an RNA molecule comprising a guide sequence portion having 20 or fewer nucleotides, and/or 23 or more nucleotides. In an embodiment, the CRISPR nuclease has its greatest cleavage activity when used with an RNA molecule comprising a guide sequence portion having 22 nucleotides.

In an embodiment, such a CRISPR nuclease has at least 95% identity to the amino acid sequence as set forth in SEQ ID NO: 31125 or the sequence encoding the CRISPR nuclease has at least a 95% sequence identity to SEQ ID NO: 31131 or SEQ ID NO: 31132. In an embodiment, such a CRISPR nuclease has at least 100%, 99%, 98%, 97%, 96%, 95%, 94%, 93%, 92%, 91%, 90%, 89%, 88%, 87%, 86%, 85%, 84%, 83%, or 82% identity to the amino acid sequence as set forth in SEQ ID NO: 31125 or the sequence encoding the CRISPR nuclease has at least a 100%, 99%, 98%, 97%, 96%, 95%, 94%, 93%, 92%, 91%, 90%, 89%, 88%, 87%, 86%, 85%, 84%, 83%, or 82% sequence identity to SEQ ID NO: 31131 or SEQ ID NO: 31132.

Guide Sequences which Specifically Target a Mutant Allele

A given gene may contain thousands of sequence variations, including variations comprising a pathogenic mutation within a mutant allele. Utilizing a 24 base pair target window for specifically targeting each known pathogenic mutation in a mutant allele would require hundreds of thousands of guide sequences. Furthermore, any given guide sequence when utilized to target a specific sequence (e.g., a target sequence containing a pathogenic mutation) may result in degradation of the guide molecule, limited or no activity, or off-target effects. Accordingly, suitable guide sequences are necessary for targeting a given mutant allele. By the present invention, a novel set of guide sequences have been identified for knocking out expression of a mutated protein, inactivating a mutant ELANE gene allele, and treating SCN or CyN.

The present disclosure provides guide sequences capable of specifically targeting a mutant allele for inactivation while leaving the functional allele unmodified. The guide sequences of the present invention are designed to, and are most likely to, specifically differentiate between a mutant allele and a functional allele. Of all possible guide sequences which target a mutant allele desired to be inactivated, the specific guide sequences disclosed herein are specifically effective to function with the disclosed embodiments.

For each gene, any one of the following strategies may be used to deactivate the mutant allele: (1) Knockout strategy using one RNA molecule—one RNA molecule is utilized to direct a CRISPR nuclease to a mutant allele and create a double-strand break (DSB) leading to formation of a frameshift mutation in an exon or in a splice site region of the mutant allele; (2) Knockout strategy using two RNA molecules—two RNA molecules are utilized. A first RNA molecule targets a region in the promoter or an upstream region of a mutant allele and another RNA molecule targets downstream of the first RNA molecule in a promoter, exon, or intron of the mutant allele; (3) Exon(s) skipping strategy—one RNA molecule may be used to target a CRISPR nuclease to a splice site region, either at the 5'end of an intron (donor sequence) or the 3' end of an intron (acceptor sequence), in order to destroy the splice site. Alternatively, two RNA molecules may be utilized such that a first RNA molecule targets an upstream region of an exon and a second RNA molecule targets a region downstream of the first RNA molecule, thereby excising the exon(s). Based on the locations of each mutant allele, any one of, or a combination of, the above-mentioned methods to deactivate the mutant allele may be utilized.

The at least one nucleotide which differs between the mutant allele and the functional allele, may be upstream, downstream or within the sequence of the disease-causing mutation of the gene of interest. The at least one nucleotide which differs between the mutant allele and the functional allele, may be within an exon or within an intron of the gene of interest. In some embodiments, the at least one nucleotide which differs between the mutant allele and the functional allele is within an exon of the gene of interest. In some embodiments, the at least one nucleotide which differs between the mutant allele and the functional allele is within an intron or an exon of the gene of interest, in close proximity to a splice site between the intron and the exon e.g., 1, 2, 3, 4, 5, 6, 7, 8, 9, 10, 11, 12, 13, 14, 15, 16, 17, 18, 19, or 20 nucleotides upstream or downstream to the splice site.

Guide sequences of the present invention may satisfy any one of the above criteria and are most likely to differentiate between a mutant allele from its corresponding functional allele.

In some embodiments the RNA molecule targets a mutant allele in the ELANE gene as shown in column 1 of Table 1 below.

Embodiments of the present invention may include excising the promoter region until intron 3 or intron 4 or the 3' UTR.

Embodiments of the present invention may include excising from intron 3 or intron 4 or 3' UTR to regions downstream to the 3' UTR.

Embodiments of the present invention excising from intron 3 or intron 4 or 3' UTR to regions downstream to the 3' UTR. The strategy is designed such as to specifically knock-out the disease-causing allele ('mutant allele'), while leaving the healthy allele intact.

Delivery to Cells

It is understood that in the methods embodied, the RNA molecules and compositions described herein may be delivered to a target cell or subject by any suitable means. The following embodiments provide non-limiting examples of methods of delivery of the RNA molecules and composition of the present invention.

In some embodiments, RNA molecule compositions of the present invention may be targeted to any cell which contains and/or expresses a dominant negative allele, including any mammalian or plant cell. For example, in one embodiment the RNA molecule specifically targets a mutant ELANE allele and the target cell is a hepatocyte cell.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Feigner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., *Agrobacterium, Rhizobium* sp. NGR234, *Sinorhizoboium meliloti, Mesorhizobium loti*, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa® Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. Nos. 5,049,386, 4,946,787; and 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186, 183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al. (1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), perC6 cells, any plant cell (differentiated or undifferentiated), as well as insect cells such as *Spodoptera fugiperda* (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+(T cells), CD45+(panB cells), GR-1 (granulocytes), and Iad (differentiated antigen presenting cells) (as a non-limiting example see Inaba et al. (1992) J. Exp. Med. 176:1693-1702). Stem cells that have been modified may also be used in some embodiments.

Typically, the cells are administered in a pharmaceutical composition comprising at least one pharmaceutically-acceptable carrier. The phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. The phrase "pharmaceutically acceptable carrier" as used herein means a pharmaceutically-acceptable material, composition or vehicle, such as a liquid or solid filler, diluent, excipient, or solvent encapsulating material.

Any one of the RNA molecule compositions described herein is suitable for genome editing in post-mitotic cells or any cell which is not actively dividing, e.g., arrested cells. Examples of post-mitotic cells which may be edited using an RNA molecule composition of the present invention include, but are not limited to, a hepatocyte cell.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via IV injection.

Vectors suitable for introduction of transgenes into immune cells (e.g., T-cells) include non-integrating lentivirus vectors. See, e.g., U.S. Patent Publication No. 2009-0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to/associates with and/or directs the RNA guided DNA nuclease to a sequence comprising at least one nucleotide which differs between a mutant allele and a functional allele (e.g., a pathogenic mutation) of a gene of interest. For example, a disease-causing or pathogenic sequence of the mutant allele may be specifically targeted since this sequence is not present in the functional allele.

The disclosed compositions and methods may also be used in the manufacture of a medicament for treating dominant genetic disorders in a patient.

Mechanisms of Action for Several Embodiments Disclosed Herein

Mutations in ELANE that were demonstrated to lead to SCN or CyN, mediate translation from alternative in frame ORF (open reading frame) that generate truncated N-terminus protein thus causing ER and protein misfolding stress.

Without being bound by any theory or mechanism, the instant invention may be utilized to apply a CRISPR nuclease to process the mutated pathologic ELANE allele and not the functional ELANE allele, such as to prevent expression of the mutated pathologic allele or to produce a truncated non-pathologic peptide from the mutated pathologic allele, or to repair/correct the mutated pathologic ELANE allele in order to prevent ameliorate or treat SCN or CyN.

Several alternative editing strategies include exclusion of the whole gene, truncation of the gene to exclude the C-terminus of the gene, and attenuation of the expression of the gene.

Examples of RNA Guide Sequences which Specifically Target Mutant Alleles of ELANE Gene.

Although a large number of guide sequences can be designed to target a mutant allele, the nucleotide sequences described in Table 1 identified by SEQ ID NOs: 1-31117 below were specifically selected to effectively implement the methods set forth herein and to effectively discriminate between alleles.

Table 1 shows guide sequences designed for use as described in the embodiments above to associate with mutant ELANE alleles. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1 (PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized.

TABLE 1

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:852329_A_G | 1-41 | 42-63 | 64-95 |
| 19:852330_T_G | 1, 20, 31, 96-135 | 136-157 | 65-66, 158-188 |
| 19:852331_G_C | 31, 97, 114, 189-228 | 229-269 | 65, 158, 270-312 |
| 19:852338_G_A | 313-358 | 359-406 | 407-456 |
| 19:852342_G_A | 457-502 | 503-550 | 551-600 |
| 19:852343_CCG_CCGCC G | 313-315, 344, 601-620 | 359-360, 391, 400, 621-632 | 407, 417, 440, 450, 633-652 |
| 19:852350_G_A | 653-698 | 699-746 | 747-796 |
| 19:852351_C_T | 656, 665-666, 670, 684, 698, 797-836 | 702, 712, 717-718, 731, 740, 837-878 | 753, 759, 767-768, 781, 790, 879-922 |
| 19:852366_C_G | 923-968 | 969-1016 | 1017-1066 |
| 19:852367_C_G | 926-927, 933, 939, 948, 950, 1067-1106 1149-1192 | 974, 980, 983, 986, 995, 997, 1107-1148 | 1022, 1029, 1032, 1035, 1047, 1049, |
| 19:852380_G_C | 1193-1238 | 1239-1284 | 1285-1334 |
| 19:852392_G_C | 1335-1380 | 1381-1426 | 1427-1476 |
| 19:852395_GG_G | 1369, 1377, 1380, 1477-1509 | 1411, 1414, 1426, 1510-1544 | 1434, 1461, 1464, 1545-1581 |
| 19:852396_G_T | 1486-1487, 1492, 1497, 1505, 1582-1622 | 1520, 1525, 1530, 1538-1539, 1623-1665 | 1555, 1560, 1571, 1574-1575, 1666-1710 |
| 19:852864_G_T | 1711-1756 | 1757-1803 | 1804-1852 |
| 19:852878_A_C | 1853-1880 | 1881-1896 | 1897-1918 |
| 19:852882_C_T | 1919-1964 | 1965-2012 | 2013-2062 |
| 19:852885_T_C | 1940, 1946, 2063-2088 | 1988, 1991, 2089-2112 | 2037, 2050, 2113-2140 |
| 19:852898_T_G | 2141-2179 | 2180-2211 | 2212-2248 |
| 19:852927_C_T | 2249-2283 | 2284-2310 | 2311-2339 |
| 19:852933_C_T | 2340-2378 | 2379-2417 | 2418-2458 |
| 19:852935_T_C | 2350, 2364, 2459-2493 | 2395, 2403, 2494-2528 | 2434, 2446, 2529-2565 |
| 19:852937_C_A | 2476, 2484, 2566-2606 | 2512, 2520, 2607-2648 | 2546, 2548, 2649-2692 |
| 19:852939_T_G | 2582, 2584, 2586, 2693-2734 | 2623, 2644, 2735-2777 | 2670, 2688, 2778-2822 |
| 19:852941_GTGTCCC_G | 2823-2863 | 2864-2906 | 2907-2951 |
| 19:852941_G_A | 2714, 2720, 2726, 2731, 2832, 2952-2992 | 2751, 2758, 2770, 2875, 2993-3034 | 2795, 2801, 2810, 2934, 3035-3079 |
| 19:852941_G_C | 2714, 2720, 2726, 2731, 2832, 2964, 3118-3157 2967, 2980, 3080-3117 | 2751, 2758, 2770, 2875, 3019, 3021, | 2795, 2801, 2810, 2934, 3068, 3070, 3078, 3158-3199 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
| --- | --- | --- | --- |
| 19:852941_G_T | 2714, 2720, 2726, 2731, 2832, 2964, 2967, 2980, 3200-3237 | 2751, 2758, 2770, 2875, 3019, 3021, 3238-3277 | 2795, 2801, 2810, 2934, 3068, 3070, 3078, 3278-3319 |
| 19:852942_T_A | 2714, 2720, 2831-2832, 2964, 2967, 2980, 3320-3358 | 2751, 2770, 2874-2875, 3019, 3021, 3359-3399 | 2801, 2810, 2919, 2934, 3068, 3070, 3078, 3400-3442 |
| 19:852945_C_A | 2824, 2826, 2828, 2831, 2856, 3350, 3443-3482 | 2864, 2868, 2870, 2873-2874, 3398, 3483-3524 | 2907, 2917-2919, 2931, 3436, 3525-3568 |
| 19:852945_C_G | 2824, 2826, 2828, 2831, 2856, 3350, 3455, 3479, 3569-3606 | 2864, 2868, 2870, 2873-2874, 3398, 3483, 3515, 3607-3645 | 2907, 2917-2919, 2931, 3436, 3528, 3530, 3646-3687 |
| 19:852945_C_T | 2824, 2826, 2828, 2831, 2856, 3350, 3455, 3479, 3688-3725 | 2864, 2868, 2870, 2873-2874, 3398, 3483, 3515, 3726-3765 | 2907, 2917-2919, 2931, 3436, 3528, 3530, 3766-3807 |
| 19:852948_T_C | 2823, 2826, 2844, 3455, 3808-3845 | 2864, 2866, 2887, 3483, 3846-3877 | 2909, 2914, 2931, 3530, 3878-3915 |
| 19:852948_T_G | 2823, 2826, 2844, 3455, 3808, 3821, 3829, 3834, 3916-3949 | 2864, 2866, 2887, 3483, 3849, 3856, 3858, 3866, 3950-3977 | 2909, 2914, 2931, 3530, 3879, 3892, 3898, 3903, 3978-4011 |
| 19:852954_T_C | 4012-4053 | 4054-4089 | 4090-4131 |
| 19:852965_C_T | 4132-4177 | 4178-4225 | 4226-4275 |
| 19:852966_A_T | 4133, 4139, 4143, 4169, 4172-4173, 4276-4315 | 4179, 4185-4186, 4216, 4221, 4225, 4316-4356 | 4227, 4234, 4250, 4266, 4268, 4275, 4357-4400 |
| 19:852967_C_A | 4133, 4139, 4143, 4173, 4282, 4288, 4401-4440 | 4179, 4186, 4216, 4221, 4338, 4441-4482 | 4234, 4250, 4266, 4275, 4371, 4397, 4483-4526 |
| 19:852971_T_A | 4527-4572 | 4573-4620 | 4621-4670 |
| 19:852972_G_A | 4529, 4536, 4550, 4553, 4561, 4563, 4671-4710 | 4582, 4597, 4608, 4610, 4616, 4619, 4711-4752 | 4641, 4646, 4659, 4665, 4668, 4670, 4753-4796 |
| 19:852972_G_C | 4529, 4536, 4550, 4553, 4561, 4563, 4696, 4709, 4797-4834 | 4582, 4597, 4608, 4610, 4616, 4619, 4713, 4752, 4835-4874 | 4641, 4646, 4659, 4665, 4668, 4670, 4761, 4790, 4875-4916 |
| 19:852974_G_C | 4529, 4563, 4696, 4709, 4917-4958 | 4582, 4619, 4713, 4752, 4959-5002 | 4646, 4670, 4761, 4790, 5003-5048 |
| 19:852976_C_CCTGATT | 4955, 5049-5092 | 4976, 5093-5138 | 5033, 5139-5186 |

TABLE 1-continued

Guide sequences designed to target mutant
alleles the ELANE gene

| Target | SEQ ID NOs: of 20 base guides | SEQ ID NOs: of 21 base guides | SEQ ID NOs: of 22 base guides |
|---|---|---|---|
| 19:852977_G_A | 4951,4955, 5064, 5075-5076, 5187-5227 | 4963,4976, 5108, 5119, 5135, 5228-5270 | 5003,5033, 5157, 5166, 5182, 5271-5315 |
| 19:852977_G_T | 4951,4955, 5064, 5075-5076, 5187, 5192, 5204, 5316-5353 | 4963,4976, 5108, 5119, 5135, 5228, 5239, 5245, 5354-5393 | 5003,5033, 5157, 5166, 5182, 5272, 5283, 5290, 5394-5435 |
| 19:852978_C_T | 5064, 5075-5076, 5187, 5192, 5204, 5436-5475 | 5108, 5119, 5135, 5228, 5239, 5245, 5476-5517 | 5157, 5166, 5182, 5272, 5283, 5290, 5518-5561 |
| 19:852980_A_C | 5076, 5204, 5445, 5447, 5562-5603 | 5108, 5239, 5477, 5498, 5604-5637 | 5166, 5272, 5530, 5536, 5638-5677 |
| 19:852984_T_C | 5678-5723 | 5724-5765 | 5766-5811 |
| 19:852984_T_G | 5680, 5684, 5687, 5691, 5693, 5708, 5712, 5719, 5812-5849 | 5726, 5730, 5733, 5737, 5750, 5752, 5755, 5757, 5850-5883 | 5768, 5772, 5779, 5786, 5793, 5795, 5801-5802, 5884-5921 |
| 19:852986_ATTGC_AG | 5693, 5922-5963 | 5755, 5964-6003 | 5802, 6004-6049 |
| 19:852987_T_C | 5680, 5693, 5926, 5930, 5934, 5944, 6050-6089 | 5750, 5755, 5968, 5972, 5975, 5993, 6090-6125 | 5786, 5802, 6012, 6015, 6033, 6039, 6126-6165 |
| 19:852988_TGCGCCAA CTTCGTCATGTCGGCC_T | 6166-6202 | 6203-6241 | 6242-6282 |
| 19:852988_T_G | 5926, 5930, 5934, 5944, 5950, 6064, 6071, 6283-6321 | 5968, 5972, 5975, 5993, 5996, 6103, 6106, 6322-6356 | 6012, 6015, 6023, 6033, 6039, 6140, 6154, 6357-6395 |
| 19:852990_C_G | 5934, 5938, 5944, 5950, 5953, 6188, 6320, 6396-6434 | 5968, 5977, 5983, 5993, 5996, 6236, 6340, 6435-6475 | 6012, 6023, 6034, 6037, 6039, 6281, 6361, 6476-6518 |
| 19:852990_C_T | 5934, 5944, 5950, 5953, 6188, 6320, 6411, 6427, 6519-6556 | 5968, 5983, 5993, 5996, 6236, 6340, 6461, 6473, 6557-6596 | 6012, 6023, 6037, 6039, 6281, 6361, 6493, 6497, 6597-6638 |
| 19:852998_TTCG_T | 6639-6679 | 6680-6722 | 6723-6767 |
| 19:853001_G_T | 6641-6642, 6644, 6648-6650, 6653, 6655, 6659, 6664, 6667, 6768-6802 | 6682-6683, 6689-6691, 6694-6695, 6701, 6706, 6709-6710, 6803-6839 | 6726, 6732-6733, 6737-6738, 6744-6745, 6750, 6753-6755, 6840-6878 |
| 19:853002_TCATGTCGG CCGCGCAC_TA | 6641, 6655, 6879-6921 | 6682, 6689, 6922-6966 | 6732, 6737, 6967-7013 |
| 19:853002_T_A | 6641-6642, 6648-6649, 6655, 6659, 6897, 7014-7052 | 6682-6683, 6689-6690, 6694-6695, 6940, 7053-7092 | 6732-6733, 6737-6738, 6754-6755, 6970, 7093-7134 |
| 19:853005_T_G | 6897, 6904, 7024, 7135-7176 | 6940-6941, 7177-7218 | 6970, 6986, 7219-7264 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:853007_TCGGCCG_T | 6166, 6173-6174, 7265-7302 | 6203, 6210, 6234, 7303-7342 | 6249, 6263, 6274, 7343-7384 |
| 19:853008_C_G | 7158, 7170, 7298, 7302, 7385-7425 | 7213, 7216, 7310, 7342, 7426-7464 | 7225, 7243, 7352, 7367, 7465-7508 |
| 19:853019_T_A | 6902, 6913, 7509-7550 | 6946, 6955, 7551-7590 | 7001-7002, 7591-7636 |
| 19:853019_T_C | 6902, 6913, 7514, 7532, 7537, 7540, 7547, 7550, 7637-7666 | 6946, 6955, 7551, 7557, 7572, 7576, 7582, 7590, 7667-7696 | 7001-7002, 7591, 7597, 7600, 7610, 7615, 7620, 7697-7730 |
| 19:853020_G_A | 6902, 7532, 7537, 7540, 7547, 7550, 7731-7770 | 6955, 7557, 7572, 7576, 7582, 7590, 7771-7812 | 7002, 7591, 7597, 7610, 7615, 7620, 7813-7856 |
| 19:853020_G_T | 6902, 7532, 7537, 7540, 7547, 7550, 7750, 7752, 7857-7894 | 6955, 7557, 7572, 7576, 7582, 7590, 7786, 7810, 7895-7934 | 7002, 7591, 7597, 7610, 7615, 7620, 7827, 7856, 7935-7976 |
| 19:853022_G_A | 7540, 7547, 7750, 7752, 7977-8018 | 7572, 7590, 7786, 7810, 8019-8062 | 7610, 7620, 7827, 7856, 8063-8108 |
| 19:853023_T_A | 7750, 7752, 7992, 7994, 8009, 8013, 8109-8146 | 7786, 7810, 8034, 8040, 8052, 8057, 8147-8182 | 7827, 7856, 8084, 8087, 8102, 8105, 8183-8224 |
| 19:853023_T_G | 7750, 7752, 7992, 7994, 8009, 8013, 8118, 8141, 8225-8254 | 7786, 7810, 8034, 8040, 8052, 8057, 8166, 8179, 8255-8284 | 7827, 7856, 8084, 8087, 8102, 8105, 8186, 8216, 8285-8318 |
| 19:853025_G_A | 7992, 8013, 8118, 8141, 8319-8360 | 8052, 8057, 8166, 8179, 8361-8404 | 8084, 8087, 8186, 8216, 8405-8450 |
| 19:853265_CGTCCGCGC G_C | 8451-8491 | 8492-8534 | 8535-8579 |
| 19:853265_CGTCC_CCC TCCCCGGCAGGACCTCCCC GGCAGGTCCTCCCTCCCCG GCAGGACCG | 8477, 8490, 8580-8621 | 8514, 8520, 8622-8661 | 8557, 8568, 8662-8703 |
| 19:853270_GCGC_G | 8482, 8485-8486, 8489, 8704-8744 | 8519, 8528-8529, 8534, 8745-8785 | 8542, 8573, 8578-8579, 8786-8830 |
| 19:853270_G_A | 8476, 8489, 8723, 8728, 8733, 8831-8871 | 8519, 8533, 8763, 8778, 8784, 8872-8913 | 8563, 8578, 8817, 8825, 8829, 8914-8958 |
| 19:853272_G_C | 8482, 8485, 8723, 8728, 8733-8734, 8870, 8959-8993 | 8528-8529, 8763, 8767, 8778, 8784, 8900, 8994-9018 | 8573, 8579, 8805, 8817, 8825, 8829, 8951, 9019-9051 |
| 19:853272_G_T | 8482, 8485, 8723, 8728, 8733-8734, 8870, 8992, 9052-9089 | 8528-8529, 8763, 8767, 8778, 8784, 8900, 9011, 9090-9129 | 8573, 8579, 8805, 8817, 8825, 8829, 8951, 9038, 9130-9171 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:853273_CGGTGCG_C | 9172-9208 | 9209-9239 | 9240-9276 |
| 19:853276_T_G | 8486, 8491, 9185, 9188, 9204, 9277-9299 | 8499, 8534, 9221-9222, 9239, 9300-9313 | 8542, 8574, 9253-9254, 9271, 9314-9332 |
| 19:853278_C_T | 9185, 9188, 9193, 9198, 9203-9204, 9208, 9281, 9333-9370 | 9221-9222, 9224, 9231-9232, 9234, 9239, 9312, 9371-9410 | 9246, 9253-9255, 9257, 9269, 9271, 9332, 9411-9452 |
| 19:853279_G_C | 9178, 9188, 9193, 9198, 9201, 9203-9204, 9208, 9453-9486 | 9215, 9222, 9224, 9231-9232, 9234-9235, 9239, 9487-9510 | 9246, 9254-9255, 9257, 9262, 9269, 9271, 9276, 9511-9542 |
| 19:853281_G_A | 9193, 9201, 9203, 9461, 9543-9584 | 9215, 9231-9232, 9246, 9257, 9500, 9585-9628 | 9262, 9533, 9629-9674 |
| 19:853285_T_A | 9675-9717 | 9718-9751 | 9752-9791 |
| 19:853288_T_C | 9694, 9792-9825 | 9724, 9826-9849 | 9753, 9760, 9850-9878 |
| 19:853290_G_A | 9796, 9805, 9821, 9879-9920 | 9833, 9837, 9921-9962 | 9855, 9858, 9963-10007 |
| 19:853290_G_C | 9796, 9805, 9821, 9882, 9885, 9887, 9898, 10008-10045 | 9833, 9837, 9924-9925, 10046-10082 | 9855, 9858, 9966, 9999-10000, 10083-10121 |
| 19:853291_G_A | 9805, 9882, 9885, 9887, 9898, 10122-10161 | 9833, 9924-9925, 10162-10202 | 9855, 9966, 9999-10000, 10203-10245 |
| 19:853293_G_T | 9882, 9898, 10125, 10130, 10246-10287 | 9924, 10195, 10288-10330 | 9999, 10214, 10331-10375 |
| 19:853295_CCATAACCT CTC_CCATAACCTCTCCCA TAACCTCTC | 10376-10398 | 10399-10423 | 10424-10450 |
| 19:853295_CCAT_C | 10256, 10451-10494 | 10309, 10495-10538 | 10342, 10539-10584 |
| 19:853302_C_T | 10585-10627 | 10628-10671 | 10672-10717 |
| 19:853312_G_A | 10718-10759 | 10760-10795 | 10796-10835 |
| 19:853327_A_C | 10836-10868 | 10869-10893 | 10894-10924 |
| 19:853327_A_T | 10840, 10842, 10857, 10868, 10925-10957 | 10870, 10873, 10875, 10886, 10958-10988 | 10895, 10898, 10912, 10914, 10989-11021 |
| 19:853329_G_A | 10840, 10857, 11022-11061 | 10870, 10873, 11062-11102 | 10895, 10912, 11103-11145 |
| 19:853329_G_T | 10840, 10857, 11023, 11046, 11146-11183 | 10870, 10873, 11079, 11086, 11184-11222 | 10895, 10912, 11121, 11143, 11223-11263 |
| 19:853333_T_C | 11264-11308 | 11309-11345 | 11346-11388 |
| 19:853335_G_A | 11295, 11298, 11307-11308, 11389-11430 | 11334, 11344-11345, 11431-11474 | 11363, 11380, 11388, 11475-11520 |
| 19:853338_G_A | 11393, 11423, 11521-11564 | 11450, 11453, 11565-11610 | 11490, 11505, 11611-11658 |

TABLE 1-continued

Guide sequences designed to target mutant
alleles the ELANE gene

| Target | SEQ ID NOs: of 20 base guides | SEQ ID NOs: of 21 base guides | SEQ ID NOs: of 22 base guides |
|---|---|---|---|
| 19:853338_G_T | 11393, 11423, 11531, 11533, 11536, 11541, 11548-11549, 11659-11696 | 11450, 11453, 11568-11569, 11579, 11582, 11593-11594, 11697-11736 | 11490, 11505, 11614-11615, 11635, 11640-11641, 11649, 11737-11778 |
| 19:853342_A_C | 11779-11824 | 11825-11872 | 11873-11922 |
| 19:853345_G_C | 11789, 11797, 11923-11966 | 11834, 11865, 11967-12012 | 11874, 11907, 12013-12060 |
| 19:853345_G_T | 11789, 11797, 11936, 11942, 11946, 11948, 11951, 11959, 12061-12098 | 11834, 11865, 11976, 11981, 11992, 11994-11995, 11998, 12099-12138 | 11874, 11907, 12022-12023, 12028, 12041-12043, 12139-12180 |
| 19:853348_T_A | 11942, 11948, 12181-12224 | 11992, 11994, 12225-12270 | 12028, 12041, 12271-12318 |
| 19:853370_C_G | 12319-12364 | 12365-12412 | 12413-12462 |
| 19:853372_TAAACTTGC TCAACGACATCGTGAT_T | 12362, 12463-12503 | 12391, 12504-12545 | 12456, 12546-12589 |
| 19:853375_A_T | 12479, 12488, 12590-12633 | 12520, 12543, 12634-12679 | 12587, 12589, 12680-12727 |
| 19:853379_G_T | 12728-12773 | 12774-12821 | 12822-12871 |
| 19:853384_A_G | 12872-12917 | 12918-12965 | 12966-13015 |
| 19:853390_T_A | 13016-13061 | 13062-13109 | 13110-13159 |
| 19:853395_A_T | 12481, 12493, 13160-13201 | 12522, 13202-13245 | 12559, 13246-13291 |
| 19:853396_T_A | 12481, 13161, 13164, 13168, 13292-13330 | 13203, 13206, 13239, 13331-13371 | 13247, 13282, 13285, 13372-13414 |
| 19:853396_T_G | 12481, 13161, 13164, 13168, 13312, 13415-13452 | 13203, 13206, 13239, 13336, 13453-13491 | 13247, 13282, 13285, 13373, 13492-13532 |
| 19:853398_C_T | 13168, 13312, 13533-13572 | 13206, 13336, 13573-13613 | 13247, 13373, 13614-13656 |
| 19:853399_T_A | 13312, 13568, 13570, 13657-13692 | 13336, 13594, 13611, 13693-13728 | 13373, 13619, 13637, 13729-13766 |
| 19:853399_T_C | 13312, 13568, 13570, 13681, 13767-13799 | 13336, 13594, 13611, 13726, 13800-13832 | 13373, 13619, 13637, 13766, 13833-13867 |
| 19:853401_C_T | 13568, 13681, 13868-13904 | 13611, 13726, 13905-13939 | 13637, 13766, 13940-13976 |
| 19:855553_C_CAC | 13977-14017 | 14018-14060 | 14061-14105 |
| 19:855556_C_A | 13979, 13988-13989, 13999, 14001, 14106-14146 | 14020, 14030-14031, 14039, 14042, 14147-14189 | 14063, 14074, 14083, 14086, 14099, 14190-14234 |
| 19:855563_G_C | 14235-14280 | 14281-14328 | 14329-14378 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:855564_C_T | 14239, 14255, 14262-14263, 14275, 14280, 14379-14418 | 14285, 14301, 14306, 14318, 14323, 14328, 14419-14460 | 14333, 14352, 14356, 14368, 14371, 14378, 14461-14504 |
| 19:855565_T_A | 14255, 14262, 14275, 14280, 14384, 14411, 14505-14544 | 14285, 14301, 14318, 14328, 14440, 14444, 14545-14586 | 14333, 14352, 14356, 14368, 14480, 14490, 14587-14630 |
| 19:855568_A_T | 14524, 14539, 14631-14674 | 14549, 14572, 14675-14720 | 14610, 14616, 14721-14768 |
| 19:855574_C_G | 14769-14814 | 14815-14862 | 14863-14912 |
| 19:855574_C_T | 14771, 14773, 14778-14779, 14783, 14785, 14790, 14793, 14913-14950 | 14819, 14824-14825, 14829, 14831-14832, 14840, 14856, 14951-14990 | 14873, 14877, 14879-14880, 14887, 14889, 14904, 14906, 14991-15032 |
| 19:855575_G_A | 14771, 14773, 14778-14779, 14783, 14793, 15033-15072 | 14824-14825, 14829, 14831, 14840, 14856, 15073-15114 | 14877, 14879-14880, 14887, 14889, 14906, 15115-15158 |
| 19:855576_GCCA_G | 15159-15197 | 15198-15238 | 15239-15281 |
| 19:855576_G_C | 14771, 14778-14779, 14793, 15043, 15067, 15178, 15282-15320 | 14824, 14829, 14840, 14856, 15075, 15092, 15212, 15321-15361 | 14877, 14879, 14887, 14906, 15124, 15130, 15241, 15362-15404 |
| 19:855577_C_A | 14771, 14793, 15043, 15067, 15172, 15178, 15181, 15292, 15405-15442 | 14824, 14856, 15075, 15092, 15200, 15212-15213, 15332, 15443-15482 | 14877, 14887, 15124, 15130, 15241, 15248, 15253, 15364, 15483-15524 |
| 19:855580_C_T | 15160-15161, 15164, 15167-15168, 15170-15172, 15179, 15181, 15183, 15193, 15525-15558 | 15199-15200, 15203, 15206-15207, 15209-15211, 15213, 15220, 15222, 15234, 15559-15594 | 15240, 15247-15248, 15250-15253, 15255, 15262, 15264-15265, 15277, 15595-15632 |
| 19:855582_ATCA_A | 15160, 15533, 15633-15672 | 15206, 15577, 15673-15714 | 15251, 15618, 15715-15758 |
| 19:855588_G_A | 15759-15804 | 15805-15852 | 15853-15902 |
| 19:855591_A_C | 15764, 15774, 15903-15946 | 15806, 15833, 15947-15992 | 15863, 15886, 15993-16040 |
| 19:855604_C_A | 16041-16086 | 16087-16133 | 16134-16182 |
| 19:855604_C_T | 16048-16049, 16053, 16060, 16070, 16074, 16078, 16081, 16183-16220 | 16094, 16099, 16101, 16107, 16117, 16121, 16128, 16221-16260 | 16136, 16142, 16147, 16149, 16155, 16166, 16170, 16261-16302 |
| 19:855613_C_G | 16303-16346 | 16347-16377 | 16378-16417 |
| 19:855613_C_T | 16303-16304, 16309, 16314, 16316, 16324, 16330, 16344, 16418-16455 | 16347-16348, 16352, 16355, 16375, 16377, 16456-16495 | 16378, 16384, 16387, 16400, 16410, 16414, 16417, 16496-16537 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:855616_C_T | 16324, 16344, 16538-16581 | 16348, 16377, 16582-16626 | 16378, 16410, 16627-16673 |
| 19:855624_C_T | 16674-16719 | 16720-16765 | 16766-16815 |
| 19:855625_G_A | 16686, 16696, 16699, 16701, 16709, 16715, 16816-16855 | 16721, 16743, 16747, 16761, 16764, 16856-16897 | 16767, 16773, 16790, 16803, 16808, 16814, 16898-16941 |
| 19:855627_C_T | 16686, 16696, 16818, 16827, 16942-16983 | 16721, 16747, 16863, 16869, 16984-17027 | 16773, 16803, 16923-16924, 17028-17073 |
| 19:855628_G_A | 16818, 16827, 16944, 16948, 16950, 16967, 17074-17113 | 16863, 16869, 16991, 16994, 17010, 17018, 17114-17155 | 16923-16924, 17032, 17040, 17042, 17064, 17156-17199 |
| 19:855634_G_A | 17200-17244 | 17245-17288 | 17289-17335 |
| 19:855639_G_A | 17336-17381 | 17382-17428 | 17429-17477 |
| 19:855648_T_A | 17478-17523 | 17524-17568 | 17569-17617 |
| 19:855649_G_A | 17479, 17483, 17497, 17499, 17510, 17514, 17618-17657 | 17525, 17529, 17543, 17545, 17549, 17658-17699 | 17570, 17573, 17590, 17596, 17603, 17700-17743 |
| 19:855649_G_C | 17479, 17483, 17497, 17499, 17510, 17514, 17635, 17638, 17744-17781 | 17525, 17529, 17543, 17545, 17549, 17660, 17684, 17782-17820 | 17570, 17573, 17590, 17596, 17603, 17708, 17720, 17821-17862 |
| 19:855649_G_T | 17479, 17483, 17497, 17499, 17510, 17514, 17635, 17638, 17863-17900 | 17525, 17529, 17543, 17545, 17549, 17660, 17684, 17901-17940 | 17570, 17573, 17590, 17596, 17603, 17708, 17720, 17941-17982 |
| 19:855650_C_G | 17479, 17483, 17499, 17510, 17635, 17638, 17983-18022 | 17525, 17543, 17545, 17549, 17660, 17684, 18023-18062 | 17573, 17590, 17596, 17603, 17708, 17720, 18063-18106 |
| 19:855652_T_C | 17635, 17638, 17985, 18002, 18107-18144 | 17660, 17684, 18031, 18042, 18145-18180 | 17708, 17720, 18076, 18092, 18181-18220 |
| 19:855653_G_A | 17985, 18002, 18115, 18119, 18135, 18144, 18221-18260 | 18031, 18042, 18155, 18158, 18165, 18180, 18261-18302 | 18076, 18092, 18194, 18201, 18204, 18208, 18303-18346 |
| 19:855654_G_C | 18115, 18119, 18135, 18144, 18234, 18249, 18347-18386 | 18155, 18158, 18165, 18180, 18285, 18293, 18387-18426 | 18194, 18201, 18204, 18208, 18343, 18346, 18427-18470 |
| 19:855655_C_A | 18119, 18135, 18234, 18249, 18368, 18370, 18471-18510 | 18158, 18180, 18285, 18293, 18414, 18423, 18511-18552 | 18204, 18208, 18343, 18346, 18448, 18460, 18553-18596 |
| 19:855663_T_C | 18597-18638 | 18639-18674 | 18675-18716 |
| 19:855665_G_C | 18598, 18615, 18629, 18633, 18717-18758 | 18640, 18644, 18665, 18667, 18759-18800 | 18680, 18684, 18706-18707, 18801-18846 |
| 19:855669_C_G | 18847-18892 | 18893-18939 | 18940-18989 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:855687_G_A | 18990-19035 | 19036-19083 | 19084-19133 |
| 19:855687_G_C | 19000, 19006-19007, 19016, 19022, 19025-19026, 19030, 19134-19171 | 19046, 19052, 19064, 19069, 19072-19073, 19077, 19082, 19172-19211 | 19087, 19101, 19105, 19114, 19122-19123, 19127, 19132, 19212-19253 |
| 19:855690_A_G | 19006, 19016, 19254-19297 | 19064, 19069, 19298-19343 | 19087, 19122, 19344-19391 |
| 19:855693_G_A | 19276, 19297, 19392-19435 | 19317, 19338, 19436-19481 | 19354, 19391, 19482-19529 |
| 19:855699_G_A | 19530-19575 | 19576-19623 | 19624-19673 |
| 19:855706_A_C | 19674-19719 | 19720-19767 | 19768-19817 |
| 19:855712_T_C | 19818-19863 | 19864-19911 | 19912-19961 |
| 19:855715_ACGTGACGGTGGTGACGTCCCTCTG_A | 19962-20004 | 20005-20049 | 20050-20096 |
| 19:855736_T_TCT | 20097-20137 | 20138-20180 | 20181-20225 |
| 19:855739_GC_G | 19969, 19986, 19996, 20116, 20132, 20226-20263 | 20009, 20013, 20030, 20170, 20175, 20264-20303 | 20054, 20075, 20077, 20197, 20214, 20304-20345 |
| 19:855741_CG_C | 19986, 20116, 20227, 20231, 20237, 20346-20385 | 20009, 20175, 20265, 20281, 20284, 20386-20427 | 20075, 20214, 20314, 20323, 20338, 20428-20471 |
| 19:855753_G_A | 20472-20517 | 20518-20565 | 20566-20615 |
| 19:855755_C_A | 20487-20488, 20494, 20513, 20616-20657 | 20535, 20554, 20557, 20561, 20658-20701 | 20590, 20603, 20606, 20614, 20702-20747 |
| 19:855758_C_A | 20637, 20656, 20748-20791 | 20674, 20682, 20792-20836 | 20715, 20720, 20837-20883 |
| 19:855764_C_G | 20884-20924 | 20925-20963 | 20964-21004 |
| 19:855765_G_A | 20899, 20916, 20919, 21005-21043 | 20943, 20956, 20959, 21044-21081 | 20977, 20982, 20997, 21082-21121 |
| 19:855767_G_A | 20899, 21031, 21122-21160 | 20959, 21058, 21161-21195 | 20997, 21117, 21196-21235 |
| 19:855770_G_C | 21125, 21236-21266 | 21167, 21267-21295 | 21196, 21222, 21296-21326 |
| 19:855770_G_T | 21125, 21236-21239, 21242, 21254, 21327-21360 | 21167, 21267-21268, 21272-21273, 21284-21285, 21361-21387 | 21196, 21222, 21296, 21300, 21303, 21307, 21314-21315, 21388-21421 |
| 19:855775_G_A | 21422-21463 | 21464-21497 | 21498-21539 |
| 19:855777_C_T | 21442, 21454, 21457, 21460, 21540-21577 | 21476, 21490-21491, 21495, 21578-21607 | 21504, 21516-21517, 21532, 21608-21645 |
| 19:855778_AG_CT | 21442, 21545, 21557, 21563, 21577, 21646-21670 | 21495, 21582, 21584, 21594, 21607, 21671-21693 | 21532, 21616, 21627, 21629, 21643, 21694-21720 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:855779_G_GGC | 21545, 21557, 21721-21739 | 21582, 21584, 21740-21756 | 21616, 21629, 21757-21777 |
| 19:855780_GC_G | 21652, 21725, 21729, 21731-21732, 21738-21739, 21778-21799 | 21685, 21743, 21745, 21750, 21756, 21800-21821 | 21713, 21761, 21763, 21767, 21770, 21772, 21777, 21822-21845 |
| 19:855783_G_GGC | 21793, 21797, 21846-21866 | 21805, 21819, 21867-21887 | 21827, 21830, 21888-21910 |
| 19:855785_C_CGTCTGTTT | 21911-21938 | 21939-21967 | 21968-21998 |
| 19:855786_G_A | 21999-22038 | 22039-22073 | 22074-22115 |
| 19:855786_G_GCT | 22013, 22015, 22116-22146 | 22052-22053, 22147-22175 | 22078, 22092, 22176-22206 |
| 19:855786_G_GTTTTT | 22207-22243 | 22244-22280 | 22281-22321 |
| 19:855795_G_A | 21922, 21925, 21931, 22322-22364 | 21951, 21960, 22365-22409 | 21990, 21994, 22410-22456 |
| 19:855795_G_C | 21922, 21925, 21931, 22325, 22327, 22332, 22344, 22351, 22457-22494 | 21951, 21960, 22368, 22375, 22382, 22388, 22390, 22495-22534 | 21990, 21994, 22413-22414, 22421, 22427, 22437, 22535-22576 |
| 19:855795_G_T | 21922, 21925, 21931, 22325, 22327, 22332, 22344, 22351, 22577-22614 | 21951, 21960, 22368, 22375, 22382, 22388, 22390, 22615-22654 | 21990, 21994, 22413-22414, 22421, 22427, 22437, 22655-22696 |
| 19:855797_A_T | 21925, 22325, 22332, 22351, 22697-22738 | 21951, 22375, 22382, 22390, 22739-22782 | 21990, 22414, 22427, 22437, 22783-22828 |
| 19:855799_G_A | 22700, 22706, 22720-22721, 22829-22870 | 22743, 22761, 22764, 22769, 22871-22914 | 22799, 22806, 22813, 22815, 22915-22960 |
| 19:855799_G_T | 22700, 22706, 22720-22721, 22833, 22850, 22856, 22858, 22961-22998 | 22743, 22761, 22764, 22769, 22875, 22881, 22899, 22904, 22999-23038 | 22799, 22806, 22813, 22815, 22926, 22940, 22949, 22951, 23039-23080 |
| 19:855955_CAG_C | 23081-23125 | 23126-23168 | 23169-23215 |
| 19:855955_C_G | 23081, 23087, 23094, 23118, 23124, 23216-23256 | 23132, 23134, 23149, 23161, 23167, 23257-23298 | 23170, 23179, 23194, 23201, 23214, 23299-23343 |
| 19:855956_AG_A | 23081-23082, 23087, 23090, 23344-23376 | 23127, 23132, 23134, 23151, 23377-23411 | 23170, 23173, 23179, 23196, 23412-23448 |
| 19:855957_G_A | 23081-23082, 23087, 23090, 23093-23094, 23118, 23346, 23449-23486 | 23127, 23132, 23134, 23137, 23151, 23161, 23167, 23377, 23487-23526 | 23170, 23173, 23179, 23194, 23196, 23208, 23214, 23417, 23527-23568 |
| 19:855958_G_GGGGACTCC | 23569-23593 | 23594-23618 | 23619-23647 |
| 19:855959_GGGACTC_G | 23345, 23354, 23359, 23648-23685 | 23379, 23383, 23389, 23686-23723 | 23414, 23419, 23422, 23724-23765 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
| --- | --- | --- | --- |
| 19:855960_GG_GGGG | 23081, 23087, 23090, 23218, 23345, 23354, 23359, 23685, 23766-23767 | 23127, 23132, 23134, 23257, 23379, 23383, 23389, 23705, 23768-23769 | 23170, 23179, 23196, 23305, 23414, 23419, 23422, 23739, 23770-23773 |
| 19:855965sj | 23662, 23677, 23684-23685, 23774-23815 | 23699, 23701, 23705, 23715, 23816-23859 | 23736-23737, 23739-23740, 23860-23905 |
| 19:855967_G_C | 23581, 23593, 23660, 23662, 23677, 23808, 23810, 23906-23944 | 23606, 23616, 23698-23699, 23701, 23850, 23856, 23945-23983 | 23642, 23645, 23736-23737, 23748, 23902, 23905, 23984-24026 |
| 19:855967_G_T | 23581, 23593, 23660, 23662, 23677, 23808, 23810, 23920, 24027-24064 | 23606, 23616, 23698-23699, 23701, 23850, 23856, 23967, 24065-24104 | 23642, 23645, 23736-23737, 23748, 23902, 23905, 23989, 24105-24146 |
| 19:855968_G_A | 23581, 23584, 23593, 23660, 23662, 23810, 23920, 24147-24185 | 23606, 23616, 23618, 23698-23699, 23850, 23967, 24186-24226 | 23631, 23642, 23645, 23736, 23748, 23902, 23989, 24227-24269 |
| 19:855971_GC_G | 24270-24308 | 24309-24349 | 24350-24392 |
| 19:855974_C_G | 24271, 24279, 24281, 24286, 24307, 24393-24433 | 24318, 24320, 24325, 24334, 24345, 24434-24474 | 24366, 24372, 24376, 24381, 24388, 24475-24519 |
| 19:855977_T_C | 24271, 24284, 24423, 24520-24562 | 24310, 24320, 24472, 24563-24601 | 24361, 24366, 24512, 24602-24644 |
| 19:855978_G_T | 24284, 24525, 24538, 24553-24554, 24560, 24645-24684 | 24310, 24568, 24576, 24580, 24594, 24685-24726 | 24361, 24602, 24612, 24617, 24621, 24639, 24727-24770 |
| 19:855982_T_C | 24771-24816 | 24817-24864 | 24865-24914 |
| 19:855982_T_G | 24771-24772, 24776, 24792, 24798, 24801, 24809, 24814, 24915-24952 | 24817, 24822-24823, 24839, 24845, 24848-24849, 24862, 24953-24992 | 24865, 24870-24871, 24889, 24894, 24897-24899, 24993-25034 |
| 19:855984_C_A | 24771-24772, 24776, 24792, 25035-25076 | 24817, 24823, 24839, 24845, 25077-25120 | 24871, 24889, 24894, 24897, 25121-25166 |
| 19:855986_A_T | 25038, 25050, 25055, 25066, 25167-25208 | 25077, 25093, 25098, 25103, 25209-25252 | 25122, 25125, 25143, 25149, 25253-25298 |
| 19:855988_G_A | 25170, 25180, 25184, 25195, 25299-25340 | 25212, 25223, 25231, 25244, 25341-25384 | 25272, 25275, 25283, 25290, 25385-25430 |
| 19:855988_G_T | 25170, 25180, 25184, 25195, 25319, 25323, 25326, 25328, 25431-25468 | 25212, 25223, 25231, 25244, 25346, 25358, 25369, 25372, 25469-25508 | 25272, 25275, 25283, 25290, 25386, 25391, 25401, 25405, 25509-25550 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:855989_G_T | 25170, 25184, 25319, 25323, 25326, 25328, 25551-25590 | 25223, 25231, 25346, 25358, 25369, 25372, 25591-25632 | 25283, 25290, 25386, 25391, 25401, 25405, 25633-25676 |
| 19:855997_C_T | 25677-25722 | 25723-25770 | 25771-25820 |
| 19:855998_A_C | 25689, 25693, 25699, 25706, 25720, 25722, 25821-25860 | 25735, 25737, 25739, 25741, 25747, 25770, 25861-25902 | 25783, 25785-25787, 25789, 25797, 25903-25946 |
| 19:855999_CG_C | 25689, 25835, 25853, 25947-25986 | 25735, 25874, 25901, 25987-26028 | 25783, 25940, 25946, 26029-26072 |
| 19:856000_G_A | 25689, 25720, 25835, 25853, 25962, 25979, 25982, 25984, 26073-26110 | 25735, 25770, 25874, 25901, 26007, 26020-26021, 26024, 26111-26150 | 25783, 25797, 25940, 25946, 26046, 26051, 26064, 26071, 26151-26192 |
| 19:856000_G_C | 25689, 25720, 25835, 25853, 25962, 25964, 25979, 25982, 25984, 26193-26229 | 25735, 25770, 25874, 25901, 26002, 26007, 26020-26021, 26024, 26230-26268 | 25783, 25797, 25940, 25946, 26044, 26046, 26051, 26064, 26071, 26269-26309 |
| 19:856000_G_T | 25689, 25720, 25835, 25853, 25962, 25979, 25982, 25984, 26310-26347 | 25735, 25770, 25874, 25901, 26007, 26020-26021, 26024, 26348-26387 | 25783, 25797, 25940, 25946, 26046, 26051, 26064, 26071, 26388-26429 |
| 19:856001_G_A | 25835, 25853, 25962, 25967, 25971, 25979, 25982, 25984-25986, 26430-26465 | 25874, 25901, 26007-26008, 26020-26021, 26024, 26026-26028, 26466-26503 | 25940, 25946, 26046, 26051-26052, 26064-26065, 26069, 26071-26072, 26504-26543 |
| 19:856001_G_T | 25835, 25853, 25962, 25967, 25979, 25982, 25984, 26451, 26544-26581 | 25874, 25901, 26007, 26020-26021, 26024, 26026, 26483, 26582-26621 | 25940, 25946, 26046, 26051, 26064-26065, 26071, 26533, 26622-26663 |
| 19:856007_C_T | 26664-26709 | 26710-26757 | 26758-26807 |
| 19:856008_CT_C | 26670, 26685, 26688, 26696, 26808-26848 | 26710, 26716, 26731, 26745, 26849-26891 | 26758, 26770, 26793, 26798, 26892-26936 |
| 19:856015_G_A | 26937-26982 | 26983-27027 | 27028-27075 |
| 19:856018_CG_C | 27076-27114 | 27115-27152 | 27153-27193 |
| 19:856019_G_A | 27077-27078, 27090, 27097, 27100, 27194-27234 | 27116-27118, 27135, 27144, 27235-27277 | 27155, 27160, 27175, 27183, 27185, 27278-27322 |
| 19:856021_G_T | 27077, 27090, 27096-27097, 27104, 27195, 27323-27362 | 27116-27117, 27128, 27141, 27144, 27239, 27363-27404 | 27154, 27160, 27168, 27183, 27185, 27287, 27405-27448 |
| 19:856025_G_A | 27076, 27449-27493 | 27134, 27494-27540 | 27181, 27541-27589 |

TABLE 1-continued

Guide sequences designed to target mutant alleles the ELANE gene

| Target | SEQ ID NOs: of 20 base guides | SEQ ID NOs: of 21 base guides | SEQ ID NOs: of 22 base guides |
|---|---|---|---|
| 19:856026_CT_T | 27454, 27463, 27480-27481, 27491, 27493, 27590-27628 | 27494, 27500, 27509, 27526, 27535, 27540, 27629-27665 | 27541, 27547-27548, 27557, 27562, 27584, 27666-27706 |
| 19:856029_C_A | 27611, 27625, 27707-27750 | 27633, 27664, 27751-27796 | 27671, 27706, 27797-27844 |
| 19:856034_C_A | 27845-27890 | 27891-27938 | 27939-27988 |
| 19:856036_G_T | 27845, 27852, 27861, 27887, 27989-28030 | 27898, 27915, 27935, 27938, 28031-28073 | 27960, 27963, 27970, 27988, 28074-28119 |
| 19:856043_AC_A | 28120-28158 | 28159-28199 | 28200-28242 |
| 19:856044_C_A | 28122, 28127, 28130-28131, 28142, 28150, 28243-28282 | 28161, 28163, 28167, 28170, 28182, 28198, 28283-28324 | 28208, 28211, 28221, 28224, 28236, 28241, 28325-28368 |
| 19:856044_C_G | 28122, 28127, 28130, 28142, 28150, 28247, 28261, 28268, 28369-28406 | 28163, 28167, 28170, 28182, 28198, 28301, 28308, 28313, 28407-28446 | 28211, 28221, 28224, 28236, 28241, 28351, 28356, 28359, 28447-28488 |
| 19:856047_CG_C | 28139, 28146, 28158, 28489-28530 | 28179, 28186, 28190, 28531-28574 | 28204, 28228, 28232, 28575-28620 |
| 19:856056_TG_T | 28621-28665 | 28666-28712 | 28713-28761 |
| 19:856056_T_TCCCCCCCCCCCCATA | 28627, 28631, 28640-28641, 28644, 28648-28653, 28658, 28762-28765 | 28672, 28677, 28687, 28690, 28694-28699, 28704-28705, 28766-28769 | 28719, 28724, 28735-28736, 28739, 28743-28748, 28753, 28770-28773 |
| 19:856057_GC_G | 28655, 28662, 28664, 28774-28809 | 28673, 28701, 28711, 28810-28847 | 28720, 28725, 28750, 28848-28887 |
| 19:856057_G_C | 28627, 28631, 28640-28641, 28648-28653, 28655-28656, 28658, 28662, 28664, 28763, 28765, 28888-28916 | 28672-28673, 28677, 28687, 28694-28699, 28701, 28704-28705, 28709, 28711, 28766-28767, 28917-28947 | 28719-28720, 28724-28725, 28735-28736, 28743-28748, 28750, 28753, 28760, 28771, 28773, 28948-28980 |
| 19:856061_CG_C | 28792, 28803, 28981-29021 | 28829, 28840, 29022-29064 | 28867, 28873, 29065-29109 |
| 19:856064_T_A | 28792, 28984, 28988, 29012-29013, 29110-29150 | 28840, 29029, 29044, 29047, 29055, 29151-29193 | 28867, 29086, 29088, 29091, 29101, 29194-29238 |
| 19:856064_T_G | 28792, 28984, 28988, 29012-29013, 29119, 29127, 29134, 29239-29276 | 28840, 29029, 29044, 29047, 29055, 29154, 29169, 29185, 29277-29316 | 28867, 29086, 29088, 29091, 29101, 29224, 29228, 29230, 29317-29358 |
| 19:856069_CA_C | 29359-29403 | 29404-29450 | 29451-29499 |
| 19:856069_C_T | 29364-29365, 29368, 29378, 29382, 29384, 29500-29539 | 29409, 29421, 29425, 29429, 29431, 29441, 29540-29581 | 29456, 29459, 29467, 29469, 29473, 29490, 29582-29625 |

TABLE 1-continued

Guide sequences designed to target mutant
alleles the ELANE gene

| Target | SEQ ID NOs: of 20 base guides | SEQ ID NOs: of 21 base guides | SEQ ID NOs: of 22 base guides |
|---|---|---|---|
| 19:856081_T_C | 29626-29671 | 29672-29719 | 29720-29769 |
| 19:856081_T_G | 29638-29639, 29641, 29644, 29646, 29652, 29659, 29669, 29770-29807 | 29677, 29685-29686, 29688, 29693, 29699-29700, 29707, 29808-29847 | 29725, 29733-29734, 29741-29742, 29748-29749, 29763, 29848-29889 |
| 19:856083_G_A | 29641, 29644, 29646, 29652, 29890-29931 | 29677, 29686, 29688, 29700, 29932-29975 | 29725, 29733-29734, 29742, 29976-30021 |
| 19:856083_G_C | 29641, 29644, 29646, 29652, 29895, 29906, 29914, 29917, 30022-30059 | 29677, 29686, 29688, 29700, 29945, 29949, 29955, 29958, 30060-30099 | 29725, 29733-29734, 29742, 29988, 29990-29991, 30001, 30100-30141 |
| 19:856084_A_T | 29644, 29652, 29895, 29906, 29914, 29917, 30142-30181 | 29677, 29688, 29945, 29949, 29955, 29958, 30182-30223 | 29734, 29742, 29988, 29990-29991, 30001, 30224-30267 |
| 19:856085_T_A | 29895, 29906, 29914, 29917, 30162, 30176, 30268-30307 | 29945, 29949, 29955, 29958, 30195, 30209, 30308-30349 | 29988, 29990-29991, 30001, 30248, 30259, 30350-30393 |
| 19:856087_G_T | 30162, 30176, 30280, 30292, 30394-30435 | 30195, 30209, 30340, 30345, 30436-30479 | 30248, 30259, 30365, 30379, 30480-30525 |
| 19:856106_C_T | 30526-30571 | 30572-30619 | 30620-30669 |
| 19:856108_G_A | 30540, 30556, 30559, 30566, 30670-30711 | 30579, 30602, 30604, 30614, 30712-30755 | 30627, 30643, 30649, 30651, 30756-30801 |
| 19:856111_G_T | 30673, 30695, 30802-30845 | 30733, 30738, 30846-30890 | 30770, 30772, 30891-30938 |
| 19:856144_C_T | 30939-30974 | 30975-31001 | 31002-31030 |
| 19:856145_C_T | 30953, 30970, 30974, 31031-31063 | 30986, 30998, 31001, 31064-31089 | 31009, 31015, 31030, 31090-31117 |

The indicated locations listed in column 1 of the Table 1 are based on gnomAD v3 database and UCSC Genome Browser assembly ID: hg38, Sequencing/Assembly provider ID: Genome Reference Consortium Human GRCh38.p12 (GCA_000001405.27). Assembly date: December 2013 initial release; December 2017 patch release 12. The SNP details are indicated by the listed SNP ID NOs. ("rs numbers"), which are based on the NCBI 2018 database of Single Nucleotide Polymorphisms (dbSNP)). The indicated DNA mutations are associated with Transcript Consequence NM_001972 as obtained from NCBI RefSeq genes.

For the foregoing embodiments, each embodiment disclosed herein is contemplated as being applicable to each of the other disclosed embodiment. For example, it is understood that any of the RNA molecules or compositions of the present invention may be utilized in any of the methods of the present invention.

As used herein, all headings are simply for organization and are not intended to limit the disclosure in any manner. The content of any individual section may be equally applicable to all sections.

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only.

Further, the examples herein below disclose methods utilizing SpCas9 and guide sequences suitable to target the SpCas9 to the disclosed ELANE pathogenic mutation sequences. The examples demonstrate the feasibility of the strategies disclosed. A person having ordinary skill in the art would understand that the same guides sequences may be used with different CRISPR nuclease to target the disclosed mutations to apply each of the specified strategies. Further, different guide sequences that target other CRISPR nucleases to the same mutations may be used together with the other nucleases to apply each of the specified strategies.

Experimental Details

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only.

CRISPR repeat (crRNA), transactivating crRNA (tracrRNA), nuclease polypeptide sequences, and PAM sequences were predicted from different metagenomic databases of sequences of environmental samples. The list of bacterial species/strains from which the CRISPR repeat, tracRNA and nuclease sequences were predicted is provided in Table 2.

TABLE 2

DNA and Protein Sequences of Nucleases

| Name | Source Organism | Protein Sequence SEQ ID NO: | Original ORF DNA Sequence SEQ ID NO: | Human optimized DNA Sequence SEQ ID NO: |
|---|---|---|---|---|
| OMNI-39 | Butyrivibrio sp. AC2005 | 31123 | 31127 | 31128 |
| OMNI-40 | Aliiarcobacter faecis | 31124 | 31129 | 31130 |
| OMNI-50 | Ezakiella peruensis strain M6.X2 | 31125 | 31131 | 31132 |
| OMNI-53 | Clostridium sp. AF02-29 | 31126 | 31133 | 31134 |

Construction of OMNI Nuclease Polypeptides

For construction of OMNI nuclease polypeptides, the open reading frame of each nuclease (OMNI) that was identified was codon optimized for *E. coli* and for human cell line expression. The *E. coli* optimized ORF was cloned into bacterial plasmid pb-NNC and the human optimized into the pmOMNI plasmid (Table 3).

TABLE 3 APPENDIX

Details of construct elements

| Element | Protein Sequence | DNA sequence |
|---|---|---|
| HA Tag | SEQ ID NO: 31141 | SEQ ID NO: 31142 |
| NLS | SEQ ID NO: 31143 | SEQ ID NO: 31144 |
| P2A | SEQ ID NO: 31145 | SEQ ID NO: 31146 |
| mCherry | SEQ ID NO: 31147 | SEQ ID NO: 31148 |

Prediction and Construction of sgRNA.

For each OMNI the sgRNA was predicted by detection of the CRISPR repeat array sequence (crRNA) and a transactivating crRNA (tracrRNA) in the bacterial genome. The native pre-mature crRNA and tracrRNA sequences were connected in-silico with tetra-loop 'gaaa' and the secondary structure elements of the duplex were predicted by using an RNA Secondary Structure prediction Web Tool available at rna.urmc.rochester.edu.

The predicted secondary structures of the full duplex RNA elements (crRNA-tracrRNA chimera) was used for identification of possible "nexus" and "hairpins" and the design of sgRNAs for each nuclease with various versions. By shortening the duplex at the upper stem at different locations, the crRNA and tracrRNA were connected with tetra-loop 'gaaa', thus generating possible sgRNA scaffolds (all sgRNA designs of all OMNIs are listed in Table 4). At least two versions of possible designed scaffolds for each OMNI were synthesized and 5' connected to a 22 nucleotide universal unique spacer sequence (T1, SEQ ID NO: 31149) and were cloned into a bacterial Guide expressing plasmid under a constitutive promoter and a mammalian expressing plasmid under a U6 promoter (pbGuide and pmGuide, accordantly, Table 3).

In order to overcome potential transcriptional and structural constraints and to assess the plasticity of the sgRNA scaffold in the human cellular environmental context, several versions of sgRNA were tested. In each case, the modifications represent small variations in the nucleotide sequence within the duplex and/or hairpins that were introduced to several synthetic sgRNAs (Table 4).

TABLE 3

Plasmids and Constructs

| Plasmid | Purpose | Elements | Example | SEQ ID NO (DNA Sequence) |
|---|---|---|---|---|
| pbNNC-2 | Expressing OMNI polypeptide in the bacterial system | T7 promoter HA Tag-Linker-OMNI ORF (Human optimized) - T7 terminator | pbNNC2 OMNI39 | 31135 |
| pbGuide T1/T2 | Expressing OMNI sgRNA in the bacterial system | J23119 promoter - T1/T2 spacer sgRNA scaffold - rrnB T1 terminator | pbGuide OMNI39 T2 sgRNA V2 | 31136 |
| pbPOS T2 library | Bacterial/TXTL depletion assay | T2 protospacer - 8N PAM library - chloramphenicol acetyltransferase | pbPOS T2 library | 31137 |
| pET9a | Expression and purification of OMNI proteins | T7 promoter - SV40 NLS - OMNI ORF (human optimized) - HA - SV40 NLS - 8 His-tag - T7 terminator | pET9a OMNI50-HisTag | 31138 |
| pmOMNI | Expressing OMNI polypeptide in the mammalian system | CMV promoter - Kozak - SV40 NLS - OMNI ORF (human optimized) - HA - SV40 NLS - P2A - mCherry - bGH poly(A) signal | pmOMNI OMNI39 | 31139 |
| pmGuide Endogenic site | Expressing OMNI sgRNA in the mammalian system | U6 promoter - Endogenic spacer sgRNA scaffold | pmGuide OMNI39 CXCR4 sgRNA V3 | 31140 |

T1
(SEQ ID NO: 31149)
GGTGCGGTTCACCAGGGTGTCG

T2
(SEQ ID NO: 31150)
ggAAGAGCagagccttGGTCTC

TABLE 4

| | | Guides | | | |
|---|---|---|---|---|---|
| | | OMNI-39 | OMNI-40 | OMNI-50 | OMNI-53 |
| crRNA:trac rRNA duplex V1 | lower + upper stem of crRNA | GUUUUAGUA CCUAGAG (SEQ ID NO: 31151) | GUUUUGUUA CCAUAUG (SEQ ID NO: 31161) | GUUUGAGAG UUAUG (SEQ ID NO: 31171) | GUUUGAGAA CCAUG (SEQ ID NO: 31182) |
| | upper + lower stem of tracrRNA | CUUUAGACC UACUAAAAU (SEQ ID NO: 31152) | UAUAUGACC UAACAAAAC (SEQ ID NO: 31162) | CAUGACGAG UUCAAAU (SEQ ID NO: 31172) | CAUGGUGAG UGCAAAU (SEQ ID NO: 31183) |
| crRNA:trac rRNA duplex V2 | lower + upper stem of crRNA | GUUUUAGUA CCUAGAGAA A (SEQ ID NO: 31153) | GUUUUGUUA CCAUAUGAU U (SEQ ID NO: 31163) | GUUUGAGAG UUAUGUAA (SEQ ID NO: 31173) | GUUUGAGAA CCAUGUAA (SEQ ID NO: 31184) |
| | upper + lower stem of tracrRNA | UUUCUUUAG ACCUACUAA AAU (SEQ ID NO: 31154) | AUUUAUAUG ACCUAACAA AAC (SEQ ID NO: 31164) | UUACAUGAC GAGUUCAAA U (SEQ ID NO: 31174) | UUACAUGGU GAGUGCAAA U (SEQ ID NO: 31185) |
| | tracrRNA (Nexus + hairpins) | AAGGCUUUA UGCCGAGAU UAAAGGAUG CCGACGGGC AUCcuuuuu u (SEQ ID NO: 31155) | AAGGGUUUA UCCCGGACU CGGCUCUUC GGAGCCUUU UU (SEQ ID NO: 31165) | AAAAAUUUA UUCAAACCG CCUAUUUAU AGGCCGCAG AUGUUCUGC AUUAUGCUU GCUAUUGCA AGCUUUUUU (SEQ ID NO: 31175) | AAGGAUUAU CCGAAAUUG UAUGCCCGC CAAUAAAAA GGCUCGAAA GAGUCUUUU U (SEQ ID NO: 31186) |
| | Nexus | GGCUUUAUG CC (SEQ ID NO: 31156) | GGGUUUAUC CC (SEQ ID NO: 31166) | GCCUAUUUA UAGGC (SEQ ID NO: 31176) | GGAUUAUCC UAGGC |
| | hairpin | AAGGAUGCC GACGGGCAU CCUUU (SEQ ID NO: 31157) | GGCUCUUCG GAGCC (SEQ ID NO: 31167) | GCAGAUGUU CUGCAUUAU GCUUGCUAU UGCAAGC (SEQ ID NO: 31177) | UGUAUGCCC GCAUUGUGC GGCAAUAAA AAGGCUCGA AAGAGUCUU U (SEQ ID NO: 31187) |
| | sgRNA V1 | GUUUUAGUA CCUAGAGga aaCUUUAGA CCUACUAAA AUAAGGCUU UAUGCCGAG UUCCGACGG GCAUCCUUU UUU (SEQ ID NO: 31158) | GUUUUGUUA CCAUAUGga aaUAUAUGA CCUAACAAA ACAAGGGUU UAUCCCGGA UCGGAGCCU UCGGAGCCU UUUU (SEQ ID NO: 31168) | GUUUGAGAG UUAUGgaaa CAUGACGAG UUCAAAUAA AAAUUUAUU CAAACCGCC UAUUUAUAG GCCGCAGAU GUUCUGCAU AUGCUUGC AAUUGCAAG CUUUUUU (SEQ ID NO: 31178) | GUUUGAGAA CCAUGgaaa CAUGGUGAG UGCAAAUAA GGAUUAUCC UAGGCCCGCAU UGUGCGGCA AUAAAAAGG CUCGAAAGA GUCUUUUU (SEQ ID NO: 31188) |
| | sgRNA V2 | GUUUUAGUA CCUAGAGAA AgaaaUUUC UUUAGACCU ACUAAAAUA | GUUUUGUUA CCAUAUGAU UgaaaAUUU AUAUGACCU AACAAAACA | GUUUGAGAG UUAUGUAAg aaaUUACAU GACGAGUUC AAAUAAAAA | GUUUGAGAA CCAUGUAAg aaaUUACAU GGUGAGUGC AAAUAAGGA |

TABLE 4-continued

| | | Guides | | | |
|---|---|---|---|---|---|
| | | OMNI-39 | OMNI-40 | OMNI-50 | OMNI-53 |
| | | AGGCUUUAU GCCGAGAUU AAAGGAUGC CGACGGGCA UCCUUUUUU (SEQ ID NO: 31159) | AGGGUUUAU CCCGGACUC GGCUCUUCG GAGCCUUUU U (SEQ ID NO: 31169) | UUUAUUCAA ACCGCCUAU UUAUAGGCC GCAGAUGUU CUGCAUUAU GCUUGCUAU UGCAAGCUU UUUU (SEQ ID NO: 31179) | UUAUCCGAA AUUGUAUGC CCGCAUUGU GCGGCAAUA AAAAGGCUC GAAAGAGUC UUUUU (SEQ ID NO: 31189) |
| Other variations | sgRNA V3 | GUUUAAGUA CCUAGAGAA AgaaaUUUC UUUAGACCU ACUUAAAUA AGGCUUUAU GCCGAGAUU AAAGGAUGC CGACGGGCA UCCUUUUUU (SEQ ID NO: 31160) | GUUUAGUUA CCAUAUGAU UgaaaAUUU AUAUGACCU AACUAAACA AGGGUUUAU CCCGGACUC GGCUCUUCG GAGCCUUUU U (SEQ ID NO: 31170) | GUUUGAGAG UUAUGUgaa aACAUGACG AGUUCAAAU AAAAAUUUA UUCAAACCG CCUAUUUAU AGGCCGCAG AUGUUCUGC AUUAUGCUU GCUAUUGCA AGCUUUUUU (SEQ ID NO: 31180) | |
| | sgRNA V4 | | | GUUUGAGAG UUAUGUAga aaUACAUGA CGAGUUCAA AUAAAAAUU UAUUCAAAC CGCCUAUUU AUAGGCCGC AGAUGUUCU GCAUUAUGC UUGCUAUUG CAAGCUUUU UU (SEQ ID NO: 31181) | |

TABLE 5

| | | PAMs | | | |
|---|---|---|---|---|---|
| | | OMNI-39 | OMNI-40 | OMNI-50 | OMNI-53 |
| Bacterial Depletion | PAM General | NNGYAD | NYGRV | | NRTA |
| | PAM Specific | NNGYAA | NYGAV | | NRTA |
| | Activity (1-Depletion score)* | 0.99 | 0.95 | | 1.00 |
| TXTL Depletion | PAM General | NNGHAD | NYGRV | NGG | NRHR |
| | PAM Specific | NNGYAA | NYGRV | NGG | NAWA |
| | Activity (1-Depletion score)* | 0.95 | 0.97 | 0.98 | 0.97 |
| | sgRNA | V2 | V2 | V2 | V2 |
| mammalian system | | | VTGAAG | NGG | NRTA |

*Depletion score - Average of the ratios from two most depleted sites
** Depends on OMNI expression and sgRNA transcription Bacterial PAM Depletion Assay.

To confirm that each of the identified loci are functional CRISPR-OMNI nuclease systems and to identify their PAMs, E. coli strain BW25141 (1DE3) was co-transformed with: (1) a library of plasmid pool containing a randomized PAM sequences of 8 N's flanking a unique protospacer (pbPOS T2 library, Table 3), (2) plasmids encoding E. coli codon-optimized OMNI nucleases, pbNNC2 (Table 3) and (3) a plasmid encoding designed sgRNA targeting the protospacer of the library or a non-targeting gRNA as control (pbGuide, T2 and T1 respectively, Table 3). Next, cells were selected for all three plasmids by recovering them on media containing appropriate antibiotics. In this this assay, plasmids containing a PAM are cleaved and the cells that contain them cannot grow, while cells containing plasmids with non-PAMs are able to propagate. A survived plasmid DNA pool was isolated, and the library was sequenced using a 75-cycle NextSeq kit (Illumina). PAM representation in the library was determined using a custom script and compared between OMNI and control. By comparing the frequency of a sequence in the library after selection of the targeting guide (T2) relative to the non-targeting (T1), individual PAM sequences could be identified. The presented data reflect a condensed 4N window library with all possible locations along the 8 bp sequence. Sequence motifs were generated using the Weblogo tool (weblogo.berkeley.edu). Activity of the OMNI nuclease was estimated based on the average of the two most depleted sequences and was calculated as: 1—Depletion score (Depletion score—Average of the ratios from two most depleted sites). OMNI nucleases with scores that are higher than 0.6 were considered as active. Following deep sequencing we detected depletion in the tested OMNI systems, indicating functional DNA interference in a heterologous host (Table 5).

In-Vitro Depletion Assay by TXTL.

Depletion of PAM sequences in-vitro was followed according to Maxwell et al, Methods. 2018. Briefly, linear DNA expressing the OMNI nucleases and the sgRNAs under a T7 promoter were added to a TXTL mix (Arbor Bioscience) together with a linear construct expressing T7 polymerase. RNA expression and protein translation by the TXTL mix results in the formation of the RNP complex. Since linear DNA was used, Chi6 sequences, a RecBCD inhibitor, were added to protect the DNA from degradation. The sgRNA spacer is designed to target a library of plasmids containing the targeting protospacer (pbPOS T2 library, Table 3) flanked by an 8N randomized set of potential PAM sequences. Depletion of PAM sequences from the library is measured by adding the adapters and indices necessary for high-throughput sequencing using PCR to both the cleaved library and to a control library expressing a non-targeting gRNA (T1). Following deep sequencing, the activity was confirmed in-vitro by depletion in 10 out of 10 tested OMNIs, showing similar PAM pattern as discovered in *E. coli* (Table 5). Thus, the in-vitro activity displayed by OMNI nucleases indicated functional DNA interference by in-vitro system (Table 5).

PAM Library in Mammalian System

While a PAM sequence preference is considered an inherent property of the nuclease, it might be effected, to some extent, from the cellular environment and genomic composition and size. Since the human cellular environment is significantly different from the bacterial one with respect to those properties, a "fine tuning" step was introduced to address potential differences in PAM preferences in human cellular context. To this end, a PAM library was constructed in human cell line. In this assay, The PAM library is introduced to the cells using a viral vector, as constant target sequence followed by a stretch of 6×N's. Upon introduction of OMNI and sgRNA targeting the library constant target site, NGS analysis is used to identify the edited sequences and the PAM associated with them. The enriched edited sequences are then used to define the PAM consensus. This method is applied to determine the "human" PAM requirements of OMNI nuclease (Table 5, "mammalian system"). OMNI-50 PAM is identical using TXTL or mammalian system. OMNI-53 PAM is a reduced version of the PAM identified by TXTL. On the other hand OMNI-40 show a more strict PAM compared with TXTL results. OMNI-39 PAM could not be determined using the mammalian system due to low number of editing events.

Expression of OMNI Nucleases Coded by an Optimized DNA Sequence in Mammalian Cells First, expression of each of the optimized DNA sequences coding for each of the OMNI proteins OMNI-39, OMNI-40, OMNI-50, and OMNI-53 in mammalian cells, was validated. To this end, an expression vector coding for an HA-tagged OMNI nuclease or *Streptococcus pyogenes* Cas9 (SpCas9) linked by P2A peptide to mCherry (pmOMNI, Table 3) was introduced into HeLa cells using the Jet-optimus transfection reagent (polyplus-transfection). P2A peptide is a self-cleaving peptide which can induce the cleaving of the recombinant protein in cell, such that the OMNI nucleases and the mCherry are separated upon expression and the mCherry can serve as indicator for transcription efficiency of the OMNI from the expression vector. The level of expression for each OMNI in the activity assays was determined using flow cytometry.

Activity in Human Cells on Endogenous Genomic Targets

OMNIs were also assayed for their ability to promote editing on specific genomic locations in human cells. To this end, per each OMNI the corresponding OMNI-P2A-mCherry expression vector (pmOMNI, Table 3) was transfected into HeLa cells together with sgRNA designed to target a specific location in the human genome (pmGuide, Table 3). At 72 h, cells were harvested, and half were used for quantification of transfection efficiency by FACS using mCherry fluorescence as marker. The rest of the cells were lysed, and their genomic DNA content was used in PCR reaction, amplifying the corresponding putative genomic targets. Amplicons were subjected to NGS and the resulting sequences were then used calculate the percentage of editing events in each target site. Short insertions or deletions (InDels) around the cut site are the typical outcome of repair of DNA ends following nuclease induced DNA cleavage. The calculation of % editing was therefore deduced from the fraction of Indels containing sequences within each amplicon. All editing values were normalized to the transfection and translation efficacy obtained for each experiment and deduced from the percentage of mCherry expressing cells. The normalized values represent the effective editing levels within the population of cells that expressed the nucleases.

Genomic activity of each OMNI was assessed using a panel of 4 to 11 unique sgRNA each design to target a different genomic location. The results of these experiments are summarized in Table 6. As can be seen in the table (column 6, "% editing"), all of the OMNIs exhibit high and significant editing levels compared to the negative control (column 9, "% editing in neg control") in all or most target site tested. OMNI-39 exhibited high and significant editing levels in 2/4 sites tested, OMNI-40 exhibit high and significant editing levels in 3/4 sites tested, OMNI50 exhibited high and significant editing levels in 11/11 sites tested, and OMNI-53 exhibited high and significant editing levels in 3/4 sites tested.

TABLE 6

Activity in human cells on endogenous genomic targets

| Nuclease | Genomic site | Corresponding Spacer name | Spacer sequence | 3' (PAM containing) genomic seq (PAM = Bold) | % indels | % transfection |
|---|---|---|---|---|---|---|
| OMNI-39 | CXCR4 site 1 | CXCR4g1_OMNI39 | CCAAGUG AUAAACA CGAGGA (SEQ ID NO: 31190) | TGGCAAGA | 49.8-73.2 | 67.13 |

TABLE 6-continued

| | | Activity in human cells on endogenous genomic targets | | | | |
|---|---|---|---|---|---|---|
| | EMX1 site 1 | EMX1g1_OMNI39 | GUCACCU CCAAUGA CUAGGGU (SEQ ID NO: 31191) | GGGCAACC | 3.9-6.3 | |
| | EMX1 site 2 | EMX1g2_OMNI39 | GCCGCCA UUGACAG AGGGAC (SEQ ID NO: 31192) | AAGCAATG | 22.8-54.7 | |
| | PDCD1 site 1 | PDCD1g1_OMNI39 | AACUGGU ACCGCAU GAGCCC (SEQ ID NO: 31193) | CAGCAACC | 3.71 | 73.67 |
| OMNI-40 | EMX1 site 1 | EMX1g1_OMNI40 | CAUCAGG CUCUCAG CUCAGC (SEQ ID NO: 31194) | CTGAGTGT | 25-37.5 | 50.33 |
| | CXCR4 site 2 | CXCR4g2_OMNI40 | AGGUGCC GUUUGUU CAUUUU (SEQ ID NO: 31195) | CTGACACT | 0.20 | 53.60 |
| | PDCD1 site 2 | PDCD1g1_OMNI40 | CCAGUUG UAGCACC GCCCAG (SEQ ID NO: 31196) | ACGACTGG | 23.59 | 28.33 |
| | PDCD1 site 3 | PDCD1g2_OMNI40 | UCUCCCC AGCCCUG CUCGUG (SEQ ID NO: 31197) | GTGACCGA | 16.66 | 49.00 |
| OMNI-50 | EMX1 site 2 | EMX1g1_OMNI50 | UCUGUGA AUGUUAG ACCCAU (SEQ ID NO: 31198) | GGGAGCAG | 44.18-25.72 | |
| | EMX1 site 3 | EMX1g2_OMNI50 | CCAUGGG AGCAGCU GGUCAG (SEQ ID NO: 31199) | AGGGGACC | 55.81 | |
| | CXCR4 site 3 | CXCR4g1_OMNI50 | GCAAGAG ACCCACA CACCGG (SEQ ID NO: 31200) | AGGAGCGC | 29.58-32.14 | |
| | CXCR4 site 4 | CXCR4g2_OMNI50 | ACACCGG AGGAGCG CCCGCU (SEQ ID NO: 31201) | TGGGGAG | 42.13-49.85 | |
| | PDCD1 site 4 | PDCD1g1_OMNI50 | CGUCUGG GCGGUGC UACAAC (SEQ ID NO: 31202) | TGGGCTGG | 13.35-8.7 | |

TABLE 6-continued

Activity in human cells on endogenous genomic targets

| | | | | | | |
|---|---|---|---|---|---|---|
| | PDCD1 site 5 | PDCD1g2_OMNI50 | CUACAAC UGGGCUG GCGGCC (SEQ ID NO: 31203) | AGGATGGT | 17.53 | |
| | ELANE g35 | ELANEg35_OMNI50 | AGUCCGG GCUGGGA GCGGGU (SEQ ID NO: 31204) | GGGGAGCA | 40.92-55.39 | |
| | ELANE g58 | ELANEg58_OMNI50 | GCUGCGG GAAAGGG AUUCCC (SEQ ID NO: 31205) | TGGGACTC | 11.11 | 20.50 |
| | ELANE g38 | ELANEg38_OMNI50 | ACAGCGG GUGUAGA CUCCGA (SEQ ID NO: 31206) | GGGGGACG | 9.99 | |
| | ELANE g39 | ELANEg39_OMNI50 | CAGCGGG UGUAGAC UCCGAG (SEQ ID NO: 31207) | GGGGACGT | 24.87 | |
| | ELANE g62 | ELANEg62_OMNI50 | GUCAAGC CCCAGAG GCCACA (SEQ ID NO: 31208) | GGGACAGA | 38.87-52.74 | |
| OMNI-53 | EMX1 site 4 | EMXg1_OMNI53 | GCCUGGG GCCCCUA ACCCUA (SEQ ID NO: 31209) | TGTAGCCT | 18.3-36.7 | 49.63 |
| | CXCR4 site 5 | CXCR4g2_OMNI53 | AUUUUCU GACACUC CCGCCC (SEQ ID NO: 31210) | AATATACC | 14.1-12.5 | 38.33 |
| | PDCD1 site 6 | PDCD1g1_OMNI53 | AUCCUGG CCGCCAG CCCAGU (SEQ ID NO: 31211) | TGTAGCAC | 11.5 | 51.27 |
| | PDCD1 site 7 | PDCD1g2_OMNI53 | GGAGAGC UUCGUGC UAAACU (SEQ ID NO: 31212) | GGTACCGC | 1.93 | 30.30 |

| Nuclease | Genomic site | Norm. % editing | % editing in neg control | % transfection in neg control | Norm. % editing in neg control |
|---|---|---|---|---|---|
| OMNI-39 | CXCR4 site 1 | | 0.08 | 76.70 | 0.107791557 |
| | EMX1 site 1 | | | | |
| | EMX1 site 2 | | | | |
| | PDCD1 site 1 | 5.03 | 0.07 | 76.70 | 0.086641622 |

TABLE 6-continued

Activity in human cells on endogenous genomic targets

| | | | | | |
|---|---|---|---|---|---|
| OMNI-40 | EMX1 site 1 | | 0.12 | 53.37 | 0.231979262 |
| | CXCR4 site 2 | 0.37 | 0.21 | 53.37 | 0.396940137 |
| | PDCD1 site 2 | 83.25 | 0.09 | 53.37 | 0.174121445 |
| | PDCD1 site 3 | 34.00 | 0.01 | 0.18 | 8.107932801 |
| OMNI-50 | EMX1 site 2 | | 0.02 | | |
| | EMX1 site 3 | | | | |
| | CXCR4 site 3 | | 0.18 | | |
| | CXCR4 site 4 | | 0.22 | | |
| | PDCD1 site 4 | | 0.05 | | |
| | PDCD1 site 5 | | | | |
| | ELANE g35 | | 0.24 | 5.95 | 3.982225429 |
| | ELANE g58 | 54.23 | 0.18 | 5.95 | 2.974553445 |
| | ELANE g38 | | | | |
| | ELANE g39 | | | | |
| | ELANE g62 | | 0.12 | 5.95 | 2.002503126 |
| OMNI-53 | EMX1 site 4 | | 0.15 | 43.80 | 0.333213614 |
| | CXCR4 site 5 | | 0.22 | 43.80 | 0.509942217 |
| | PDCD1 site 6 | 22.50 | 0.05 | 43.80 | 0.105935337 |
| | PDCD1 site 7 | 6.38 | 0.01 | 43.80 | 0.019429028 |

Intrinsic Fidelity in Human Cells

Figure 2:
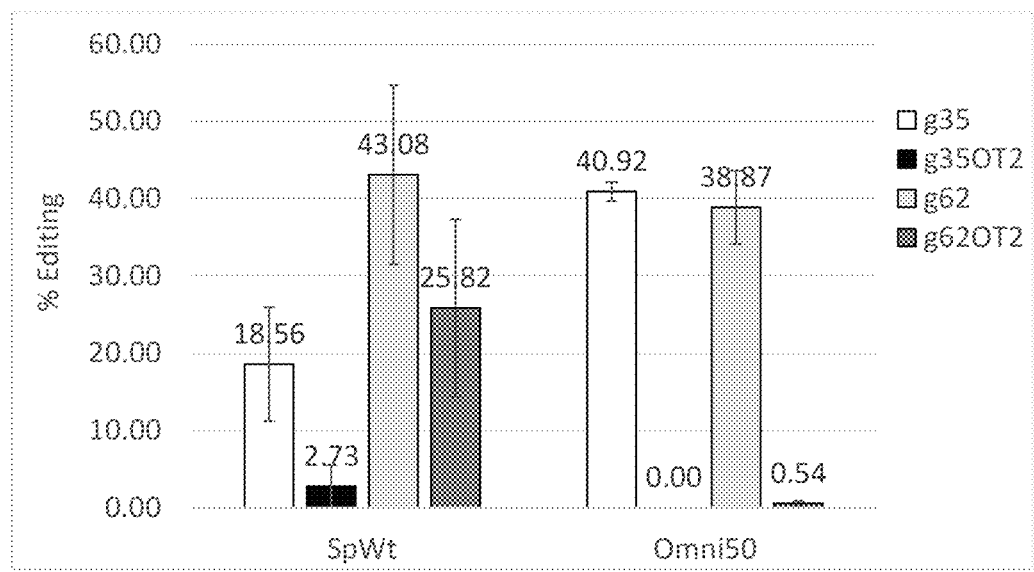
FIG. 2: Intrinsic fidelity in human cells. OMNI-50 or SpCas9 nuclease was expressed in a mammalian cell system by DNA transfection together with a sgRNA-expressing plasmid. Cell lysates were used for site specific genomic DNA amplification and NGS. The percentage of indels was measured and analyzed to compare on-target vs off-target editing in HeLa cell line using ELANEg35_OMNI50 or ELANEg62_OMNI50 (see Table 3). In both cases, the genomic On and Off target sequences are noted below the chart with the PAM sequence underlined. Each experiment represents three (3) independent repeats.

The intrinsic fidelity of a nuclease is a measure of its cleavage specificity. High fidelity nuclease is a nuclease that promotes cleavage on the intended target ("on-target") with minimal or no cleavage of the unintended target ("Off-target"). In CRISPR nucleases, the target is acquired based on sequence complementarity to the spacer element of the guide RNA. Off-targeting results from similarity of an unintended target to the spacer sequence. The intrinsic fidelity of OMNIs at the genomic level in human cells was measured by conducting an activity assay, followed by PCR amplification, NGS, and InDel analysis for both the on-target region and a pre-validated off target region. A measurement of intrinsic fidelity for OMNI-50 is provided in FIG. 2. In this example, OMNI-50 fidelity was measured using two guide RNAs independently, in each case a side by side measurement of SpCas9 is provided for reference. The first site was targeted using the ELANE g35 gRNA (Table 6) which has a defined on-target site upstream to the ELANE gene on chr19 and an off-target site on chr15. As can be seen in FIG. 2, the on/off target editing efficiency ratio obtained by OMNI-50 was 41:0 while SpCas9 on/off ratio is 6.8:1 (40.9%/0%; 18.6%/2.7% respectively). The second site was targeted by ELANE g62 gRNA (Table 6). This gRNA spacer sequence has a defined on-target at the ELANE gene on chr19 and an off-target site on chr1. In this case, the On/Off ratio obtained by OMNI-50 was 72:1 compared to 1.7:1 ratio obtained by SpCas9 (38.9%/0.6%; 43.1%/25.8% respectively). These results demonstrate that OMNI-50 has a significantly higher intrinsic fidelity in comparison to SpCas9 in human cellular environment.

Purification of OMNIs Protein.

The OMNI-50 open-reading frame was cloned into bacterial expression plasmids (T7-NLS-OMNI-NLS-HA-His-tag, pET9a, Table 3) and expressed in C43 cells (Lucigen). Cells were grown in Terrific Broth to mid-log phase and the temperature was lowered to 18° C. Expression was induced at 0.6 OD with 1 mM IPTG for 16-20 h before harvesting and freezing cells at −80° C. Cell paste was resuspended in lysis buffer (50 mM $NaH_2PO_4$, 300 mM NaCl, 10 mM imidazole pH8.0, 1 mM TCEP) supplemented with EDTA-free complete protease inhibitor cocktail set III (Calbiochem). Cells were lysed using sonication and cleared lysate was incubated with Ni-NTA resin. The resin was loaded onto gravity column and washed with wash buffer (50 mM $NaH_2PO_4$, 300 mM NaCl, 50 mM imidazole pH8.0, 1 mM TCEP) and OMNI protein eluted with wash buffer supplemented with 100-500 mM Imidazole. Fractions containing OMNI protein were pooled and concentrated and loaded onto a centricone (Amicon Ultra 15 ml 100K, Merck), and buffer exchanged to GF buffer (50 mM Tris-HCl pH 7.5, 500 mM NaCl, 10% glycerol, 0.4M Arginine). The concentrated OMNI protein was further purified by SEC on HiLoad 16/600 Superdex 200 µg-SEC, AKTA Pure (GE Healthcare Life Sciences) with a 50 mM Tris-HCl pH 7.5, 500 mM NaCl, 10% glycerol, 0.4M Arginine. Fractions containing OMNI protein were pooled and concentrated and loaded onto a centricone (Amicon Ultra 15 ml 100K, Merck) with a final storage buffer of 10 mM Tris-HCl, pH 7.5, 150 mM NaCl, 10% glycerol and 1 mM TCEP. Purified OMNI protein was concentrated to 10 mg/ml stocks and flash-frozen in liquid nitrogen and stored at −80° C.

Guide Optimization by RNP Activity Assay.

Figure 3A:
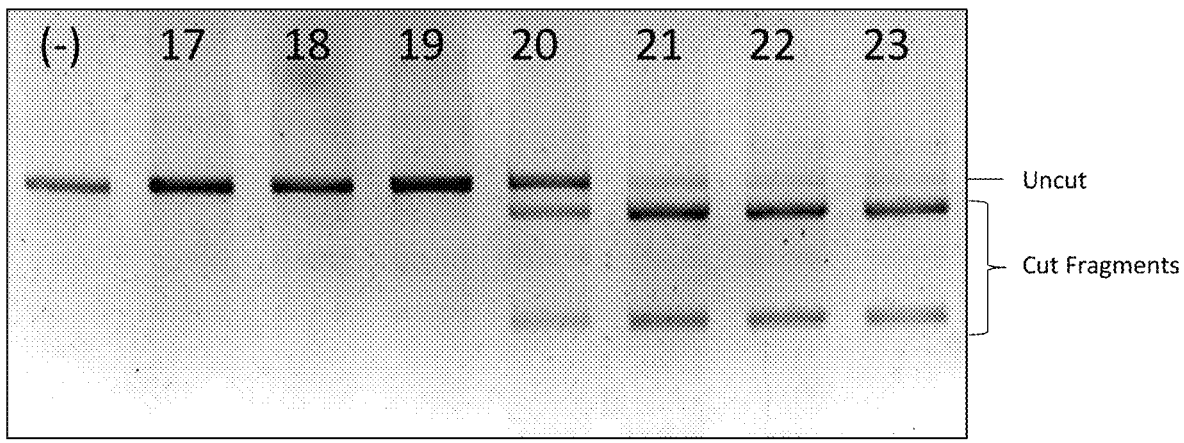
FIGS. 3A-3D: OMNI-50 activity Assay as RNP. OMNI-50 nuclease was over-expressed and purified. The purified protein was complexed with synthetic sgRNA to form RNPs. For the in-vitro assays (FIG. 3A and FIG. 3B) RNPs were incubated with a linear DNA template with the corresponding target and PAM sequences (listed in Table 5). Activity was verified by the ability to cleave the linear template. For the in-vivo assays (FIG. 3C and FIG. 3D) U2OS cells were electroporated with RNP, and activity was determined as indel frequency by NGS.
Figure 3B:
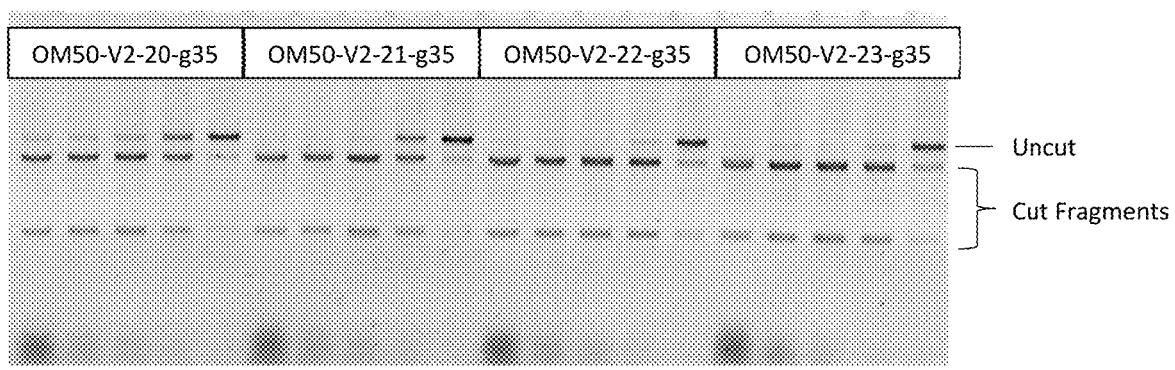

Synthetic sgRNAs of OMNI-50 were synthesized with three 2'-O-methyl 3'-phosphorothioate at the 3' and 5' ends (Agilent). Activity assay of OMNI-50 RNP with different spacer lengths (17-23 nucleotides) of guide 35 (Table 7, FIG. 3A). Briefly, 4 pmol of OMNI-50 nuclease were mixed with 6 pmol of synthetic guide. After 10 min of incubation at room-temp, the RNP complexes were reacted with 100 ng template of On-target. Only spacer larger than 22 nucleotides show near full cleavage of the On-target template. Furthermore, reducing amounts of RNPs (4, 2, 1.2, 0.6 and 0.2 pmol) with spacer lengths 20-23 were reacted with 100 ng DNA target template (FIG. 3B) Spacer at lengths of 22 nucleotides showed better cleavage activity even at lower RNP concentrations.

TABLE 7

| | synthetic sgRNA (RNP) | | |
|---|---|---|---|
| | Name | | |
| | O50_ELANE_V2_g35_23 | O50_ELANE_V2_g35_22 | O50_ELANE_V2_g35_21 |
| Spacer | UgcAGUCCGGGCUGGGAGCGGGU (SEQ ID NO: 31213) | gcAGUCCGGGCUGGGAGCGGGU (SEQ ID NO: 31217) | cAGUCCGGGCUGGGAGCGGGU(SEQ ID NO: 31219) |
| Scaffold | gUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31179) | gUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31179) | gUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31179) |
| Version | V2 | V2 | V2 |
| Full sgRNA sequence | UgcAGUCCGGGCUGGGAGCGGGUgUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31214) | gcAGUCCGGGCUGGGAGCGGGUgUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31218) | cAGUCCGGGCUGGGAGCGGGUgUUUGAGAGUUAUGUAAgaaaUUACAUGACGAGUUCAAAUAAAAAUUUAUUCAAACCGCCUAUUUAUAGGCCGCAGAUGUUCUGCAUUAUGCUUGCUAUUGCAAGCUUUUUU (SEQ ID NO: 31220) |

TABLE 7-continued

| | synthetic sgRNA (RNP) | | |
|---|---|---|---|
| Protospacer (with PAM = Bold) - On target | CTGTTGCTG CAGTCCGGG CTGGGAGCG GGTGGGGAG CAGAGGG (SEQ ID NO: 31215) | CTGTTGCTG CAGTCCGGG CTGGGAGCG GGTGGGGAG CAGAGGG (SEQ ID NO: 31215) | CTGTTGCTG CAGTCCGGG CTGGGAGCG GGTGGGGAG CAGAGGG (SEQ ID NO: 31215) |
| Protospacer (with PAM = Bold) - Off target | GTTAAGA*ga* CAGTCC*a*GG CTGGGAGC*a* GGTGGGGAG AGGAGGG (SEQ ID NO: 31216) | GTTAAGA*ga* CAGTCC*a*GG CTGGGAGC*a* GGTGGGGAG AGGAGGG (SEQ ID NO: 31216) | GTTAAGA*ga* CAGTCC*a*GG CTGGGAGC*a* GGTGGGGAG AGGAGGG (SEQ ID NO: 31216) |

| | Name | |
|---|---|---|
| | O50_ELANE_V2_g35_20 | O50_ELANE_V2_g35_19 |
| Spacer | AGUCCGGGC UGGGAGCGG GU (SEQ ID NO: 31221) | GUCCGGGCU GGGAGCGGG U (SEQ ID NO: 31223) |
| Scaffold | gUUUGAGAG UUAUGUAAg aaaUUACAU GACGAGUUC AAAUAAAAA UUUAUUCAA ACCGCCUAU UUAUAGGCC GCAGAUGUU CUGCAUUAU GCUUGCUAU UGCAAGCUU UUUU (SEQ ID NO: 31179) | gUUUGAGAG UUAUGUAAg aaaUUACAU GACGAGUUC AAAUAAAAA UUUAUUCAA ACCGCCUAU UUAUAGGCC GCAGAUGUU CUGCAUUAU GCUUGCUAU UGCAAGCUU UUUU (SEQ ID NO: 31179) |
| Version | V2 | V2 |
| Full sgRNA sequence | AGUCCGGGC UGGGAGCGG GUgUUUGAG AGUUAUGUA AgaaaUUAC AUGACGAGU UCAAAUAAA AAUUUAUUC AAACCGCCU AUUUAUAGG CCGCAGAUG UUCUGCAUU AUGCUUGCU AUUGCAAGC UUUUUU (SEQ ID NO: 31222) | GUCCGGGCU GGGAGCGGG UgUUUGAGA GUUAUGUAA gaaaUUACA UGACGAGUU CAAAUAAAA AUUUAUUCA AACCGCCUA UUUAUAGGC CGCAGAUGU UCUGCAUUA UGCUUGCUA UUGCAAGCU UUUU (SEQ ID NO: 31224) |
| Protospacer (with PAM = Bold) - On target | CTGTTGCTG CAGTCCGGG CTGGGAGCG GGTGGGGAG CAGAGGG (SEQ ID NO: 31215) | CTGTTGCTG CAGTCCGGG CTGGGAGCG GGTGGGGAG CAGAGGG (SEQ ID NO: 31215) |
| Protospacer (with PAM = Bold) - Off target | GTTAAGA*ga* CAGTCC*a*GG CTGGGAGC*a* GGTGGGGAG AGGAGGG (SEQ ID NO: 31216) | GTTAAGA*ga* CAGTCC*a*GG CTGGGAGC*a* GGTGGGGAG AGGAGGG (SEQ ID NO: 31216) |

TABLE 7-continued

| | synthetic sgRNA (RNP) | |
|---|---|---|
| | Name | |
| | O50_ELANE_V2_g35_18 | O50_ELANE_V2_g35_17 |
| Spacer | UCCGGGCUGGG AGCGGGU (SEQ ID NO: 31225) | CCGGGCUGGGA GCGGGU (SEQ ID NO: 31227) |
| Scaffold | gUUUGAGAGUU AUGUAAgaaaU UACAUGACGAG UUCAAAUAAAA AUUUAUUCAAA CCGCCUAUUUA UAGGCCGCAGA UGUUCUGCAUU AUGCUUGCUAU UGCAAGCUUUU UU (SEQ ID NO: 31179) | gUUUGAGAGUU AUGUAAgaaaU UACAUGACGAG UUCAAAUAAAA AUUUAUUCAAA CCGCCUAUUUA UAGGCCGCAGA UGUUCUGCAUU AUGCUUGCUAU UGCAAGCUUUU UU (SEQ ID NO: 31179) |
| Version | V2 | V2 |
| Full sgRNA sequence | UCCGGGCUGGG AGCGGGUgUUU GAGAGUUAUGU AAgaaaUUACA UGACGAGUUCA AAUAAAAAUUU AUUCAAACCGC CUAUUUAUAGG CCGCAGAUGUU CUGCAUUAUGC UUGCUAUUGCA AGUUUUU (SEQ ID NO: 31226) | CCGGGCUGGGA GCGGGUgUUUG AGAGUUAUGUA AgaaaUUACAU GACGAGUUCAA AUAAAAAUUUA UUCAAACCGCC UAUUUAUAGGC CGCAGAUGUUC UGCAUUAUGCU UGCUAUUGCAA GCCUUUUUU (SEQ NO: ID 31228) |
| Protospacer (with PAM = Bold) - On target | CTGTTGCTGCA GTCCGGGCTGG GAGCGGGTGGG GAGCAGAGGG (SEQ ID NO: 31215) | CTGTTGCTGCA GTCCGGGCTGG GAGCGGGTGGG GAGCAGAGGG (SEQ ID NO: 31215) |
| Protospacer (with PAM = Bold) - Off target | GTTAAGA*ga*CA GTCC*a*GGCTGG GAGC*a*GGTGGG GAGAGGAGGG (SEQ ID NO: 31216) | GTTAAGA*ga*CA GTC*a*GGCTGG GAGC*a*GGTGGG GAGAGGAGGG (SEQ ID NO: 31216) |

| | Name | |
|---|---|---|
| | O50_ELANE_V3_g35_20 | O50_ELANE_V4_g35_20 |
| Spacer | AGUCCGGGCUG GGAGCGGGU (SEQ ID NO: 31221) | AGUCCGGGCUG GGAGCGGGU (SEQ ID NO: 31221) |
| Scaffold | gUUUGAGAGUU AUGUgaaaACA UGACGAGUUCA AAUAAAAAUUU AUUCAAACCGC CUAUUUAUAGG CCGCAGAUGUU CUGCAUUAUGC UUGCUAUUGCA AGCUUUUUU (SEQ ID NO: 31180) | gUUUGAGAGUU AUGUAgaaaUA CAUGACGAGUU CAAAUAAAAAU UUAUUCAAACC GCCUAUUUAUA GGCCGCAGAUG UUCUGCAUUAU GCUUGCUAUUG CAAGCUUUUUU (SEQ ID NO: 31181) |

TABLE 7-continued synthetic sgRNA (RNP)

| Version | V3 | V4 |
|---|---|---|
| Full sgRNA sequence | AGUCCGGGCUG GGAGCGGGUgU UUGAGAGUUAU GUgaaaACAUG ACGAGUUCAAA UAAAAAUUUAU UCAAACCGCCU AUUUAUAGGCC GCAGAUGUUCU GCAUUAUGCUU GCUAUUGCAAG CUUUUUUU (SEQ ID NO: 31229) | AGUCCGGGCUG GGAGCGGGUgU UUGAGAGUUAU GUAgaaaUACA UGACGAGUUCA AAUAAAAAUUU AUUCAAACCGC CUAUUUAUAGG CCGCAGAUGUU CUGCAUUAUGC UUGCUAUUGCA AGCUUUUUU (SEQ ID NO: 31230) |
| Protospacer (with PAM = Bold) - On target | CTGTTGCTGCA GTCCGGGCTGG GAGCGGGTGGG GAGCAGAGGG (SEQ ID NO: 31215) | CTGTTGCTGCA GTCCGGGCTGG GAGCGGGTGGG GAGCAGAGGG (SEQ ID NO: 31215) |
| Protospacer (with PAM = Bold) - Off target | GTTAAGA*ga*CA GTCC*a*GGCTGG GAGC*a*GGTGGG GAGAGGAGGG (SEQ ID NO: 31216) | GTTAAGA*ga*CA GTCC*a*GGCTGG GAGC*a*GGTGGG GAGAGGAGGG (SEQ ID NO: 31216) |

Figure 3C:
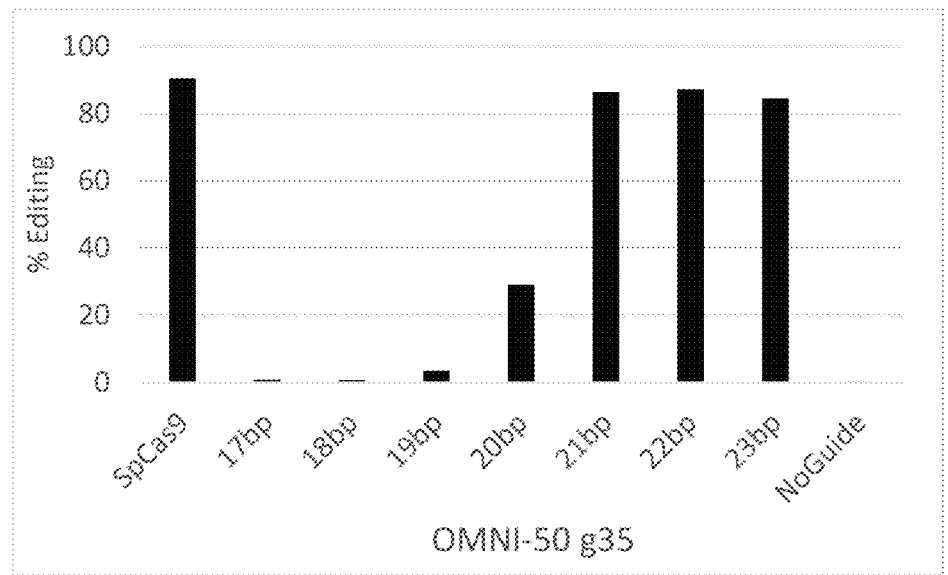

Spacer length optimization was also performed in a cell line context. RNPs were assembled by mixing 100 uM nuclease with 120 uM of synthetic guide with different spacer length (17-23 nt, Table 4) (and 100 uM Cas9 electroporation enhancer (IDT). After 10 mins of incubation at room temperature, the RNP complexes were mixed with 200,000 pre-washed U2OS cells and electroporated using Lonza SE Cell Line 4D-Nucleofector™ X Kit with the DN100 program, according to the manufacturer's protocol. At 72 h cells were lysed, and their genomic DNA content was used in a PCR reaction to amplify the corresponding putative genomic targets. Amplicons were subjected to NGS and the resulting sequences were then used to calculate the percentage of editing events. As can be seen in FIG. 3C, spacers of 17-19 nt show low editing levels, 20 nt spacer shows medium editing levels, and spacers of 21-23 nt show the highest editing levels.

Figure 3D:
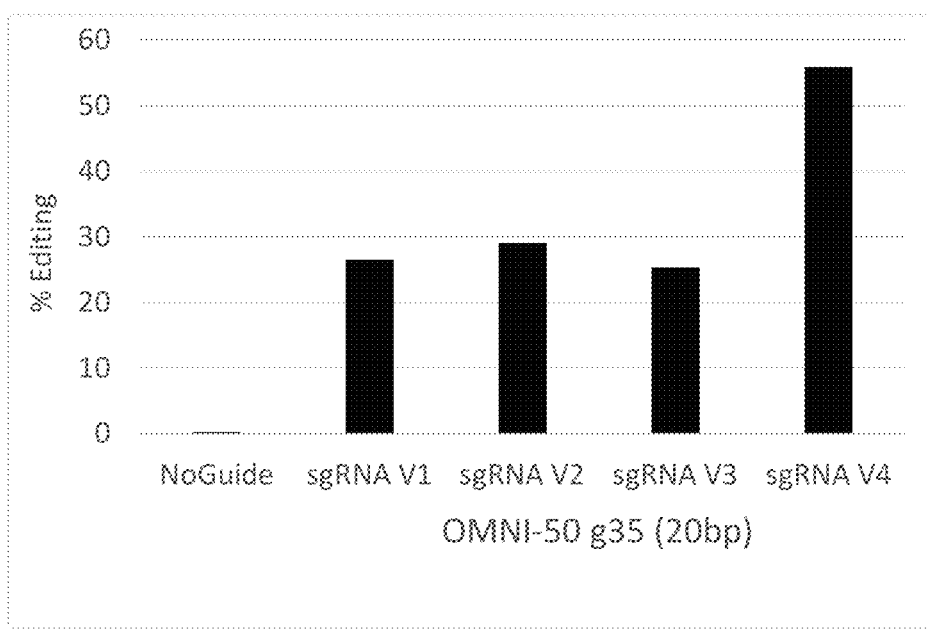

Using the same cell line context, we also tested different versions of tracer RNA modifications (Table 7). The different versions of sgRNA were tested with a 20 nt spacer. As can be seen in FIG. 3D, RNP assembly using either sgRNA V1, V2, and V3 results in similar editing levels. However, RNP assembly using sgRNA V4 results in significantly higher editing level.

Figure 4:
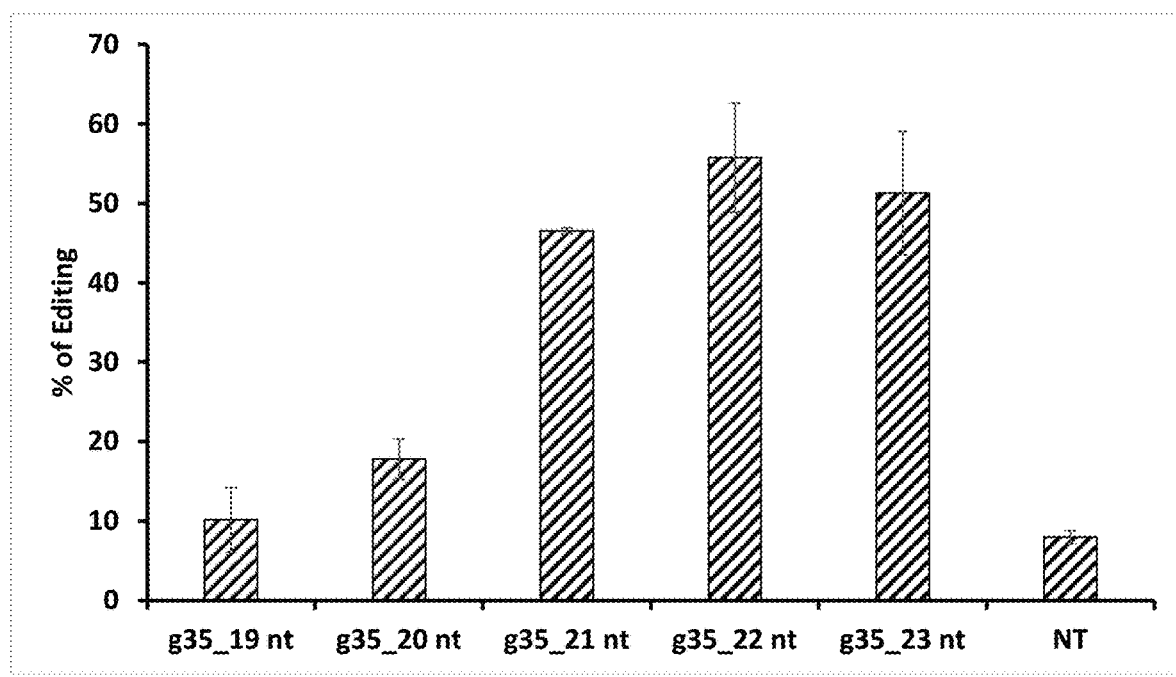
FIG. 4. Activity assay for OMNI-50 as RNP in iPSCs: RNPs with spacer lengths 17-23 nucleotides (Table 4) were electroporated into an iPSC cell line and editing levels (indels) were measured by NGS.

OMNI-50 guide length effects on editing efficacy were also tested in iPSC. Cells were nucleofected with OMNI-50 RNP complexes containing guides of different spacer length (17-23 nt, Table 4). Cells were harvested 72 h post nucleofection, gDNA was used for site specific genomic DNA amplification and capillary gel electrophoresis analysis using sg35 on-target primers which amplify the endogenous genomic region within the target gene. The capillary gel electrophoresis data was used to determine the Total % Editing. As can be seen in FIG. 4, a spacer length of 19 nt showed levels of editing similar to background (NT), 20 nt spacers resulted in medium editing levels, and 21-23 nt spacers resulted in the most significant editing levels, in agreement with the in vitro and the U2OS experiment described above.

EXAMPLE: ELANE Mutant Targeting Analysis

Guide sequences comprising 17-30 contiguous nucleotides containing nucleotides in the sequence set forth in any one of SEQ ID NOs: 1-31117 are screened for high on target activity using SpCas9 in HeLa cells. On target activity is determined by DNA capillary electrophoresis analysis.

REFERENCES

1. Ahmad and Allen (1992) "Antibody-mediated Specific Binging and Cytotoxicity of Lipsome-entrapped Doxorubicin to Lung Cancer Cells in Vitro", Cancer Research 52:4817-20
2. Anders (1992) "Human gene therapy", Science 256:808-13
3. Basha et al. (2011) "Influence of Cationic Lipid Composition on Gene Silencing Properties of Lipid Nanoparticle Formulations of siRNA in Antigen-Presenting Cells", Mol. Ther. 19(12):2186-200
4. Behr (1994) Gene transfer with synthetic cationic amphiphiles: Prospects for gene therapy", Bioconjuage Chem 5:382-89
5. Blaese (1995) "Vectors in cancer therapy: how will they deliver", Cancer Gene Ther. 2:291-97
6. Blaese et al. (1995) "T lympocyte-directed gene therapy for ADA-SCID: initial trial results after 4 years", Science 270(5235):475-80
7. Boxer, L. A. (2012) "How to approach neutropenia", Hematology Am Soc Hematol Educ Program 2012: 174-182
8. Buchschacher and Panganiban (1992) "Human immunodeficiency virus vectors for inducible expression of foreign genes", J. Virol. 66:2731-39

9. Burstein et al. (2017) "New CRISPR-Cas systems from uncultivated microbes", Nature 542:237-41

10. Carlsson, G et al. (2012) "Incidence of severe congenital neutropenia in Sweden and risk of evolution to myelodysplastic syndrome/leukaemia", Br J Haematol 158(3): 363-369

11. Chung et al. (2006) "*Agrobacterium* is not alone: gene transfer to plants by viruses and other bacteria", Trends Plant Sci. 11(1):1-4

12. Connelly, J. A. et al. (2012) "Hematopoietic stem cell transplantation for severe congenital neutropenia", Curr Opin Hematol 19(1): 44-51

13. Crystal (1995) "Transfer of genes to humans: early lessons and obstacles to success", Science 270(5235): 404-10

14. Dale, D. C. (2017) "How I manage children with neutropenia", Br J Haematol 178(3): 351-363

15. Dillon (1993) "Regulation gene expression in gene therapy" Trends in Biotechnology 11(5):167-173

16. Donadieu, J. et al. (2011) "Congenital neutropenia: diagnosis, molecular bases and patient management", Orphanet J Rare Dis 6: 26.

17. Dranoff et al. (1997) "A phase I study of vaccination with autologous, irradiated melanoma cells engineered to secrete human granulocyte macrophage colony stimulating factor", Hum. Gene Ther. 8(1):111-23

18. Donadieu et al. (2011) "Congenital neutropenia: diagnosis, molecular bases and patient management", Orphanet J Rare Dis. 6:26

19. Dunbar et al. (1995) "Retrovirally marked CD34-enriched peripheral blood and bone marrow cells contribute to long-term engraftment after autologous transplantation", Blood 85:3048-57

20. Ellem et al. (1997) "A case report: immune responses and clinical course of the first human use of ganulocyte/macrophage-colony-stimulating-factor-tranduced autologous melanoma cells for immunotherapy", Cancer Immunol Immunother 44:10-20

21. Gao and Huang (1995) "Cationic liposome-mediated gene transfer" Gene Ther. 2(10):710-22

22. Germeshausen et al. (2013) "The spectrum of ELANE mutations and their implications in severe congenital and cyclic neutropenia", Hum Mutat. 34(6):905-14

23. Haddada et al. (1995) "Gene Therapy Using Adenovirus Vectors", in: The Molecular Repertoire of Adenoviruses III: Biology and Pathogenesis, ed. Doerfler and Bohm, pp. 297-306

24. Han et al. (1995) "Ligand-directed retro-viral targeting of human breast cancer cells", Proc Natl Acad Sci U.S.A. 92(21):9747-51

25. Horwitz, M. S. et al. (2013) "ELANE mutations in cyclic and severe congenital neutropenia: genetics and pathophysiology", Hematol Oncol Clin North Am 27(1): 19-41, vii.

26. Inaba et al. (1992) "Generation of large numbers of dendritic cells from mouse bone marrow cultures supplemented with granulocyte/macrophage colony-stimulating factor", J Exp Med. 176(6):1693-702

27. Jinek et al. (2012) "A programmable dual-RNA-guided DNA endonuclease in adaptive bacterial immunity," Science 337(6096):816-21

28. Johan et al. (1992) "GLVR1, a receptor for gibbon ape leukemia virus, is homologous to a phosphate permease of *Neurospora crassa* and is expressed at high levels in the brain and thymus", J Virol 66(3):1635-40

29. Judge et al. (2006) "Design of noninflammatory synthetic siRNA mediating potent gene silencing in vivo", Mol Ther. 13(3):494-505

30. Kohn et al. (1995) "Engraftment of gene-modified umbilical cord blood cells in neonates with adnosine deaminase deficiency", Nature Medicine 1:1017-23

31. Koonen et al. (2017) "Diversity, classification and evolution of CRIPR-Cas systems", Current Opinion in Microbiology 37:67-78

32. Kremer and Perricaudet (1995) "Adenovirus and adeno-associated virus mediated gene transfer", Br. Med. Bull. 51(1):31-44

33. Macdiarmid et al. (2009) "Sequential treatment of drug-resistant tumors with targeted minicells containing siRNA or a cytotoxic drug", Nat Biotehcnol. 27(7):643-51

34. Malech et al. (1997) "Prolonged production of NADPH oxidase-corrected granulocyes after gene therapy of chronic granulomatous disease", PNAS 94(22):12133-38

35. Makaran et al. (2015) "The diversity of mutations and clinical outcomes for ELANE-associated neutropenia", Curr Opin Hematol. 22(1):3-11

36. Miller et al. (1991) "Construction and properties of retrovirus packaging cells based on gibbon ape leukemia virus", J Virol. 65(5):2220-24

37. Miller (1992) "Human gene therapy comes of age", Nature 357:455-60

38. Mitani and Caskey (1993) "Delivering therapeutic genes—matching approach and application", Trends in Biotechnology 11(5):162-66

39. Nabel and Feigner (1993) "Direct gene transfer for immunotherapy and immunization", Trends in Biotechnology 11(5):211-15

40. Remy et al. (1994) "Gene Transfer with a Series of Lipphilic DNA-Binding Molecules", Bioconjugate Chem. 5(6):647-54

41. Rosenberg, P. S. et al. (2010) "Stable long-term risk of leukaemia in patients with severe congenital neutropenia maintained on G-CSF therapy", Br J Haematol 150(2): 196-199.

42. Schaffer, A et al. (2007) "Genetic heterogeneity in severe congenital neutropenia: how many aberrant pathways can kill a neutrophil?" Curr Opin Allergy Clin Immunol 7(6): 481-494

43. Sentmanat et al. (2018) "A Survey of Validation Strategies for CRISPR-Cas9 Editing", Scientific Reports 8:888, doi:10.1038/s41598-018-19441-8

44. Skokowa, J. et al. (2017) "Severe congenital neutropenias", Nat Rev Dis Primers 3: 17032

45. Sommerfelt et al. (1990) "Localization of the receptor gene for type D simian retroviruses on human chromosome 19", J. Virol. 64(12):6214-20

46. Van Brunt (1988) "Molecular framing: transgenic animals as bioactors" Biotechnology 6:1149-54

47. Vigne et al. (1995) "Third-generation adenovectors for gene therapy", Restorative Neurology and Neuroscience 8(1,2): 35-36

48. Wilson et al. (1989) "Formation of infectious hybrid virion with gibbon ape leukemia virus and human T-cell leukemia virus retroviral envelope glycoproteins and the gag and pol proteins of Moloney murine leukemia virus", J. Virol. 63:2374-78

49. Yu et al. (1994) "Progress towards gene therapy for HIV infection", Gene Ther. 1(1):13-26

50. Yu, K et al. (2016) "Gene Editing of Human Hematopoietic Stem and Progenitor Cells: Promise and Potential Hurdles", Hum Gene Ther 27(10): 729-740
51. Zetsche et al. (2015) "Cpf1 is a single RNA-guided endonuclease of a class 2 CRIPSR-Cas system" Cell 163(3):759-71
52. Zhenwang et al. (2017) "Large-scale ex vivo generation of human neutrophils from cord blood CD34$^+$ cells", PLOS ONE, doi.org/10.1371/journal.pone.0180832
53. Zuris et al. (2015) "Cationic lipid-mediated delivery of proteins enables efficient protein based genome editing in vitro and in vivo" Nat Biotechnol. 33(1):73-80

SEQUENCE LISTING (31234 sequences)

SEQ ID NO: 1 - RNA, 20 nt, Artificial Sequence
  ELANE RNA Guide
accccggagccccagcccca

SEQ ID NO: 2 - RNA, 20 nt, Artificial Sequence
  ELANE RNA Guide
accgugacccucggccgccg

SEQ ID NO: 3 - RNA, 20 nt, Artificial Sequence
  ELANE RNA Guide
acgguggggcuggggcuccg

SEQ ID NO: 4 - RNA, 20 nt, Artificial Sequence
  ELANE RNA Guide
agccccaccgugacccucgg

SEQ ID NO: 5 - RNA, 20 nt, Artificial Sequence
  ELANE RNA Guide
agccccagccccaccgugac

SEQ ID NO: 6 - RNA, 20 nt, Artificial Sequence
  ELANE RNA Guide
agggucacgguggggcuggg

SEQ ID NO: 7 - RNA, 20 nt, Artificial Sequence
  ELANE RNA Guide
agucggcggccgagggucac

SEQ ID NO: 8 - RNA, 20 nt, Artificial Sequence
  ELANE RNA Guide
caccgugacccucggccgcc

SEQ ID NO: 9 - RNA, 20 nt, Artificial Sequence
  ELANE RNA Guide
cacgguggggcuggggcucc

SEQ ID NO: 10 - RNA, 20 nt, Artificial Sequence
  ELANE RNA Guide
cagccccaccgugacccucg

SEQ ID NO: 11 - RNA, 20 nt, Artificial Sequence
  ELANE RNA Guide
ccaccgugacccucggccgc

SEQ ID NO: 12 - RNA, 20 nt, Artificial Sequence
  ELANE RNA Guide
ccagccccaccgugacccuc

SEQ ID NO: 13 - RNA, 20 nt, Artificial Sequence
  ELANE RNA Guide
cccaccgugacccucggccg

SEQ ID NO: 14 - RNA, 20 nt, Artificial Sequence
  ELANE RNA Guide
cccagccccaccgugacccu

SEQ ID NO: 15 - RNA, 20 nt, Artificial Sequence
  ELANE RNA Guide
ccccaccgugacccucggcc

SEQ ID NO: 16 - RNA, 20 nt, Artificial Sequence
  ELANE RNA Guide
ccccagccccaccgugaccc

SEQ ID NO: 17 - RNA, 20 nt, Artificial Sequence
  ELANE RNA Guide
ccgagggucacgguggggcu

SEQ ID NO: 18 - RNA, 20 nt, Artificial Sequence
  ELANE RNA Guide
ccgugacccucggccgccga

SEQ ID NO: 19 - RNA, 20 nt, Artificial Sequence
  ELANE RNA Guide
cgagggucacgguggggcug

SEQ ID NO: 20 - RNA, 20 nt, Artificial Sequence
  ELANE RNA Guide
cgagucggcggccgaggguc

SEQ ID NO: 21 - RNA, 20 nt, Artificial Sequence
  ELANE RNA Guide
cggagccccagccccaccgu

SEQ ID NO: 22 - RNA, 20 nt, Artificial Sequence
  ELANE RNA Guide
cggccgagggucacgguggg

SEQ ID NO: 23 - RNA, 20 nt, Artificial Sequence
  ELANE RNA Guide
cggcggccgagggucacggu

SEQ ID NO: 24 - RNA, 20 nt, Artificial Sequence
  ELANE RNA Guide
cgugacccucggccgccgac

SEQ ID NO: 25 - RNA, 20 nt, Artificial Sequence
  ELANE RNA Guide
gagccccagccccaccguga

SEQ ID NO: 26 - RNA, 20 nt, Artificial Sequence
  ELANE RNA Guide
gagggucacgguggggcugg

SEQ ID NO: 27 - RNA, 20 nt, Artificial Sequence
  ELANE RNA Guide
gagucggcggccgaggguca

SEQ ID NO: 28 - RNA, 20 nt, Artificial Sequence
  ELANE RNA Guide
gccccaccgugacccucggc

SEQ ID NO: 29 - RNA, 20 nt, Artificial Sequence
  ELANE RNA Guide
gccccagccccaccgugacc

SEQ ID NO: 30 - RNA, 20 nt, Artificial Sequence
  ELANE RNA Guide
gccgagggucacgguggggc

SEQ ID NO: 31 - RNA, 20 nt, Artificial Sequence
  ELANE RNA Guide
gcgagucggcggccgagggu

SEQ ID NO: 32 - RNA, 20 nt, Artificial Sequence
  ELANE RNA Guide
gcggccgagggucacggugg

SEQ ID NO: 33 - RNA, 20 nt, Artificial Sequence
  ELANE RNA Guide
ggagccccagccccaccgug

SEQ ID NO: 34 - RNA, 20 nt, Artificial Sequence
  ELANE RNA Guide
ggccgagggucacggugggg

SEQ ID NO: 35 - RNA, 20 nt, Artificial Sequence
  ELANE RNA Guide
ggcggccgagggucacggug

SEQ ID NO: 36 - RNA, 20 nt, Artificial Sequence
  ELANE RNA Guide
gggucacgguggggcugggg

SEQ ID NO: 37 - RNA, 20 nt, Artificial Sequence
  ELANE RNA Guide
ggucacgguggggcuggggc

SEQ ID NO: 38 - RNA, 20 nt, Artificial Sequence
  ELANE RNA Guide
gucacgguggggcuggggcu

SEQ ID NO: 39 - RNA, 20 nt, Artificial Sequence
  ELANE RNA Guide
gucggcggccgagggucacg

SEQ ID NO: 40 - RNA, 20 nt, Artificial Sequence
  ELANE RNA Guide
ucacgguggggcuggggcuc

SEQ ID NO: 41 - RNA, 20 nt, Artificial Sequence
  ELANE RNA Guide
ucggcggccgagggucacgg

SEQ ID NO: 42 - RNA, 21 nt, Artificial Sequence
  ELANE RNA Guide
accgugacccucggccgccga

SEQ ID NO: 43 - RNA, 21 nt, Artificial Sequence
  ELANE RNA Guide
agccccaccgugacccucggc

SEQ ID NO: 44 - RNA, 21 nt, Artificial Sequence
  ELANE RNA Guide
agccccagccccaccgugacc

SEQ ID NO: 45 - RNA, 21 nt, Artificial Sequence
  ELANE RNA Guide
agggucacgguggggcugggg

SEQ ID NO: 46 - RNA, 21 nt, Artificial Sequence
  ELANE RNA Guide
agucggcggccgagggucacg

SEQ ID NO: 47 - RNA, 21 nt, Artificial Sequence
  ELANE RNA Guide
cagccccaccgugacccucgg

SEQ ID NO: 48 - RNA, 21 nt, Artificial Sequence
  ELANE RNA Guide
ccagccccaccgugacccucg

SEQ ID NO: 49 - RNA, 21 nt, Artificial Sequence
  ELANE RNA Guide
cccagccccaccgugacccuc

SEQ ID NO: 50 - RNA, 21 nt, Artificial Sequence
  ELANE RNA Guide
ccccagccccaccgugacccu

SEQ ID NO: 51 - RNA, 21 nt, Artificial Sequence
  ELANE RNA Guide
ccgagggucacgguggggcug

SEQ ID NO: 52 - RNA, 21 nt, Artificial Sequence
  ELANE RNA Guide
cgagggucacgguggggcugg

SEQ ID NO: 53 - RNA, 21 nt, Artificial Sequence
  ELANE RNA Guide
cgagucggcggccgaggguca

SEQ ID NO: 54 - RNA, 21 nt, Artificial Sequence
  ELANE RNA Guide
cgugacccucggccgccgacu

SEQ ID NO: 55 - RNA, 21 nt, Artificial Sequence
  ELANE RNA Guide
gagccccagccccaccgugac

SEQ ID NO: 56 - RNA, 21 nt, Artificial Sequence
  ELANE RNA Guide
gagggucacgguggggcuggg

SEQ ID NO: 57 - RNA, 21 nt, Artificial Sequence
  ELANE RNA Guide
gagucggcggccgagggucac

SEQ ID NO: 58 - RNA, 21 nt, Artificial Sequence
  ELANE RNA Guide
gccgagggucacgguggggcu

SEQ ID NO: 59 - RNA, 21 nt, Artificial Sequence
  ELANE RNA Guide
ggagccccagccccaccguga

SEQ ID NO: 60 - RNA, 21 nt, Artificial Sequence
  ELANE RNA Guide
ggucacgguggggcuggggcu

SEQ ID NO: 61 - RNA, 21 nt, Artificial Sequence
  ELANE RNA Guide
gucacgguggggcuggggcuc

SEQ ID NO: 62 - RNA, 21 nt, Artificial Sequence
  ELANE RNA Guide
ucacgguggggcuggggcucc

SEQ ID NO: 63 - RNA, 21 nt, Artificial Sequence
  ELANE RNA Guide
ucggcggccgagggucacggu

SEQ ID NO: 64 - RNA, 22 nt, Artificial Sequence
  ELANE RNA Guide
accgugacccucggccgccgac

SEQ ID NO: 65 - RNA, 22 nt, Artificial Sequence
  ELANE RNA Guide
acgcgagucggcggccgagggu

SEQ ID NO: 66 - RNA, 22 nt, Artificial Sequence
  ELANE RNA Guide
agaccccggagccccagcccca

SEQ ID NO: 67 - RNA, 22 nt, Artificial Sequence
  ELANE RNA Guide
agccccaccgugacccucggcc

SEQ ID NO: 68 - RNA, 22 nt, Artificial Sequence
  ELANE RNA Guide
agccccagccccaccgugaccc

SEQ ID NO: 69 - RNA, 22 nt, Artificial Sequence
  ELANE RNA Guide
agggucacgguggggcuggggc

SEQ ID NO: 70 - RNA, 22 nt, Artificial Sequence
  ELANE RNA Guide
agucggcggccgagggucacgg

SEQ ID NO: 71 - RNA, 22 nt, Artificial Sequence
  ELANE RNA Guide
caccgugacccucggccgccga

SEQ ID NO: 72 - RNA, 22 nt, Artificial Sequence
  ELANE RNA Guide
cagccccaccgugacccucggc

SEQ ID NO: 73 - RNA, 22 nt, Artificial Sequence
  ELANE RNA Guide
ccagccccaccgugacccucgg

SEQ ID NO: 74 - RNA, 22 nt, Artificial Sequence
  ELANE RNA Guide
cccagccccaccgugacccucg

SEQ ID NO: 75 - RNA, 22 nt, Artificial Sequence
  ELANE RNA Guide
ccccagccccaccgugacccuc

SEQ ID NO: 76 - RNA, 22 nt, Artificial Sequence
  ELANE RNA Guide
ccgagggucacgguggggcugg

SEQ ID NO: 77 - RNA, 22 nt, Artificial Sequence
  ELANE RNA Guide
ccgugacccucggccgccgacu

SEQ ID NO: 78 - RNA, 22 nt, Artificial Sequence
  ELANE RNA Guide
cgagggucacgguggggcuggg

SEQ ID NO: 79 - RNA, 22 nt, Artificial Sequence
  ELANE RNA Guide
cgagucggcggccgagggucac

SEQ ID NO: 80 - RNA, 22 nt, Artificial Sequence
  ELANE RNA Guide
cggagccccagccccaccguga

SEQ ID NO: 81 - RNA, 22 nt, Artificial Sequence
  ELANE RNA Guide
cgugacccucggccgccgacuc

SEQ ID NO: 82 - RNA, 22 nt, Artificial Sequence
  ELANE RNA Guide
gagccccagccccaccgugacc

SEQ ID NO: 83 - RNA, 22 nt, Artificial Sequence
  ELANE RNA Guide
gagggucacgguggggcugggg

SEQ ID NO: 84 - RNA, 22 nt, Artificial Sequence
  ELANE RNA Guide
gagucggcggccgagggucacg

SEQ ID NO: 85 - RNA, 22 nt, Artificial Sequence
  ELANE RNA Guide
gccccagccccaccgugacccu

SEQ ID NO: 86 - RNA, 22 nt, Artificial Sequence
  ELANE RNA Guide
gccgagggucacgguggggcug

SEQ ID NO: 87 - RNA, 22 nt, Artificial Sequence
  ELANE RNA Guide
gcgagucggcggccgaggguca

SEQ ID NO: 88 - RNA, 22 nt, Artificial Sequence
  ELANE RNA Guide
ggagccccagccccaccgugac

SEQ ID NO: 89 - RNA, 22 nt, Artificial Sequence
  ELANE RNA Guide
ggccgagggucacgguggggcu

SEQ ID NO: 90 - RNA, 22 nt, Artificial Sequence
  ELANE RNA Guide
gggucacgguggggcuggggcu

SEQ ID NO: 91 - RNA, 22 nt, Artificial Sequence
  ELANE RNA Guide
ggucacgguggggcuggggcuc

SEQ ID NO: 92 - RNA, 22 nt, Artificial Sequence
  ELANE RNA Guide
gucacgguggggcuggggcucc

SEQ ID NO: 93 - RNA, 22 nt, Artificial Sequence
  ELANE RNA Guide
gucggcggccgagggucacggu

SEQ ID NO: 94 - RNA, 22 nt, Artificial Sequence
  ELANE RNA Guide
ucacgguggggcuggggcuccg

SEQ ID NO: 95 - RNA, 22 nt, Artificial Sequence
  ELANE RNA Guide
ucggcggccgagggucacggug

SEQ ID NO: 96 - RNA, 20 nt, Artificial Sequence
  ELANE RNA Guide
accaggacccucggccgccg

SEQ ID NO: 97 - RNA, 20 nt, Artificial Sequence
  ELANE RNA Guide
acgcgagucggcggccgagg

SEQ ID NO: 98 - RNA, 20 nt, Artificial Sequence
  ELANE RNA Guide
agccccaccaggacccucgg

SEQ ID NO: 99 - RNA, 20 nt, Artificial Sequence
  ELANE RNA Guide
agccccagccccaccaggac

SEQ ID NO: 100 - RNA, 20 nt, Artificial Sequence
  ELANE RNA Guide
aggacccucggccgccgacu

SEQ ID NO: 101 - RNA, 20 nt, Artificial Sequence
  ELANE RNA Guide
aggguccugguggggcuggg

SEQ ID NO: 102 - RNA, 20 nt, Artificial Sequence
  ELANE RNA Guide
agucggcggccgaggguccu

SEQ ID NO: 103 - RNA, 20 nt, Artificial Sequence
  ELANE RNA Guide
caccaggacccucggccgcc

SEQ ID NO: 104 - RNA, 20 nt, Artificial Sequence
  ELANE RNA Guide
cagccccaccaggacccucg

SEQ ID NO: 105 - RNA, 20 nt, Artificial Sequence
  ELANE RNA Guide
caggacccucggccgccgac

SEQ ID NO: 106 - RNA, 20 nt, Artificial Sequence
  ELANE RNA Guide
ccaccaggacccucggccgc

SEQ ID NO: 107 - RNA, 20 nt, Artificial Sequence
  ELANE RNA Guide
ccagccccaccaggacccuc

SEQ ID NO: 108 - RNA, 20 nt, Artificial Sequence
  ELANE RNA Guide
ccaggacccucggccgccga

SEQ ID NO: 109 - RNA, 20 nt, Artificial Sequence
  ELANE RNA Guide
cccaccaggacccucggccg

SEQ ID NO: 110 - RNA, 20 nt, Artificial Sequence
  ELANE RNA Guide
cccagccccaccaggacccu

SEQ ID NO: 111 - RNA, 20 nt, Artificial Sequence
  ELANE RNA Guide
ccccaccaggacccucggcc

SEQ ID NO: 112 - RNA, 20 nt, Artificial Sequence
  ELANE RNA Guide
ccccagccccaccaggaccc

SEQ ID NO: 113 - RNA, 20 nt, Artificial Sequence
  ELANE RNA Guide
ccgaggguccugguggggcu

SEQ ID NO: 114 - RNA, 20 nt, Artificial Sequence
  ELANE RNA Guide
ccggagccccagccccacca

SEQ ID NO: 115 - RNA, 20 nt, Artificial Sequence
  ELANE RNA Guide
ccugguggggcuggggcucc

SEQ ID NO: 116 - RNA, 20 nt, Artificial Sequence
  ELANE RNA Guide
cgaggguccugguggggcug

SEQ ID NO: 117 - RNA, 20 nt, Artificial Sequence
  ELANE RNA Guide
cggagccccagccccaccag

SEQ ID NO: 118 - RNA, 20 nt, Artificial Sequence
  ELANE RNA Guide
cggccgaggguccugguggg

SEQ ID NO: 119 - RNA, 20 nt, Artificial Sequence
  ELANE RNA Guide
cggcggccgaggguccuggu

SEQ ID NO: 120 - RNA, 20 nt, Artificial Sequence
  ELANE RNA Guide
gagccccagccccaccagga

SEQ ID NO: 121 - RNA, 20 nt, Artificial Sequence
  ELANE RNA Guide
gaggguccugguggggcugg

SEQ ID NO: 122 - RNA, 20 nt, Artificial Sequence
  ELANE RNA Guide
gagucggcggccgagggucc

SEQ ID NO: 123 - RNA, 20 nt, Artificial Sequence
  ELANE RNA Guide
gccccaccaggacccucggc

SEQ ID NO: 124 - RNA, 20 nt, Artificial Sequence
  ELANE RNA Guide
gccccagccccaccaggacc

SEQ ID NO: 125 - RNA, 20 nt, Artificial Sequence
  ELANE RNA Guide
gccgaggguccugguggggc

SEQ ID NO: 126 - RNA, 20 nt, Artificial Sequence
  ELANE RNA Guide
gcggccgaggguccuggugg

SEQ ID NO: 127 - RNA, 20 nt, Artificial Sequence
  ELANE RNA Guide
ggagccccagccccaccagg

SEQ ID NO: 128 - RNA, 20 nt, Artificial Sequence
  ELANE RNA Guide
ggccgaggguccuggugggg

SEQ ID NO: 129 - RNA, 20 nt, Artificial Sequence
  ELANE RNA Guide
ggcggccgaggguccuggug

SEQ ID NO: 130 - RNA, 20 nt, Artificial Sequence
  ELANE RNA Guide
ggguccugguggggcugggg

SEQ ID NO: 131 - RNA, 20 nt, Artificial Sequence
  ELANE RNA Guide
gguccugguggggcuggggc

SEQ ID NO: 132 - RNA, 20 nt, Artificial Sequence
  ELANE RNA Guide
guccugguggggcuggggcu

SEQ ID NO: 133 - RNA, 20 nt, Artificial Sequence
  ELANE RNA Guide
gucggcggccgaggguccug

SEQ ID NO: 134 - RNA, 20 nt, Artificial Sequence
  ELANE RNA Guide
uccugguggggcuggggcuc

SEQ ID NO: 135 - RNA, 20 nt, Artificial Sequence
  ELANE RNA Guide
ucggcggccgaggguccugg

SEQ ID NO: 136 - RNA, 21 nt, Artificial Sequence
  ELANE RNA Guide
accaggacccucggccgccga

SEQ ID NO: 137 - RNA, 21 nt, Artificial Sequence
  ELANE RNA Guide
agccccaccaggacccucggc

SEQ ID NO: 138 - RNA, 21 nt, Artificial Sequence
  ELANE RNA Guide
agccccagccccaccaggacc

SEQ ID NO: 139 - RNA, 21 nt, Artificial Sequence
  ELANE RNA Guide
aggacccucggccgccgacuc

SEQ ID NO: 140 - RNA, 21 nt, Artificial Sequence
  ELANE RNA Guide
aggguccugguggggcugggg

SEQ ID NO: 141 - RNA, 21 nt, Artificial Sequence
  ELANE RNA Guide
agucggcggccgaggguccug

SEQ ID NO: 142 - RNA, 21 nt, Artificial Sequence
  ELANE RNA Guide
cagccccaccaggacccucgg

SEQ ID NO: 143 - RNA, 21 nt, Artificial Sequence
  ELANE RNA Guide
caggacccucggccgccgacu

SEQ ID NO: 144 - RNA, 21 nt, Artificial Sequence
  ELANE RNA Guide
ccagccccaccaggacccucg

SEQ ID NO: 145 - RNA, 21 nt, Artificial Sequence
  ELANE RNA Guide
cccagccccaccaggacccuc

SEQ ID NO: 146 - RNA, 21 nt, Artificial Sequence
  ELANE RNA Guide
ccccagccccaccaggacccu

SEQ ID NO: 147 - RNA, 21 nt, Artificial Sequence
  ELANE RNA Guide
ccgaggguccugguggggcug

SEQ ID NO: 148 - RNA, 21 nt, Artificial Sequence
  ELANE RNA Guide
cgaggguccugguggggcugg

SEQ ID NO: 149 - RNA, 21 nt, Artificial Sequence
  ELANE RNA Guide
gagccccagccccaccaggac

SEQ ID NO: 150 - RNA, 21 nt, Artificial Sequence
  ELANE RNA Guide
gaggguccugguggggcuggg

SEQ ID NO: 151 - RNA, 21 nt, Artificial Sequence
  ELANE RNA Guide
gagucggcggccgaggguccu

SEQ ID NO: 152 - RNA, 21 nt, Artificial Sequence
  ELANE RNA Guide
gccgaggguccugguggggcu

SEQ ID NO: 153 - RNA, 21 nt, Artificial Sequence
  ELANE RNA Guide
ggagccccagccccaccagga

SEQ ID NO: 154 - RNA, 21 nt, Artificial Sequence
  ELANE RNA Guide
gguccugguggggcuggggcu

SEQ ID NO: 155 - RNA, 21 nt, Artificial Sequence
  ELANE RNA Guide
guccugguggggcuggggcuc

SEQ ID NO: 156 - RNA, 21 nt, Artificial Sequence
  ELANE RNA Guide
uccugguggggcuggggcucc

SEQ ID NO: 157 - RNA, 21 nt, Artificial Sequence
  ELANE RNA Guide
ucggcggccgaggguccuggu

SEQ ID NO: 158 - RNA, 22 nt, Artificial Sequence
  ELANE RNA Guide
acacgcgagucggcggccgagg

SEQ ID NO: 159 - RNA, 22 nt, Artificial Sequence
  ELANE RNA Guide
accaggacccucggccgccgac

SEQ ID NO: 160 - RNA, 22 nt, Artificial Sequence
  ELANE RNA Guide
agccccaccaggacccucggcc

SEQ ID NO: 161 - RNA, 22 nt, Artificial Sequence
  ELANE RNA Guide
agccccagccccaccaggaccc

SEQ ID NO: 162 - RNA, 22 nt, Artificial Sequence
  ELANE RNA Guide
aggacccucggccgccgacucg

SEQ ID NO: 163 - RNA, 22 nt, Artificial Sequence
  ELANE RNA Guide
aggguccugguggggcuggggc

SEQ ID NO: 164 - RNA, 22 nt, Artificial Sequence
  ELANE RNA Guide
agucggcggccgaggguccugg

SEQ ID NO: 165 - RNA, 22 nt, Artificial Sequence
  ELANE RNA Guide
caccaggacccucggccgccga

SEQ ID NO: 166 - RNA, 22 nt, Artificial Sequence
  ELANE RNA Guide
cagccccaccaggacccucggc

SEQ ID NO: 167 - RNA, 22 nt, Artificial Sequence
  ELANE RNA Guide
caggacccucggccgccgacuc

SEQ ID NO: 168 - RNA, 22 nt, Artificial Sequence
  ELANE RNA Guide
ccagccccaccaggacccucgg

SEQ ID NO: 169 - RNA, 22 nt, Artificial Sequence
  ELANE RNA Guide
ccaggacccucggccgccgacu

SEQ ID NO: 170 - RNA, 22 nt, Artificial Sequence
  ELANE RNA Guide
cccagccccaccaggacccucg

SEQ ID NO: 171 - RNA, 22 nt, Artificial Sequence
  ELANE RNA Guide
ccccagccccaccaggacccuc

SEQ ID NO: 172 - RNA, 22 nt, Artificial Sequence
  ELANE RNA Guide
ccgaggguccugguggggcugg

SEQ ID NO: 173 - RNA, 22 nt, Artificial Sequence
  ELANE RNA Guide
cgaggguccugguggggcuggg

SEQ ID NO: 174 - RNA, 22 nt, Artificial Sequence
  ELANE RNA Guide
cgagucggcggccgaggguccu

SEQ ID NO: 175 - RNA, 22 nt, Artificial Sequence
  ELANE RNA Guide
cggagccccagccccaccagga

SEQ ID NO: 176 - RNA, 22 nt, Artificial Sequence
  ELANE RNA Guide
gagccccagccccaccaggacc

SEQ ID NO: 177 - RNA, 22 nt, Artificial Sequence
  ELANE RNA Guide
gaggguccugguggggcugggg

SEQ ID NO: 178 - RNA, 22 nt, Artificial Sequence
  ELANE RNA Guide
gagucggcggccgaggguccug

SEQ ID NO: 179 - RNA, 22 nt, Artificial Sequence
  ELANE RNA Guide
gccccagccccaccaggacccu

SEQ ID NO: 180 - RNA, 22 nt, Artificial Sequence
  ELANE RNA Guide
gccgaggguccugguggggcug

SEQ ID NO: 181 - RNA, 22 nt, Artificial Sequence
  ELANE RNA Guide
ggagccccagccccaccaggac

SEQ ID NO: 182 - RNA, 22 nt, Artificial Sequence
  ELANE RNA Guide
ggccgaggguccugguggggcu

SEQ ID NO: 183 - RNA, 22 nt, Artificial Sequence
  ELANE RNA Guide
ggguccugguggggcuggggcu

SEQ ID NO: 184 - RNA, 22 nt, Artificial Sequence
  ELANE RNA Guide
gguccugguggggcuggggcuc

SEQ ID NO: 185 - RNA, 22 nt, Artificial Sequence
  ELANE RNA Guide
guccugguggggcuggggcucc

SEQ ID NO: 186 - RNA, 22 nt, Artificial Sequence
  ELANE RNA Guide
gucggcggccgaggguccuggu

SEQ ID NO: 187 - RNA, 22 nt, Artificial Sequence
  ELANE RNA Guide
uccugguggggcuggggcuccg

SEQ ID NO: 188 - RNA, 22 nt, Artificial Sequence
  ELANE RNA Guide
ucggcggccgaggguccuggug

SEQ ID NO: 189 - RNA, 20 nt, Artificial Sequence
  ELANE RNA Guide
accaucacccucggccgccg

SEQ ID NO: 190 - RNA, 20 nt, Artificial Sequence
  ELANE RNA Guide
agccccaccaucacccucgg

SEQ ID NO: 191 - RNA, 20 nt, Artificial Sequence
  ELANE RNA Guide
agccccagccccaccaucac

SEQ ID NO: 192 - RNA, 20 nt, Artificial Sequence
  ELANE RNA Guide
agggugaugguggggcuggg

SEQ ID NO: 193 - RNA, 20 nt, Artificial Sequence
  ELANE RNA Guide
agucggcggccgagggugau

SEQ ID NO: 194 - RNA, 20 nt, Artificial Sequence
  ELANE RNA Guide
aucacccucggccgccgacu

SEQ ID NO: 195 - RNA, 20 nt, Artificial Sequence
  ELANE RNA Guide
caccaucacccucggccgcc

SEQ ID NO: 196 - RNA, 20 nt, Artificial Sequence
  ELANE RNA Guide
cacgcgagucggcggccgag

SEQ ID NO: 197 - RNA, 20 nt, Artificial Sequence
  ELANE RNA Guide
cagccccaccaucacccucg

SEQ ID NO: 198 - RNA, 20 nt, Artificial Sequence
  ELANE RNA Guide
caucacccucggccgccgac

SEQ ID NO: 199 - RNA, 20 nt, Artificial Sequence
  ELANE RNA Guide
ccaccaucacccucggccgc

SEQ ID NO: 200 - RNA, 20 nt, Artificial Sequence
  ELANE RNA Guide
ccagccccaccaucacccuc

SEQ ID NO: 201 - RNA, 20 nt, Artificial Sequence
  ELANE RNA Guide
ccaucacccucggccgccga

SEQ ID NO: 202 - RNA, 20 nt, Artificial Sequence
  ELANE RNA Guide
cccaccaucacccucggccg

SEQ ID NO: 203 - RNA, 20 nt, Artificial Sequence
  ELANE RNA Guide
cccagccccaccaucacccu

SEQ ID NO: 204 - RNA, 20 nt, Artificial Sequence
  ELANE RNA Guide
ccccaccaucacccucggcc

SEQ ID NO: 205 - RNA, 20 nt, Artificial Sequence
  ELANE RNA Guide
ccccagccccaccaucaccc

SEQ ID NO: 206 - RNA, 20 nt, Artificial Sequence
  ELANE RNA Guide
ccgagggugaugguggggcu

SEQ ID NO: 207 - RNA, 20 nt, Artificial Sequence
  ELANE RNA Guide
cgagggugaugguggggcug

SEQ ID NO: 208 - RNA, 20 nt, Artificial Sequence
  ELANE RNA Guide
cgagucggcggccgagggug

SEQ ID NO: 209 - RNA, 20 nt, Artificial Sequence
  ELANE RNA Guide
cggagccccagccccaccau

SEQ ID NO: 210 - RNA, 20 nt, Artificial Sequence
  ELANE RNA Guide
cggccgagggugaugguggg

SEQ ID NO: 211 - RNA, 20 nt, Artificial Sequence
  ELANE RNA Guide
cggcggccgagggugauggu

SEQ ID NO: 212 - RNA, 20 nt, Artificial Sequence
  ELANE RNA Guide
gagccccagccccaccauca

SEQ ID NO: 213 - RNA, 20 nt, Artificial Sequence
  ELANE RNA Guide
gagggugaugguggggcugg

SEQ ID NO: 214 - RNA, 20 nt, Artificial Sequence
  ELANE RNA Guide
gagucggcggccgaggguga

SEQ ID NO: 215 - RNA, 20 nt, Artificial Sequence
  ELANE RNA Guide
gccccaccaucacccucggc

SEQ ID NO: 216 - RNA, 20 nt, Artificial Sequence
  ELANE RNA Guide
gccccagccccaccaucacc

SEQ ID NO: 217 - RNA, 20 nt, Artificial Sequence
  ELANE RNA Guide
gccgagggugaugguggggc

SEQ ID NO: 218 - RNA, 20 nt, Artificial Sequence
  ELANE RNA Guide
gcggccgagggugauggugg

SEQ ID NO: 219 - RNA, 20 nt, Artificial Sequence
  ELANE RNA Guide
ggagccccagccccaccauc

SEQ ID NO: 220 - RNA, 20 nt, Artificial Sequence
  ELANE RNA Guide
ggccgagggugauggugggg

SEQ ID NO: 221 - RNA, 20 nt, Artificial Sequence
  ELANE RNA Guide
ggcggccgagggugauggug

SEQ ID NO: 222 - RNA, 20 nt, Artificial Sequence
  ELANE RNA Guide
gggugaugguggggcugggg

SEQ ID NO: 223 - RNA, 20 nt, Artificial Sequence
  ELANE RNA Guide
ggugaugguggggcuggggc

SEQ ID NO: 224 - RNA, 20 nt, Artificial Sequence
  ELANE RNA Guide
gucggcggccgagggugaug

SEQ ID NO: 225 - RNA, 20 nt, Artificial Sequence
  ELANE RNA Guide
gugaugguggggcuggggcu

SEQ ID NO: 226 - RNA, 20 nt, Artificial Sequence
  ELANE RNA Guide
ucacccucggccgccgacuc

SEQ ID NO: 227 - RNA, 20 nt, Artificial Sequence
  ELANE RNA Guide
ucggcggccgagggugaugg

SEQ ID NO: 228 - RNA, 20 nt, Artificial Sequence
  ELANE RNA Guide
ugaugguggggcuggggcuc

SEQ ID NO: 229 - RNA, 21 nt, Artificial Sequence
  ELANE RNA Guide
acacgcgagucggcggccgag

SEQ ID NO: 230 - RNA, 21 nt, Artificial Sequence
  ELANE RNA Guide
accaucacccucggccgccga

SEQ ID NO: 231 - RNA, 21 nt, Artificial Sequence
  ELANE RNA Guide
agccccaccaucacccucggc

SEQ ID NO: 232 - RNA, 21 nt, Artificial Sequence
  ELANE RNA Guide
agccccagccccaccaucacc

SEQ ID NO: 233 - RNA, 21 nt, Artificial Sequence
  ELANE RNA Guide
agggugaugguggggcugggg

SEQ ID NO: 234 - RNA, 21 nt, Artificial Sequence
  ELANE RNA Guide
agucggcggccgagggugaug

SEQ ID NO: 235 - RNA, 21 nt, Artificial Sequence
  ELANE RNA Guide
aucacccucggccgccgacuc

SEQ ID NO: 236 - RNA, 21 nt, Artificial Sequence
  ELANE RNA Guide
caccaucacccucggccgccg

SEQ ID NO: 237 - RNA, 21 nt, Artificial Sequence
  ELANE RNA Guide
cagccccaccaucacccucgg

SEQ ID NO: 238 - RNA, 21 nt, Artificial Sequence
  ELANE RNA Guide
caucacccucggccgccgacu

SEQ ID NO: 239 - RNA, 21 nt, Artificial Sequence
  ELANE RNA Guide
ccaccaucacccucggccgcc

SEQ ID NO: 240 - RNA, 21 nt, Artificial Sequence
  ELANE RNA Guide
ccagccccaccaucacccucg

SEQ ID NO: 241 - RNA, 21 nt, Artificial Sequence
  ELANE RNA Guide
ccaucacccucggccgccgac

SEQ ID NO: 242 - RNA, 21 nt, Artificial Sequence
  ELANE RNA Guide
cccaccaucacccucggccgc

SEQ ID NO: 243 - RNA, 21 nt, Artificial Sequence
  ELANE RNA Guide
cccagccccaccaucacccuc

SEQ ID NO: 244 - RNA, 21 nt, Artificial Sequence
  ELANE RNA Guide
ccccaccaucacccucggccg

SEQ ID NO: 245 - RNA, 21 nt, Artificial Sequence
  ELANE RNA Guide
ccccagccccaccaucacccu

SEQ ID NO: 246 - RNA, 21 nt, Artificial Sequence
  ELANE RNA Guide
ccgagggugaugguggggcug

SEQ ID NO: 247 - RNA, 21 nt, Artificial Sequence
  ELANE RNA Guide
ccggagccccagccccaccau

SEQ ID NO: 248 - RNA, 21 nt, Artificial Sequence
  ELANE RNA Guide
cgagggugaugguggggcugg

SEQ ID NO: 249 - RNA, 21 nt, Artificial Sequence
  ELANE RNA Guide
cgagucggcggccgaggguga

SEQ ID NO: 250 - RNA, 21 nt, Artificial Sequence
  ELANE RNA Guide
cggagccccagccccaccauc

SEQ ID NO: 251 - RNA, 21 nt, Artificial Sequence
  ELANE RNA Guide
cggccgagggugauggugggg

SEQ ID NO: 252 - RNA, 21 nt, Artificial Sequence
  ELANE RNA Guide
cggcggccgagggugauggug

SEQ ID NO: 253 - RNA, 21 nt, Artificial Sequence
  ELANE RNA Guide
gagccccagccccaccaucac

SEQ ID NO: 254 - RNA, 21 nt, Artificial Sequence
  ELANE RNA Guide
gagggugaugguggggcuggg

SEQ ID NO: 255 - RNA, 21 nt, Artificial Sequence
  ELANE RNA Guide
gagucggcggccgagggugau

SEQ ID NO: 256 - RNA, 21 nt, Artificial Sequence
  ELANE RNA Guide
gccccaccaucacccucggcc

SEQ ID NO: 257 - RNA, 21 nt, Artificial Sequence
  ELANE RNA Guide
gccccagccccaccaucaccc

SEQ ID NO: 258 - RNA, 21 nt, Artificial Sequence
  ELANE RNA Guide
gccgagggugaugguggggcu

SEQ ID NO: 259 - RNA, 21 nt, Artificial Sequence
  ELANE RNA Guide
gcggccgagggugaugguggg

SEQ ID NO: 260 - RNA, 21 nt, Artificial Sequence
  ELANE RNA Guide
ggagccccagccccaccauca

SEQ ID NO: 261 - RNA, 21 nt, Artificial Sequence
  ELANE RNA Guide
ggccgagggugaugguggggc

SEQ ID NO: 262 - RNA, 21 nt, Artificial Sequence
  ELANE RNA Guide
ggcggccgagggugauggugg

SEQ ID NO: 263 - RNA, 21 nt, Artificial Sequence
  ELANE RNA Guide
gggugaugguggggcuggggc

SEQ ID NO: 264 - RNA, 21 nt, Artificial Sequence
  ELANE RNA Guide
ggugaugguggggcuggggcu

SEQ ID NO: 265 - RNA, 21 nt, Artificial Sequence
  ELANE RNA Guide
gucggcggccgagggugaugg

SEQ ID NO: 266 - RNA, 21 nt, Artificial Sequence
  ELANE RNA Guide
gugaugguggggcuggggcuc

SEQ ID NO: 267 - RNA, 21 nt, Artificial Sequence
  ELANE RNA Guide
ucacccucggccgccgacucg

SEQ ID NO: 268 - RNA, 21 nt, Artificial Sequence
  ELANE RNA Guide
ucggcggccgagggugauggu

SEQ ID NO: 269 - RNA, 21 nt, Artificial Sequence
  ELANE RNA Guide
ugaugguggggcuggggcucc

SEQ ID NO: 270 - RNA, 22 nt, Artificial Sequence
  ELANE RNA Guide
accaucacccucggccgccgac

SEQ ID NO: 271 - RNA, 22 nt, Artificial Sequence
  ELANE RNA Guide
agccccaccaucacccucggcc

SEQ ID NO: 272 - RNA, 22 nt, Artificial Sequence
  ELANE RNA Guide
agccccagccccaccaucaccc

SEQ ID NO: 273 - RNA, 22 nt, Artificial Sequence
  ELANE RNA Guide
agggugaugguggggcuggggc

SEQ ID NO: 274 - RNA, 22 nt, Artificial Sequence
  ELANE RNA Guide
agucggcggccgagggugaugg

SEQ ID NO: 275 - RNA, 22 nt, Artificial Sequence
  ELANE RNA Guide
aucacccucggccgccgacucg

SEQ ID NO: 276 - RNA, 22 nt, Artificial Sequence
  ELANE RNA Guide
caccaucacccucggccgccga

SEQ ID NO: 277 - RNA, 22 nt, Artificial Sequence
  ELANE RNA Guide
cagccccaccaucacccucggc

SEQ ID NO: 278 - RNA, 22 nt, Artificial Sequence
  ELANE RNA Guide
caucacccucggccgccgacuc

SEQ ID NO: 279 - RNA, 22 nt, Artificial Sequence
  ELANE RNA Guide
ccaccaucacccucggccgccg

SEQ ID NO: 280 - RNA, 22 nt, Artificial Sequence
  ELANE RNA Guide
ccagccccaccaucacccucgg

SEQ ID NO: 281 - RNA, 22 nt, Artificial Sequence
  ELANE RNA Guide
ccaucacccucggccgccgacu

SEQ ID NO: 282 - RNA, 22 nt, Artificial Sequence
  ELANE RNA Guide
cccaccaucacccucggccgcc

SEQ ID NO: 283 - RNA, 22 nt, Artificial Sequence
  ELANE RNA Guide
cccagccccaccaucacccucg

SEQ ID NO: 284 - RNA, 22 nt, Artificial Sequence
  ELANE RNA Guide
ccccaccaucacccucggccgc

SEQ ID NO: 285 - RNA, 22 nt, Artificial Sequence
  ELANE RNA Guide
ccccagccccaccaucacccuc

SEQ ID NO: 286 - RNA, 22 nt, Artificial Sequence
  ELANE RNA Guide
cccggagccccagccccaccau

SEQ ID NO: 287 - RNA, 22 nt, Artificial Sequence
  ELANE RNA Guide
ccgagggugaugguggggcugg

SEQ ID NO: 288 - RNA, 22 nt, Artificial Sequence
  ELANE RNA Guide
ccggagccccagccccaccauc

SEQ ID NO: 289 - RNA, 22 nt, Artificial Sequence
  ELANE RNA Guide
cgagggugaugguggggcuggg

SEQ ID NO: 290 - RNA, 22 nt, Artificial Sequence
  ELANE RNA Guide
cgagucggcggccgagggugau

SEQ ID NO: 291 - RNA, 22 nt, Artificial Sequence
  ELANE RNA Guide
cggagccccagccccaccauca

SEQ ID NO: 292 - RNA, 22 nt, Artificial Sequence
  ELANE RNA Guide
cggccgagggugaugguggggc

SEQ ID NO: 293 - RNA, 22 nt, Artificial Sequence
  ELANE RNA Guide
cggcggccgagggugauggugg

SEQ ID NO: 294 - RNA, 22 nt, Artificial Sequence
  ELANE RNA Guide
gacacgcgagucggcggccgag

SEQ ID NO: 295 - RNA, 22 nt, Artificial Sequence
  ELANE RNA Guide
gagccccagccccaccaucacc

SEQ ID NO: 296 - RNA, 22 nt, Artificial Sequence
  ELANE RNA Guide
gagggugaugguggggcugggg

SEQ ID NO: 297 - RNA, 22 nt, Artificial Sequence
  ELANE RNA Guide
gagucggcggccgagggugaug

SEQ ID NO: 298 - RNA, 22 nt, Artificial Sequence
  ELANE RNA Guide
gccccaccaucacccucggccg

SEQ ID NO: 299 - RNA, 22 nt, Artificial Sequence
  ELANE RNA Guide
gccccagccccaccaucacccu

SEQ ID NO: 300 - RNA, 22 nt, Artificial Sequence
  ELANE RNA Guide
gccgagggugaugguggggcug

SEQ ID NO: 301 - RNA, 22 nt, Artificial Sequence
  ELANE RNA Guide
gcgagucggcggccgaggguga

SEQ ID NO: 302 - RNA, 22 nt, Artificial Sequence
  ELANE RNA Guide
gcggccgagggugauggugggg

SEQ ID NO: 303 - RNA, 22 nt, Artificial Sequence
  ELANE RNA Guide
ggagccccagccccaccaucac

SEQ ID NO: 304 - RNA, 22 nt, Artificial Sequence
  ELANE RNA Guide
ggccgagggugaugguggggcu

SEQ ID NO: 305 - RNA, 22 nt, Artificial Sequence
  ELANE RNA Guide
ggcggccgagggugaugguggg

SEQ ID NO: 306 - RNA, 22 nt, Artificial Sequence
  ELANE RNA Guide
gggugaugguggggcuggggcu

SEQ ID NO: 307 - RNA, 22 nt, Artificial Sequence
  ELANE RNA Guide
ggugaugguggggcuggggcuc

SEQ ID NO: 308 - RNA, 22 nt, Artificial Sequence
  ELANE RNA Guide
gucggcggccgagggugauggu

SEQ ID NO: 309 - RNA, 22 nt, Artificial Sequence
  ELANE RNA Guide
gugaugguggggcuggggcucc

SEQ ID NO: 310 - RNA, 22 nt, Artificial Sequence
  ELANE RNA Guide
ucacccucggccgccgacucgc

SEQ ID NO: 311 - RNA, 22 nt, Artificial Sequence
  ELANE RNA Guide
ucggcggccgagggugauggug

SEQ ID NO: 312 - RNA, 22 nt, Artificial Sequence
  ELANE RNA Guide
ugaugguggggcuggggcuccg

SEQ ID NO: 313 - RNA, 20 nt, Artificial Sequence
  ELANE RNA Guide
aaaagacacgcgagucggcg

SEQ ID NO: 314 - RNA, 20 nt, Artificial Sequence
  ELANE RNA Guide
aaagacacgcgagucggcgg

SEQ ID NO: 315 - RNA, 20 nt, Artificial Sequence
  ELANE RNA Guide
aagacacgcgagucggcggc

SEQ ID NO: 316 - RNA, 20 nt, Artificial Sequence
  ELANE RNA Guide
acacgcgagucggcggcuga

SEQ ID NO: 317 - RNA, 20 nt, Artificial Sequence
  ELANE RNA Guide
accaugacccucagccgccg

SEQ ID NO: 318 - RNA, 20 nt, Artificial Sequence
  ELANE RNA Guide
acccucagccgccgacucgc

SEQ ID NO: 319 - RNA, 20 nt, Artificial Sequence
  ELANE RNA Guide
acgcgagucggcggcugagg

SEQ ID NO: 320 - RNA, 20 nt, Artificial Sequence
  ELANE RNA Guide
agacacgcgagucggcggcu

SEQ ID NO: 321 - RNA, 20 nt, Artificial Sequence
  ELANE RNA Guide
agccccaccaugacccucag

SEQ ID NO: 322 - RNA, 20 nt, Artificial Sequence
  ELANE RNA Guide
agucggcggcugagggucau

SEQ ID NO: 323 - RNA, 20 nt, Artificial Sequence
  ELANE RNA Guide
augacccucagccgccgacu

SEQ ID NO: 324 - RNA, 20 nt, Artificial Sequence
  ELANE RNA Guide
caccaugacccucagccgcc

SEQ ID NO: 325 - RNA, 20 nt, Artificial Sequence
  ELANE RNA Guide
cacgcgagucggcggcugag

SEQ ID NO: 326 - RNA, 20 nt, Artificial Sequence
  ELANE RNA Guide
cagccccaccaugacccuca

SEQ ID NO: 327 - RNA, 20 nt, Artificial Sequence
  ELANE RNA Guide
cagccgccgacucgcguguc

SEQ ID NO: 328 - RNA, 20 nt, Artificial Sequence
  ELANE RNA Guide
caugacccucagccgccgac

SEQ ID NO: 329 - RNA, 20 nt, Artificial Sequence
  ELANE RNA Guide
ccaccaugacccucagccgc

SEQ ID NO: 330 - RNA, 20 nt, Artificial Sequence
  ELANE RNA Guide
ccagccccaccaugacccuc

SEQ ID NO: 331 - RNA, 20 nt, Artificial Sequence
  ELANE RNA Guide
ccaugacccucagccgccga

SEQ ID NO: 332 - RNA, 20 nt, Artificial Sequence
  ELANE RNA Guide
cccaccaugacccucagccg

SEQ ID NO: 333 - RNA, 20 nt, Artificial Sequence
  ELANE RNA Guide
cccagccccaccaugacccu

SEQ ID NO: 334 - RNA, 20 nt, Artificial Sequence
  ELANE RNA Guide
ccccaccaugacccucagcc

SEQ ID NO: 335 - RNA, 20 nt, Artificial Sequence
  ELANE RNA Guide
ccccagccccaccaugaccc

SEQ ID NO: 336 - RNA, 20 nt, Artificial Sequence
  ELANE RNA Guide
cccucagccgccgacucgcg

SEQ ID NO: 337 - RNA, 20 nt, Artificial Sequence
  ELANE RNA Guide
ccucagccgccgacucgcgu

SEQ ID NO: 338 - RNA, 20 nt, Artificial Sequence
  ELANE RNA Guide
cgagucggcggcugaggguc

SEQ ID NO: 339 - RNA, 20 nt, Artificial Sequence
  ELANE RNA Guide
cgcgagucggcggcugaggg

SEQ ID NO: 340 - RNA, 20 nt, Artificial Sequence
  ELANE RNA Guide
cggcggcugagggucauggu

SEQ ID NO: 341 - RNA, 20 nt, Artificial Sequence
  ELANE RNA Guide
cggcugagggucaugguggg

SEQ ID NO: 342 - RNA, 20 nt, Artificial Sequence
  ELANE RNA Guide
cucagccgccgacucgcgug

SEQ ID NO: 343 - RNA, 20 nt, Artificial Sequence
  ELANE RNA Guide
cugagggucaugguggggcu

SEQ ID NO: 344 - RNA, 20 nt, Artificial Sequence
  ELANE RNA Guide
gaaaagacacgcgagucggc

SEQ ID NO: 345 - RNA, 20 nt, Artificial Sequence
  ELANE RNA Guide
gacacgcgagucggcggcug

SEQ ID NO: 346 - RNA, 20 nt, Artificial Sequence
  ELANE RNA Guide
gacccucagccgccgacucg

SEQ ID NO: 347 - RNA, 20 nt, Artificial Sequence
  ELANE RNA Guide
gagucggcggcugaggguca

SEQ ID NO: 348 - RNA, 20 nt, Artificial Sequence
  ELANE RNA Guide
gccccaccaugacccucagc

SEQ ID NO: 349 - RNA, 20 nt, Artificial Sequence
  ELANE RNA Guide
gccccagccccaccaugacc

SEQ ID NO: 350 - RNA, 20 nt, Artificial Sequence
  ELANE RNA Guide
gcgagucggcggcugagggu

SEQ ID NO: 351 - RNA, 20 nt, Artificial Sequence
  ELANE RNA Guide
gcggcugagggucauggugg

SEQ ID NO: 352 - RNA, 20 nt, Artificial Sequence
  ELANE RNA Guide
gcugagggucaugguggggc

SEQ ID NO: 353 - RNA, 20 nt, Artificial Sequence
  ELANE RNA Guide
ggcggcugagggucauggug

SEQ ID NO: 354 - RNA, 20 nt, Artificial Sequence
  ELANE RNA Guide
ggcugagggucauggugggg

SEQ ID NO: 355 - RNA, 20 nt, Artificial Sequence
  ELANE RNA Guide
gucggcggcugagggucaug

SEQ ID NO: 356 - RNA, 20 nt, Artificial Sequence
  ELANE RNA Guide
ucagccgccgacucgcgugu

SEQ ID NO: 357 - RNA, 20 nt, Artificial Sequence
  ELANE RNA Guide
ucggcggcugagggucaugg

SEQ ID NO: 358 - RNA, 20 nt, Artificial Sequence
  ELANE RNA Guide
ugacccucagccgccgacuc

SEQ ID NO: 359 - RNA, 21 nt, Artificial Sequence
  ELANE RNA Guide
aaaagacacgcgagucggcgg

SEQ ID NO: 360 - RNA, 21 nt, Artificial Sequence
  ELANE RNA Guide
aaagacacgcgagucggcggc

SEQ ID NO: 361 - RNA, 21 nt, Artificial Sequence
  ELANE RNA Guide
aagacacgcgagucggcggcu

SEQ ID NO: 362 - RNA, 21 nt, Artificial Sequence
  ELANE RNA Guide
acacgcgagucggcggcugag

SEQ ID NO: 363 - RNA, 21 nt, Artificial Sequence
  ELANE RNA Guide
accaugacccucagccgccga

SEQ ID NO: 364 - RNA, 21 nt, Artificial Sequence
  ELANE RNA Guide
acccucagccgccgacucgcg

SEQ ID NO: 365 - RNA, 21 nt, Artificial Sequence
  ELANE RNA Guide
acgcgagucggcggcugaggg

SEQ ID NO: 366 - RNA, 21 nt, Artificial Sequence
  ELANE RNA Guide
agacacgcgagucggcggcug

SEQ ID NO: 367 - RNA, 21 nt, Artificial Sequence
  ELANE RNA Guide
agccccaccaugacccucagc

SEQ ID NO: 368 - RNA, 21 nt, Artificial Sequence
  ELANE RNA Guide
agccccagccccaccaugacc

SEQ ID NO: 369 - RNA, 21 nt, Artificial Sequence
  ELANE RNA Guide
agucggcggcugagggucaug

SEQ ID NO: 370 - RNA, 21 nt, Artificial Sequence
  ELANE RNA Guide
augacccucagccgccgacuc

SEQ ID NO: 371 - RNA, 21 nt, Artificial Sequence
  ELANE RNA Guide
caccaugacccucagccgccg

SEQ ID NO: 372 - RNA, 21 nt, Artificial Sequence
  ELANE RNA Guide
cacgcgagucggcggcugagg

SEQ ID NO: 373 - RNA, 21 nt, Artificial Sequence
  ELANE RNA Guide
cagccccaccaugacccucag

SEQ ID NO: 374 - RNA, 21 nt, Artificial Sequence
  ELANE RNA Guide
cagccgccgacucgcgugucu

SEQ ID NO: 375 - RNA, 21 nt, Artificial Sequence
  ELANE RNA Guide
caugacccucagccgccgacu

SEQ ID NO: 376 - RNA, 21 nt, Artificial Sequence
  ELANE RNA Guide
ccaccaugacccucagccgcc

SEQ ID NO: 377 - RNA, 21 nt, Artificial Sequence
  ELANE RNA Guide
ccagccccaccaugacccuca

SEQ ID NO: 378 - RNA, 21 nt, Artificial Sequence
  ELANE RNA Guide
ccaugacccucagccgccgac

SEQ ID NO: 379 - RNA, 21 nt, Artificial Sequence
  ELANE RNA Guide
cccaccaugacccucagccgc

SEQ ID NO: 380 - RNA, 21 nt, Artificial Sequence
  ELANE RNA Guide
cccagccccaccaugacccuc

SEQ ID NO: 381 - RNA, 21 nt, Artificial Sequence
  ELANE RNA Guide
ccccaccaugacccucagccg

SEQ ID NO: 382 - RNA, 21 nt, Artificial Sequence
  ELANE RNA Guide
ccccagccccaccaugacccu

SEQ ID NO: 383 - RNA, 21 nt, Artificial Sequence
  ELANE RNA Guide
cccucagccgccgacucgcgu

SEQ ID NO: 384 - RNA, 21 nt, Artificial Sequence
  ELANE RNA Guide
ccucagccgccgacucgcgug

SEQ ID NO: 385 - RNA, 21 nt, Artificial Sequence
  ELANE RNA Guide
cgagucggcggcugaggguca

SEQ ID NO: 386 - RNA, 21 nt, Artificial Sequence
  ELANE RNA Guide
cgcgagucggcggcugagggu

SEQ ID NO: 387 - RNA, 21 nt, Artificial Sequence
  ELANE RNA Guide
cggcggcugagggucauggug

SEQ ID NO: 388 - RNA, 21 nt, Artificial Sequence
  ELANE RNA Guide
cggcugagggucauggugggg

SEQ ID NO: 389 - RNA, 21 nt, Artificial Sequence
  ELANE RNA Guide
cucagccgccgacucgcgugu

SEQ ID NO: 390 - RNA, 21 nt, Artificial Sequence
  ELANE RNA Guide
cugagggucaugguggggcug

SEQ ID NO: 391 - RNA, 21 nt, Artificial Sequence
  ELANE RNA Guide
gaaaagacacgcgagucggcg

SEQ ID NO: 392 - RNA, 21 nt, Artificial Sequence
  ELANE RNA Guide
gacacgcgagucggcggcuga

SEQ ID NO: 393 - RNA, 21 nt, Artificial Sequence
  ELANE RNA Guide
gacccucagccgccgacucgc

SEQ ID NO: 394 - RNA, 21 nt, Artificial Sequence
  ELANE RNA Guide
gagucggcggcugagggucau

SEQ ID NO: 395 - RNA, 21 nt, Artificial Sequence
  ELANE RNA Guide
gccccaccaugacccucagcc

SEQ ID NO: 396 - RNA, 21 nt, Artificial Sequence
  ELANE RNA Guide
gccccagccccaccaugaccc

SEQ ID NO: 397 - RNA, 21 nt, Artificial Sequence
  ELANE RNA Guide
gcgagucggcggcugaggguc

SEQ ID NO: 398 - RNA, 21 nt, Artificial Sequence
  ELANE RNA Guide
gcggcugagggucaugguggg

SEQ ID NO: 399 - RNA, 21 nt, Artificial Sequence
  ELANE RNA Guide
gcugagggucaugguggggcu

SEQ ID NO: 400 - RNA, 21 nt, Artificial Sequence
  ELANE RNA Guide
ggaaaagacacgcgagucggc

SEQ ID NO: 401 - RNA, 21 nt, Artificial Sequence
  ELANE RNA Guide
ggcggcugagggucauggugg

SEQ ID NO: 402 - RNA, 21 nt, Artificial Sequence
  ELANE RNA Guide
ggcugagggucaugguggggc

SEQ ID NO: 403 - RNA, 21 nt, Artificial Sequence
  ELANE RNA Guide
gucggcggcugagggucaugg

SEQ ID NO: 404 - RNA, 21 nt, Artificial Sequence
  ELANE RNA Guide
ucagccgccgacucgcguguc

SEQ ID NO: 405 - RNA, 21 nt, Artificial Sequence
  ELANE RNA Guide
ucggcggcugagggucauggu

SEQ ID NO: 406 - RNA, 21 nt, Artificial Sequence
  ELANE RNA Guide
ugacccucagccgccgacucg

SEQ ID NO: 407 - RNA, 22 nt, Artificial Sequence
  ELANE RNA Guide
aaaagacacgcgagucggcggc

SEQ ID NO: 408 - RNA, 22 nt, Artificial Sequence
  ELANE RNA Guide
aaagacacgcgagucggcggcu

SEQ ID NO: 409 - RNA, 22 nt, Artificial Sequence
  ELANE RNA Guide
aagacacgcgagucggcggcug

SEQ ID NO: 410 - RNA, 22 nt, Artificial Sequence
  ELANE RNA Guide
acacgcgagucggcggcugagg

SEQ ID NO: 411 - RNA, 22 nt, Artificial Sequence
  ELANE RNA Guide
accaugacccucagccgccgac

SEQ ID NO: 412 - RNA, 22 nt, Artificial Sequence
  ELANE RNA Guide
acccucagccgccgacucgcgu

SEQ ID NO: 413 - RNA, 22 nt, Artificial Sequence
  ELANE RNA Guide
acgcgagucggcggcugagggu

SEQ ID NO: 414 - RNA, 22 nt, Artificial Sequence
  ELANE RNA Guide
agacacgcgagucggcggcuga

SEQ ID NO: 415 - RNA, 22 nt, Artificial Sequence
  ELANE RNA Guide
agccccaccaugacccucagcc

SEQ ID NO: 416 - RNA, 22 nt, Artificial Sequence
  ELANE RNA Guide
agccccagccccaccaugaccc

SEQ ID NO: 417 - RNA, 22 nt, Artificial Sequence
  ELANE RNA Guide
aggaaaagacacgcgagucggc

SEQ ID NO: 418 - RNA, 22 nt, Artificial Sequence
  ELANE RNA Guide
agucggcggcugagggucaugg

SEQ ID NO: 419 - RNA, 22 nt, Artificial Sequence
  ELANE RNA Guide
augacccucagccgccgacucg

SEQ ID NO: 420 - RNA, 22 nt, Artificial Sequence
  ELANE RNA Guide
caccaugacccucagccgccga

SEQ ID NO: 421 - RNA, 22 nt, Artificial Sequence
  ELANE RNA Guide
cacgcgagucggcggcugaggg

SEQ ID NO: 422 - RNA, 22 nt, Artificial Sequence
  ELANE RNA Guide
cagccccaccaugacccucagc

SEQ ID NO: 423 - RNA, 22 nt, Artificial Sequence
  ELANE RNA Guide
cagccgccgacucgcgugucuu

SEQ ID NO: 424 - RNA, 22 nt, Artificial Sequence
  ELANE RNA Guide
caugacccucagccgccgacuc

SEQ ID NO: 425 - RNA, 22 nt, Artificial Sequence
  ELANE RNA Guide
ccaccaugacccucagccgccg

SEQ ID NO: 426 - RNA, 22 nt, Artificial Sequence
  ELANE RNA Guide
ccagccccaccaugacccucag

SEQ ID NO: 427 - RNA, 22 nt, Artificial Sequence
  ELANE RNA Guide
ccaugacccucagccgccgacu

SEQ ID NO: 428 - RNA, 22 nt, Artificial Sequence
  ELANE RNA Guide
cccaccaugacccucagccgcc

SEQ ID NO: 429 - RNA, 22 nt, Artificial Sequence
  ELANE RNA Guide
cccagccccaccaugacccuca

SEQ ID NO: 430 - RNA, 22 nt, Artificial Sequence
  ELANE RNA Guide
ccccaccaugacccucagccgc

SEQ ID NO: 431 - RNA, 22 nt, Artificial Sequence
  ELANE RNA Guide
ccccagccccaccaugacccuc

SEQ ID NO: 432 - RNA, 22 nt, Artificial Sequence
  ELANE RNA Guide
cccucagccgccgacucgcgug

SEQ ID NO: 433 - RNA, 22 nt, Artificial Sequence
  ELANE RNA Guide
ccucagccgccgacucgcgugu

SEQ ID NO: 434 - RNA, 22 nt, Artificial Sequence
  ELANE RNA Guide
cgagucggcggcugagggucau

SEQ ID NO: 435 - RNA, 22 nt, Artificial Sequence
  ELANE RNA Guide
cgcgagucggcggcugaggguc

SEQ ID NO: 436 - RNA, 22 nt, Artificial Sequence
  ELANE RNA Guide
cggcggcugagggucauggugg

SEQ ID NO: 437 - RNA, 22 nt, Artificial Sequence
  ELANE RNA Guide
cggcugagggucaugguggggc

SEQ ID NO: 438 - RNA, 22 nt, Artificial Sequence
  ELANE RNA Guide
cucagccgccgacucgcguguc

SEQ ID NO: 439 - RNA, 22 nt, Artificial Sequence
  ELANE RNA Guide
cugagggucaugguggggcugg

SEQ ID NO: 440 - RNA, 22 nt, Artificial Sequence
  ELANE RNA Guide
gaaaagacacgcgagucggcgg

SEQ ID NO: 441 - RNA, 22 nt, Artificial Sequence
  ELANE RNA Guide
gacacgcgagucggcggcugag

SEQ ID NO: 442 - RNA, 22 nt, Artificial Sequence
  ELANE RNA Guide
gacccucagccgccgacucgcg

SEQ ID NO: 443 - RNA, 22 nt, Artificial Sequence
  ELANE RNA Guide
gagccccagccccaccaugacc

SEQ ID NO: 444 - RNA, 22 nt, Artificial Sequence
  ELANE RNA Guide
gagucggcggcugagggucaug

SEQ ID NO: 445 - RNA, 22 nt, Artificial Sequence
  ELANE RNA Guide
gccccaccaugacccucagccg

SEQ ID NO: 446 - RNA, 22 nt, Artificial Sequence
  ELANE RNA Guide
gccccagccccaccaugacccu

SEQ ID NO: 447 - RNA, 22 nt, Artificial Sequence
  ELANE RNA Guide
gcgagucggcggcugaggguca

SEQ ID NO: 448 - RNA, 22 nt, Artificial Sequence
  ELANE RNA Guide
gcggcugagggucauggugggg

SEQ ID NO: 449 - RNA, 22 nt, Artificial Sequence
  ELANE RNA Guide
gcugagggucaugguggggcug

SEQ ID NO: 450 - RNA, 22 nt, Artificial Sequence
  ELANE RNA Guide
ggaaaagacacgcgagucggcg

SEQ ID NO: 451 - RNA, 22 nt, Artificial Sequence
  ELANE RNA Guide
ggcggcugagggucaugguggg

SEQ ID NO: 452 - RNA, 22 nt, Artificial Sequence
  ELANE RNA Guide
ggcugagggucaugguggggcu

SEQ ID NO: 453 - RNA, 22 nt, Artificial Sequence
  ELANE RNA Guide
gucggcggcugagggucauggu

SEQ ID NO: 454 - RNA, 22 nt, Artificial Sequence
  ELANE RNA Guide
ucagccgccgacucgcgugucu

SEQ ID NO: 455 - RNA, 22 nt, Artificial Sequence
  ELANE RNA Guide
ucggcggcugagggucauggug

SEQ ID NO: 456 - RNA, 22 nt, Artificial Sequence
  ELANE RNA Guide
ugacccucagccgccgacucgc

SEQ ID NO: 457 - RNA, 20 nt, Artificial Sequence
  ELANE RNA Guide
aaaagacacgcgagucggug

SEQ ID NO: 458 - RNA, 20 nt, Artificial Sequence
  ELANE RNA Guide
aaagacacgcgagucggugg

SEQ ID NO: 459 - RNA, 20 nt, Artificial Sequence
  ELANE RNA Guide
aagacacgcgagucgguggc

SEQ ID NO: 460 - RNA, 20 nt, Artificial Sequence
  ELANE RNA Guide
acacgcgagucgguggccga

SEQ ID NO: 461 - RNA, 20 nt, Artificial Sequence
  ELANE RNA Guide
accaugacccucggccaccg

SEQ ID NO: 462 - RNA, 20 nt, Artificial Sequence
  ELANE RNA Guide
acccucggccaccgacucgc

SEQ ID NO: 463 - RNA, 20 nt, Artificial Sequence
  ELANE RNA Guide
acgcgagucgguggccgagg

SEQ ID NO: 464 - RNA, 20 nt, Artificial Sequence
  ELANE RNA Guide
agacacgcgagucgguggcc

SEQ ID NO: 465 - RNA, 20 nt, Artificial Sequence
  ELANE RNA Guide
agccccaccaugacccucgg

SEQ ID NO: 466 - RNA, 20 nt, Artificial Sequence
  ELANE RNA Guide
aggaaaagacacgcgagucg

SEQ ID NO: 467 - RNA, 20 nt, Artificial Sequence
  ELANE RNA Guide
agucgguggccgagggucau

SEQ ID NO: 468 - RNA, 20 nt, Artificial Sequence
  ELANE RNA Guide
augacccucggccaccgacu

SEQ ID NO: 469 - RNA, 20 nt, Artificial Sequence
  ELANE RNA Guide
caccaugacccucggccacc

SEQ ID NO: 470 - RNA, 20 nt, Artificial Sequence
  ELANE RNA Guide
caccgacucgcgugucuuuu

SEQ ID NO: 471 - RNA, 20 nt, Artificial Sequence
  ELANE RNA Guide
cacgcgagucgguggccgag

SEQ ID NO: 472 - RNA, 20 nt, Artificial Sequence
  ELANE RNA Guide
cagccccaccaugacccucg

SEQ ID NO: 473 - RNA, 20 nt, Artificial Sequence
  ELANE RNA Guide
caugacccucggccaccgac

SEQ ID NO: 474 - RNA, 20 nt, Artificial Sequence
  ELANE RNA Guide
ccaccaugacccucggccac

SEQ ID NO: 475 - RNA, 20 nt, Artificial Sequence
  ELANE RNA Guide
ccaccgacucgcgugucuuu

SEQ ID NO: 476 - RNA, 20 nt, Artificial Sequence
  ELANE RNA Guide
ccaugacccucggccaccga

SEQ ID NO: 477 - RNA, 20 nt, Artificial Sequence
  ELANE RNA Guide
cccaccaugacccucggcca

SEQ ID NO: 478 - RNA, 20 nt, Artificial Sequence
  ELANE RNA Guide
ccccaccaugacccucggcc

SEQ ID NO: 479 - RNA, 20 nt, Artificial Sequence
  ELANE RNA Guide
cccucggccaccgacucgcg

SEQ ID NO: 480 - RNA, 20 nt, Artificial Sequence
  ELANE RNA Guide
ccucggccaccgacucgcgu

SEQ ID NO: 481 - RNA, 20 nt, Artificial Sequence
  ELANE RNA Guide
cgaggaaaagacacgcgagu

SEQ ID NO: 482 - RNA, 20 nt, Artificial Sequence
  ELANE RNA Guide
cgagucgguggccgaggguc

SEQ ID NO: 483 - RNA, 20 nt, Artificial Sequence
  ELANE RNA Guide
cgcgagucgguggccgaggg

SEQ ID NO: 484 - RNA, 20 nt, Artificial Sequence
  ELANE RNA Guide
cggccaccgacucgcguguc

SEQ ID NO: 485 - RNA, 20 nt, Artificial Sequence
  ELANE RNA Guide
cgguggccgagggucauggu

SEQ ID NO: 486 - RNA, 20 nt, Artificial Sequence
  ELANE RNA Guide
cucggccaccgacucgcgug

SEQ ID NO: 487 - RNA, 20 nt, Artificial Sequence
  ELANE RNA Guide
gaaaagacacgcgagucggu

SEQ ID NO: 488 - RNA, 20 nt, Artificial Sequence
  ELANE RNA Guide
gacacgcgagucgguggccg

SEQ ID NO: 489 - RNA, 20 nt, Artificial Sequence
  ELANE RNA Guide
gacccucggccaccgacucg

SEQ ID NO: 490 - RNA, 20 nt, Artificial Sequence
  ELANE RNA Guide
gaggaaaagacacgcgaguc

SEQ ID NO: 491 - RNA, 20 nt, Artificial Sequence
  ELANE RNA Guide
gagucgguggccgaggguca

SEQ ID NO: 492 - RNA, 20 nt, Artificial Sequence
  ELANE RNA Guide
gccaccgacucgcgugucuu

SEQ ID NO: 493 - RNA, 20 nt, Artificial Sequence
  ELANE RNA Guide
gccccaccaugacccucggc

SEQ ID NO: 494 - RNA, 20 nt, Artificial Sequence
  ELANE RNA Guide
gcgagucgguggccgagggu

SEQ ID NO: 495 - RNA, 20 nt, Artificial Sequence
  ELANE RNA Guide
ggaaaagacacgcgagucgg

SEQ ID NO: 496 - RNA, 20 nt, Artificial Sequence
  ELANE RNA Guide
ggccaccgacucgcgugucu

SEQ ID NO: 497 - RNA, 20 nt, Artificial Sequence
  ELANE RNA Guide
gguggccgagggucauggug

SEQ ID NO: 498 - RNA, 20 nt, Artificial Sequence
  ELANE RNA Guide
gucgguggccgagggucaug

SEQ ID NO: 499 - RNA, 20 nt, Artificial Sequence
  ELANE RNA Guide
guggccgagggucauggugg

SEQ ID NO: 500 - RNA, 20 nt, Artificial Sequence
  ELANE RNA Guide
ucggccaccgacucgcgugu

SEQ ID NO: 501 - RNA, 20 nt, Artificial Sequence
  ELANE RNA Guide
ucgguggccgagggucaugg

SEQ ID NO: 502 - RNA, 20 nt, Artificial Sequence
  ELANE RNA Guide
ugacccucggccaccgacuc

SEQ ID NO: 503 - RNA, 21 nt, Artificial Sequence
  ELANE RNA Guide
aaaagacacgcgagucggugg

SEQ ID NO: 504 - RNA, 21 nt, Artificial Sequence
  ELANE RNA Guide
aaagacacgcgagucgguggc

SEQ ID NO: 505 - RNA, 21 nt, Artificial Sequence
  ELANE RNA Guide
aagacacgcgagucgguggcc

SEQ ID NO: 506 - RNA, 21 nt, Artificial Sequence
  ELANE RNA Guide
acacgcgagucgguggccgag

SEQ ID NO: 507 - RNA, 21 nt, Artificial Sequence
  ELANE RNA Guide
accaugacccucggccaccga

SEQ ID NO: 508 - RNA, 21 nt, Artificial Sequence
  ELANE RNA Guide
acccucggccaccgacucgcg

SEQ ID NO: 509 - RNA, 21 nt, Artificial Sequence
  ELANE RNA Guide
acgcgagucgguggccgaggg

SEQ ID NO: 510 - RNA, 21 nt, Artificial Sequence
  ELANE RNA Guide
agacacgcgagucgguggccg

SEQ ID NO: 511 - RNA, 21 nt, Artificial Sequence
  ELANE RNA Guide
agccccaccaugacccucggc

SEQ ID NO: 512 - RNA, 21 nt, Artificial Sequence
  ELANE RNA Guide
aggaaaagacacgcgagucgg

SEQ ID NO: 513 - RNA, 21 nt, Artificial Sequence
  ELANE RNA Guide
agucgguggccgagggucaug

SEQ ID NO: 514 - RNA, 21 nt, Artificial Sequence
  ELANE RNA Guide
augacccucggccaccgacuc

SEQ ID NO: 515 - RNA, 21 nt, Artificial Sequence
  ELANE RNA Guide
caccaugacccucggccaccg

SEQ ID NO: 516 - RNA, 21 nt, Artificial Sequence
  ELANE RNA Guide
caccgacucgcgugucuuuuc

SEQ ID NO: 517 - RNA, 21 nt, Artificial Sequence
  ELANE RNA Guide
cacgcgagucgguggccgagg

SEQ ID NO: 518 - RNA, 21 nt, Artificial Sequence
  ELANE RNA Guide
cagccccaccaugacccucgg

SEQ ID NO: 519 - RNA, 21 nt, Artificial Sequence
  ELANE RNA Guide
caugacccucggccaccgacu

SEQ ID NO: 520 - RNA, 21 nt, Artificial Sequence
  ELANE RNA Guide
ccaccaugacccucggccacc

SEQ ID NO: 521 - RNA, 21 nt, Artificial Sequence
  ELANE RNA Guide
ccaccgacucgcgugucuuuu

SEQ ID NO: 522 - RNA, 21 nt, Artificial Sequence
  ELANE RNA Guide
ccagccccaccaugacccucg

SEQ ID NO: 523 - RNA, 21 nt, Artificial Sequence
  ELANE RNA Guide
ccaugacccucggccaccgac

SEQ ID NO: 524 - RNA, 21 nt, Artificial Sequence
  ELANE RNA Guide
cccaccaugacccucggccac

SEQ ID NO: 525 - RNA, 21 nt, Artificial Sequence
  ELANE RNA Guide
ccccaccaugacccucggcca

SEQ ID NO: 526 - RNA, 21 nt, Artificial Sequence
  ELANE RNA Guide
cccucggccaccgacucgcgu

SEQ ID NO: 527 - RNA, 21 nt, Artificial Sequence
  ELANE RNA Guide
ccucggccaccgacucgcgug

SEQ ID NO: 528 - RNA, 21 nt, Artificial Sequence
  ELANE RNA Guide
cgaggaaaagacacgcgaguc

SEQ ID NO: 529 - RNA, 21 nt, Artificial Sequence
  ELANE RNA Guide
cgagucgguggccgaggguca

SEQ ID NO: 530 - RNA, 21 nt, Artificial Sequence
  ELANE RNA Guide
cgcgagucgguggccgagggu

SEQ ID NO: 531 - RNA, 21 nt, Artificial Sequence
  ELANE RNA Guide
cggccaccgacucgcgugucu

SEQ ID NO: 532 - RNA, 21 nt, Artificial Sequence
  ELANE RNA Guide
cgguggccgagggucauggug

SEQ ID NO: 533 - RNA, 21 nt, Artificial Sequence
  ELANE RNA Guide
cucggccaccgacucgcgugu

SEQ ID NO: 534 - RNA, 21 nt, Artificial Sequence
  ELANE RNA Guide
gaaaagacacgcgagucggug

SEQ ID NO: 535 - RNA, 21 nt, Artificial Sequence
  ELANE RNA Guide
gacacgcgagucgguggccga

SEQ ID NO: 536 - RNA, 21 nt, Artificial Sequence
  ELANE RNA Guide
gacccucggccaccgacucgc

SEQ ID NO: 537 - RNA, 21 nt, Artificial Sequence
  ELANE RNA Guide
gaggaaaagacacgcgagucg

SEQ ID NO: 538 - RNA, 21 nt, Artificial Sequence
  ELANE RNA Guide
gagucgguggccgagggucau

SEQ ID NO: 539 - RNA, 21 nt, Artificial Sequence
  ELANE RNA Guide
gccaccgacucgcgugucuuu

SEQ ID NO: 540 - RNA, 21 nt, Artificial Sequence
  ELANE RNA Guide
gccccaccaugacccucggcc

SEQ ID NO: 541 - RNA, 21 nt, Artificial Sequence
  ELANE RNA Guide
gcgaggaaaagacacgcgagu

SEQ ID NO: 542 - RNA, 21 nt, Artificial Sequence
  ELANE RNA Guide
gcgagucgguggccgaggguc

SEQ ID NO: 543 - RNA, 21 nt, Artificial Sequence
  ELANE RNA Guide
ggaaaagacacgcgagucggu

SEQ ID NO: 544 - RNA, 21 nt, Artificial Sequence
  ELANE RNA Guide
ggccaccgacucgcgugucuu

SEQ ID NO: 545 - RNA, 21 nt, Artificial Sequence
  ELANE RNA Guide
gguggccgagggucauggugg

SEQ ID NO: 546 - RNA, 21 nt, Artificial Sequence
  ELANE RNA Guide
gucgguggccgagggucaugg

SEQ ID NO: 547 - RNA, 21 nt, Artificial Sequence
  ELANE RNA Guide
guggccgagggucaugguggg

SEQ ID NO: 548 - RNA, 21 nt, Artificial Sequence
  ELANE RNA Guide
ucggccaccgacucgcguguc

SEQ ID NO: 549 - RNA, 21 nt, Artificial Sequence
  ELANE RNA Guide
ucgguggccgagggucauggu

SEQ ID NO: 550 - RNA, 21 nt, Artificial Sequence
  ELANE RNA Guide
ugacccucggccaccgacucg

SEQ ID NO: 551 - RNA, 22 nt, Artificial Sequence
  ELANE RNA Guide
aaaagacacgcgagucgguggc

SEQ ID NO: 552 - RNA, 22 nt, Artificial Sequence
  ELANE RNA Guide
aaagacacgcgagucgguggcc

SEQ ID NO: 553 - RNA, 22 nt, Artificial Sequence
  ELANE RNA Guide
aagacacgcgagucgguggccg

SEQ ID NO: 554 - RNA, 22 nt, Artificial Sequence
  ELANE RNA Guide
acacgcgagucgguggccgagg

SEQ ID NO: 555 - RNA, 22 nt, Artificial Sequence
  ELANE RNA Guide
accaugacccucggccaccgac

SEQ ID NO: 556 - RNA, 22 nt, Artificial Sequence
  ELANE RNA Guide
acccucggccaccgacucgcgu

SEQ ID NO: 557 - RNA, 22 nt, Artificial Sequence
  ELANE RNA Guide
acgcgagucgguggccgagggu

SEQ ID NO: 558 - RNA, 22 nt, Artificial Sequence
  ELANE RNA Guide
agacacgcgagucgguggccga

SEQ ID NO: 559 - RNA, 22 nt, Artificial Sequence
  ELANE RNA Guide
agccccaccaugacccucggcc

SEQ ID NO: 560 - RNA, 22 nt, Artificial Sequence
  ELANE RNA Guide
aggaaaagacacgcgagucggu

SEQ ID NO: 561 - RNA, 22 nt, Artificial Sequence
  ELANE RNA Guide
agucgguggccgagggucaugg

SEQ ID NO: 562 - RNA, 22 nt, Artificial Sequence
  ELANE RNA Guide
augacccucggccaccgacucg

SEQ ID NO: 563 - RNA, 22 nt, Artificial Sequence
  ELANE RNA Guide
caccaugacccucggccaccga

SEQ ID NO: 564 - RNA, 22 nt, Artificial Sequence
  ELANE RNA Guide
caccgacucgcgugucuuuucc

SEQ ID NO: 565 - RNA, 22 nt, Artificial Sequence
  ELANE RNA Guide
cacgcgagucgguggccgaggg

SEQ ID NO: 566 - RNA, 22 nt, Artificial Sequence
  ELANE RNA Guide
cagccccaccaugacccucggc

SEQ ID NO: 567 - RNA, 22 nt, Artificial Sequence
  ELANE RNA Guide
caugacccucggccaccgacuc

SEQ ID NO: 568 - RNA, 22 nt, Artificial Sequence
  ELANE RNA Guide
ccaccaugacccucggccaccg

SEQ ID NO: 569 - RNA, 22 nt, Artificial Sequence
  ELANE RNA Guide
ccaccgacucgcgugucuuuuc

SEQ ID NO: 570 - RNA, 22 nt, Artificial Sequence
  ELANE RNA Guide
ccagccccaccaugacccucgg

SEQ ID NO: 571 - RNA, 22 nt, Artificial Sequence
  ELANE RNA Guide
ccaugacccucggccaccgacu

SEQ ID NO: 572 - RNA, 22 nt, Artificial Sequence
  ELANE RNA Guide
cccaccaugacccucggccacc

SEQ ID NO: 573 - RNA, 22 nt, Artificial Sequence
  ELANE RNA Guide
cccagccccaccaugacccucg

SEQ ID NO: 574 - RNA, 22 nt, Artificial Sequence
  ELANE RNA Guide
ccccaccaugacccucggccac

SEQ ID NO: 575 - RNA, 22 nt, Artificial Sequence
  ELANE RNA Guide
cccucggccaccgacucgcgug

SEQ ID NO: 576 - RNA, 22 nt, Artificial Sequence
  ELANE RNA Guide
ccucggccaccgacucgcgugu

SEQ ID NO: 577 - RNA, 22 nt, Artificial Sequence
  ELANE RNA Guide
cgaggaaaagacacgcgagucg

SEQ ID NO: 578 - RNA, 22 nt, Artificial Sequence
  ELANE RNA Guide
cgagucgguggccgagggucau

SEQ ID NO: 579 - RNA, 22 nt, Artificial Sequence
  ELANE RNA Guide
cgcgagucgguggccgaggguc

SEQ ID NO: 580 - RNA, 22 nt, Artificial Sequence
  ELANE RNA Guide
cggccaccgacucgcgugucuu

SEQ ID NO: 581 - RNA, 22 nt, Artificial Sequence
  ELANE RNA Guide
cgguggccgagggucauggugg

SEQ ID NO: 582 - RNA, 22 nt, Artificial Sequence
  ELANE RNA Guide
cucggccaccgacucgcguguc

SEQ ID NO: 583 - RNA, 22 nt, Artificial Sequence
  ELANE RNA Guide
gaaaagacacgcgagucggugg

SEQ ID NO: 584 - RNA, 22 nt, Artificial Sequence
  ELANE RNA Guide
gacacgcgagucgguggccgag

SEQ ID NO: 585 - RNA, 22 nt, Artificial Sequence
  ELANE RNA Guide
gacccucggccaccgacucgcg

SEQ ID NO: 586 - RNA, 22 nt, Artificial Sequence
  ELANE RNA Guide
gaggaaaagacacgcgagucgg

SEQ ID NO: 587 - RNA, 22 nt, Artificial Sequence
  ELANE RNA Guide
gagucgguggccgagggucaug

SEQ ID NO: 588 - RNA, 22 nt, Artificial Sequence
  ELANE RNA Guide
gccaccgacucgcgugucuuuu

SEQ ID NO: 589 - RNA, 22 nt, Artificial Sequence
  ELANE RNA Guide
gccccaccaugacccucggcca

SEQ ID NO: 590 - RNA, 22 nt, Artificial Sequence
  ELANE RNA Guide
gcgaggaaaagacacgcgaguc

SEQ ID NO: 591 - RNA, 22 nt, Artificial Sequence
  ELANE RNA Guide
gcgagucgguggccgaggguca

SEQ ID NO: 592 - RNA, 22 nt, Artificial Sequence
  ELANE RNA Guide
ggaaaagacacgcgagucggug

SEQ ID NO: 593 - RNA, 22 nt, Artificial Sequence
  ELANE RNA Guide
ggccaccgacucgcgugucuuu

SEQ ID NO: 594 - RNA, 22 nt, Artificial Sequence
  ELANE RNA Guide
ggcgaggaaaagacacgcgagu

SEQ ID NO: 595 - RNA, 22 nt, Artificial Sequence
  ELANE RNA Guide
gguggccgagggucaugguggg

SEQ ID NO: 596 - RNA, 22 nt, Artificial Sequence
  ELANE RNA Guide
gucgguggccgagggucauggu

SEQ ID NO: 597 - RNA, 22 nt, Artificial Sequence
  ELANE RNA Guide
guggccgagggucauggugggg

SEQ ID NO: 598 - RNA, 22 nt, Artificial Sequence
  ELANE RNA Guide
ucggccaccgacucgcgugucu

SEQ ID NO: 599 - RNA, 22 nt, Artificial Sequence
  ELANE RNA Guide
ucgguggccgagggucauggug

SEQ ID NO: 600 - RNA, 22 nt, Artificial Sequence
  ELANE RNA Guide
ugacccucggccaccgacucgc

SEQ ID NO: 601 - RNA, 20 nt, Artificial Sequence
  ELANE RNA Guide
acacgcgagucggcggcggc

SEQ ID NO: 602 - RNA, 20 nt, Artificial Sequence
  ELANE RNA Guide
accaugacccucggccgccg

SEQ ID NO: 603 - RNA, 20 nt, Artificial Sequence
  ELANE RNA Guide
acccucggccgccgccgacu

SEQ ID NO: 604 - RNA, 20 nt, Artificial Sequence
  ELANE RNA Guide
agacacgcgagucggcggcg

SEQ ID NO: 605 - RNA, 20 nt, Artificial Sequence
  ELANE RNA Guide
agucggcggcggccgagggu

SEQ ID NO: 606 - RNA, 20 nt, Artificial Sequence
  ELANE RNA Guide
augacccucggccgccgccg

SEQ ID NO: 607 - RNA, 20 nt, Artificial Sequence
  ELANE RNA Guide
caccaugacccucggccgcc

SEQ ID NO: 608 - RNA, 20 nt, Artificial Sequence
  ELANE RNA Guide
caugacccucggccgccgcc

SEQ ID NO: 609 - RNA, 20 nt, Artificial Sequence
  ELANE RNA Guide
ccaccaugacccucggccgc

SEQ ID NO: 610 - RNA, 20 nt, Artificial Sequence
  ELANE RNA Guide
ccaugacccucggccgccgc

SEQ ID NO: 611 - RNA, 20 nt, Artificial Sequence
  ELANE RNA Guide
cccaccaugacccucggccg

SEQ ID NO: 612 - RNA, 20 nt, Artificial Sequence
  ELANE RNA Guide
ccgccgccgacucgcguguc

SEQ ID NO: 613 - RNA, 20 nt, Artificial Sequence
  ELANE RNA Guide
cgccgccgacucgcgugucu

SEQ ID NO: 614 - RNA, 20 nt, Artificial Sequence
  ELANE RNA Guide
cggcggcggccgagggucau

SEQ ID NO: 615 - RNA, 20 nt, Artificial Sequence
  ELANE RNA Guide
gacacgcgagucggcggcgg

SEQ ID NO: 616 - RNA, 20 nt, Artificial Sequence
  ELANE RNA Guide
gccgccgccgacucgcgugu

SEQ ID NO: 617 - RNA, 20 nt, Artificial Sequence
  ELANE RNA Guide
gcggcggccgagggucaugg

SEQ ID NO: 618 - RNA, 20 nt, Artificial Sequence
  ELANE RNA Guide
ggcggcggccgagggucaug

SEQ ID NO: 619 - RNA, 20 nt, Artificial Sequence
  ELANE RNA Guide
ucggcggcggccgaggguca

SEQ ID NO: 620 - RNA, 20 nt, Artificial Sequence
  ELANE RNA Guide
ugacccucggccgccgccga

SEQ ID NO: 621 - RNA, 21 nt, Artificial Sequence
  ELANE RNA Guide
aagacacgcgagucggcggcg

SEQ ID NO: 622 - RNA, 21 nt, Artificial Sequence
  ELANE RNA Guide
accaugacccucggccgccgc

SEQ ID NO: 623 - RNA, 21 nt, Artificial Sequence
  ELANE RNA Guide
agacacgcgagucggcggcgg

SEQ ID NO: 624 - RNA, 21 nt, Artificial Sequence
  ELANE RNA Guide
augacccucggccgccgccga

SEQ ID NO: 625 - RNA, 21 nt, Artificial Sequence
  ELANE RNA Guide
caccaugacccucggccgccg

SEQ ID NO: 626 - RNA, 21 nt, Artificial Sequence
  ELANE RNA Guide
ccaccaugacccucggccgcc

SEQ ID NO: 627 - RNA, 21 nt, Artificial Sequence
  ELANE RNA Guide
cccaccaugacccucggccgc

SEQ ID NO: 628 - RNA, 21 nt, Artificial Sequence
  ELANE RNA Guide
ccccaccaugacccucggccg

SEQ ID NO: 629 - RNA, 21 nt, Artificial Sequence
  ELANE RNA Guide
ccgccgccgacucgcgugucu

SEQ ID NO: 630 - RNA, 21 nt, Artificial Sequence
  ELANE RNA Guide
cgccgccgacucgcgugucuu

SEQ ID NO: 631 - RNA, 21 nt, Artificial Sequence
  ELANE RNA Guide
gcggcggccgagggucauggu

SEQ ID NO: 632 - RNA, 21 nt, Artificial Sequence
  ELANE RNA Guide
ucggcggcggccgagggucau

SEQ ID NO: 633 - RNA, 22 nt, Artificial Sequence
  ELANE RNA Guide
aaagacacgcgagucggcggcg

SEQ ID NO: 634 - RNA, 22 nt, Artificial Sequence
  ELANE RNA Guide
aagacacgcgagucggcggcgg

SEQ ID NO: 635 - RNA, 22 nt, Artificial Sequence
  ELANE RNA Guide
accaugacccucggccgccgcc

SEQ ID NO: 636 - RNA, 22 nt, Artificial Sequence
  ELANE RNA Guide
agacacgcgagucggcggcggc

SEQ ID NO: 637 - RNA, 22 nt, Artificial Sequence
  ELANE RNA Guide
agucggcggcggccgaggguca

SEQ ID NO: 638 - RNA, 22 nt, Artificial Sequence
  ELANE RNA Guide
augacccucggccgccgccgac

SEQ ID NO: 639 - RNA, 22 nt, Artificial Sequence
  ELANE RNA Guide
caccaugacccucggccgccgc

SEQ ID NO: 640 - RNA, 22 nt, Artificial Sequence
  ELANE RNA Guide
caugacccucggccgccgccga

SEQ ID NO: 641 - RNA, 22 nt, Artificial Sequence
  ELANE RNA Guide
ccaccaugacccucggccgccg

SEQ ID NO: 642 - RNA, 22 nt, Artificial Sequence
  ELANE RNA Guide
cccaccaugacccucggccgcc

SEQ ID NO: 643 - RNA, 22 nt, Artificial Sequence
  ELANE RNA Guide
ccccaccaugacccucggccgc

SEQ ID NO: 644 - RNA, 22 nt, Artificial Sequence
  ELANE RNA Guide
ccgccgccgacucgcgugucuu

SEQ ID NO: 645 - RNA, 22 nt, Artificial Sequence
  ELANE RNA Guide
cgccgccgacucgcgugucuuu

SEQ ID NO: 646 - RNA, 22 nt, Artificial Sequence
  ELANE RNA Guide
gccccaccaugacccucggccg

SEQ ID NO: 647 - RNA, 22 nt, Artificial Sequence
  ELANE RNA Guide
gccgccgccgacucgcgugucu

SEQ ID NO: 648 - RNA, 22 nt, Artificial Sequence
  ELANE RNA Guide
gcggcggccgagggucauggug

SEQ ID NO: 649 - RNA, 22 nt, Artificial Sequence
  ELANE RNA Guide
ggcggcggccgagggucauggu

SEQ ID NO: 650 - RNA, 22 nt, Artificial Sequence
  ELANE RNA Guide
gucggcggcggccgagggucau

SEQ ID NO: 651 - RNA, 22 nt, Artificial Sequence
  ELANE RNA Guide
ucggcggcggccgagggucaug

SEQ ID NO: 652 - RNA, 22 nt, Artificial Sequence
  ELANE RNA Guide
ugacccucggccgccgccgacu

SEQ ID NO: 653 - RNA, 20 nt, Artificial Sequence
  ELANE RNA Guide
aaaagacacgugagucggcg

SEQ ID NO: 654 - RNA, 20 nt, Artificial Sequence
  ELANE RNA Guide
aaagacacgugagucggcgg

SEQ ID NO: 655 - RNA, 20 nt, Artificial Sequence
  ELANE RNA Guide
aagacacgugagucggcggc

SEQ ID NO: 656 - RNA, 20 nt, Artificial Sequence
  ELANE RNA Guide
acacaggcgaggaaaagaca

SEQ ID NO: 657 - RNA, 20 nt, Artificial Sequence
  ELANE RNA Guide
acacgugagucggcggccga

SEQ ID NO: 658 - RNA, 20 nt, Artificial Sequence
  ELANE RNA Guide
acaggcgaggaaaagacacg

SEQ ID NO: 659 - RNA, 20 nt, Artificial Sequence
  ELANE RNA Guide
acccucggccgccgacucac

SEQ ID NO: 660 - RNA, 20 nt, Artificial Sequence
  ELANE RNA Guide
acgugagucggcggccgagg

SEQ ID NO: 661 - RNA, 20 nt, Artificial Sequence
  ELANE RNA Guide
acucacgugucuuuuccucg

SEQ ID NO: 662 - RNA, 20 nt, Artificial Sequence
  ELANE RNA Guide
agacacgugagucggcggcc

SEQ ID NO: 663 - RNA, 20 nt, Artificial Sequence
  ELANE RNA Guide
aggaaaagacacgugagucg

SEQ ID NO: 664 - RNA, 20 nt, Artificial Sequence
  ELANE RNA Guide
aggcgaggaaaagacacgug

SEQ ID NO: 665 - RNA, 20 nt, Artificial Sequence
  ELANE RNA Guide
augacccucggccgccgacu

SEQ ID NO: 666 - RNA, 20 nt, Artificial Sequence
  ELANE RNA Guide
cacaggcgaggaaaagacac

SEQ ID NO: 667 - RNA, 20 nt, Artificial Sequence
  ELANE RNA Guide
cacgugagucggcggccgag

SEQ ID NO: 668 - RNA, 20 nt, Artificial Sequence
  ELANE RNA Guide
cacgugucuuuuccucgccu

SEQ ID NO: 669 - RNA, 20 nt, Artificial Sequence
  ELANE RNA Guide
caggcgaggaaaagacacgu

SEQ ID NO: 670 - RNA, 20 nt, Artificial Sequence
  ELANE RNA Guide
caugacccucggccgccgac

SEQ ID NO: 671 - RNA, 20 nt, Artificial Sequence
  ELANE RNA Guide
ccaugacccucggccgccga

SEQ ID NO: 672 - RNA, 20 nt, Artificial Sequence
  ELANE RNA Guide
cccucggccgccgacucacg

SEQ ID NO: 673 - RNA, 20 nt, Artificial Sequence
  ELANE RNA Guide
ccgacucacgugucuuuucc

SEQ ID NO: 674 - RNA, 20 nt, Artificial Sequence
  ELANE RNA Guide
ccgccgacucacgugucuuu

SEQ ID NO: 675 - RNA, 20 nt, Artificial Sequence
  ELANE RNA Guide
ccucggccgccgacucacgu

SEQ ID NO: 676 - RNA, 20 nt, Artificial Sequence
  ELANE RNA Guide
cgacucacgugucuuuuccu

SEQ ID NO: 677 - RNA, 20 nt, Artificial Sequence
  ELANE RNA Guide
cgaggaaaagacacgugagu

SEQ ID NO: 678 - RNA, 20 nt, Artificial Sequence
  ELANE RNA Guide
cgccgacucacgugucuuuu

SEQ ID NO: 679 - RNA, 20 nt, Artificial Sequence
  ELANE RNA Guide
cggccgccgacucacguguc

SEQ ID NO: 680 - RNA, 20 nt, Artificial Sequence
  ELANE RNA Guide
cgugagucggcggccgaggg

SEQ ID NO: 681 - RNA, 20 nt, Artificial Sequence
  ELANE RNA Guide
cucacgugucuuuuccucgc

SEQ ID NO: 682 - RNA, 20 nt, Artificial Sequence
  ELANE RNA Guide
cucggccgccgacucacgug

SEQ ID NO: 683 - RNA, 20 nt, Artificial Sequence
  ELANE RNA Guide
gaaaagacacgugagucggc

SEQ ID NO: 684 - RNA, 20 nt, Artificial Sequence
  ELANE RNA Guide
gacacaggcgaggaaaagac

SEQ ID NO: 685 - RNA, 20 nt, Artificial Sequence
  ELANE RNA Guide
gacacgugagucggcggccg

SEQ ID NO: 686 - RNA, 20 nt, Artificial Sequence
  ELANE RNA Guide
gacccucggccgccgacuca

SEQ ID NO: 687 - RNA, 20 nt, Artificial Sequence
  ELANE RNA Guide
gacucacgugucuuuuccuc

SEQ ID NO: 688 - RNA, 20 nt, Artificial Sequence
  ELANE RNA Guide
gaggaaaagacacgugaguc

SEQ ID NO: 689 - RNA, 20 nt, Artificial Sequence
  ELANE RNA Guide
gccgacucacgugucuuuuc

SEQ ID NO: 690 - RNA, 20 nt, Artificial Sequence
  ELANE RNA Guide
gccgccgacucacgugucuu

SEQ ID NO: 691 - RNA, 20 nt, Artificial Sequence
  ELANE RNA Guide
gcgaggaaaagacacgugag

SEQ ID NO: 692 - RNA, 20 nt, Artificial Sequence
  ELANE RNA Guide
ggaaaagacacgugagucgg

SEQ ID NO: 693 - RNA, 20 nt, Artificial Sequence
  ELANE RNA Guide
ggccgccgacucacgugucu

SEQ ID NO: 694 - RNA, 20 nt, Artificial Sequence
  ELANE RNA Guide
ggcgaggaaaagacacguga

SEQ ID NO: 695 - RNA, 20 nt, Artificial Sequence
  ELANE RNA Guide
gugagucggcggccgagggu

SEQ ID NO: 696 - RNA, 20 nt, Artificial Sequence
  ELANE RNA Guide
ucacgugucuuuuccucgcc

SEQ ID NO: 697 - RNA, 20 nt, Artificial Sequence
  ELANE RNA Guide
ucggccgccgacucacgugu

SEQ ID NO: 698 - RNA, 20 nt, Artificial Sequence
  ELANE RNA Guide
ugacccucggccgccgacuc

SEQ ID NO: 699 - RNA, 21 nt, Artificial Sequence
  ELANE RNA Guide
aaaagacacgugagucggcgg

SEQ ID NO: 700 - RNA, 21 nt, Artificial Sequence
  ELANE RNA Guide
aaagacacgugagucggcggc

SEQ ID NO: 701 - RNA, 21 nt, Artificial Sequence
  ELANE RNA Guide
aagacacgugagucggcggcc

SEQ ID NO: 702 - RNA, 21 nt, Artificial Sequence
  ELANE RNA Guide
acacaggcgaggaaaagacac

SEQ ID NO: 703 - RNA, 21 nt, Artificial Sequence
  ELANE RNA Guide
acacgugagucggcggccgag

SEQ ID NO: 704 - RNA, 21 nt, Artificial Sequence
  ELANE RNA Guide
acaggcgaggaaaagacacgu

SEQ ID NO: 705 - RNA, 21 nt, Artificial Sequence
  ELANE RNA Guide
accaugacccucggccgccga

SEQ ID NO: 706 - RNA, 21 nt, Artificial Sequence
  ELANE RNA Guide
acccucggccgccgacucacg

SEQ ID NO: 707 - RNA, 21 nt, Artificial Sequence
  ELANE RNA Guide
acgugagucggcggccgaggg

SEQ ID NO: 708 - RNA, 21 nt, Artificial Sequence
  ELANE RNA Guide
acucacgugucuuuuccucgc

SEQ ID NO: 709 - RNA, 21 nt, Artificial Sequence
  ELANE RNA Guide
agacacgugagucggcggccg

SEQ ID NO: 710 - RNA, 21 nt, Artificial Sequence
  ELANE RNA Guide
aggaaaagacacgugagucgg

SEQ ID NO: 711 - RNA, 21 nt, Artificial Sequence
  ELANE RNA Guide
aggcgaggaaaagacacguga

SEQ ID NO: 712 - RNA, 21 nt, Artificial Sequence
  ELANE RNA Guide
augacccucggccgccgacuc

SEQ ID NO: 713 - RNA, 21 nt, Artificial Sequence
  ELANE RNA Guide
cacaggcgaggaaaagacacg

SEQ ID NO: 714 - RNA, 21 nt, Artificial Sequence
  ELANE RNA Guide
cacgugagucggcggccgagg

SEQ ID NO: 715 - RNA, 21 nt, Artificial Sequence
  ELANE RNA Guide
cacgugucuuuuccucgccug

SEQ ID NO: 716 - RNA, 21 nt, Artificial Sequence
  ELANE RNA Guide
caggcgaggaaaagacacgug

SEQ ID NO: 717 - RNA, 21 nt, Artificial Sequence
  ELANE RNA Guide
caugacccucggccgccgacu

SEQ ID NO: 718 - RNA, 21 nt, Artificial Sequence
  ELANE RNA Guide
ccaugacccucggccgccgac

SEQ ID NO: 719 - RNA, 21 nt, Artificial Sequence
  ELANE RNA Guide
cccucggccgccgacucacgu

SEQ ID NO: 720 - RNA, 21 nt, Artificial Sequence
  ELANE RNA Guide
ccgacucacgugucuuuuccu

SEQ ID NO: 721 - RNA, 21 nt, Artificial Sequence
  ELANE RNA Guide
ccgccgacucacgugucuuuu

SEQ ID NO: 722 - RNA, 21 nt, Artificial Sequence
  ELANE RNA Guide
ccucggccgccgacucacgug

SEQ ID NO: 723 - RNA, 21 nt, Artificial Sequence
  ELANE RNA Guide
cgacucacgugucuuuuccuc

SEQ ID NO: 724 - RNA, 21 nt, Artificial Sequence
  ELANE RNA Guide
cgaggaaaagacacgugaguc

SEQ ID NO: 725 - RNA, 21 nt, Artificial Sequence
  ELANE RNA Guide
cgccgacucacgugucuuuuc

SEQ ID NO: 726 - RNA, 21 nt, Artificial Sequence
  ELANE RNA Guide
cggccgccgacucacgugucu

SEQ ID NO: 727 - RNA, 21 nt, Artificial Sequence
  ELANE RNA Guide
cgugagucggcggccgagggu

SEQ ID NO: 728 - RNA, 21 nt, Artificial Sequence
  ELANE RNA Guide
cucacgugucuuuuccucgcc

SEQ ID NO: 729 - RNA, 21 nt, Artificial Sequence
  ELANE RNA Guide
cucggccgccgacucacgugu

SEQ ID NO: 730 - RNA, 21 nt, Artificial Sequence
  ELANE RNA Guide
gaaaagacacgugagucggcg

SEQ ID NO: 731 - RNA, 21 nt, Artificial Sequence
  ELANE RNA Guide
gacacaggcgaggaaaagaca

SEQ ID NO: 732 - RNA, 21 nt, Artificial Sequence
  ELANE RNA Guide
gacacgugagucggcggccga

SEQ ID NO: 733 - RNA, 21 nt, Artificial Sequence
  ELANE RNA Guide
gacccucggccgccgacucac

SEQ ID NO: 734 - RNA, 21 nt, Artificial Sequence
  ELANE RNA Guide
gacucacgugucuuuuccucg

SEQ ID NO: 735 - RNA, 21 nt, Artificial Sequence
  ELANE RNA Guide
gaggaaaagacacgugagucg

SEQ ID NO: 736 - RNA, 21 nt, Artificial Sequence
  ELANE RNA Guide
gccgacucacgugucuuuucc

SEQ ID NO: 737 - RNA, 21 nt, Artificial Sequence
  ELANE RNA Guide
gccgccgacucacgugucuuu

SEQ ID NO: 738 - RNA, 21 nt, Artificial Sequence
  ELANE RNA Guide
gcgaggaaaagacacgugagu

SEQ ID NO: 739 - RNA, 21 nt, Artificial Sequence
  ELANE RNA Guide
ggaaaagacacgugagucggc

SEQ ID NO: 740 - RNA, 21 nt, Artificial Sequence
  ELANE RNA Guide
ggacacaggcgaggaaaagac

SEQ ID NO: 741 - RNA, 21 nt, Artificial Sequence
  ELANE RNA Guide
ggccgccgacucacgugucuu

SEQ ID NO: 742 - RNA, 21 nt, Artificial Sequence
  ELANE RNA Guide
ggcgaggaaaagacacgugag

SEQ ID NO: 743 - RNA, 21 nt, Artificial Sequence
  ELANE RNA Guide
gugagucggcggccgaggguc

SEQ ID NO: 744 - RNA, 21 nt, Artificial Sequence
  ELANE RNA Guide
ucacgugucuuuuccucgccu

SEQ ID NO: 745 - RNA, 21 nt, Artificial Sequence
  ELANE RNA Guide
ucggccgccgacucacguguc

SEQ ID NO: 746 - RNA, 21 nt, Artificial Sequence
  ELANE RNA Guide
ugacccucggccgccgacuca

SEQ ID NO: 747 - RNA, 22 nt, Artificial Sequence
  ELANE RNA Guide
aaaagacacgugagucggcggc

SEQ ID NO: 748 - RNA, 22 nt, Artificial Sequence
  ELANE RNA Guide
aaagacacgugagucggcggcc

SEQ ID NO: 749 - RNA, 22 nt, Artificial Sequence
  ELANE RNA Guide
aagacacgugagucggcggccg

SEQ ID NO: 750 - RNA, 22 nt, Artificial Sequence
  ELANE RNA Guide
acacaggcgaggaaaagacacg

SEQ ID NO: 751 - RNA, 22 nt, Artificial Sequence
  ELANE RNA Guide
acacgugagucggcggccgagg

SEQ ID NO: 752 - RNA, 22 nt, Artificial Sequence
  ELANE RNA Guide
acaggcgaggaaaagacacgug

SEQ ID NO: 753 - RNA, 22 nt, Artificial Sequence
  ELANE RNA Guide
accaugacccucggccgccgac

SEQ ID NO: 754 - RNA, 22 nt, Artificial Sequence
  ELANE RNA Guide
acccucggccgccgacucacgu

SEQ ID NO: 755 - RNA, 22 nt, Artificial Sequence
  ELANE RNA Guide
acgugagucggcggccgagggu

SEQ ID NO: 756 - RNA, 22 nt, Artificial Sequence
  ELANE RNA Guide
acucacgugucuuuuccucgcc

SEQ ID NO: 757 - RNA, 22 nt, Artificial Sequence
  ELANE RNA Guide
agacacgugagucggcggccga

SEQ ID NO: 758 - RNA, 22 nt, Artificial Sequence
  ELANE RNA Guide
aggaaaagacacgugagucggc

SEQ ID NO: 759 - RNA, 22 nt, Artificial Sequence
  ELANE RNA Guide
aggacacaggcgaggaaaagac

SEQ ID NO: 760 - RNA, 22 nt, Artificial Sequence
  ELANE RNA Guide
aggcgaggaaaagacacgugag

SEQ ID NO: 761 - RNA, 22 nt, Artificial Sequence
  ELANE RNA Guide
augacccucggccgccgacuca

SEQ ID NO: 762 - RNA, 22 nt, Artificial Sequence
  ELANE RNA Guide
cacaggcgaggaaaagacacgu

SEQ ID NO: 763 - RNA, 22 nt, Artificial Sequence
  ELANE RNA Guide
caccaugacccucggccgccga

SEQ ID NO: 764 - RNA, 22 nt, Artificial Sequence
  ELANE RNA Guide
cacgugagucggcggccgaggg

SEQ ID NO: 765 - RNA, 22 nt, Artificial Sequence
  ELANE RNA Guide
cacgugucuuuuccucgccugu

SEQ ID NO: 766 - RNA, 22 nt, Artificial Sequence
  ELANE RNA Guide
caggcgaggaaaagacacguga

SEQ ID NO: 767 - RNA, 22 nt, Artificial Sequence
  ELANE RNA Guide
caugacccucggccgccgacuc

SEQ ID NO: 768 - RNA, 22 nt, Artificial Sequence
  ELANE RNA Guide
ccaugacccucggccgccgacu

SEQ ID NO: 769 - RNA, 22 nt, Artificial Sequence
  ELANE RNA Guide
cccucggccgccgacucacgug

SEQ ID NO: 770 - RNA, 22 nt, Artificial Sequence
  ELANE RNA Guide
ccgacucacgugucuuuuccuc

SEQ ID NO: 771 - RNA, 22 nt, Artificial Sequence
  ELANE RNA Guide
ccgccgacucacgugucuuuuc

SEQ ID NO: 772 - RNA, 22 nt, Artificial Sequence
  ELANE RNA Guide
ccucggccgccgacucacgugu

SEQ ID NO: 773 - RNA, 22 nt, Artificial Sequence
  ELANE RNA Guide
cgacucacgugucuuuuccucg

SEQ ID NO: 774 - RNA, 22 nt, Artificial Sequence
  ELANE RNA Guide
cgaggaaaagacacgugagucg

SEQ ID NO: 775 - RNA, 22 nt, Artificial Sequence
  ELANE RNA Guide
cgccgacucacgugucuuuucc

SEQ ID NO: 776 - RNA, 22 nt, Artificial Sequence
  ELANE RNA Guide
cggccgccgacucacgugucuu

SEQ ID NO: 777 - RNA, 22 nt, Artificial Sequence
  ELANE RNA Guide
cgugagucggcggccgaggguc

SEQ ID NO: 778 - RNA, 22 nt, Artificial Sequence
  ELANE RNA Guide
cucacgugucuuuuccucgccu

SEQ ID NO: 779 - RNA, 22 nt, Artificial Sequence
  ELANE RNA Guide
cucggccgccgacucacguguc

SEQ ID NO: 780 - RNA, 22 nt, Artificial Sequence
  ELANE RNA Guide
gaaaagacacgugagucggcgg

SEQ ID NO: 781 - RNA, 22 nt, Artificial Sequence
  ELANE RNA Guide
gacacaggcgaggaaaagacac

SEQ ID NO: 782 - RNA, 22 nt, Artificial Sequence
  ELANE RNA Guide
gacacgugagucggcggccgag

SEQ ID NO: 783 - RNA, 22 nt, Artificial Sequence
  ELANE RNA Guide
gacccucggccgccgacucacg

SEQ ID NO: 784 - RNA, 22 nt, Artificial Sequence
  ELANE RNA Guide
gacucacgugucuuuuccucgc

SEQ ID NO: 785 - RNA, 22 nt, Artificial Sequence
  ELANE RNA Guide
gaggaaaagacacgugagucgg

SEQ ID NO: 786 - RNA, 22 nt, Artificial Sequence
  ELANE RNA Guide
gccgacucacgugucuuuuccu

SEQ ID NO: 787 - RNA, 22 nt, Artificial Sequence
  ELANE RNA Guide
gccgccgacucacgugucuuuu

SEQ ID NO: 788 - RNA, 22 nt, Artificial Sequence
  ELANE RNA Guide
gcgaggaaaagacacgugaguc

SEQ ID NO: 789 - RNA, 22 nt, Artificial Sequence
  ELANE RNA Guide
ggaaaagacacgugagucggcg

SEQ ID NO: 790 - RNA, 22 nt, Artificial Sequence
  ELANE RNA Guide
ggacacaggcgaggaaaagaca

SEQ ID NO: 791 - RNA, 22 nt, Artificial Sequence
  ELANE RNA Guide
ggccgccgacucacgugucuuu

SEQ ID NO: 792 - RNA, 22 nt, Artificial Sequence
  ELANE RNA Guide
ggcgaggaaaagacacgugagu

SEQ ID NO: 793 - RNA, 22 nt, Artificial Sequence
  ELANE RNA Guide
gugagucggcggccgaggguca

SEQ ID NO: 794 - RNA, 22 nt, Artificial Sequence
  ELANE RNA Guide
ucacgugucuuuuccucgccug

SEQ ID NO: 795 - RNA, 22 nt, Artificial Sequence
  ELANE RNA Guide
ucggccgccgacucacgugucu

SEQ ID NO: 796 - RNA, 22 nt, Artificial Sequence
  ELANE RNA Guide
ugacccucggccgccgacucac

SEQ ID NO: 797 - RNA, 20 nt, Artificial Sequence
  ELANE RNA Guide
aaaagacacacgagucggcg

SEQ ID NO: 798 - RNA, 20 nt, Artificial Sequence
  ELANE RNA Guide
aaagacacacgagucggcgg

SEQ ID NO: 799 - RNA, 20 nt, Artificial Sequence
  ELANE RNA Guide
aagacacacgagucggcggc

SEQ ID NO: 800 - RNA, 20 nt, Artificial Sequence
  ELANE RNA Guide
acacacgagucggcggccga

SEQ ID NO: 801 - RNA, 20 nt, Artificial Sequence
  ELANE RNA Guide
acacgagucggcggccgagg

SEQ ID NO: 802 - RNA, 20 nt, Artificial Sequence
  ELANE RNA Guide
acaggcgaggaaaagacaca

SEQ ID NO: 803 - RNA, 20 nt, Artificial Sequence
  ELANE RNA Guide
acccucggccgccgacucgu

SEQ ID NO: 804 - RNA, 20 nt, Artificial Sequence
  ELANE RNA Guide
acucgugugucuuuuccucg

SEQ ID NO: 805 - RNA, 20 nt, Artificial Sequence
  ELANE RNA Guide
agacacacgagucggcggcc

SEQ ID NO: 806 - RNA, 20 nt, Artificial Sequence
  ELANE RNA Guide
aggaaaagacacacgagucg

SEQ ID NO: 807 - RNA, 20 nt, Artificial Sequence
  ELANE RNA Guide
aggcgaggaaaagacacacg

SEQ ID NO: 808 - RNA, 20 nt, Artificial Sequence
  ELANE RNA Guide
cacacgagucggcggccgag

SEQ ID NO: 809 - RNA, 20 nt, Artificial Sequence
  ELANE RNA Guide
cacgagucggcggccgaggg

SEQ ID NO: 810 - RNA, 20 nt, Artificial Sequence
  ELANE RNA Guide
caggcgaggaaaagacacac

SEQ ID NO: 811 - RNA, 20 nt, Artificial Sequence
  ELANE RNA Guide
cccucggccgccgacucgug

SEQ ID NO: 812 - RNA, 20 nt, Artificial Sequence
  ELANE RNA Guide
ccgacucgugugucuuuucc

SEQ ID NO: 813 - RNA, 20 nt, Artificial Sequence
  ELANE RNA Guide
ccgccgacucgugugucuuu

SEQ ID NO: 814 - RNA, 20 nt, Artificial Sequence
  ELANE RNA Guide
ccucggccgccgacucgugu

SEQ ID NO: 815 - RNA, 20 nt, Artificial Sequence
  ELANE RNA Guide
cgacucgugugucuuuuccu

SEQ ID NO: 816 - RNA, 20 nt, Artificial Sequence
  ELANE RNA Guide
cgaggaaaagacacacgagu

SEQ ID NO: 817 - RNA, 20 nt, Artificial Sequence
  ELANE RNA Guide
cgccgacucgugugucuuuu

SEQ ID NO: 818 - RNA, 20 nt, Artificial Sequence
  ELANE RNA Guide
cggccgccgacucguguguc

SEQ ID NO: 819 - RNA, 20 nt, Artificial Sequence
  ELANE RNA Guide
cgugugucuuuuccucgccu

SEQ ID NO: 820 - RNA, 20 nt, Artificial Sequence
  ELANE RNA Guide
cucggccgccgacucgugug

SEQ ID NO: 821 - RNA, 20 nt, Artificial Sequence
  ELANE RNA Guide
cucgugugucuuuuccucgc

SEQ ID NO: 822 - RNA, 20 nt, Artificial Sequence
  ELANE RNA Guide
gaaaagacacacgagucggc

SEQ ID NO: 823 - RNA, 20 nt, Artificial Sequence
  ELANE RNA Guide
gacacacgagucggcggccg

SEQ ID NO: 824 - RNA, 20 nt, Artificial Sequence
  ELANE RNA Guide
gacccucggccgccgacucg

SEQ ID NO: 825 - RNA, 20 nt, Artificial Sequence
  ELANE RNA Guide
gacucgugugucuuuuccuc

SEQ ID NO: 826 - RNA, 20 nt, Artificial Sequence
  ELANE RNA Guide
gaggaaaagacacacgaguc

SEQ ID NO: 827 - RNA, 20 nt, Artificial Sequence
  ELANE RNA Guide
gccgacucgugugucuuuuc

SEQ ID NO: 828 - RNA, 20 nt, Artificial Sequence
  ELANE RNA Guide
gccgccgacucgugugucuu

SEQ ID NO: 829 - RNA, 20 nt, Artificial Sequence
  ELANE RNA Guide
gcgaggaaaagacacacgag

SEQ ID NO: 830 - RNA, 20 nt, Artificial Sequence
  ELANE RNA Guide
ggaaaagacacacgagucgg

SEQ ID NO: 831 - RNA, 20 nt, Artificial Sequence
  ELANE RNA Guide
ggacacaggcgaggaaaaga

SEQ ID NO: 832 - RNA, 20 nt, Artificial Sequence
  ELANE RNA Guide
ggccgccgacucgugugucu

SEQ ID NO: 833 - RNA, 20 nt, Artificial Sequence
  ELANE RNA Guide
ggcgaggaaaagacacacga

SEQ ID NO: 834 - RNA, 20 nt, Artificial Sequence
  ELANE RNA Guide
gugugucuuuuccucgccug

SEQ ID NO: 835 - RNA, 20 nt, Artificial Sequence
  ELANE RNA Guide
ucggccgccgacucgugugu

SEQ ID NO: 836 - RNA, 20 nt, Artificial Sequence
  ELANE RNA Guide
ucgugugucuuuuccucgcc

SEQ ID NO: 837 - RNA, 21 nt, Artificial Sequence
  ELANE RNA Guide
aaaagacacacgagucggcgg

SEQ ID NO: 838 - RNA, 21 nt, Artificial Sequence
  ELANE RNA Guide
aaagacacacgagucggcggc

SEQ ID NO: 839 - RNA, 21 nt, Artificial Sequence
  ELANE RNA Guide
aagacacacgagucggcggcc

SEQ ID NO: 840 - RNA, 21 nt, Artificial Sequence
  ELANE RNA Guide
acacacgagucggcggccgag

SEQ ID NO: 841 - RNA, 21 nt, Artificial Sequence
  ELANE RNA Guide
acacgagucggcggccgaggg

SEQ ID NO: 842 - RNA, 21 nt, Artificial Sequence
  ELANE RNA Guide
acaggcgaggaaaagacacac

SEQ ID NO: 843 - RNA, 21 nt, Artificial Sequence
  ELANE RNA Guide
acccucggccgccgacucgug

SEQ ID NO: 844 - RNA, 21 nt, Artificial Sequence
  ELANE RNA Guide
acucgugugucuuuuccucgc

SEQ ID NO: 845 - RNA, 21 nt, Artificial Sequence
  ELANE RNA Guide
agacacacgagucggcggccg

SEQ ID NO: 846 - RNA, 21 nt, Artificial Sequence
  ELANE RNA Guide
aggaaaagacacacgagucgg

SEQ ID NO: 847 - RNA, 21 nt, Artificial Sequence
  ELANE RNA Guide
aggacacaggcgaggaaaaga

SEQ ID NO: 848 - RNA, 21 nt, Artificial Sequence
  ELANE RNA Guide
aggcgaggaaaagacacacga

SEQ ID NO: 849 - RNA, 21 nt, Artificial Sequence
  ELANE RNA Guide
cacacgagucggcggccgagg

SEQ ID NO: 850 - RNA, 21 nt, Artificial Sequence
  ELANE RNA Guide
cacaggcgaggaaaagacaca

SEQ ID NO: 851 - RNA, 21 nt, Artificial Sequence
  ELANE RNA Guide
cacgagucggcggccgagggu

SEQ ID NO: 852 - RNA, 21 nt, Artificial Sequence
  ELANE RNA Guide
caggcgaggaaaagacacacg

SEQ ID NO: 853 - RNA, 21 nt, Artificial Sequence
  ELANE RNA Guide
cccucggccgccgacucgugu

SEQ ID NO: 854 - RNA, 21 nt, Artificial Sequence
  ELANE RNA Guide
ccgacucgugugucuuuuccu

SEQ ID NO: 855 - RNA, 21 nt, Artificial Sequence
  ELANE RNA Guide
ccgccgacucgugugucuuuu

SEQ ID NO: 856 - RNA, 21 nt, Artificial Sequence
  ELANE RNA Guide
ccucggccgccgacucgugug

SEQ ID NO: 857 - RNA, 21 nt, Artificial Sequence
  ELANE RNA Guide
cgacucgugugucuuuuccuc

SEQ ID NO: 858 - RNA, 21 nt, Artificial Sequence
  ELANE RNA Guide
cgaggaaaagacacacgaguc

SEQ ID NO: 859 - RNA, 21 nt, Artificial Sequence
  ELANE RNA Guide
cgccgacucgugugucuuuuc

SEQ ID NO: 860 - RNA, 21 nt, Artificial Sequence
  ELANE RNA Guide
cggccgccgacucgugugucu

SEQ ID NO: 861 - RNA, 21 nt, Artificial Sequence
  ELANE RNA Guide
cgugugucuuuuccucgccug

SEQ ID NO: 862 - RNA, 21 nt, Artificial Sequence
  ELANE RNA Guide
cucggccgccgacucgugugu

SEQ ID NO: 863 - RNA, 21 nt, Artificial Sequence
  ELANE RNA Guide
cucgugugucuuuuccucgcc

SEQ ID NO: 864 - RNA, 21 nt, Artificial Sequence
  ELANE RNA Guide
gaaaagacacacgagucggcg

SEQ ID NO: 865 - RNA, 21 nt, Artificial Sequence
  ELANE RNA Guide
gacacacgagucggcggccga

SEQ ID NO: 866 - RNA, 21 nt, Artificial Sequence
  ELANE RNA Guide
gacccucggccgccgacucgu

SEQ ID NO: 867 - RNA, 21 nt, Artificial Sequence
  ELANE RNA Guide
gacucgugugucuuuuccucg

SEQ ID NO: 868 - RNA, 21 nt, Artificial Sequence
  ELANE RNA Guide
gaggaaaagacacacgagucg

SEQ ID NO: 869 - RNA, 21 nt, Artificial Sequence
  ELANE RNA Guide
gccgacucgugugucuuuucc

SEQ ID NO: 870 - RNA, 21 nt, Artificial Sequence
  ELANE RNA Guide
gccgccgacucgugugucuuu

SEQ ID NO: 871 - RNA, 21 nt, Artificial Sequence
  ELANE RNA Guide
gcgaggaaaagacacacgagu

SEQ ID NO: 872 - RNA, 21 nt, Artificial Sequence
  ELANE RNA Guide
ggaaaagacacacgagucggc

SEQ ID NO: 873 - RNA, 21 nt, Artificial Sequence
  ELANE RNA Guide
ggccgccgacucgugugucuu

SEQ ID NO: 874 - RNA, 21 nt, Artificial Sequence
  ELANE RNA Guide
ggcgaggaaaagacacacgag

SEQ ID NO: 875 - RNA, 21 nt, Artificial Sequence
  ELANE RNA Guide
gugugucuuuuccucgccugu

SEQ ID NO: 876 - RNA, 21 nt, Artificial Sequence
  ELANE RNA Guide
ucggccgccgacucguguguc

SEQ ID NO: 877 - RNA, 21 nt, Artificial Sequence
  ELANE RNA Guide
ucgugugucuuuuccucgccu

SEQ ID NO: 878 - RNA, 21 nt, Artificial Sequence
  ELANE RNA Guide
ugacccucggccgccgacucg

SEQ ID NO: 879 - RNA, 22 nt, Artificial Sequence
  ELANE RNA Guide
aaaagacacacgagucggcggc

SEQ ID NO: 880 - RNA, 22 nt, Artificial Sequence
  ELANE RNA Guide
aaagacacacgagucggcggcc

SEQ ID NO: 881 - RNA, 22 nt, Artificial Sequence
  ELANE RNA Guide
aagacacacgagucggcggccg

SEQ ID NO: 882 - RNA, 22 nt, Artificial Sequence
  ELANE RNA Guide
acacacgagucggcggccgagg

SEQ ID NO: 883 - RNA, 22 nt, Artificial Sequence
  ELANE RNA Guide
acacaggcgaggaaaagacaca

SEQ ID NO: 884 - RNA, 22 nt, Artificial Sequence
  ELANE RNA Guide
acacgagucggcggccgagggu

SEQ ID NO: 885 - RNA, 22 nt, Artificial Sequence
  ELANE RNA Guide
acaggcgaggaaaagacacacg

SEQ ID NO: 886 - RNA, 22 nt, Artificial Sequence
  ELANE RNA Guide
acccucggccgccgacucgugu

SEQ ID NO: 887 - RNA, 22 nt, Artificial Sequence
  ELANE RNA Guide
acucgugugucuuuuccucgcc

SEQ ID NO: 888 - RNA, 22 nt, Artificial Sequence
  ELANE RNA Guide
agacacacgagucggcggccga

SEQ ID NO: 889 - RNA, 22 nt, Artificial Sequence
  ELANE RNA Guide
aggaaaagacacacgagucggc

SEQ ID NO: 890 - RNA, 22 nt, Artificial Sequence
  ELANE RNA Guide
aggcgaggaaaagacacacgag

SEQ ID NO: 891 - RNA, 22 nt, Artificial Sequence
  ELANE RNA Guide
augacccucggccgccgacucg

SEQ ID NO: 892 - RNA, 22 nt, Artificial Sequence
  ELANE RNA Guide
cacacgagucggcggccgaggg

SEQ ID NO: 893 - RNA, 22 nt, Artificial Sequence
  ELANE RNA Guide
cacaggcgaggaaaagacacac

SEQ ID NO: 894 - RNA, 22 nt, Artificial Sequence
  ELANE RNA Guide
cacgagucggcggccgaggguc

SEQ ID NO: 895 - RNA, 22 nt, Artificial Sequence
  ELANE RNA Guide
caggacacaggcgaggaaaaga

SEQ ID NO: 896 - RNA, 22 nt, Artificial Sequence
  ELANE RNA Guide
caggcgaggaaaagacacacga

SEQ ID NO: 897 - RNA, 22 nt, Artificial Sequence
  ELANE RNA Guide
cccucggccgccgacucgugug

SEQ ID NO: 898 - RNA, 22 nt, Artificial Sequence
  ELANE RNA Guide
ccgacucgugugucuuuuccuc

SEQ ID NO: 899 - RNA, 22 nt, Artificial Sequence
  ELANE RNA Guide
ccgccgacucgugugucuuuuc

SEQ ID NO: 900 - RNA, 22 nt, Artificial Sequence
  ELANE RNA Guide
ccucggccgccgacucgugugu

SEQ ID NO: 901 - RNA, 22 nt, Artificial Sequence
  ELANE RNA Guide
cgacucgugugucuuuuccucg

SEQ ID NO: 902 - RNA, 22 nt, Artificial Sequence
  ELANE RNA Guide
cgaggaaaagacacacgagucg

SEQ ID NO: 903 - RNA, 22 nt, Artificial Sequence
  ELANE RNA Guide
cgccgacucgugugucuuuucc

SEQ ID NO: 904 - RNA, 22 nt, Artificial Sequence
  ELANE RNA Guide
cggccgccgacucgugugucuu

SEQ ID NO: 905 - RNA, 22 nt, Artificial Sequence
  ELANE RNA Guide
cgugugucuuuuccucgccugu

SEQ ID NO: 906 - RNA, 22 nt, Artificial Sequence
  ELANE RNA Guide
cucggccgccgacucguguguc

SEQ ID NO: 907 - RNA, 22 nt, Artificial Sequence
  ELANE RNA Guide
cucgugugucuuuuccucgccu

SEQ ID NO: 908 - RNA, 22 nt, Artificial Sequence
  ELANE RNA Guide
gaaaagacacacgagucggcgg

SEQ ID NO: 909 - RNA, 22 nt, Artificial Sequence
  ELANE RNA Guide
gacacacgagucggcggccgag

SEQ ID NO: 910 - RNA, 22 nt, Artificial Sequence
  ELANE RNA Guide
gacccucggccgccgacucgug

SEQ ID NO: 911 - RNA, 22 nt, Artificial Sequence
  ELANE RNA Guide
gacucgugugucuuuuccucgc

SEQ ID NO: 912 - RNA, 22 nt, Artificial Sequence
  ELANE RNA Guide
gaggaaaagacacacgagucgg

SEQ ID NO: 913 - RNA, 22 nt, Artificial Sequence
  ELANE RNA Guide
gccgacucgugugucuuuuccu

SEQ ID NO: 914 - RNA, 22 nt, Artificial Sequence
  ELANE RNA Guide
gccgccgacucgugugucuuuu

SEQ ID NO: 915 - RNA, 22 nt, Artificial Sequence
  ELANE RNA Guide
gcgaggaaaagacacacgaguc

SEQ ID NO: 916 - RNA, 22 nt, Artificial Sequence
  ELANE RNA Guide
ggaaaagacacacgagucggcg

SEQ ID NO: 917 - RNA, 22 nt, Artificial Sequence
  ELANE RNA Guide
ggccgccgacucgugugucuuu

SEQ ID NO: 918 - RNA, 22 nt, Artificial Sequence
  ELANE RNA Guide
ggcgaggaaaagacacacgagu

SEQ ID NO: 919 - RNA, 22 nt, Artificial Sequence
  ELANE RNA Guide
gugugucuuuuccucgccugug

SEQ ID NO: 920 - RNA, 22 nt, Artificial Sequence
  ELANE RNA Guide
ucggccgccgacucgugugucu

SEQ ID NO: 921 - RNA, 22 nt, Artificial Sequence
  ELANE RNA Guide
ucgugugucuuuuccucgccug

SEQ ID NO: 922 - RNA, 22 nt, Artificial Sequence
  ELANE RNA Guide
ugacccucggccgccgacucgu

SEQ ID NO: 923 - RNA, 20 nt, Artificial Sequence
  ELANE RNA Guide
aaggccggcaggacacagcc

SEQ ID NO: 924 - RNA, 20 nt, Artificial Sequence
  ELANE RNA Guide
acacagccgaggaaaagaca

SEQ ID NO: 925 - RNA, 20 nt, Artificial Sequence
  ELANE RNA Guide
acagccgaggaaaagacacg

SEQ ID NO: 926 - RNA, 20 nt, Artificial Sequence
  ELANE RNA Guide
acucgcgugucuuuuccucg

SEQ ID NO: 927 - RNA, 20 nt, Artificial Sequence
  ELANE RNA Guide
agcaaggccggcaggacaca

SEQ ID NO: 928 - RNA, 20 nt, Artificial Sequence
  ELANE RNA Guide
agccgaggaaaagacacgcg

SEQ ID NO: 929 - RNA, 20 nt, Artificial Sequence
  ELANE RNA Guide
aggacacagccgaggaaaag

SEQ ID NO: 930 - RNA, 20 nt, Artificial Sequence
  ELANE RNA Guide
aggccggcaggacacagccg

SEQ ID NO: 931 - RNA, 20 nt, Artificial Sequence
  ELANE RNA Guide
caaggccggcaggacacagc

SEQ ID NO: 932 - RNA, 20 nt, Artificial Sequence
  ELANE RNA Guide
cacagccgaggaaaagacac

SEQ ID NO: 933 - RNA, 20 nt, Artificial Sequence
  ELANE RNA Guide
cagcaaggccggcaggacac

SEQ ID NO: 934 - RNA, 20 nt, Artificial Sequence
  ELANE RNA Guide
cagccgaggaaaagacacgc

SEQ ID NO: 935 - RNA, 20 nt, Artificial Sequence
  ELANE RNA Guide
caggacacagccgaggaaaa

SEQ ID NO: 936 - RNA, 20 nt, Artificial Sequence
  ELANE RNA Guide
ccgacucgcgugucuuuucc

SEQ ID NO: 937 - RNA, 20 nt, Artificial Sequence
  ELANE RNA Guide
ccggcaggacacagccgagg

SEQ ID NO: 938 - RNA, 20 nt, Artificial Sequence
  ELANE RNA Guide
ccucggcuguguccugccgg

SEQ ID NO: 939 - RNA, 20 nt, Artificial Sequence
  ELANE RNA Guide
cgacucgcgugucuuuuccu

SEQ ID NO: 940 - RNA, 20 nt, Artificial Sequence
  ELANE RNA Guide
cgcgugucuuuuccucggcu

SEQ ID NO: 941 - RNA, 20 nt, Artificial Sequence
  ELANE RNA Guide
cggcaggacacagccgagga

SEQ ID NO: 942 - RNA, 20 nt, Artificial Sequence
  ELANE RNA Guide
cggcuguguccugccggccu

SEQ ID NO: 943 - RNA, 20 nt, Artificial Sequence
  ELANE RNA Guide
cgugucuuuuccucggcugu

SEQ ID NO: 944 - RNA, 20 nt, Artificial Sequence
  ELANE RNA Guide
cucgcgugucuuuuccucgg

SEQ ID NO: 945 - RNA, 20 nt, Artificial Sequence
  ELANE RNA Guide
cucggcuguguccugccggc

SEQ ID NO: 946 - RNA, 20 nt, Artificial Sequence
  ELANE RNA Guide
cuuuuccucggcuguguccu

SEQ ID NO: 947 - RNA, 20 nt, Artificial Sequence
  ELANE RNA Guide
gacacagccgaggaaaagac

SEQ ID NO: 948 - RNA, 20 nt, Artificial Sequence
  ELANE RNA Guide
gacucgcgugucuuuuccuc

SEQ ID NO: 949 - RNA, 20 nt, Artificial Sequence
  ELANE RNA Guide
gcaaggccggcaggacacag

SEQ ID NO: 950 - RNA, 20 nt, Artificial Sequence
  ELANE RNA Guide
gcagcaaggccggcaggaca

SEQ ID NO: 951 - RNA, 20 nt, Artificial Sequence
  ELANE RNA Guide
gcaggacacagccgaggaaa

SEQ ID NO: 952 - RNA, 20 nt, Artificial Sequence
  ELANE RNA Guide
gccgaggaaaagacacgcga

SEQ ID NO: 953 - RNA, 20 nt, Artificial Sequence
  ELANE RNA Guide
gccggcaggacacagccgag

SEQ ID NO: 954 - RNA, 20 nt, Artificial Sequence
  ELANE RNA Guide
gcgugucuuuuccucggcug

SEQ ID NO: 955 - RNA, 20 nt, Artificial Sequence
  ELANE RNA Guide
ggacacagccgaggaaaaga

SEQ ID NO: 956 - RNA, 20 nt, Artificial Sequence
  ELANE RNA Guide
ggcaggacacagccgaggaa

SEQ ID NO: 957 - RNA, 20 nt, Artificial Sequence
  ELANE RNA Guide
ggccggcaggacacagccga

SEQ ID NO: 958 - RNA, 20 nt, Artificial Sequence
  ELANE RNA Guide
ggcuguguccugccggccuu

SEQ ID NO: 959 - RNA, 20 nt, Artificial Sequence
  ELANE RNA Guide
gucuuuuccucggcuguguc

SEQ ID NO: 960 - RNA, 20 nt, Artificial Sequence
  ELANE RNA Guide
gugucuuuuccucggcugug

SEQ ID NO: 961 - RNA, 20 nt, Artificial Sequence
  ELANE RNA Guide
uccucggcuguguccugccg

SEQ ID NO: 962 - RNA, 20 nt, Artificial Sequence
  ELANE RNA Guide
ucgcgugucuuuuccucggc

SEQ ID NO: 963 - RNA, 20 nt, Artificial Sequence
  ELANE RNA Guide
ucggcuguguccugccggcc

SEQ ID NO: 964 - RNA, 20 nt, Artificial Sequence
  ELANE RNA Guide
ucuuuuccucggcugugucc

SEQ ID NO: 965 - RNA, 20 nt, Artificial Sequence
  ELANE RNA Guide
ugucuuuuccucggcugugu

SEQ ID NO: 966 - RNA, 20 nt, Artificial Sequence
  ELANE RNA Guide
uuccucggcuguguccugcc

SEQ ID NO: 967 - RNA, 20 nt, Artificial Sequence
  ELANE RNA Guide
uuuccucggcuguguccugc

SEQ ID NO: 968 - RNA, 20 nt, Artificial Sequence
  ELANE RNA Guide
uuuuccucggcuguguccug

SEQ ID NO: 969 - RNA, 21 nt, Artificial Sequence
  ELANE RNA Guide
aaggccggcaggacacagccg

SEQ ID NO: 970 - RNA, 21 nt, Artificial Sequence
  ELANE RNA Guide
acacagccgaggaaaagacac

SEQ ID NO: 971 - RNA, 21 nt, Artificial Sequence
  ELANE RNA Guide
acagccgaggaaaagacacgc

SEQ ID NO: 972 - RNA, 21 nt, Artificial Sequence
  ELANE RNA Guide
acucgcgugucuuuuccucgg

SEQ ID NO: 973 - RNA, 21 nt, Artificial Sequence
  ELANE RNA Guide
agcaaggccggcaggacacag

SEQ ID NO: 974 - RNA, 21 nt, Artificial Sequence
  ELANE RNA Guide
agcagcaaggccggcaggaca

SEQ ID NO: 975 - RNA, 21 nt, Artificial Sequence
  ELANE RNA Guide
agccgaggaaaagacacgcga

SEQ ID NO: 976 - RNA, 21 nt, Artificial Sequence
  ELANE RNA Guide
aggacacagccgaggaaaaga

SEQ ID NO: 977 - RNA, 21 nt, Artificial Sequence
  ELANE RNA Guide
aggccggcaggacacagccga

SEQ ID NO: 978 - RNA, 21 nt, Artificial Sequence
  ELANE RNA Guide
caaggccggcaggacacagcc

SEQ ID NO: 979 - RNA, 21 nt, Artificial Sequence
  ELANE RNA Guide
cacagccgaggaaaagacacg

SEQ ID NO: 980 - RNA, 21 nt, Artificial Sequence
  ELANE RNA Guide
cagcaaggccggcaggacaca

SEQ ID NO: 981 - RNA, 21 nt, Artificial Sequence
  ELANE RNA Guide
cagccgaggaaaagacacgcg

SEQ ID NO: 982 - RNA, 21 nt, Artificial Sequence
  ELANE RNA Guide
caggacacagccgaggaaaag

SEQ ID NO: 983 - RNA, 21 nt, Artificial Sequence
  ELANE RNA Guide
ccgacucgcgugucuuuuccu

SEQ ID NO: 984 - RNA, 21 nt, Artificial Sequence
  ELANE RNA Guide
ccggcaggacacagccgagga

SEQ ID NO: 985 - RNA, 21 nt, Artificial Sequence
  ELANE RNA Guide
ccucggcuguguccugccggc

SEQ ID NO: 986 - RNA, 21 nt, Artificial Sequence
  ELANE RNA Guide
cgacucgcgugucuuuuccuc

SEQ ID NO: 987 - RNA, 21 nt, Artificial Sequence
  ELANE RNA Guide
cgcgugucuuuuccucggcug

SEQ ID NO: 988 - RNA, 21 nt, Artificial Sequence
  ELANE RNA Guide
cggcaggacacagccgaggaa

SEQ ID NO: 989 - RNA, 21 nt, Artificial Sequence
  ELANE RNA Guide
cggcuguguccugccggccuu

SEQ ID NO: 990 - RNA, 21 nt, Artificial Sequence
  ELANE RNA Guide
cgugucuuuuccucggcugug

SEQ ID NO: 991 - RNA, 21 nt, Artificial Sequence
  ELANE RNA Guide
cucgcgugucuuuuccucggc

SEQ ID NO: 992 - RNA, 21 nt, Artificial Sequence
  ELANE RNA Guide
cucggcuguguccugccggcc

SEQ ID NO: 993 - RNA, 21 nt, Artificial Sequence
  ELANE RNA Guide
cuuuuccucggcuguguccug

SEQ ID NO: 994 - RNA, 21 nt, Artificial Sequence
  ELANE RNA Guide
gacacagccgaggaaaagaca

SEQ ID NO: 995 - RNA, 21 nt, Artificial Sequence
  ELANE RNA Guide
gacucgcgugucuuuuccucg

SEQ ID NO: 996 - RNA, 21 nt, Artificial Sequence
  ELANE RNA Guide
gcaaggccggcaggacacagc

SEQ ID NO: 997 - RNA, 21 nt, Artificial Sequence
  ELANE RNA Guide
gcagcaaggccggcaggacac

SEQ ID NO: 998 - RNA, 21 nt, Artificial Sequence
  ELANE RNA Guide
gcaggacacagccgaggaaaa

SEQ ID NO: 999 - RNA, 21 nt, Artificial Sequence
  ELANE RNA Guide
gccgacucgcgugucuuuucc

SEQ ID NO: 1000 - RNA, 21 nt, Artificial Sequence
  ELANE RNA Guide
gccgaggaaaagacacgcgag

SEQ ID NO: 1001 - RNA, 21 nt, Artificial Sequence
  ELANE RNA Guide
gccggcaggacacagccgagg

SEQ ID NO: 1002 - RNA, 21 nt, Artificial Sequence
  ELANE RNA Guide
gcgugucuuuuccucggcugu

SEQ ID NO: 1003 - RNA, 21 nt, Artificial Sequence
  ELANE RNA Guide
ggacacagccgaggaaaagac

SEQ ID NO: 1004 - RNA, 21 nt, Artificial Sequence
  ELANE RNA Guide
ggcaggacacagccgaggaaa

SEQ ID NO: 1005 - RNA, 21 nt, Artificial Sequence
  ELANE RNA Guide
ggccggcaggacacagccgag

SEQ ID NO: 1006 - RNA, 21 nt, Artificial Sequence
  ELANE RNA Guide
ggcuguguccugccggccuug

SEQ ID NO: 1007 - RNA, 21 nt, Artificial Sequence
  ELANE RNA Guide
gucuuuuccucggcugugucc

SEQ ID NO: 1008 - RNA, 21 nt, Artificial Sequence
  ELANE RNA Guide
gugucuuuuccucggcugugu

SEQ ID NO: 1009 - RNA, 21 nt, Artificial Sequence
  ELANE RNA Guide
uccucggcuguguccugccgg

SEQ ID NO: 1010 - RNA, 21 nt, Artificial Sequence
  ELANE RNA Guide
ucgcgugucuuuuccucggcu

SEQ ID NO: 1011 - RNA, 21 nt, Artificial Sequence
  ELANE RNA Guide
ucggcuguguccugccggccu

SEQ ID NO: 1012 - RNA, 21 nt, Artificial Sequence
  ELANE RNA Guide
ucuuuuccucggcuguguccu

SEQ ID NO: 1013 - RNA, 21 nt, Artificial Sequence
  ELANE RNA Guide
ugucuuuuccucggcuguguc

SEQ ID NO: 1014 - RNA, 21 nt, Artificial Sequence
  ELANE RNA Guide
uuccucggcuguguccugccg

SEQ ID NO: 1015 - RNA, 21 nt, Artificial Sequence
  ELANE RNA Guide
uuuccucggcuguguccugcc

SEQ ID NO: 1016 - RNA, 21 nt, Artificial Sequence
  ELANE RNA Guide
uuuuccucggcuguguccugc

SEQ ID NO: 1017 - RNA, 22 nt, Artificial Sequence
  ELANE RNA Guide
aaggccggcaggacacagccga

SEQ ID NO: 1018 - RNA, 22 nt, Artificial Sequence
  ELANE RNA Guide
acacagccgaggaaaagacacg

SEQ ID NO: 1019 - RNA, 22 nt, Artificial Sequence
  ELANE RNA Guide
acagccgaggaaaagacacgcg

SEQ ID NO: 1020 - RNA, 22 nt, Artificial Sequence
  ELANE RNA Guide
acucgcgugucuuuuccucggc

SEQ ID NO: 1021 - RNA, 22 nt, Artificial Sequence
  ELANE RNA Guide
agcaaggccggcaggacacagc

SEQ ID NO: 1022 - RNA, 22 nt, Artificial Sequence
  ELANE RNA Guide
agcagcaaggccggcaggacac

SEQ ID NO: 1023 - RNA, 22 nt, Artificial Sequence
  ELANE RNA Guide
agccgaggaaaagacacgcgag

SEQ ID NO: 1024 - RNA, 22 nt, Artificial Sequence
  ELANE RNA Guide
aggacacagccgaggaaaagac

SEQ ID NO: 1025 - RNA, 22 nt, Artificial Sequence
  ELANE RNA Guide
aggccggcaggacacagccgag

SEQ ID NO: 1026 - RNA, 22 nt, Artificial Sequence
  ELANE RNA Guide
caaggccggcaggacacagccg

SEQ ID NO: 1027 - RNA, 22 nt, Artificial Sequence
  ELANE RNA Guide
cacagccgaggaaaagacacgc

SEQ ID NO: 1028 - RNA, 22 nt, Artificial Sequence
  ELANE RNA Guide
cagcaaggccggcaggacacag

SEQ ID NO: 1029 - RNA, 22 nt, Artificial Sequence
  ELANE RNA Guide
cagcagcaaggccggcaggaca

SEQ ID NO: 1030 - RNA, 22 nt, Artificial Sequence
  ELANE RNA Guide
cagccgaggaaaagacacgcga

SEQ ID NO: 1031 - RNA, 22 nt, Artificial Sequence
  ELANE RNA Guide
caggacacagccgaggaaaaga

SEQ ID NO: 1032 - RNA, 22 nt, Artificial Sequence
  ELANE RNA Guide
ccgacucgcgugucuuuuccuc

SEQ ID NO: 1033 - RNA, 22 nt, Artificial Sequence
  ELANE RNA Guide
ccggcaggacacagccgaggaa

SEQ ID NO: 1034 - RNA, 22 nt, Artificial Sequence
  ELANE RNA Guide
ccucggcuguguccugccggcc

SEQ ID NO: 1035 - RNA, 22 nt, Artificial Sequence
  ELANE RNA Guide
cgacucgcgugucuuuuccucg

SEQ ID NO: 1036 - RNA, 22 nt, Artificial Sequence
  ELANE RNA Guide
cgccgacucgcgugucuuuucc

SEQ ID NO: 1037 - RNA, 22 nt, Artificial Sequence
  ELANE RNA Guide
cgcgugucuuuuccucggcugu

SEQ ID NO: 1038 - RNA, 22 nt, Artificial Sequence
  ELANE RNA Guide
cggcaggacacagccgaggaaa

SEQ ID NO: 1039 - RNA, 22 nt, Artificial Sequence
  ELANE RNA Guide
cggcuguguccugccggccuug

SEQ ID NO: 1040 - RNA, 22 nt, Artificial Sequence
  ELANE RNA Guide
cgugucuuuuccucggcugugu

SEQ ID NO: 1041 - RNA, 22 nt, Artificial Sequence
  ELANE RNA Guide
cucgcgugucuuuuccucggcu

SEQ ID NO: 1042 - RNA, 22 nt, Artificial Sequence
  ELANE RNA Guide
cucggcuguguccugccggccu

SEQ ID NO: 1043 - RNA, 22 nt, Artificial Sequence
  ELANE RNA Guide
cuuuuccucggcuguguccugc

SEQ ID NO: 1044 - RNA, 22 nt, Artificial Sequence
  ELANE RNA Guide
gacacagccgaggaaaagacac

SEQ ID NO: 1045 - RNA, 22 nt, Artificial Sequence
  ELANE RNA Guide
gacucgcgugucuuuuccucgg

SEQ ID NO: 1046 - RNA, 22 nt, Artificial Sequence
  ELANE RNA Guide
gcaaggccggcaggacacagcc

SEQ ID NO: 1047 - RNA, 22 nt, Artificial Sequence
  ELANE RNA Guide
gcagcaaggccggcaggacaca

SEQ ID NO: 1048 - RNA, 22 nt, Artificial Sequence
  ELANE RNA Guide
gcaggacacagccgaggaaaag

SEQ ID NO: 1049 - RNA, 22 nt, Artificial Sequence
  ELANE RNA Guide
gccgacucgcgugucuuuuccu

SEQ ID NO: 1050 - RNA, 22 nt, Artificial Sequence
  ELANE RNA Guide
gccgaggaaaagacacgcgagu

SEQ ID NO: 1051 - RNA, 22 nt, Artificial Sequence
  ELANE RNA Guide
gccggcaggacacagccgagga

SEQ ID NO: 1052 - RNA, 22 nt, Artificial Sequence
  ELANE RNA Guide
gcgugucuuuuccucggcugug

SEQ ID NO: 1053 - RNA, 22 nt, Artificial Sequence
  ELANE RNA Guide
ggacacagccgaggaaaagaca

SEQ ID NO: 1054 - RNA, 22 nt, Artificial Sequence
  ELANE RNA Guide
ggcaggacacagccgaggaaaa

SEQ ID NO: 1055 - RNA, 22 nt, Artificial Sequence
  ELANE RNA Guide
ggccggcaggacacagccgagg

SEQ ID NO: 1056 - RNA, 22 nt, Artificial Sequence
  ELANE RNA Guide
ggcuguguccugccggccuugc

SEQ ID NO: 1057 - RNA, 22 nt, Artificial Sequence
  ELANE RNA Guide
gucuuuuccucggcuguguccu

SEQ ID NO: 1058 - RNA, 22 nt, Artificial Sequence
  ELANE RNA Guide
gugucuuuuccucggcuguguc

SEQ ID NO: 1059 - RNA, 22 nt, Artificial Sequence
  ELANE RNA Guide
uccucggcuguguccugccggc

SEQ ID NO: 1060 - RNA, 22 nt, Artificial Sequence
  ELANE RNA Guide
ucgcgugucuuuuccucggcug

SEQ ID NO: 1061 - RNA, 22 nt, Artificial Sequence
  ELANE RNA Guide
ucggcuguguccugccggccuu

SEQ ID NO: 1062 - RNA, 22 nt, Artificial Sequence
  ELANE RNA Guide
ucuuuuccucggcuguguccug

SEQ ID NO: 1063 - RNA, 22 nt, Artificial Sequence
  ELANE RNA Guide
ugucuuuuccucggcugugucc

SEQ ID NO: 1064 - RNA, 22 nt, Artificial Sequence
  ELANE RNA Guide
uuccucggcuguguccugccgg

SEQ ID NO: 1065 - RNA, 22 nt, Artificial Sequence
  ELANE RNA Guide
uuuccucggcuguguccugccg

SEQ ID NO: 1066 - RNA, 22 nt, Artificial Sequence
  ELANE RNA Guide
uuuuccucggcuguguccugcc

SEQ ID NO: 1067 - RNA, 20 nt, Artificial Sequence
  ELANE RNA Guide
aaggccggcaggacacacgc

SEQ ID NO: 1068 - RNA, 20 nt, Artificial Sequence
  ELANE RNA Guide
acacacgcgaggaaaagaca

SEQ ID NO: 1069 - RNA, 20 nt, Artificial Sequence
  ELANE RNA Guide
acacgcgaggaaaagacacg

SEQ ID NO: 1070 - RNA, 20 nt, Artificial Sequence
  ELANE RNA Guide
acgcgaggaaaagacacgcg

SEQ ID NO: 1071 - RNA, 20 nt, Artificial Sequence
  ELANE RNA Guide
agcagcaaggccggcaggac

SEQ ID NO: 1072 - RNA, 20 nt, Artificial Sequence
  ELANE RNA Guide
aggacacacgcgaggaaaag

SEQ ID NO: 1073 - RNA, 20 nt, Artificial Sequence
  ELANE RNA Guide
aggccggcaggacacacgcg

SEQ ID NO: 1074 - RNA, 20 nt, Artificial Sequence
  ELANE RNA Guide
caaggccggcaggacacacg

SEQ ID NO: 1075 - RNA, 20 nt, Artificial Sequence
  ELANE RNA Guide
cacacgcgaggaaaagacac

SEQ ID NO: 1076 - RNA, 20 nt, Artificial Sequence
  ELANE RNA Guide
cacgcgaggaaaagacacgc

SEQ ID NO: 1077 - RNA, 20 nt, Artificial Sequence
  ELANE RNA Guide
caggacacacgcgaggaaaa

SEQ ID NO: 1078 - RNA, 20 nt, Artificial Sequence
  ELANE RNA Guide
ccggcaggacacacgcgagg

SEQ ID NO: 1079 - RNA, 20 nt, Artificial Sequence
  ELANE RNA Guide
ccucgcguguguccugccgg

SEQ ID NO: 1080 - RNA, 20 nt, Artificial Sequence
  ELANE RNA Guide
cgcgugucuuuuccucgcgu

SEQ ID NO: 1081 - RNA, 20 nt, Artificial Sequence
  ELANE RNA Guide
cgcguguguccugccggccu

SEQ ID NO: 1082 - RNA, 20 nt, Artificial Sequence
  ELANE RNA Guide
cggcaggacacacgcgagga

SEQ ID NO: 1083 - RNA, 20 nt, Artificial Sequence
  ELANE RNA Guide
cgugucuuuuccucgcgugu

SEQ ID NO: 1084 - RNA, 20 nt, Artificial Sequence
  ELANE RNA Guide
cguguguccugccggccuug

SEQ ID NO: 1085 - RNA, 20 nt, Artificial Sequence
  ELANE RNA Guide
cucgcgugucuuuuccucgc

SEQ ID NO: 1086 - RNA, 20 nt, Artificial Sequence
  ELANE RNA Guide
cucgcguguguccugccggc

SEQ ID NO: 1087 - RNA, 20 nt, Artificial Sequence
  ELANE RNA Guide
cuuuuccucgcguguguccu

SEQ ID NO: 1088 - RNA, 20 nt, Artificial Sequence
  ELANE RNA Guide
gacacacgcgaggaaaagac

SEQ ID NO: 1089 - RNA, 20 nt, Artificial Sequence
  ELANE RNA Guide
gcaaggccggcaggacacac

SEQ ID NO: 1090 - RNA, 20 nt, Artificial Sequence
  ELANE RNA Guide
gcaggacacacgcgaggaaa

SEQ ID NO: 1091 - RNA, 20 nt, Artificial Sequence
  ELANE RNA Guide
gccggcaggacacacgcgag

SEQ ID NO: 1092 - RNA, 20 nt, Artificial Sequence
  ELANE RNA Guide
gcgugucuuuuccucgcgug

SEQ ID NO: 1093 - RNA, 20 nt, Artificial Sequence
  ELANE RNA Guide
gcguguguccugccggccuu

SEQ ID NO: 1094 - RNA, 20 nt, Artificial Sequence
  ELANE RNA Guide
ggacacacgcgaggaaaaga

SEQ ID NO: 1095 - RNA, 20 nt, Artificial Sequence
  ELANE RNA Guide
ggcaggacacacgcgaggaa

SEQ ID NO: 1096 - RNA, 20 nt, Artificial Sequence
  ELANE RNA Guide
ggccggcaggacacacgcga

SEQ ID NO: 1097 - RNA, 20 nt, Artificial Sequence
  ELANE RNA Guide
gucuuuuccucgcguguguc

SEQ ID NO: 1098 - RNA, 20 nt, Artificial Sequence
  ELANE RNA Guide
gugucuuuuccucgcgugug

SEQ ID NO: 1099 - RNA, 20 nt, Artificial Sequence
  ELANE RNA Guide
uccucgcguguguccugccg

SEQ ID NO: 1100 - RNA, 20 nt, Artificial Sequence
  ELANE RNA Guide
ucgcgugucuuuuccucgcg

SEQ ID NO: 1101 - RNA, 20 nt, Artificial Sequence
  ELANE RNA Guide
ucgcguguguccugccggcc

SEQ ID NO: 1102 - RNA, 20 nt, Artificial Sequence
  ELANE RNA Guide
ucuuuuccucgcgugugucc

SEQ ID NO: 1103 - RNA, 20 nt, Artificial Sequence
  ELANE RNA Guide
ugucuuuuccucgcgugugu

SEQ ID NO: 1104 - RNA, 20 nt, Artificial Sequence
  ELANE RNA Guide
uuccucgcguguguccugcc

SEQ ID NO: 1105 - RNA, 20 nt, Artificial Sequence
  ELANE RNA Guide
uuuccucgcguguguccugc

SEQ ID NO: 1106 - RNA, 20 nt, Artificial Sequence
  ELANE RNA Guide
uuuuccucgcguguguccug

SEQ ID NO: 1107 - RNA, 21 nt, Artificial Sequence
  ELANE RNA Guide
aaggccggcaggacacacgcg

SEQ ID NO: 1108 - RNA, 21 nt, Artificial Sequence
  ELANE RNA Guide
acacacgcgaggaaaagacac

SEQ ID NO: 1109 - RNA, 21 nt, Artificial Sequence
  ELANE RNA Guide
acacgcgaggaaaagacacgc

SEQ ID NO: 1110 - RNA, 21 nt, Artificial Sequence
  ELANE RNA Guide
acgcgaggaaaagacacgcga

SEQ ID NO: 1111 - RNA, 21 nt, Artificial Sequence
  ELANE RNA Guide
acucgcgugucuuuuccucgc

SEQ ID NO: 1112 - RNA, 21 nt, Artificial Sequence
  ELANE RNA Guide
agcaaggccggcaggacacac

SEQ ID NO: 1113 - RNA, 21 nt, Artificial Sequence
  ELANE RNA Guide
aggacacacgcgaggaaaaga

SEQ ID NO: 1114 - RNA, 21 nt, Artificial Sequence
  ELANE RNA Guide
aggccggcaggacacacgcga

SEQ ID NO: 1115 - RNA, 21 nt, Artificial Sequence
  ELANE RNA Guide
caaggccggcaggacacacgc

SEQ ID NO: 1116 - RNA, 21 nt, Artificial Sequence
  ELANE RNA Guide
cacacgcgaggaaaagacacg

SEQ ID NO: 1117 - RNA, 21 nt, Artificial Sequence
  ELANE RNA Guide
cacgcgaggaaaagacacgcg

SEQ ID NO: 1118 - RNA, 21 nt, Artificial Sequence
  ELANE RNA Guide
cagcagcaaggccggcaggac

SEQ ID NO: 1119 - RNA, 21 nt, Artificial Sequence
  ELANE RNA Guide
caggacacacgcgaggaaaag

SEQ ID NO: 1120 - RNA, 21 nt, Artificial Sequence
  ELANE RNA Guide
ccggcaggacacacgcgagga

SEQ ID NO: 1121 - RNA, 21 nt, Artificial Sequence
  ELANE RNA Guide
ccucgcguguguccugccggc

SEQ ID NO: 1122 - RNA, 21 nt, Artificial Sequence
  ELANE RNA Guide
cgcgugucuuuuccucgcgug

SEQ ID NO: 1123 - RNA, 21 nt, Artificial Sequence
  ELANE RNA Guide
cgcguguguccugccggccuu

SEQ ID NO: 1124 - RNA, 21 nt, Artificial Sequence
  ELANE RNA Guide
cggcaggacacacgcgaggaa

SEQ ID NO: 1125 - RNA, 21 nt, Artificial Sequence
  ELANE RNA Guide
cgugucuuuuccucgcgugug

SEQ ID NO: 1126 - RNA, 21 nt, Artificial Sequence
  ELANE RNA Guide
cguguguccugccggccuugc

SEQ ID NO: 1127 - RNA, 21 nt, Artificial Sequence
  ELANE RNA Guide
cucgcgugucuuuuccucgcg

SEQ ID NO: 1128 - RNA, 21 nt, Artificial Sequence
  ELANE RNA Guide
cucgcguguguccugccggcc

SEQ ID NO: 1129 - RNA, 21 nt, Artificial Sequence
  ELANE RNA Guide
cuuuuccucgcguguguccug

SEQ ID NO: 1130 - RNA, 21 nt, Artificial Sequence
  ELANE RNA Guide
gacacacgcgaggaaaagaca

SEQ ID NO: 1131 - RNA, 21 nt, Artificial Sequence
  ELANE RNA Guide
gcaaggccggcaggacacacg

SEQ ID NO: 1132 - RNA, 21 nt, Artificial Sequence
  ELANE RNA Guide
gcaggacacacgcgaggaaaa

SEQ ID NO: 1133 - RNA, 21 nt, Artificial Sequence
  ELANE RNA Guide
gccggcaggacacacgcgagg

SEQ ID NO: 1134 - RNA, 21 nt, Artificial Sequence
  ELANE RNA Guide
gcgugucuuuuccucgcgugu

SEQ ID NO: 1135 - RNA, 21 nt, Artificial Sequence
  ELANE RNA Guide
gcguguguccugccggccuug

SEQ ID NO: 1136 - RNA, 21 nt, Artificial Sequence
  ELANE RNA Guide
ggacacacgcgaggaaaagac

SEQ ID NO: 1137 - RNA, 21 nt, Artificial Sequence
  ELANE RNA Guide
ggcaggacacacgcgaggaaa

SEQ ID NO: 1138 - RNA, 21 nt, Artificial Sequence
  ELANE RNA Guide
ggccggcaggacacacgcgag

SEQ ID NO: 1139 - RNA, 21 nt, Artificial Sequence
  ELANE RNA Guide
gucuuuuccucgcgugugucc

SEQ ID NO: 1140 - RNA, 21 nt, Artificial Sequence
  ELANE RNA Guide
gugucuuuuccucgcgugugu

SEQ ID NO: 1141 - RNA, 21 nt, Artificial Sequence
  ELANE RNA Guide
uccucgcguguguccugccgg

SEQ ID NO: 1142 - RNA, 21 nt, Artificial Sequence
  ELANE RNA Guide
ucgcgugucuuuuccucgcgu

SEQ ID NO: 1143 - RNA, 21 nt, Artificial Sequence
  ELANE RNA Guide
ucgcguguguccugccggccu

SEQ ID NO: 1144 - RNA, 21 nt, Artificial Sequence
  ELANE RNA Guide
ucuuuuccucgcguguguccu

SEQ ID NO: 1145 - RNA, 21 nt, Artificial Sequence
  ELANE RNA Guide
ugucuuuuccucgcguguguc

SEQ ID NO: 1146 - RNA, 21 nt, Artificial Sequence
  ELANE RNA Guide
uuccucgcguguguccugccg

SEQ ID NO: 1147 - RNA, 21 nt, Artificial Sequence
  ELANE RNA Guide
uuuccucgcguguguccugcc

SEQ ID NO: 1148 - RNA, 21 nt, Artificial Sequence
  ELANE RNA Guide
uuuuccucgcguguguccugc

SEQ ID NO: 1149 - RNA, 22 nt, Artificial Sequence
  ELANE RNA Guide
aaggccggcaggacacacgcga

SEQ ID NO: 1150 - RNA, 22 nt, Artificial Sequence
  ELANE RNA Guide
acacacgcgaggaaaagacacg

SEQ ID NO: 1151 - RNA, 22 nt, Artificial Sequence
  ELANE RNA Guide
acacgcgaggaaaagacacgcg

SEQ ID NO: 1152 - RNA, 22 nt, Artificial Sequence
  ELANE RNA Guide
acgcgaggaaaagacacgcgag

SEQ ID NO: 1153 - RNA, 22 nt, Artificial Sequence
  ELANE RNA Guide
acucgcgugucuuuuccucgcg

SEQ ID NO: 1154 - RNA, 22 nt, Artificial Sequence
  ELANE RNA Guide
agcaaggccggcaggacacacg

SEQ ID NO: 1155 - RNA, 22 nt, Artificial Sequence
  ELANE RNA Guide
aggacacacgcgaggaaaagac

SEQ ID NO: 1156 - RNA, 22 nt, Artificial Sequence
  ELANE RNA Guide
aggccggcaggacacacgcgag

SEQ ID NO: 1157 - RNA, 22 nt, Artificial Sequence
  ELANE RNA Guide
caaggccggcaggacacacgcg

SEQ ID NO: 1158 - RNA, 22 nt, Artificial Sequence
  ELANE RNA Guide
cacacgcgaggaaaagacacgc

SEQ ID NO: 1159 - RNA, 22 nt, Artificial Sequence
  ELANE RNA Guide
cacgcgaggaaaagacacgcga

SEQ ID NO: 1160 - RNA, 22 nt, Artificial Sequence
  ELANE RNA Guide
cagcaaggccggcaggacacac

SEQ ID NO: 1161 - RNA, 22 nt, Artificial Sequence
  ELANE RNA Guide
caggacacacgcgaggaaaaga

SEQ ID NO: 1162 - RNA, 22 nt, Artificial Sequence
  ELANE RNA Guide
ccagcagcaaggccggcaggac

SEQ ID NO: 1163 - RNA, 22 nt, Artificial Sequence
  ELANE RNA Guide
ccggcaggacacacgcgaggaa

SEQ ID NO: 1164 - RNA, 22 nt, Artificial Sequence
  ELANE RNA Guide
ccucgcguguguccugccggcc

SEQ ID NO: 1165 - RNA, 22 nt, Artificial Sequence
  ELANE RNA Guide
cgcgugucuuuuccucgcgugu

SEQ ID NO: 1166 - RNA, 22 nt, Artificial Sequence
  ELANE RNA Guide
cgcguguguccugccggccuug

SEQ ID NO: 1167 - RNA, 22 nt, Artificial Sequence
  ELANE RNA Guide
cggcaggacacacgcgaggaaa

SEQ ID NO: 1168 - RNA, 22 nt, Artificial Sequence
  ELANE RNA Guide
cgugucuuuuccucgcgugugu

SEQ ID NO: 1169 - RNA, 22 nt, Artificial Sequence
  ELANE RNA Guide
cguguguccugccggccuugcu

SEQ ID NO: 1170 - RNA, 22 nt, Artificial Sequence
  ELANE RNA Guide
cucgcgugucuuuuccucgcgu

SEQ ID NO: 1171 - RNA, 22 nt, Artificial Sequence
  ELANE RNA Guide
cucgcguguguccugccggccu

SEQ ID NO: 1172 - RNA, 22 nt, Artificial Sequence
  ELANE RNA Guide
cuuuuccucgcguguguccugc

SEQ ID NO: 1173 - RNA, 22 nt, Artificial Sequence
  ELANE RNA Guide
gacacacgcgaggaaaagacac

SEQ ID NO: 1174 - RNA, 22 nt, Artificial Sequence
  ELANE RNA Guide
gacucgcgugucuuuuccucgc

SEQ ID NO: 1175 - RNA, 22 nt, Artificial Sequence
  ELANE RNA Guide
gcaaggccggcaggacacacgc

SEQ ID NO: 1176 - RNA, 22 nt, Artificial Sequence
  ELANE RNA Guide
gcaggacacacgcgaggaaaag

SEQ ID NO: 1177 - RNA, 22 nt, Artificial Sequence
  ELANE RNA Guide
gccggcaggacacacgcgagga

SEQ ID NO: 1178 - RNA, 22 nt, Artificial Sequence
  ELANE RNA Guide
gcgugucuuuuccucgcgugug

SEQ ID NO: 1179 - RNA, 22 nt, Artificial Sequence
  ELANE RNA Guide
gcguguguccugccggccuugc

SEQ ID NO: 1180 - RNA, 22 nt, Artificial Sequence
  ELANE RNA Guide
ggacacacgcgaggaaaagaca

SEQ ID NO: 1181 - RNA, 22 nt, Artificial Sequence
  ELANE RNA Guide
ggcaggacacacgcgaggaaaa

SEQ ID NO: 1182 - RNA, 22 nt, Artificial Sequence
  ELANE RNA Guide
ggccggcaggacacacgcgagg

SEQ ID NO: 1183 - RNA, 22 nt, Artificial Sequence
  ELANE RNA Guide
gucuuuuccucgcguguguccu

SEQ ID NO: 1184 - RNA, 22 nt, Artificial Sequence
  ELANE RNA Guide
gugucuuuuccucgcguguguc

SEQ ID NO: 1185 - RNA, 22 nt, Artificial Sequence
  ELANE RNA Guide
uccucgcguguguccugccggc

SEQ ID NO: 1186 - RNA, 22 nt, Artificial Sequence
  ELANE RNA Guide
ucgcgugucuuuuccucgcgug

SEQ ID NO: 1187 - RNA, 22 nt, Artificial Sequence
  ELANE RNA Guide
ucgcguguguccugccggccuu

SEQ ID NO: 1188 - RNA, 22 nt, Artificial Sequence
  ELANE RNA Guide
ucuuuuccucgcguguguccug

SEQ ID NO: 1189 - RNA, 22 nt, Artificial Sequence
  ELANE RNA Guide
ugucuuuuccucgcgugugucc

SEQ ID NO: 1190 - RNA, 22 nt, Artificial Sequence
  ELANE RNA Guide
uuccucgcguguguccugccgg

SEQ ID NO: 1191 - RNA, 22 nt, Artificial Sequence
  ELANE RNA Guide
uuuccucgcguguguccugccg

SEQ ID NO: 1192 - RNA, 22 nt, Artificial Sequence
  ELANE RNA Guide
uuuuccucgcguguguccugcc

SEQ ID NO: 1193 - RNA, 20 nt, Artificial Sequence
  ELANE RNA Guide
aaacucaccccccagcagca

SEQ ID NO: 1194 - RNA, 20 nt, Artificial Sequence
  ELANE RNA Guide
aacucaccccccagcagcaa

SEQ ID NO: 1195 - RNA, 20 nt, Artificial Sequence
  ELANE RNA Guide
aagggcggcaggacacaggc

SEQ ID NO: 1196 - RNA, 20 nt, Artificial Sequence
  ELANE RNA Guide
accccccagcagcaagggcg

SEQ ID NO: 1197 - RNA, 20 nt, Artificial Sequence
  ELANE RNA Guide
acucaccccccagcagcaag

SEQ ID NO: 1198 - RNA, 20 nt, Artificial Sequence
  ELANE RNA Guide
agcaagggcggcaggacaca

SEQ ID NO: 1199 - RNA, 20 nt, Artificial Sequence
  ELANE RNA Guide
agcagcaagggcggcaggac

SEQ ID NO: 1200 - RNA, 20 nt, Artificial Sequence
  ELANE RNA Guide
agggcggcaggacacaggcg

SEQ ID NO: 1201 - RNA, 20 nt, Artificial Sequence
  ELANE RNA Guide
caagggcggcaggacacagg

SEQ ID NO: 1202 - RNA, 20 nt, Artificial Sequence
  ELANE RNA Guide
caccccccagcagcaagggc

SEQ ID NO: 1203 - RNA, 20 nt, Artificial Sequence
  ELANE RNA Guide
cagcaagggcggcaggacac

SEQ ID NO: 1204 - RNA, 20 nt, Artificial Sequence
  ELANE RNA Guide
cagcagcaagggcggcagga

SEQ ID NO: 1205 - RNA, 20 nt, Artificial Sequence
  ELANE RNA Guide
ccagcagcaagggcggcagg

SEQ ID NO: 1206 - RNA, 20 nt, Artificial Sequence
  ELANE RNA Guide
cccagcagcaagggcggcag

SEQ ID NO: 1207 - RNA, 20 nt, Artificial Sequence
  ELANE RNA Guide
ccccagcagcaagggcggca

SEQ ID NO: 1208 - RNA, 20 nt, Artificial Sequence
  ELANE RNA Guide
cccccagcagcaagggcggc

SEQ ID NO: 1209 - RNA, 20 nt, Artificial Sequence
  ELANE RNA Guide
ccccccagcagcaagggcgg

SEQ ID NO: 1210 - RNA, 20 nt, Artificial Sequence
  ELANE RNA Guide
ccgcccuugcugcugggggg

SEQ ID NO: 1211 - RNA, 20 nt, Artificial Sequence
  ELANE RNA Guide
ccucgccuguguccugccgc

SEQ ID NO: 1212 - RNA, 20 nt, Artificial Sequence
  ELANE RNA Guide
ccugccgcccuugcugcugg

SEQ ID NO: 1213 - RNA, 20 nt, Artificial Sequence
  ELANE RNA Guide
ccuguguccugccgcccuug

SEQ ID NO: 1214 - RNA, 20 nt, Artificial Sequence
  ELANE RNA Guide
cgcccuugcugcuggggggu

SEQ ID NO: 1215 - RNA, 20 nt, Artificial Sequence
  ELANE RNA Guide
cgccuguguccugccgcccu

SEQ ID NO: 1216 - RNA, 20 nt, Artificial Sequence
  ELANE RNA Guide
cucaccccccagcagcaagg

SEQ ID NO: 1217 - RNA, 20 nt, Artificial Sequence
  ELANE RNA Guide
cucgccuguguccugccgcc

SEQ ID NO: 1218 - RNA, 20 nt, Artificial Sequence
  ELANE RNA Guide
cugccgcccuugcugcuggg

SEQ ID NO: 1219 - RNA, 20 nt, Artificial Sequence
  ELANE RNA Guide
cuguguccugccgcccuugc

SEQ ID NO: 1220 - RNA, 20 nt, Artificial Sequence
  ELANE RNA Guide
gcaagggcggcaggacacag

SEQ ID NO: 1221 - RNA, 20 nt, Artificial Sequence
  ELANE RNA Guide
gcagcaagggcggcaggaca

SEQ ID NO: 1222 - RNA, 20 nt, Artificial Sequence
  ELANE RNA Guide
gcccuugcugcuggggggug

SEQ ID NO: 1223 - RNA, 20 nt, Artificial Sequence
  ELANE RNA Guide
gccgcccuugcugcuggggg

SEQ ID NO: 1224 - RNA, 20 nt, Artificial Sequence
  ELANE RNA Guide
gccuguguccugccgcccuu

SEQ ID NO: 1225 - RNA, 20 nt, Artificial Sequence
  ELANE RNA Guide
ggcggcaggacacaggcgag

SEQ ID NO: 1226 - RNA, 20 nt, Artificial Sequence
  ELANE RNA Guide
gggcggcaggacacaggcga

SEQ ID NO: 1227 - RNA, 20 nt, Artificial Sequence
  ELANE RNA Guide
guccugccgcccuugcugcu

SEQ ID NO: 1228 - RNA, 20 nt, Artificial Sequence
  ELANE RNA Guide
guguccugccgcccuugcug

SEQ ID NO: 1229 - RNA, 20 nt, Artificial Sequence
  ELANE RNA Guide
ucaccccccagcagcaaggg

SEQ ID NO: 1230 - RNA, 20 nt, Artificial Sequence
  ELANE RNA Guide
uccucgccuguguccugccg

SEQ ID NO: 1231 - RNA, 20 nt, Artificial Sequence
  ELANE RNA Guide
uccugccgcccuugcugcug

SEQ ID NO: 1232 - RNA, 20 nt, Artificial Sequence
  ELANE RNA Guide
ucgccuguguccugccgccc

SEQ ID NO: 1233 - RNA, 20 nt, Artificial Sequence
  ELANE RNA Guide
ugccgcccuugcugcugggg

SEQ ID NO: 1234 - RNA, 20 nt, Artificial Sequence
  ELANE RNA Guide
uguccugccgcccuugcugc

SEQ ID NO: 1235 - RNA, 20 nt, Artificial Sequence
  ELANE RNA Guide
uguguccugccgcccuugcu

SEQ ID NO: 1236 - RNA, 20 nt, Artificial Sequence
  ELANE RNA Guide
uuccucgccuguguccugcc

SEQ ID NO: 1237 - RNA, 20 nt, Artificial Sequence
  ELANE RNA Guide
uuuccucgccuguguccugc

SEQ ID NO: 1238 - RNA, 20 nt, Artificial Sequence
  ELANE RNA Guide
uuuuccucgccuguguccug

SEQ ID NO: 1239 - RNA, 21 nt, Artificial Sequence
  ELANE RNA Guide
aaaacucaccccccagcagca

SEQ ID NO: 1240 - RNA, 21 nt, Artificial Sequence
  ELANE RNA Guide
aaacucaccccccagcagcaa

SEQ ID NO: 1241 - RNA, 21 nt, Artificial Sequence
  ELANE RNA Guide
aacucaccccccagcagcaag

SEQ ID NO: 1242 - RNA, 21 nt, Artificial Sequence
  ELANE RNA Guide
aagggcggcaggacacaggcg

SEQ ID NO: 1243 - RNA, 21 nt, Artificial Sequence
  ELANE RNA Guide
accccccagcagcaagggcgg

SEQ ID NO: 1244 - RNA, 21 nt, Artificial Sequence
  ELANE RNA Guide
acucaccccccagcagcaagg

SEQ ID NO: 1245 - RNA, 21 nt, Artificial Sequence
  ELANE RNA Guide
agcaagggcggcaggacacag

SEQ ID NO: 1246 - RNA, 21 nt, Artificial Sequence
  ELANE RNA Guide
agcagcaagggcggcaggaca

SEQ ID NO: 1247 - RNA, 21 nt, Artificial Sequence
  ELANE RNA Guide
agggcggcaggacacaggcga

SEQ ID NO: 1248 - RNA, 21 nt, Artificial Sequence
  ELANE RNA Guide
caagggcggcaggacacaggc

SEQ ID NO: 1249 - RNA, 21 nt, Artificial Sequence
  ELANE RNA Guide
caccccccagcagcaagggcg

SEQ ID NO: 1250 - RNA, 21 nt, Artificial Sequence
  ELANE RNA Guide
cagcaagggcggcaggacaca

SEQ ID NO: 1251 - RNA, 21 nt, Artificial Sequence
  ELANE RNA Guide
cagcagcaagggcggcaggac

SEQ ID NO: 1252 - RNA, 21 nt, Artificial Sequence
  ELANE RNA Guide
ccagcagcaagggcggcagga

SEQ ID NO: 1253 - RNA, 21 nt, Artificial Sequence
  ELANE RNA Guide
cccagcagcaagggcggcagg

SEQ ID NO: 1254 - RNA, 21 nt, Artificial Sequence
  ELANE RNA Guide
ccccagcagcaagggcggcag

SEQ ID NO: 1255 - RNA, 21 nt, Artificial Sequence
  ELANE RNA Guide
cccccagcagcaagggcggca

SEQ ID NO: 1256 - RNA, 21 nt, Artificial Sequence
  ELANE RNA Guide
ccgcccuugcugcuggggggu

SEQ ID NO: 1257 - RNA, 21 nt, Artificial Sequence
  ELANE RNA Guide
ccucgccuguguccugccgcc

SEQ ID NO: 1258 - RNA, 21 nt, Artificial Sequence
  ELANE RNA Guide
ccugccgcccuugcugcuggg

SEQ ID NO: 1259 - RNA, 21 nt, Artificial Sequence
  ELANE RNA Guide
ccuguguccugccgcccuugc

SEQ ID NO: 1260 - RNA, 21 nt, Artificial Sequence
  ELANE RNA Guide
cgcccuugcugcuggggggug

SEQ ID NO: 1261 - RNA, 21 nt, Artificial Sequence
  ELANE RNA Guide
cgccuguguccugccgcccuu

SEQ ID NO: 1262 - RNA, 21 nt, Artificial Sequence
  ELANE RNA Guide
cucaccccccagcagcaaggg

SEQ ID NO: 1263 - RNA, 21 nt, Artificial Sequence
  ELANE RNA Guide
cucgccuguguccugccgccc

SEQ ID NO: 1264 - RNA, 21 nt, Artificial Sequence
  ELANE RNA Guide
cugccgcccuugcugcugggg

SEQ ID NO: 1265 - RNA, 21 nt, Artificial Sequence
  ELANE RNA Guide
cuguguccugccgcccuugcu

SEQ ID NO: 1266 - RNA, 21 nt, Artificial Sequence
  ELANE RNA Guide
cuuuuccucgccuguguccug

SEQ ID NO: 1267 - RNA, 21 nt, Artificial Sequence
  ELANE RNA Guide
gcaagggcggcaggacacagg

SEQ ID NO: 1268 - RNA, 21 nt, Artificial Sequence
  ELANE RNA Guide
gcagcaagggcggcaggacac

SEQ ID NO: 1269 - RNA, 21 nt, Artificial Sequence
  ELANE RNA Guide
gcccuugcugcugggggguga

SEQ ID NO: 1270 - RNA, 21 nt, Artificial Sequence
  ELANE RNA Guide
gccuguguccugccgcccuug

SEQ ID NO: 1271 - RNA, 21 nt, Artificial Sequence
  ELANE RNA Guide
ggcggcaggacacaggcgagg

SEQ ID NO: 1272 - RNA, 21 nt, Artificial Sequence
  ELANE RNA Guide
gggcggcaggacacaggcgag

SEQ ID NO: 1273 - RNA, 21 nt, Artificial Sequence
  ELANE RNA Guide
guccugccgcccuugcugcug

SEQ ID NO: 1274 - RNA, 21 nt, Artificial Sequence
  ELANE RNA Guide
guguccugccgcccuugcugc

SEQ ID NO: 1275 - RNA, 21 nt, Artificial Sequence
  ELANE RNA Guide
ucaccccccagcagcaagggc

SEQ ID NO: 1276 - RNA, 21 nt, Artificial Sequence
  ELANE RNA Guide
uccucgccuguguccugccgc

SEQ ID NO: 1277 - RNA, 21 nt, Artificial Sequence
  ELANE RNA Guide
uccugccgcccuugcugcugg

SEQ ID NO: 1278 - RNA, 21 nt, Artificial Sequence
  ELANE RNA Guide
ucgccuguguccugccgcccu

SEQ ID NO: 1279 - RNA, 21 nt, Artificial Sequence
  ELANE RNA Guide
ugccgcccuugcugcuggggg

SEQ ID NO: 1280 - RNA, 21 nt, Artificial Sequence
  ELANE RNA Guide
uguccugccgcccuugcugcu

SEQ ID NO: 1281 - RNA, 21 nt, Artificial Sequence
  ELANE RNA Guide
uguguccugccgcccuugcug

SEQ ID NO: 1282 - RNA, 21 nt, Artificial Sequence
  ELANE RNA Guide
uuccucgccuguguccugccg

SEQ ID NO: 1283 - RNA, 21 nt, Artificial Sequence
  ELANE RNA Guide
uuuccucgccuguguccugcc

SEQ ID NO: 1284 - RNA, 21 nt, Artificial Sequence
  ELANE RNA Guide
uuuuccucgccuguguccugc

SEQ ID NO: 1285 - RNA, 22 nt, Artificial Sequence
  ELANE RNA Guide
aaaaacucaccccccagcagca

SEQ ID NO: 1286 - RNA, 22 nt, Artificial Sequence
  ELANE RNA Guide
aaaacucaccccccagcagcaa

SEQ ID NO: 1287 - RNA, 22 nt, Artificial Sequence
  ELANE RNA Guide
aaacucaccccccagcagcaag

SEQ ID NO: 1288 - RNA, 22 nt, Artificial Sequence
  ELANE RNA Guide
aacucaccccccagcagcaagg

SEQ ID NO: 1289 - RNA, 22 nt, Artificial Sequence
  ELANE RNA Guide
aagggcggcaggacacaggcga

SEQ ID NO: 1290 - RNA, 22 nt, Artificial Sequence
  ELANE RNA Guide
accccccagcagcaagggcggc

SEQ ID NO: 1291 - RNA, 22 nt, Artificial Sequence
  ELANE RNA Guide
acucaccccccagcagcaaggg

SEQ ID NO: 1292 - RNA, 22 nt, Artificial Sequence
  ELANE RNA Guide
agcaagggcggcaggacacagg

SEQ ID NO: 1293 - RNA, 22 nt, Artificial Sequence
  ELANE RNA Guide
agcagcaagggcggcaggacac

SEQ ID NO: 1294 - RNA, 22 nt, Artificial Sequence
  ELANE RNA Guide
agggcggcaggacacaggcgag

SEQ ID NO: 1295 - RNA, 22 nt, Artificial Sequence
  ELANE RNA Guide
caagggcggcaggacacaggcg

SEQ ID NO: 1296 - RNA, 22 nt, Artificial Sequence
  ELANE RNA Guide
caccccccagcagcaagggcgg

SEQ ID NO: 1297 - RNA, 22 nt, Artificial Sequence
  ELANE RNA Guide
cagcaagggcggcaggacacag

SEQ ID NO: 1298 - RNA, 22 nt, Artificial Sequence
  ELANE RNA Guide
cagcagcaagggcggcaggaca

SEQ ID NO: 1299 - RNA, 22 nt, Artificial Sequence
  ELANE RNA Guide
ccagcagcaagggcggcaggac

SEQ ID NO: 1300 - RNA, 22 nt, Artificial Sequence
  ELANE RNA Guide
cccagcagcaagggcggcagga

SEQ ID NO: 1301 - RNA, 22 nt, Artificial Sequence
  ELANE RNA Guide
ccccagcagcaagggcggcagg

SEQ ID NO: 1302 - RNA, 22 nt, Artificial Sequence
  ELANE RNA Guide
cccccagcagcaagggcggcag

SEQ ID NO: 1303 - RNA, 22 nt, Artificial Sequence
  ELANE RNA Guide
ccccccagcagcaagggcggca

SEQ ID NO: 1304 - RNA, 22 nt, Artificial Sequence
  ELANE RNA Guide
ccgcccuugcugcuggggggug

SEQ ID NO: 1305 - RNA, 22 nt, Artificial Sequence
  ELANE RNA Guide
ccucgccuguguccugccgccc

SEQ ID NO: 1306 - RNA, 22 nt, Artificial Sequence
  ELANE RNA Guide
ccugccgcccuugcugcugggg

SEQ ID NO: 1307 - RNA, 22 nt, Artificial Sequence
  ELANE RNA Guide
ccuguguccugccgcccuugcu

SEQ ID NO: 1308 - RNA, 22 nt, Artificial Sequence
  ELANE RNA Guide
cgcccuugcugcugggggguga

SEQ ID NO: 1309 - RNA, 22 nt, Artificial Sequence
  ELANE RNA Guide
cgccuguguccugccgcccuug

SEQ ID NO: 1310 - RNA, 22 nt, Artificial Sequence
  ELANE RNA Guide
cucaccccccagcagcaagggc

SEQ ID NO: 1311 - RNA, 22 nt, Artificial Sequence
  ELANE RNA Guide
cucgccuguguccugccgcccu

SEQ ID NO: 1312 - RNA, 22 nt, Artificial Sequence
  ELANE RNA Guide
cugccgcccuugcugcuggggg

SEQ ID NO: 1313 - RNA, 22 nt, Artificial Sequence
  ELANE RNA Guide
cuguguccugccgcccuugcug

SEQ ID NO: 1314 - RNA, 22 nt, Artificial Sequence
  ELANE RNA Guide
cuuuuccucgccuguguccugc

SEQ ID NO: 1315 - RNA, 22 nt, Artificial Sequence
  ELANE RNA Guide
gcaagggcggcaggacacaggc

SEQ ID NO: 1316 - RNA, 22 nt, Artificial Sequence
  ELANE RNA Guide
gcagcaagggcggcaggacaca

SEQ ID NO: 1317 - RNA, 22 nt, Artificial Sequence
  ELANE RNA Guide
gcccuugcugcuggggggugag

SEQ ID NO: 1318 - RNA, 22 nt, Artificial Sequence
  ELANE RNA Guide
gccgcccuugcugcuggggggu

SEQ ID NO: 1319 - RNA, 22 nt, Artificial Sequence
  ELANE RNA Guide
gccuguguccugccgcccuugc

SEQ ID NO: 1320 - RNA, 22 nt, Artificial Sequence
  ELANE RNA Guide
ggcggcaggacacaggcgagga

SEQ ID NO: 1321 - RNA, 22 nt, Artificial Sequence
  ELANE RNA Guide
gggcggcaggacacaggcgagg

SEQ ID NO: 1322 - RNA, 22 nt, Artificial Sequence
  ELANE RNA Guide
guccugccgcccuugcugcugg

SEQ ID NO: 1323 - RNA, 22 nt, Artificial Sequence
  ELANE RNA Guide
guguccugccgcccuugcugcu

SEQ ID NO: 1324 - RNA, 22 nt, Artificial Sequence
  ELANE RNA Guide
ucaccccccagcagcaagggcg

SEQ ID NO: 1325 - RNA, 22 nt, Artificial Sequence
  ELANE RNA Guide
uccucgccuguguccugccgcc

SEQ ID NO: 1326 - RNA, 22 nt, Artificial Sequence
  ELANE RNA Guide
uccugccgcccuugcugcuggg

SEQ ID NO: 1327 - RNA, 22 nt, Artificial Sequence
  ELANE RNA Guide
ucgccuguguccugccgcccuu

SEQ ID NO: 1328 - RNA, 22 nt, Artificial Sequence
  ELANE RNA Guide
ucuuuuccucgccuguguccug

SEQ ID NO: 1329 - RNA, 22 nt, Artificial Sequence
  ELANE RNA Guide
ugccgcccuugcugcugggggg

SEQ ID NO: 1330 - RNA, 22 nt, Artificial Sequence
  ELANE RNA Guide
uguccugccgcccuugcugcug

SEQ ID NO: 1331 - RNA, 22 nt, Artificial Sequence
  ELANE RNA Guide
uguguccugccgcccuugcugc

SEQ ID NO: 1332 - RNA, 22 nt, Artificial Sequence
  ELANE RNA Guide
uuccucgccuguguccugccgc

SEQ ID NO: 1333 - RNA, 22 nt, Artificial Sequence
  ELANE RNA Guide
uuuccucgccuguguccugccg

SEQ ID NO: 1334 - RNA, 22 nt, Artificial Sequence
  ELANE RNA Guide
uuuuccucgccuguguccugcc

SEQ ID NO: 1335 - RNA, 20 nt, Artificial Sequence
  ELANE RNA Guide
aaaaacucaccccgcagcag

SEQ ID NO: 1336 - RNA, 20 nt, Artificial Sequence
  ELANE RNA Guide
aaaacucaccccgcagcagc

SEQ ID NO: 1337 - RNA, 20 nt, Artificial Sequence
  ELANE RNA Guide
aaacucaccccgcagcagca

SEQ ID NO: 1338 - RNA, 20 nt, Artificial Sequence
  ELANE RNA Guide
aacucaccccgcagcagcaa

SEQ ID NO: 1339 - RNA, 20 nt, Artificial Sequence
  ELANE RNA Guide
accccgcagcagcaaggccg

SEQ ID NO: 1340 - RNA, 20 nt, Artificial Sequence
  ELANE RNA Guide
acucaaaaacucaccccgca

SEQ ID NO: 1341 - RNA, 20 nt, Artificial Sequence
  ELANE RNA Guide
acucaccccgcagcagcaag

SEQ ID NO: 1342 - RNA, 20 nt, Artificial Sequence
  ELANE RNA Guide
caaaaacucaccccgcagca

SEQ ID NO: 1343 - RNA, 20 nt, Artificial Sequence
  ELANE RNA Guide
caccccgcagcagcaaggcc

SEQ ID NO: 1344 - RNA, 20 nt, Artificial Sequence
  ELANE RNA Guide
ccccgcagcagcaaggccgg

SEQ ID NO: 1345 - RNA, 20 nt, Artificial Sequence
  ELANE RNA Guide
cccgcagcagcaaggccggc

SEQ ID NO: 1346 - RNA, 20 nt, Artificial Sequence
  ELANE RNA Guide
ccgcagcagcaaggccggca

SEQ ID NO: 1347 - RNA, 20 nt, Artificial Sequence
  ELANE RNA Guide
ccggccuugcugcugcgggg

SEQ ID NO: 1348 - RNA, 20 nt, Artificial Sequence
  ELANE RNA Guide
ccugccggccuugcugcugc

SEQ ID NO: 1349 - RNA, 20 nt, Artificial Sequence
  ELANE RNA Guide
ccuugcugcugcggggugag

SEQ ID NO: 1350 - RNA, 20 nt, Artificial Sequence
  ELANE RNA Guide
cgcagcagcaaggccggcag

SEQ ID NO: 1351 - RNA, 20 nt, Artificial Sequence
  ELANE RNA Guide
cggccuugcugcugcggggu

SEQ ID NO: 1352 - RNA, 20 nt, Artificial Sequence
  ELANE RNA Guide
cucaaaaacucaccccgcag

SEQ ID NO: 1353 - RNA, 20 nt, Artificial Sequence
  ELANE RNA Guide
cucaccccgcagcagcaagg

SEQ ID NO: 1354 - RNA, 20 nt, Artificial Sequence
  ELANE RNA Guide
cugccggccuugcugcugcg

SEQ ID NO: 1355 - RNA, 20 nt, Artificial Sequence
  ELANE RNA Guide
cugcggggugaguuuuugag

SEQ ID NO: 1356 - RNA, 20 nt, Artificial Sequence
  ELANE RNA Guide
cugcugcggggugaguuuuu

SEQ ID NO: 1357 - RNA, 20 nt, Artificial Sequence
  ELANE RNA Guide
cuugcugcugcggggugagu

SEQ ID NO: 1358 - RNA, 20 nt, Artificial Sequence
  ELANE RNA Guide
gacucaaaaacucaccccgc

SEQ ID NO: 1359 - RNA, 20 nt, Artificial Sequence
  ELANE RNA Guide
gccggccuugcugcugcggg

SEQ ID NO: 1360 - RNA, 20 nt, Artificial Sequence
  ELANE RNA Guide
gccuugcugcugcgggguga

SEQ ID NO: 1361 - RNA, 20 nt, Artificial Sequence
  ELANE RNA Guide
gcggggugaguuuuugaguc

SEQ ID NO: 1362 - RNA, 20 nt, Artificial Sequence
  ELANE RNA Guide
gcugcggggugaguuuuuga

SEQ ID NO: 1363 - RNA, 20 nt, Artificial Sequence
  ELANE RNA Guide
gcugcugcggggugaguuuu

SEQ ID NO: 1364 - RNA, 20 nt, Artificial Sequence
  ELANE RNA Guide
ggacucaaaaacucaccccg

SEQ ID NO: 1365 - RNA, 20 nt, Artificial Sequence
  ELANE RNA Guide
ggccuugcugcugcggggug

SEQ ID NO: 1366 - RNA, 20 nt, Artificial Sequence
  ELANE RNA Guide
gguuggacucaaaaacucac

SEQ ID NO: 1367 - RNA, 20 nt, Artificial Sequence
  ELANE RNA Guide
guccugccggccuugcugcu

SEQ ID NO: 1368 - RNA, 20 nt, Artificial Sequence
  ELANE RNA Guide
guguccugccggccuugcug

SEQ ID NO: 1369 - RNA, 20 nt, Artificial Sequence
  ELANE RNA Guide
guuggacucaaaaacucacc

SEQ ID NO: 1370 - RNA, 20 nt, Artificial Sequence
  ELANE RNA Guide
ucaaaaacucaccccgcagc

SEQ ID NO: 1371 - RNA, 20 nt, Artificial Sequence
  ELANE RNA Guide
ucaccccgcagcagcaaggc

SEQ ID NO: 1372 - RNA, 20 nt, Artificial Sequence
  ELANE RNA Guide
uccugccggccuugcugcug

SEQ ID NO: 1373 - RNA, 20 nt, Artificial Sequence
  ELANE RNA Guide
ugccggccuugcugcugcgg

SEQ ID NO: 1374 - RNA, 20 nt, Artificial Sequence
  ELANE RNA Guide
ugcggggugaguuuuugagu

SEQ ID NO: 1375 - RNA, 20 nt, Artificial Sequence
  ELANE RNA Guide
ugcugcggggugaguuuuug

SEQ ID NO: 1376 - RNA, 20 nt, Artificial Sequence
  ELANE RNA Guide
ugcugcugcggggugaguuu

SEQ ID NO: 1377 - RNA, 20 nt, Artificial Sequence
  ELANE RNA Guide
uggacucaaaaacucacccc

SEQ ID NO: 1378 - RNA, 20 nt, Artificial Sequence
  ELANE RNA Guide
uguccugccggccuugcugc

SEQ ID NO: 1379 - RNA, 20 nt, Artificial Sequence
  ELANE RNA Guide
uugcugcugcggggugaguu

SEQ ID NO: 1380 - RNA, 20 nt, Artificial Sequence
  ELANE RNA Guide
uuggacucaaaaacucaccc

SEQ ID NO: 1381 - RNA, 21 nt, Artificial Sequence
  ELANE RNA Guide
aaaaacucaccccgcagcagc

SEQ ID NO: 1382 - RNA, 21 nt, Artificial Sequence
  ELANE RNA Guide
aaaacucaccccgcagcagca

SEQ ID NO: 1383 - RNA, 21 nt, Artificial Sequence
  ELANE RNA Guide
aaacucaccccgcagcagcaa

SEQ ID NO: 1384 - RNA, 21 nt, Artificial Sequence
  ELANE RNA Guide
aacucaccccgcagcagcaag

SEQ ID NO: 1385 - RNA, 21 nt, Artificial Sequence
  ELANE RNA Guide
accccgcagcagcaaggccgg

SEQ ID NO: 1386 - RNA, 21 nt, Artificial Sequence
  ELANE RNA Guide
acucaaaaacucaccccgcag

SEQ ID NO: 1387 - RNA, 21 nt, Artificial Sequence
  ELANE RNA Guide
acucaccccgcagcagcaagg

SEQ ID NO: 1388 - RNA, 21 nt, Artificial Sequence
  ELANE RNA Guide
agguuggacucaaaaacucac

SEQ ID NO: 1389 - RNA, 21 nt, Artificial Sequence
  ELANE RNA Guide
caaaaacucaccccgcagcag

SEQ ID NO: 1390 - RNA, 21 nt, Artificial Sequence
  ELANE RNA Guide
caccccgcagcagcaaggccg

SEQ ID NO: 1391 - RNA, 21 nt, Artificial Sequence
  ELANE RNA Guide
cccgcagcagcaaggccggca

SEQ ID NO: 1392 - RNA, 21 nt, Artificial Sequence
  ELANE RNA Guide
ccgcagcagcaaggccggcag

SEQ ID NO: 1393 - RNA, 21 nt, Artificial Sequence
  ELANE RNA Guide
ccggccuugcugcugcggggu

SEQ ID NO: 1394 - RNA, 21 nt, Artificial Sequence
  ELANE RNA Guide
ccugccggccuugcugcugcg

SEQ ID NO: 1395 - RNA, 21 nt, Artificial Sequence
  ELANE RNA Guide
ccuugcugcugcggggugagu

SEQ ID NO: 1396 - RNA, 21 nt, Artificial Sequence
  ELANE RNA Guide
cgcagcagcaaggccggcagg

SEQ ID NO: 1397 - RNA, 21 nt, Artificial Sequence
  ELANE RNA Guide
cggccuugcugcugcggggug

SEQ ID NO: 1398 - RNA, 21 nt, Artificial Sequence
  ELANE RNA Guide
cucaaaaacucaccccgcagc

SEQ ID NO: 1399 - RNA, 21 nt, Artificial Sequence
  ELANE RNA Guide
cucaccccgcagcagcaaggc

SEQ ID NO: 1400 - RNA, 21 nt, Artificial Sequence
  ELANE RNA Guide
cugccggccuugcugcugcgg

SEQ ID NO: 1401 - RNA, 21 nt, Artificial Sequence
  ELANE RNA Guide
cugcggggugaguuuuugagu

SEQ ID NO: 1402 - RNA, 21 nt, Artificial Sequence
  ELANE RNA Guide
cugcugcggggugaguuuuug

SEQ ID NO: 1403 - RNA, 21 nt, Artificial Sequence
  ELANE RNA Guide
cuugcugcugcggggugaguu

SEQ ID NO: 1404 - RNA, 21 nt, Artificial Sequence
  ELANE RNA Guide
gacucaaaaacucaccccgca

SEQ ID NO: 1405 - RNA, 21 nt, Artificial Sequence
  ELANE RNA Guide
gccuugcugcugcggggugag

SEQ ID NO: 1406 - RNA, 21 nt, Artificial Sequence
  ELANE RNA Guide
gcggggugaguuuuugagucc

SEQ ID NO: 1407 - RNA, 21 nt, Artificial Sequence
  ELANE RNA Guide
gcugcggggugaguuuuugag

SEQ ID NO: 1408 - RNA, 21 nt, Artificial Sequence
  ELANE RNA Guide
gcugcugcggggugaguuuuu

SEQ ID NO: 1409 - RNA, 21 nt, Artificial Sequence
  ELANE RNA Guide
ggacucaaaaacucaccccgc

SEQ ID NO: 1410 - RNA, 21 nt, Artificial Sequence
  ELANE RNA Guide
ggccuugcugcugcgggguga

SEQ ID NO: 1411 - RNA, 21 nt, Artificial Sequence
  ELANE RNA Guide
gguuggacucaaaaacucacc

SEQ ID NO: 1412 - RNA, 21 nt, Artificial Sequence
  ELANE RNA Guide
guccugccggccuugcugcug

SEQ ID NO: 1413 - RNA, 21 nt, Artificial Sequence
  ELANE RNA Guide
guguccugccggccuugcugc

SEQ ID NO: 1414 - RNA, 21 nt, Artificial Sequence
  ELANE RNA Guide
guuggacucaaaaacucaccc

SEQ ID NO: 1415 - RNA, 21 nt, Artificial Sequence
  ELANE RNA Guide
ucaaaaacucaccccgcagca

SEQ ID NO: 1416 - RNA, 21 nt, Artificial Sequence
  ELANE RNA Guide
ucaccccgcagcagcaaggcc

SEQ ID NO: 1417 - RNA, 21 nt, Artificial Sequence
  ELANE RNA Guide
uccugccggccuugcugcugc

SEQ ID NO: 1418 - RNA, 21 nt, Artificial Sequence
  ELANE RNA Guide
ugccggccuugcugcugcggg

SEQ ID NO: 1419 - RNA, 21 nt, Artificial Sequence
  ELANE RNA Guide
ugcggggugaguuuuugaguc

SEQ ID NO: 1420 - RNA, 21 nt, Artificial Sequence
  ELANE RNA Guide
ugcugcggggugaguuuuuga

SEQ ID NO: 1421 - RNA, 21 nt, Artificial Sequence
  ELANE RNA Guide
ugcugcugcggggugaguuuu

SEQ ID NO: 1422 - RNA, 21 nt, Artificial Sequence
  ELANE RNA Guide
uggacucaaaaacucaccccg

SEQ ID NO: 1423 - RNA, 21 nt, Artificial Sequence
  ELANE RNA Guide
uguccugccggccuugcugcu

SEQ ID NO: 1424 - RNA, 21 nt, Artificial Sequence
  ELANE RNA Guide
uguguccugccggccuugcug

SEQ ID NO: 1425 - RNA, 21 nt, Artificial Sequence
  ELANE RNA Guide
uugcugcugcggggugaguuu

SEQ ID NO: 1426 - RNA, 21 nt, Artificial Sequence
  ELANE RNA Guide
uuggacucaaaaacucacccc

SEQ ID NO: 1427 - RNA, 22 nt, Artificial Sequence
  ELANE RNA Guide
aaaaacucaccccgcagcagca

SEQ ID NO: 1428 - RNA, 22 nt, Artificial Sequence
  ELANE RNA Guide
aaaacucaccccgcagcagcaa

SEQ ID NO: 1429 - RNA, 22 nt, Artificial Sequence
  ELANE RNA Guide
aaacucaccccgcagcagcaag

SEQ ID NO: 1430 - RNA, 22 nt, Artificial Sequence
  ELANE RNA Guide
aacucaccccgcagcagcaagg

SEQ ID NO: 1431 - RNA, 22 nt, Artificial Sequence
  ELANE RNA Guide
accccgcagcagcaaggccggc

SEQ ID NO: 1432 - RNA, 22 nt, Artificial Sequence
  ELANE RNA Guide
acucaaaaacucaccccgcagc

SEQ ID NO: 1433 - RNA, 22 nt, Artificial Sequence
  ELANE RNA Guide
acucaccccgcagcagcaaggc

SEQ ID NO: 1434 - RNA, 22 nt, Artificial Sequence
  ELANE RNA Guide
agguuggacucaaaaacucacc

SEQ ID NO: 1435 - RNA, 22 nt, Artificial Sequence
  ELANE RNA Guide
caaaaacucaccccgcagcagc

SEQ ID NO: 1436 - RNA, 22 nt, Artificial Sequence
  ELANE RNA Guide
caccccgcagcagcaaggccgg

SEQ ID NO: 1437 - RNA, 22 nt, Artificial Sequence
  ELANE RNA Guide
ccccgcagcagcaaggccggca

SEQ ID NO: 1438 - RNA, 22 nt, Artificial Sequence
  ELANE RNA Guide
cccgcagcagcaaggccggcag

SEQ ID NO: 1439 - RNA, 22 nt, Artificial Sequence
  ELANE RNA Guide
ccgcagcagcaaggccggcagg

SEQ ID NO: 1440 - RNA, 22 nt, Artificial Sequence
  ELANE RNA Guide
ccggccuugcugcugcggggug

SEQ ID NO: 1441 - RNA, 22 nt, Artificial Sequence
  ELANE RNA Guide
ccugccggccuugcugcugcgg

SEQ ID NO: 1442 - RNA, 22 nt, Artificial Sequence
  ELANE RNA Guide
ccuugcugcugcggggugaguu

SEQ ID NO: 1443 - RNA, 22 nt, Artificial Sequence
  ELANE RNA Guide
cgcagcagcaaggccggcagga

SEQ ID NO: 1444 - RNA, 22 nt, Artificial Sequence
  ELANE RNA Guide
cggccuugcugcugcgggguga

SEQ ID NO: 1445 - RNA, 22 nt, Artificial Sequence
  ELANE RNA Guide
cucaaaaacucaccccgcagca

SEQ ID NO: 1446 - RNA, 22 nt, Artificial Sequence
  ELANE RNA Guide
cucaccccgcagcagcaaggcc

SEQ ID NO: 1447 - RNA, 22 nt, Artificial Sequence
  ELANE RNA Guide
cugccggccuugcugcugcggg

SEQ ID NO: 1448 - RNA, 22 nt, Artificial Sequence
  ELANE RNA Guide
cugcggggugaguuuuugaguc

SEQ ID NO: 1449 - RNA, 22 nt, Artificial Sequence
  ELANE RNA Guide
cugcugcggggugaguuuuuga

SEQ ID NO: 1450 - RNA, 22 nt, Artificial Sequence
  ELANE RNA Guide
cuguguccugccggccuugcug

SEQ ID NO: 1451 - RNA, 22 nt, Artificial Sequence
  ELANE RNA Guide
cuugcugcugcggggugaguuu

SEQ ID NO: 1452 - RNA, 22 nt, Artificial Sequence
  ELANE RNA Guide
gacucaaaaacucaccccgcag

SEQ ID NO: 1453 - RNA, 22 nt, Artificial Sequence
  ELANE RNA Guide
gagguuggacucaaaaacucac

SEQ ID NO: 1454 - RNA, 22 nt, Artificial Sequence
  ELANE RNA Guide
gccggccuugcugcugcggggu

SEQ ID NO: 1455 - RNA, 22 nt, Artificial Sequence
  ELANE RNA Guide
gccuugcugcugcggggugagu

SEQ ID NO: 1456 - RNA, 22 nt, Artificial Sequence
  ELANE RNA Guide
gcggggugaguuuuugagucca

SEQ ID NO: 1457 - RNA, 22 nt, Artificial Sequence
  ELANE RNA Guide
gcugcggggugaguuuuugagu

SEQ ID NO: 1458 - RNA, 22 nt, Artificial Sequence
  ELANE RNA Guide
gcugcugcggggugaguuuuug

SEQ ID NO: 1459 - RNA, 22 nt, Artificial Sequence
  ELANE RNA Guide
ggacucaaaaacucaccccgca

SEQ ID NO: 1460 - RNA, 22 nt, Artificial Sequence
  ELANE RNA Guide
ggccuugcugcugcggggugag

SEQ ID NO: 1461 - RNA, 22 nt, Artificial Sequence
  ELANE RNA Guide
gguuggacucaaaaacucaccc

SEQ ID NO: 1462 - RNA, 22 nt, Artificial Sequence
  ELANE RNA Guide
guccugccggccuugcugcugc

SEQ ID NO: 1463 - RNA, 22 nt, Artificial Sequence
  ELANE RNA Guide
guguccugccggccuugcugcu

SEQ ID NO: 1464 - RNA, 22 nt, Artificial Sequence
  ELANE RNA Guide
guuggacucaaaaacucacccc

SEQ ID NO: 1465 - RNA, 22 nt, Artificial Sequence
  ELANE RNA Guide
ucaaaaacucaccccgcagcag

SEQ ID NO: 1466 - RNA, 22 nt, Artificial Sequence
  ELANE RNA Guide
ucaccccgcagcagcaaggccg

SEQ ID NO: 1467 - RNA, 22 nt, Artificial Sequence
  ELANE RNA Guide
uccugccggccuugcugcugcg

SEQ ID NO: 1468 - RNA, 22 nt, Artificial Sequence
  ELANE RNA Guide
ugccggccuugcugcugcgggg

SEQ ID NO: 1469 - RNA, 22 nt, Artificial Sequence
  ELANE RNA Guide
ugcggggugaguuuuugagucc

SEQ ID NO: 1470 - RNA, 22 nt, Artificial Sequence
  ELANE RNA Guide
ugcugcggggugaguuuuugag

SEQ ID NO: 1471 - RNA, 22 nt, Artificial Sequence
  ELANE RNA Guide
ugcugcugcggggugaguuuuu

SEQ ID NO: 1472 - RNA, 22 nt, Artificial Sequence
  ELANE RNA Guide
uggacucaaaaacucaccccgc

SEQ ID NO: 1473 - RNA, 22 nt, Artificial Sequence
  ELANE RNA Guide
uguccugccggccuugcugcug

SEQ ID NO: 1474 - RNA, 22 nt, Artificial Sequence
  ELANE RNA Guide
uguguccugccggccuugcugc

SEQ ID NO: 1475 - RNA, 22 nt, Artificial Sequence
  ELANE RNA Guide
uugcugcugcggggugaguuuu

SEQ ID NO: 1476 - RNA, 22 nt, Artificial Sequence
  ELANE RNA Guide
uuggacucaaaaacucaccccg

SEQ ID NO: 1477 - RNA, 20 nt, Artificial Sequence
  ELANE RNA Guide
aaaaacucacccccagcagc

SEQ ID NO: 1478 - RNA, 20 nt, Artificial Sequence
  ELANE RNA Guide
aaaacucacccccagcagca

SEQ ID NO: 1479 - RNA, 20 nt, Artificial Sequence
  ELANE RNA Guide
aaacucacccccagcagcaa

SEQ ID NO: 1480 - RNA, 20 nt, Artificial Sequence
  ELANE RNA Guide
aacucacccccagcagcaag

SEQ ID NO: 1481 - RNA, 20 nt, Artificial Sequence
  ELANE RNA Guide
acccccagcagcaaggccgg

SEQ ID NO: 1482 - RNA, 20 nt, Artificial Sequence
  ELANE RNA Guide
acucaaaaacucacccccag

SEQ ID NO: 1483 - RNA, 20 nt, Artificial Sequence
  ELANE RNA Guide
acucacccccagcagcaagg

SEQ ID NO: 1484 - RNA, 20 nt, Artificial Sequence
  ELANE RNA Guide
caaaaacucacccccagcag

SEQ ID NO: 1485 - RNA, 20 nt, Artificial Sequence
  ELANE RNA Guide
cacccccagcagcaaggccg

SEQ ID NO: 1486 - RNA, 20 nt, Artificial Sequence
  ELANE RNA Guide
ccggccuugcugcugggggu

SEQ ID NO: 1487 - RNA, 20 nt, Artificial Sequence
  ELANE RNA Guide
ccugccggccuugcugcugg

SEQ ID NO: 1488 - RNA, 20 nt, Artificial Sequence
  ELANE RNA Guide
ccuugcugcugggggugagu

SEQ ID NO: 1489 - RNA, 20 nt, Artificial Sequence
  ELANE RNA Guide
cggccuugcugcugggggug

SEQ ID NO: 1490 - RNA, 20 nt, Artificial Sequence
  ELANE RNA Guide
cucaaaaacucacccccagc

SEQ ID NO: 1491 - RNA, 20 nt, Artificial Sequence
  ELANE RNA Guide
cucacccccagcagcaaggc

SEQ ID NO: 1492 - RNA, 20 nt, Artificial Sequence
  ELANE RNA Guide
cugccggccuugcugcuggg

SEQ ID NO: 1493 - RNA, 20 nt, Artificial Sequence
  ELANE RNA Guide
cugcugggggugaguuuuug

SEQ ID NO: 1494 - RNA, 20 nt, Artificial Sequence
  ELANE RNA Guide
cugggggugaguuuuugagu

SEQ ID NO: 1495 - RNA, 20 nt, Artificial Sequence
  ELANE RNA Guide
cuugcugcugggggugaguu

SEQ ID NO: 1496 - RNA, 20 nt, Artificial Sequence
  ELANE RNA Guide
gacucaaaaacucaccccca

SEQ ID NO: 1497 - RNA, 20 nt, Artificial Sequence
  ELANE RNA Guide
gccggccuugcugcuggggg

SEQ ID NO: 1498 - RNA, 20 nt, Artificial Sequence
  ELANE RNA Guide
gccuugcugcugggggugag

SEQ ID NO: 1499 - RNA, 20 nt, Artificial Sequence
  ELANE RNA Guide
gcugcugggggugaguuuuu

SEQ ID NO: 1500 - RNA, 20 nt, Artificial Sequence
  ELANE RNA Guide
gcugggggugaguuuuugag

SEQ ID NO: 1501 - RNA, 20 nt, Artificial Sequence
  ELANE RNA Guide
ggacucaaaaacucaccccc

SEQ ID NO: 1502 - RNA, 20 nt, Artificial Sequence
  ELANE RNA Guide
ggccuugcugcuggggguga

SEQ ID NO: 1503 - RNA, 20 nt, Artificial Sequence
  ELANE RNA Guide
ucaaaaacucacccccagca

SEQ ID NO: 1504 - RNA, 20 nt, Artificial Sequence
  ELANE RNA Guide
ucacccccagcagcaaggcc

SEQ ID NO: 1505 - RNA, 20 nt, Artificial Sequence
  ELANE RNA Guide
ugccggccuugcugcugggg

SEQ ID NO: 1506 - RNA, 20 nt, Artificial Sequence
  ELANE RNA Guide
ugcugcugggggugaguuuu

SEQ ID NO: 1507 - RNA, 20 nt, Artificial Sequence
  ELANE RNA Guide
ugcugggggugaguuuuuga

SEQ ID NO: 1508 - RNA, 20 nt, Artificial Sequence
  ELANE RNA Guide
ugggggugaguuuuugaguc

SEQ ID NO: 1509 - RNA, 20 nt, Artificial Sequence
  ELANE RNA Guide
uugcugcugggggugaguuu

SEQ ID NO: 1510 - RNA, 21 nt, Artificial Sequence
  ELANE RNA Guide
aaaaacucacccccagcagca

SEQ ID NO: 1511 - RNA, 21 nt, Artificial Sequence
  ELANE RNA Guide
aaaacucacccccagcagcaa

SEQ ID NO: 1512 - RNA, 21 nt, Artificial Sequence
  ELANE RNA Guide
aaacucacccccagcagcaag

SEQ ID NO: 1513 - RNA, 21 nt, Artificial Sequence
  ELANE RNA Guide
aacucacccccagcagcaagg

SEQ ID NO: 1514 - RNA, 21 nt, Artificial Sequence
  ELANE RNA Guide
acccccagcagcaaggccggc

SEQ ID NO: 1515 - RNA, 21 nt, Artificial Sequence
  ELANE RNA Guide
acucaaaaacucacccccagc

SEQ ID NO: 1516 - RNA, 21 nt, Artificial Sequence
  ELANE RNA Guide
acucacccccagcagcaaggc

SEQ ID NO: 1517 - RNA, 21 nt, Artificial Sequence
  ELANE RNA Guide
caaaaacucacccccagcagc

SEQ ID NO: 1518 - RNA, 21 nt, Artificial Sequence
  ELANE RNA Guide
cacccccagcagcaaggccgg

SEQ ID NO: 1519 - RNA, 21 nt, Artificial Sequence
  ELANE RNA Guide
ccggccuugcugcugggggug

SEQ ID NO: 1520 - RNA, 21 nt, Artificial Sequence
  ELANE RNA Guide
ccugccggccuugcugcuggg

SEQ ID NO: 1521 - RNA, 21 nt, Artificial Sequence
  ELANE RNA Guide
ccuugcugcugggggugaguu

SEQ ID NO: 1522 - RNA, 21 nt, Artificial Sequence
  ELANE RNA Guide
cggccuugcugcuggggguga

SEQ ID NO: 1523 - RNA, 21 nt, Artificial Sequence
  ELANE RNA Guide
cucaaaaacucacccccagca

SEQ ID NO: 1524 - RNA, 21 nt, Artificial Sequence
  ELANE RNA Guide
cucacccccagcagcaaggcc

SEQ ID NO: 1525 - RNA, 21 nt, Artificial Sequence
  ELANE RNA Guide
cugccggccuugcugcugggg

SEQ ID NO: 1526 - RNA, 21 nt, Artificial Sequence
  ELANE RNA Guide
cugcugggggugaguuuuuga

SEQ ID NO: 1527 - RNA, 21 nt, Artificial Sequence
  ELANE RNA Guide
cugggggugaguuuuugaguc

SEQ ID NO: 1528 - RNA, 21 nt, Artificial Sequence
  ELANE RNA Guide
cuugcugcugggggugaguuu

SEQ ID NO: 1529 - RNA, 21 nt, Artificial Sequence
  ELANE RNA Guide
gacucaaaaacucacccccag

SEQ ID NO: 1530 - RNA, 21 nt, Artificial Sequence
  ELANE RNA Guide
gccggccuugcugcugggggu

SEQ ID NO: 1531 - RNA, 21 nt, Artificial Sequence
  ELANE RNA Guide
gccuugcugcugggggugagu

SEQ ID NO: 1532 - RNA, 21 nt, Artificial Sequence
  ELANE RNA Guide
gcugcugggggugaguuuuug

SEQ ID NO: 1533 - RNA, 21 nt, Artificial Sequence
  ELANE RNA Guide
gcugggggugaguuuuugagu

SEQ ID NO: 1534 - RNA, 21 nt, Artificial Sequence
  ELANE RNA Guide
ggacucaaaaacucaccccca

SEQ ID NO: 1535 - RNA, 21 nt, Artificial Sequence
  ELANE RNA Guide
ggccuugcugcugggggugag

SEQ ID NO: 1536 - RNA, 21 nt, Artificial Sequence
  ELANE RNA Guide
ucaaaaacucacccccagcag

SEQ ID NO: 1537 - RNA, 21 nt, Artificial Sequence
  ELANE RNA Guide
ucacccccagcagcaaggccg

SEQ ID NO: 1538 - RNA, 21 nt, Artificial Sequence
  ELANE RNA Guide
uccugccggccuugcugcugg

SEQ ID NO: 1539 - RNA, 21 nt, Artificial Sequence
  ELANE RNA Guide
ugccggccuugcugcuggggg

SEQ ID NO: 1540 - RNA, 21 nt, Artificial Sequence
  ELANE RNA Guide
ugcugcugggggugaguuuuu

SEQ ID NO: 1541 - RNA, 21 nt, Artificial Sequence
  ELANE RNA Guide
ugcugggggugaguuuuugag

SEQ ID NO: 1542 - RNA, 21 nt, Artificial Sequence
  ELANE RNA Guide
uggacucaaaaacucaccccc

SEQ ID NO: 1543 - RNA, 21 nt, Artificial Sequence
  ELANE RNA Guide
ugggggugaguuuuugagucc

SEQ ID NO: 1544 - RNA, 21 nt, Artificial Sequence
  ELANE RNA Guide
uugcugcugggggugaguuuu

SEQ ID NO: 1545 - RNA, 22 nt, Artificial Sequence
  ELANE RNA Guide
aaaaacucacccccagcagcaa

SEQ ID NO: 1546 - RNA, 22 nt, Artificial Sequence
  ELANE RNA Guide
aaaacucacccccagcagcaag

SEQ ID NO: 1547 - RNA, 22 nt, Artificial Sequence
  ELANE RNA Guide
aaacucacccccagcagcaagg

SEQ ID NO: 1548 - RNA, 22 nt, Artificial Sequence
  ELANE RNA Guide
aacucacccccagcagcaaggc

SEQ ID NO: 1549 - RNA, 22 nt, Artificial Sequence
  ELANE RNA Guide
acccccagcagcaaggccggca

SEQ ID NO: 1550 - RNA, 22 nt, Artificial Sequence
  ELANE RNA Guide
acucaaaaacucacccccagca

SEQ ID NO: 1551 - RNA, 22 nt, Artificial Sequence
  ELANE RNA Guide
acucacccccagcagcaaggcc

SEQ ID NO: 1552 - RNA, 22 nt, Artificial Sequence
  ELANE RNA Guide
caaaaacucacccccagcagca

SEQ ID NO: 1553 - RNA, 22 nt, Artificial Sequence
  ELANE RNA Guide
cacccccagcagcaaggccggc

SEQ ID NO: 1554 - RNA, 22 nt, Artificial Sequence
  ELANE RNA Guide
ccggccuugcugcuggggguga

SEQ ID NO: 1555 - RNA, 22 nt, Artificial Sequence
  ELANE RNA Guide
ccugccggccuugcugcugggg

SEQ ID NO: 1556 - RNA, 22 nt, Artificial Sequence
  ELANE RNA Guide
ccuugcugcugggggugaguuu

SEQ ID NO: 1557 - RNA, 22 nt, Artificial Sequence
  ELANE RNA Guide
cggccuugcugcugggggugag

SEQ ID NO: 1558 - RNA, 22 nt, Artificial Sequence
  ELANE RNA Guide
cucaaaaacucacccccagcag

SEQ ID NO: 1559 - RNA, 22 nt, Artificial Sequence
  ELANE RNA Guide
cucacccccagcagcaaggccg

SEQ ID NO: 1560 - RNA, 22 nt, Artificial Sequence
  ELANE RNA Guide
cugccggccuugcugcuggggg

SEQ ID NO: 1561 - RNA, 22 nt, Artificial Sequence
  ELANE RNA Guide
cugcugggggugaguuuuugag

SEQ ID NO: 1562 - RNA, 22 nt, Artificial Sequence
  ELANE RNA Guide
cugggggugaguuuuugagucc

SEQ ID NO: 1563 - RNA, 22 nt, Artificial Sequence
  ELANE RNA Guide
cuugcugcugggggugaguuuu

SEQ ID NO: 1564 - RNA, 22 nt, Artificial Sequence
  ELANE RNA Guide
gacucaaaaacucacccccagc

SEQ ID NO: 1565 - RNA, 22 nt, Artificial Sequence
  ELANE RNA Guide
gccggccuugcugcugggggug

SEQ ID NO: 1566 - RNA, 22 nt, Artificial Sequence
  ELANE RNA Guide
gccuugcugcugggggugaguu

SEQ ID NO: 1567 - RNA, 22 nt, Artificial Sequence
  ELANE RNA Guide
gcugcugggggugaguuuuuga

SEQ ID NO: 1568 - RNA, 22 nt, Artificial Sequence
  ELANE RNA Guide
gcugggggugaguuuuugaguc

SEQ ID NO: 1569 - RNA, 22 nt, Artificial Sequence
  ELANE RNA Guide
ggacucaaaaacucacccccag

SEQ ID NO: 1570 - RNA, 22 nt, Artificial Sequence
  ELANE RNA Guide
ggccuugcugcugggggugagu

SEQ ID NO: 1571 - RNA, 22 nt, Artificial Sequence
  ELANE RNA Guide
guccugccggccuugcugcugg

SEQ ID NO: 1572 - RNA, 22 nt, Artificial Sequence
  ELANE RNA Guide
ucaaaaacucacccccagcagc

SEQ ID NO: 1573 - RNA, 22 nt, Artificial Sequence
  ELANE RNA Guide
ucacccccagcagcaaggccgg

SEQ ID NO: 1574 - RNA, 22 nt, Artificial Sequence
  ELANE RNA Guide
uccugccggccuugcugcuggg

SEQ ID NO: 1575 - RNA, 22 nt, Artificial Sequence
  ELANE RNA Guide
ugccggccuugcugcugggggu

SEQ ID NO: 1576 - RNA, 22 nt, Artificial Sequence
  ELANE RNA Guide
ugcugcugggggugaguuuuug

SEQ ID NO: 1577 - RNA, 22 nt, Artificial Sequence
  ELANE RNA Guide
ugcugggggugaguuuuugagu

SEQ ID NO: 1578 - RNA, 22 nt, Artificial Sequence
  ELANE RNA Guide
uggacucaaaaacucaccccca

SEQ ID NO: 1579 - RNA, 22 nt, Artificial Sequence
  ELANE RNA Guide
ugggggugaguuuuugagucca

SEQ ID NO: 1580 - RNA, 22 nt, Artificial Sequence
  ELANE RNA Guide
uugcugcugggggugaguuuuu

SEQ ID NO: 1581 - RNA, 22 nt, Artificial Sequence
  ELANE RNA Guide
uuggacucaaaaacucaccccc

SEQ ID NO: 1582 - RNA, 20 nt, Artificial Sequence
  ELANE RNA Guide
aaaaacucaacccccagcag

SEQ ID NO: 1583 - RNA, 20 nt, Artificial Sequence
  ELANE RNA Guide
aaaacucaacccccagcagc

SEQ ID NO: 1584 - RNA, 20 nt, Artificial Sequence
  ELANE RNA Guide
aaacucaacccccagcagca

SEQ ID NO: 1585 - RNA, 20 nt, Artificial Sequence
  ELANE RNA Guide
aacccccagcagcaaggccg

SEQ ID NO: 1586 - RNA, 20 nt, Artificial Sequence
  ELANE RNA Guide
aacucaacccccagcagcaa

SEQ ID NO: 1587 - RNA, 20 nt, Artificial Sequence
  ELANE RNA Guide
acucaaaaacucaaccccca

SEQ ID NO: 1588 - RNA, 20 nt, Artificial Sequence
  ELANE RNA Guide
acucaacccccagcagcaag

SEQ ID NO: 1589 - RNA, 20 nt, Artificial Sequence
  ELANE RNA Guide
agguuggacucaaaaacuca

SEQ ID NO: 1590 - RNA, 20 nt, Artificial Sequence
  ELANE RNA Guide
caaaaacucaacccccagca

SEQ ID NO: 1591 - RNA, 20 nt, Artificial Sequence
  ELANE RNA Guide
caacccccagcagcaaggcc

SEQ ID NO: 1592 - RNA, 20 nt, Artificial Sequence
  ELANE RNA Guide
ccuugcugcuggggguugag

SEQ ID NO: 1593 - RNA, 20 nt, Artificial Sequence
  ELANE RNA Guide
cggccuugcugcuggggguu

SEQ ID NO: 1594 - RNA, 20 nt, Artificial Sequence
  ELANE RNA Guide
cucaaaaacucaacccccag

SEQ ID NO: 1595 - RNA, 20 nt, Artificial Sequence
  ELANE RNA Guide
cucaacccccagcagcaagg

SEQ ID NO: 1596 - RNA, 20 nt, Artificial Sequence
  ELANE RNA Guide
cugcuggggguugaguuuuu

SEQ ID NO: 1597 - RNA, 20 nt, Artificial Sequence
  ELANE RNA Guide
cuggggguugaguuuuugag

SEQ ID NO: 1598 - RNA, 20 nt, Artificial Sequence
  ELANE RNA Guide
cuugcugcuggggguugagu

SEQ ID NO: 1599 - RNA, 20 nt, Artificial Sequence
  ELANE RNA Guide
gacucaaaaacucaaccccc

SEQ ID NO: 1600 - RNA, 20 nt, Artificial Sequence
  ELANE RNA Guide
gagguuggacucaaaaacuc

SEQ ID NO: 1601 - RNA, 20 nt, Artificial Sequence
  ELANE RNA Guide
gccuugcugcuggggguuga

SEQ ID NO: 1602 - RNA, 20 nt, Artificial Sequence
  ELANE RNA Guide
gcugcuggggguugaguuuu

SEQ ID NO: 1603 - RNA, 20 nt, Artificial Sequence
  ELANE RNA Guide
gcuggggguugaguuuuuga

SEQ ID NO: 1604 - RNA, 20 nt, Artificial Sequence
  ELANE RNA Guide
ggacucaaaaacucaacccc

SEQ ID NO: 1605 - RNA, 20 nt, Artificial Sequence
  ELANE RNA Guide
ggagguuggacucaaaaacu

SEQ ID NO: 1606 - RNA, 20 nt, Artificial Sequence
  ELANE RNA Guide
ggccuugcugcuggggguug

SEQ ID NO: 1607 - RNA, 20 nt, Artificial Sequence
  ELANE RNA Guide
gggagguuggacucaaaaac

SEQ ID NO: 1608 - RNA, 20 nt, Artificial Sequence
  ELANE RNA Guide
ggggguugaguuuuugaguc

SEQ ID NO: 1609 - RNA, 20 nt, Artificial Sequence
  ELANE RNA Guide
gggguugaguuuuugagucc

SEQ ID NO: 1610 - RNA, 20 nt, Artificial Sequence
  ELANE RNA Guide
ggguugaguuuuugagucca

SEQ ID NO: 1611 - RNA, 20 nt, Artificial Sequence
  ELANE RNA Guide
gguugaguuuuugaguccaa

SEQ ID NO: 1612 - RNA, 20 nt, Artificial Sequence
  ELANE RNA Guide
gguuggacucaaaaacucaa

SEQ ID NO: 1613 - RNA, 20 nt, Artificial Sequence
  ELANE RNA Guide
guugaguuuuugaguccaac

SEQ ID NO: 1614 - RNA, 20 nt, Artificial Sequence
  ELANE RNA Guide
guuggacucaaaaacucaac

SEQ ID NO: 1615 - RNA, 20 nt, Artificial Sequence
  ELANE RNA Guide
ucaaaaacucaacccccagc

SEQ ID NO: 1616 - RNA, 20 nt, Artificial Sequence
  ELANE RNA Guide
ucaacccccagcagcaaggc

SEQ ID NO: 1617 - RNA, 20 nt, Artificial Sequence
  ELANE RNA Guide
ugcugcuggggguugaguuu

SEQ ID NO: 1618 - RNA, 20 nt, Artificial Sequence
  ELANE RNA Guide
ugcuggggguugaguuuuug

SEQ ID NO: 1619 - RNA, 20 nt, Artificial Sequence
  ELANE RNA Guide
uggacucaaaaacucaaccc

SEQ ID NO: 1620 - RNA, 20 nt, Artificial Sequence
  ELANE RNA Guide
uggggguugaguuuuugagu

SEQ ID NO: 1621 - RNA, 20 nt, Artificial Sequence
  ELANE RNA Guide
uugcugcuggggguugaguu

SEQ ID NO: 1622 - RNA, 20 nt, Artificial Sequence
  ELANE RNA Guide
uuggacucaaaaacucaacc

SEQ ID NO: 1623 - RNA, 21 nt, Artificial Sequence
  ELANE RNA Guide
aaaaacucaacccccagcagc

SEQ ID NO: 1624 - RNA, 21 nt, Artificial Sequence
  ELANE RNA Guide
aaaacucaacccccagcagca

SEQ ID NO: 1625 - RNA, 21 nt, Artificial Sequence
  ELANE RNA Guide
aaacucaacccccagcagcaa

SEQ ID NO: 1626 - RNA, 21 nt, Artificial Sequence
  ELANE RNA Guide
aacccccagcagcaaggccgg

SEQ ID NO: 1627 - RNA, 21 nt, Artificial Sequence
  ELANE RNA Guide
aacucaacccccagcagcaag

SEQ ID NO: 1628 - RNA, 21 nt, Artificial Sequence
  ELANE RNA Guide
acucaaaaacucaacccccag

SEQ ID NO: 1629 - RNA, 21 nt, Artificial Sequence
  ELANE RNA Guide
acucaacccccagcagcaagg

SEQ ID NO: 1630 - RNA, 21 nt, Artificial Sequence
  ELANE RNA Guide
agguuggacucaaaaacucaa

SEQ ID NO: 1631 - RNA, 21 nt, Artificial Sequence
  ELANE RNA Guide
caaaaacucaacccccagcag

SEQ ID NO: 1632 - RNA, 21 nt, Artificial Sequence
  ELANE RNA Guide
caacccccagcagcaaggccg

SEQ ID NO: 1633 - RNA, 21 nt, Artificial Sequence
  ELANE RNA Guide
ccggccuugcugcuggggguu

SEQ ID NO: 1634 - RNA, 21 nt, Artificial Sequence
  ELANE RNA Guide
ccuugcugcuggggguugagu

SEQ ID NO: 1635 - RNA, 21 nt, Artificial Sequence
  ELANE RNA Guide
cggccuugcugcuggggguug

SEQ ID NO: 1636 - RNA, 21 nt, Artificial Sequence
  ELANE RNA Guide
cgggagguuggacucaaaaac

SEQ ID NO: 1637 - RNA, 21 nt, Artificial Sequence
  ELANE RNA Guide
cucaaaaacucaacccccagc

SEQ ID NO: 1638 - RNA, 21 nt, Artificial Sequence
  ELANE RNA Guide
cucaacccccagcagcaaggc

SEQ ID NO: 1639 - RNA, 21 nt, Artificial Sequence
  ELANE RNA Guide
cugcuggggguugaguuuuug

SEQ ID NO: 1640 - RNA, 21 nt, Artificial Sequence
  ELANE RNA Guide
cuggggguugaguuuuugagu

SEQ ID NO: 1641 - RNA, 21 nt, Artificial Sequence
  ELANE RNA Guide
cuugcugcuggggguugaguu

SEQ ID NO: 1642 - RNA, 21 nt, Artificial Sequence
  ELANE RNA Guide
gacucaaaaacucaaccccca

SEQ ID NO: 1643 - RNA, 21 nt, Artificial Sequence
  ELANE RNA Guide
gagguuggacucaaaaacuca

SEQ ID NO: 1644 - RNA, 21 nt, Artificial Sequence
  ELANE RNA Guide
gccuugcugcuggggguugag

SEQ ID NO: 1645 - RNA, 21 nt, Artificial Sequence
  ELANE RNA Guide
gcugcuggggguugaguuuuu

SEQ ID NO: 1646 - RNA, 21 nt, Artificial Sequence
  ELANE RNA Guide
gcuggggguugaguuuuugag

SEQ ID NO: 1647 - RNA, 21 nt, Artificial Sequence
  ELANE RNA Guide
ggacucaaaaacucaaccccc

SEQ ID NO: 1648 - RNA, 21 nt, Artificial Sequence
  ELANE RNA Guide
ggagguuggacucaaaaacuc

SEQ ID NO: 1649 - RNA, 21 nt, Artificial Sequence
  ELANE RNA Guide
ggccuugcugcuggggguuga

SEQ ID NO: 1650 - RNA, 21 nt, Artificial Sequence
  ELANE RNA Guide
gggagguuggacucaaaaacu

SEQ ID NO: 1651 - RNA, 21 nt, Artificial Sequence
  ELANE RNA Guide
ggggguugaguuuuugagucc

SEQ ID NO: 1652 - RNA, 21 nt, Artificial Sequence
  ELANE RNA Guide
gggguugaguuuuugagucca

SEQ ID NO: 1653 - RNA, 21 nt, Artificial Sequence
  ELANE RNA Guide
ggguugaguuuuugaguccaa

SEQ ID NO: 1654 - RNA, 21 nt, Artificial Sequence
  ELANE RNA Guide
gguugaguuuuugaguccaac

SEQ ID NO: 1655 - RNA, 21 nt, Artificial Sequence
  ELANE RNA Guide
gguuggacucaaaaacucaac

SEQ ID NO: 1656 - RNA, 21 nt, Artificial Sequence
  ELANE RNA Guide
guugaguuuuugaguccaacc

SEQ ID NO: 1657 - RNA, 21 nt, Artificial Sequence
  ELANE RNA Guide
guuggacucaaaaacucaacc

SEQ ID NO: 1658 - RNA, 21 nt, Artificial Sequence
  ELANE RNA Guide
ucaaaaacucaacccccagca

SEQ ID NO: 1659 - RNA, 21 nt, Artificial Sequence
  ELANE RNA Guide
ucaacccccagcagcaaggcc

SEQ ID NO: 1660 - RNA, 21 nt, Artificial Sequence
  ELANE RNA Guide
ugcugcuggggguugaguuuu

SEQ ID NO: 1661 - RNA, 21 nt, Artificial Sequence
  ELANE RNA Guide
ugcuggggguugaguuuuuga

SEQ ID NO: 1662 - RNA, 21 nt, Artificial Sequence
  ELANE RNA Guide
uggacucaaaaacucaacccc

SEQ ID NO: 1663 - RNA, 21 nt, Artificial Sequence
  ELANE RNA Guide
uggggguugaguuuuugaguc

SEQ ID NO: 1664 - RNA, 21 nt, Artificial Sequence
  ELANE RNA Guide
uugcugcuggggguugaguuu

SEQ ID NO: 1665 - RNA, 21 nt, Artificial Sequence
  ELANE RNA Guide
uuggacucaaaaacucaaccc

SEQ ID NO: 1666 - RNA, 22 nt, Artificial Sequence
  ELANE RNA Guide
aaaaacucaacccccagcagca

SEQ ID NO: 1667 - RNA, 22 nt, Artificial Sequence
  ELANE RNA Guide
aaaacucaacccccagcagcaa

SEQ ID NO: 1668 - RNA, 22 nt, Artificial Sequence
  ELANE RNA Guide
aaacucaacccccagcagcaag

SEQ ID NO: 1669 - RNA, 22 nt, Artificial Sequence
  ELANE RNA Guide
aacccccagcagcaaggccggc

SEQ ID NO: 1670 - RNA, 22 nt, Artificial Sequence
  ELANE RNA Guide
aacucaacccccagcagcaagg

SEQ ID NO: 1671 - RNA, 22 nt, Artificial Sequence
  ELANE RNA Guide
acucaaaaacucaacccccagc

SEQ ID NO: 1672 - RNA, 22 nt, Artificial Sequence
  ELANE RNA Guide
acucaacccccagcagcaaggc

SEQ ID NO: 1673 - RNA, 22 nt, Artificial Sequence
  ELANE RNA Guide
agguuggacucaaaaacucaac

SEQ ID NO: 1674 - RNA, 22 nt, Artificial Sequence
  ELANE RNA Guide
caaaaacucaacccccagcagc

SEQ ID NO: 1675 - RNA, 22 nt, Artificial Sequence
  ELANE RNA Guide
caacccccagcagcaaggccgg

SEQ ID NO: 1676 - RNA, 22 nt, Artificial Sequence
  ELANE RNA Guide
ccggccuugcugcuggggguug

SEQ ID NO: 1677 - RNA, 22 nt, Artificial Sequence
  ELANE RNA Guide
ccuugcugcuggggguugaguu

SEQ ID NO: 1678 - RNA, 22 nt, Artificial Sequence
  ELANE RNA Guide
cggccuugcugcuggggguuga

SEQ ID NO: 1679 - RNA, 22 nt, Artificial Sequence
  ELANE RNA Guide
cgggagguuggacucaaaaacu

SEQ ID NO: 1680 - RNA, 22 nt, Artificial Sequence
  ELANE RNA Guide
cucaaaaacucaacccccagca

SEQ ID NO: 1681 - RNA, 22 nt, Artificial Sequence
  ELANE RNA Guide
cucaacccccagcagcaaggcc

SEQ ID NO: 1682 - RNA, 22 nt, Artificial Sequence
  ELANE RNA Guide
cugcuggggguugaguuuuuga

SEQ ID NO: 1683 - RNA, 22 nt, Artificial Sequence
  ELANE RNA Guide
cuggggguugaguuuuugaguc

SEQ ID NO: 1684 - RNA, 22 nt, Artificial Sequence
  ELANE RNA Guide
cuugcugcuggggguugaguuu

SEQ ID NO: 1685 - RNA, 22 nt, Artificial Sequence
  ELANE RNA Guide
gacucaaaaacucaacccccag

SEQ ID NO: 1686 - RNA, 22 nt, Artificial Sequence
  ELANE RNA Guide
gagguuggacucaaaaacucaa

SEQ ID NO: 1687 - RNA, 22 nt, Artificial Sequence
  ELANE RNA Guide
gccggccuugcugcuggggguu

SEQ ID NO: 1688 - RNA, 22 nt, Artificial Sequence
  ELANE RNA Guide
gccuugcugcuggggguugagu

SEQ ID NO: 1689 - RNA, 22 nt, Artificial Sequence
  ELANE RNA Guide
gcgggagguuggacucaaaaac

SEQ ID NO: 1690 - RNA, 22 nt, Artificial Sequence
  ELANE RNA Guide
gcugcuggggguugaguuuuug

SEQ ID NO: 1691 - RNA, 22 nt, Artificial Sequence
  ELANE RNA Guide
gcuggggguugaguuuuugagu

SEQ ID NO: 1692 - RNA, 22 nt, Artificial Sequence
  ELANE RNA Guide
ggacucaaaaacucaaccccca

SEQ ID NO: 1693 - RNA, 22 nt, Artificial Sequence
  ELANE RNA Guide
ggagguuggacucaaaaacuca

SEQ ID NO: 1694 - RNA, 22 nt, Artificial Sequence
  ELANE RNA Guide
ggccuugcugcuggggguugag

SEQ ID NO: 1695 - RNA, 22 nt, Artificial Sequence
  ELANE RNA Guide
gggagguuggacucaaaaacuc

SEQ ID NO: 1696 - RNA, 22 nt, Artificial Sequence
  ELANE RNA Guide
ggggguugaguuuuugagucca

SEQ ID NO: 1697 - RNA, 22 nt, Artificial Sequence
  ELANE RNA Guide
gggguugaguuuuugaguccaa

SEQ ID NO: 1698 - RNA, 22 nt, Artificial Sequence
  ELANE RNA Guide
ggguugaguuuuugaguccaac

SEQ ID NO: 1699 - RNA, 22 nt, Artificial Sequence
  ELANE RNA Guide
gguugaguuuuugaguccaacc

SEQ ID NO: 1700 - RNA, 22 nt, Artificial Sequence
  ELANE RNA Guide
gguuggacucaaaaacucaacc

SEQ ID NO: 1701 - RNA, 22 nt, Artificial Sequence
  ELANE RNA Guide
guugaguuuuugaguccaaccu

SEQ ID NO: 1702 - RNA, 22 nt, Artificial Sequence
  ELANE RNA Guide
guuggacucaaaaacucaaccc

SEQ ID NO: 1703 - RNA, 22 nt, Artificial Sequence
  ELANE RNA Guide
ucaaaaacucaacccccagcag

SEQ ID NO: 1704 - RNA, 22 nt, Artificial Sequence
  ELANE RNA Guide
ucaacccccagcagcaaggccg

SEQ ID NO: 1705 - RNA, 22 nt, Artificial Sequence
  ELANE RNA Guide
ugcugcuggggguugaguuuuu

SEQ ID NO: 1706 - RNA, 22 nt, Artificial Sequence
  ELANE RNA Guide
ugcuggggguugaguuuuugag

SEQ ID NO: 1707 - RNA, 22 nt, Artificial Sequence
  ELANE RNA Guide
uggacucaaaaacucaaccccc

SEQ ID NO: 1708 - RNA, 22 nt, Artificial Sequence
  ELANE RNA Guide
uggggguugaguuuuugagucc

SEQ ID NO: 1709 - RNA, 22 nt, Artificial Sequence
  ELANE RNA Guide
uugcugcuggggguugaguuuu

SEQ ID NO: 1710 - RNA, 22 nt, Artificial Sequence
  ELANE RNA Guide
uuggacucaaaaacucaacccc

SEQ ID NO: 1711 - RNA, 20 nt, Artificial Sequence
  ELANE RNA Guide
aacgggugcgggugcugagu

SEQ ID NO: 1712 - RNA, 20 nt, Artificial Sequence
  ELANE RNA Guide
acaacgggugcgggugcuga

SEQ ID NO: 1713 - RNA, 20 nt, Artificial Sequence
  ELANE RNA Guide
acacaacgggugcgggugcu

SEQ ID NO: 1714 - RNA, 20 nt, Artificial Sequence
  ELANE RNA Guide
acccgcacccguuguguccc

SEQ ID NO: 1715 - RNA, 20 nt, Artificial Sequence
  ELANE RNA Guide
acccguuguguccccaggca

SEQ ID NO: 1716 - RNA, 20 nt, Artificial Sequence
  ELANE RNA Guide
acucagcacccgcacccguu

SEQ ID NO: 1717 - RNA, 20 nt, Artificial Sequence
  ELANE RNA Guide
agcacccgcacccguugugu

SEQ ID NO: 1718 - RNA, 20 nt, Artificial Sequence
  ELANE RNA Guide
agcgcggugccuggggacac

SEQ ID NO: 1719 - RNA, 20 nt, Artificial Sequence
  ELANE RNA Guide
aggcacucagcacccgcacc

SEQ ID NO: 1720 - RNA, 20 nt, Artificial Sequence
  ELANE RNA Guide
caacgggugcgggugcugag

SEQ ID NO: 1721 - RNA, 20 nt, Artificial Sequence
  ELANE RNA Guide
cacaacgggugcgggugcug

SEQ ID NO: 1722 - RNA, 20 nt, Artificial Sequence
  ELANE RNA Guide
cacccgcacccguugugucc

SEQ ID NO: 1723 - RNA, 20 nt, Artificial Sequence
  ELANE RNA Guide
cacccguuguguccccaggc

SEQ ID NO: 1724 - RNA, 20 nt, Artificial Sequence
  ELANE RNA Guide
cacucagcacccgcacccgu

SEQ ID NO: 1725 - RNA, 20 nt, Artificial Sequence
  ELANE RNA Guide
cagcacccgcacccguugug

SEQ ID NO: 1726 - RNA, 20 nt, Artificial Sequence
  ELANE RNA Guide
cagcgcggugccuggggaca

SEQ ID NO: 1727 - RNA, 20 nt, Artificial Sequence
  ELANE RNA Guide
caggcacucagcacccgcac

SEQ ID NO: 1728 - RNA, 20 nt, Artificial Sequence
  ELANE RNA Guide
ccagcgcggugccuggggac

SEQ ID NO: 1729 - RNA, 20 nt, Artificial Sequence
  ELANE RNA Guide
cccgcacccguugugucccc

SEQ ID NO: 1730 - RNA, 20 nt, Artificial Sequence
  ELANE RNA Guide
cccguuguguccccaggcac

SEQ ID NO: 1731 - RNA, 20 nt, Artificial Sequence
  ELANE RNA Guide
ccgcacccguugugucccca

SEQ ID NO: 1732 - RNA, 20 nt, Artificial Sequence
  ELANE RNA Guide
ccguuguguccccaggcacc

SEQ ID NO: 1733 - RNA, 20 nt, Artificial Sequence
  ELANE RNA Guide
ccuggggacacaacgggugc

SEQ ID NO: 1734 - RNA, 20 nt, Artificial Sequence
  ELANE RNA Guide
cgcacccguuguguccccag

SEQ ID NO: 1735 - RNA, 20 nt, Artificial Sequence
  ELANE RNA Guide
cgcggugccuggggacacaa

SEQ ID NO: 1736 - RNA, 20 nt, Artificial Sequence
  ELANE RNA Guide
cggugccuggggacacaacg

SEQ ID NO: 1737 - RNA, 20 nt, Artificial Sequence
  ELANE RNA Guide
cguuguguccccaggcaccg

SEQ ID NO: 1738 - RNA, 20 nt, Artificial Sequence
  ELANE RNA Guide
cucagcacccgcacccguug

SEQ ID NO: 1739 - RNA, 20 nt, Artificial Sequence
  ELANE RNA Guide
cuggggacacaacgggugcg

SEQ ID NO: 1740 - RNA, 20 nt, Artificial Sequence
  ELANE RNA Guide
gacacaacgggugcgggugc

SEQ ID NO: 1741 - RNA, 20 nt, Artificial Sequence
  ELANE RNA Guide
gcacccgcacccguuguguc

SEQ ID NO: 1742 - RNA, 20 nt, Artificial Sequence
  ELANE RNA Guide
gcacccguuguguccccagg

SEQ ID NO: 1743 - RNA, 20 nt, Artificial Sequence
  ELANE RNA Guide
gcacucagcacccgcacccg

SEQ ID NO: 1744 - RNA, 20 nt, Artificial Sequence
  ELANE RNA Guide
gccuggggacacaacgggug

SEQ ID NO: 1745 - RNA, 20 nt, Artificial Sequence
  ELANE RNA Guide
gcgcggugccuggggacaca

SEQ ID NO: 1746 - RNA, 20 nt, Artificial Sequence
  ELANE RNA Guide
gcggugccuggggacacaac

SEQ ID NO: 1747 - RNA, 20 nt, Artificial Sequence
  ELANE RNA Guide
ggacacaacgggugcgggug

SEQ ID NO: 1748 - RNA, 20 nt, Artificial Sequence
  ELANE RNA Guide
ggcacucagcacccgcaccc

SEQ ID NO: 1749 - RNA, 20 nt, Artificial Sequence
  ELANE RNA Guide
gggacacaacgggugcgggu

SEQ ID NO: 1750 - RNA, 20 nt, Artificial Sequence
  ELANE RNA Guide
ggggacacaacgggugcggg

SEQ ID NO: 1751 - RNA, 20 nt, Artificial Sequence
  ELANE RNA Guide
ggugccuggggacacaacgg

SEQ ID NO: 1752 - RNA, 20 nt, Artificial Sequence
  ELANE RNA Guide
gugccuggggacacaacggg

SEQ ID NO: 1753 - RNA, 20 nt, Artificial Sequence
  ELANE RNA Guide
guuguguccccaggcaccgc

SEQ ID NO: 1754 - RNA, 20 nt, Artificial Sequence
  ELANE RNA Guide
ucagcacccgcacccguugu

SEQ ID NO: 1755 - RNA, 20 nt, Artificial Sequence
  ELANE RNA Guide
ugccuggggacacaacgggu

SEQ ID NO: 1756 - RNA, 20 nt, Artificial Sequence
  ELANE RNA Guide
uggggacacaacgggugcgg

SEQ ID NO: 1757 - RNA, 21 nt, Artificial Sequence
  ELANE RNA Guide
aacgggugcgggugcugagug

SEQ ID NO: 1758 - RNA, 21 nt, Artificial Sequence
  ELANE RNA Guide
acaacgggugcgggugcugag

SEQ ID NO: 1759 - RNA, 21 nt, Artificial Sequence
  ELANE RNA Guide
acacaacgggugcgggugcug

SEQ ID NO: 1760 - RNA, 21 nt, Artificial Sequence
  ELANE RNA Guide
acccgcacccguugugucccc

SEQ ID NO: 1761 - RNA, 21 nt, Artificial Sequence
  ELANE RNA Guide
acccguuguguccccaggcac

SEQ ID NO: 1762 - RNA, 21 nt, Artificial Sequence
  ELANE RNA Guide
acucagcacccgcacccguug

SEQ ID NO: 1763 - RNA, 21 nt, Artificial Sequence
  ELANE RNA Guide
agcacccgcacccguuguguc

SEQ ID NO: 1764 - RNA, 21 nt, Artificial Sequence
  ELANE RNA Guide
agcgcggugccuggggacaca

SEQ ID NO: 1765 - RNA, 21 nt, Artificial Sequence
  ELANE RNA Guide
aggcacucagcacccgcaccc

SEQ ID NO: 1766 - RNA, 21 nt, Artificial Sequence
  ELANE RNA Guide
caacgggugcgggugcugagu

SEQ ID NO: 1767 - RNA, 21 nt, Artificial Sequence
  ELANE RNA Guide
cacaacgggugcgggugcuga

SEQ ID NO: 1768 - RNA, 21 nt, Artificial Sequence
  ELANE RNA Guide
cacccgcacccguuguguccc

SEQ ID NO: 1769 - RNA, 21 nt, Artificial Sequence
  ELANE RNA Guide
cacccguuguguccccaggca

SEQ ID NO: 1770 - RNA, 21 nt, Artificial Sequence
  ELANE RNA Guide
cacucagcacccgcacccguu

SEQ ID NO: 1771 - RNA, 21 nt, Artificial Sequence
  ELANE RNA Guide
cagcacccgcacccguugugu

SEQ ID NO: 1772 - RNA, 21 nt, Artificial Sequence
  ELANE RNA Guide
cagcgcggugccuggggacac

SEQ ID NO: 1773 - RNA, 21 nt, Artificial Sequence
  ELANE RNA Guide
caggcacucagcacccgcacc

SEQ ID NO: 1774 - RNA, 21 nt, Artificial Sequence
  ELANE RNA Guide
ccagcgcggugccuggggaca

SEQ ID NO: 1775 - RNA, 21 nt, Artificial Sequence
  ELANE RNA Guide
cccgcacccguugugucccca

SEQ ID NO: 1776 - RNA, 21 nt, Artificial Sequence
  ELANE RNA Guide
cccguuguguccccaggcacc

SEQ ID NO: 1777 - RNA, 21 nt, Artificial Sequence
  ELANE RNA Guide
ccgcacccguuguguccccag

SEQ ID NO: 1778 - RNA, 21 nt, Artificial Sequence
  ELANE RNA Guide
ccguuguguccccaggcaccg

SEQ ID NO: 1779 - RNA, 21 nt, Artificial Sequence
  ELANE RNA Guide
ccuggggacacaacgggugcg

SEQ ID NO: 1780 - RNA, 21 nt, Artificial Sequence
  ELANE RNA Guide
cgcacccguuguguccccagg

SEQ ID NO: 1781 - RNA, 21 nt, Artificial Sequence
  ELANE RNA Guide
cgcggugccuggggacacaac

SEQ ID NO: 1782 - RNA, 21 nt, Artificial Sequence
  ELANE RNA Guide
cggugccuggggacacaacgg

SEQ ID NO: 1783 - RNA, 21 nt, Artificial Sequence
  ELANE RNA Guide
cguuguguccccaggcaccgc

SEQ ID NO: 1784 - RNA, 21 nt, Artificial Sequence
  ELANE RNA Guide
cucagcacccgcacccguugu

SEQ ID NO: 1785 - RNA, 21 nt, Artificial Sequence
  ELANE RNA Guide
cuggggacacaacgggugcgg

SEQ ID NO: 1786 - RNA, 21 nt, Artificial Sequence
  ELANE RNA Guide
gacacaacgggugcgggugcu

SEQ ID NO: 1787 - RNA, 21 nt, Artificial Sequence
  ELANE RNA Guide
gcacccgcacccguugugucc

SEQ ID NO: 1788 - RNA, 21 nt, Artificial Sequence
  ELANE RNA Guide
gcacccguuguguccccaggc

SEQ ID NO: 1789 - RNA, 21 nt, Artificial Sequence
  ELANE RNA Guide
gcacucagcacccgcacccgu

SEQ ID NO: 1790 - RNA, 21 nt, Artificial Sequence
  ELANE RNA Guide
gcaggcacucagcacccgcac

SEQ ID NO: 1791 - RNA, 21 nt, Artificial Sequence
  ELANE RNA Guide
gccuggggacacaacgggugc

SEQ ID NO: 1792 - RNA, 21 nt, Artificial Sequence
  ELANE RNA Guide
gcgcggugccuggggacacaa

SEQ ID NO: 1793 - RNA, 21 nt, Artificial Sequence
  ELANE RNA Guide
gcggugccuggggacacaacg

SEQ ID NO: 1794 - RNA, 21 nt, Artificial Sequence
  ELANE RNA Guide
ggacacaacgggugcgggugc

SEQ ID NO: 1795 - RNA, 21 nt, Artificial Sequence
  ELANE RNA Guide
ggcacucagcacccgcacccg

SEQ ID NO: 1796 - RNA, 21 nt, Artificial Sequence
  ELANE RNA Guide
gggacacaacgggugcgggug

SEQ ID NO: 1797 - RNA, 21 nt, Artificial Sequence
  ELANE RNA Guide
ggggacacaacgggugcgggu

SEQ ID NO: 1798 - RNA, 21 nt, Artificial Sequence
  ELANE RNA Guide
ggugccuggggacacaacggg

SEQ ID NO: 1799 - RNA, 21 nt, Artificial Sequence
  ELANE RNA Guide
gugccuggggacacaacgggu

SEQ ID NO: 1800 - RNA, 21 nt, Artificial Sequence
  ELANE RNA Guide
guuguguccccaggcaccgcg

SEQ ID NO: 1801 - RNA, 21 nt, Artificial Sequence
  ELANE RNA Guide
ucagcacccgcacccguugug

SEQ ID NO: 1802 - RNA, 21 nt, Artificial Sequence
  ELANE RNA Guide
ugccuggggacacaacgggug

SEQ ID NO: 1803 - RNA, 21 nt, Artificial Sequence
  ELANE RNA Guide
uggggacacaacgggugcggg

SEQ ID NO: 1804 - RNA, 22 nt, Artificial Sequence
  ELANE RNA Guide
aacgggugcgggugcugagugc

SEQ ID NO: 1805 - RNA, 22 nt, Artificial Sequence
  ELANE RNA Guide
acaacgggugcgggugcugagu

SEQ ID NO: 1806 - RNA, 22 nt, Artificial Sequence
  ELANE RNA Guide
acacaacgggugcgggugcuga

SEQ ID NO: 1807 - RNA, 22 nt, Artificial Sequence
  ELANE RNA Guide
acccgcacccguugugucccca

SEQ ID NO: 1808 - RNA, 22 nt, Artificial Sequence
  ELANE RNA Guide
acccguuguguccccaggcacc

SEQ ID NO: 1809 - RNA, 22 nt, Artificial Sequence
  ELANE RNA Guide
acucagcacccgcacccguugu

SEQ ID NO: 1810 - RNA, 22 nt, Artificial Sequence
  ELANE RNA Guide
agcacccgcacccguugugucc

SEQ ID NO: 1811 - RNA, 22 nt, Artificial Sequence
  ELANE RNA Guide
agcgcggugccuggggacacaa

SEQ ID NO: 1812 - RNA, 22 nt, Artificial Sequence
  ELANE RNA Guide
aggcacucagcacccgcacccg

SEQ ID NO: 1813 - RNA, 22 nt, Artificial Sequence
  ELANE RNA Guide
caacgggugcgggugcugagug

SEQ ID NO: 1814 - RNA, 22 nt, Artificial Sequence
  ELANE RNA Guide
cacaacgggugcgggugcugag

SEQ ID NO: 1815 - RNA, 22 nt, Artificial Sequence
  ELANE RNA Guide
cacccgcacccguugugucccc

SEQ ID NO: 1816 - RNA, 22 nt, Artificial Sequence
  ELANE RNA Guide
cacccguuguguccccaggcac

SEQ ID NO: 1817 - RNA, 22 nt, Artificial Sequence
  ELANE RNA Guide
cacucagcacccgcacccguug

SEQ ID NO: 1818 - RNA, 22 nt, Artificial Sequence
  ELANE RNA Guide
cagcacccgcacccguuguguc

SEQ ID NO: 1819 - RNA, 22 nt, Artificial Sequence
  ELANE RNA Guide
cagcgcggugccuggggacaca

SEQ ID NO: 1820 - RNA, 22 nt, Artificial Sequence
  ELANE RNA Guide
caggcacucagcacccgcaccc

SEQ ID NO: 1821 - RNA, 22 nt, Artificial Sequence
  ELANE RNA Guide
ccagcgcggugccuggggacac

SEQ ID NO: 1822 - RNA, 22 nt, Artificial Sequence
  ELANE RNA Guide
cccgcacccguuguguccccag

SEQ ID NO: 1823 - RNA, 22 nt, Artificial Sequence
  ELANE RNA Guide
cccguuguguccccaggcaccg

SEQ ID NO: 1824 - RNA, 22 nt, Artificial Sequence
  ELANE RNA Guide
ccgcacccguuguguccccagg

SEQ ID NO: 1825 - RNA, 22 nt, Artificial Sequence
  ELANE RNA Guide
ccguuguguccccaggcaccgc

SEQ ID NO: 1826 - RNA, 22 nt, Artificial Sequence
  ELANE RNA Guide
ccuggggacacaacgggugcgg

SEQ ID NO: 1827 - RNA, 22 nt, Artificial Sequence
  ELANE RNA Guide
cgcacccguuguguccccaggc

SEQ ID NO: 1828 - RNA, 22 nt, Artificial Sequence
  ELANE RNA Guide
cgcggugccuggggacacaacg

SEQ ID NO: 1829 - RNA, 22 nt, Artificial Sequence
  ELANE RNA Guide
cggugccuggggacacaacggg

SEQ ID NO: 1830 - RNA, 22 nt, Artificial Sequence
  ELANE RNA Guide
cguuguguccccaggcaccgcg

SEQ ID NO: 1831 - RNA, 22 nt, Artificial Sequence
  ELANE RNA Guide
cucagcacccgcacccguugug

SEQ ID NO: 1832 - RNA, 22 nt, Artificial Sequence
  ELANE RNA Guide
cuggggacacaacgggugcggg

SEQ ID NO: 1833 - RNA, 22 nt, Artificial Sequence
  ELANE RNA Guide
gacacaacgggugcgggugcug

SEQ ID NO: 1834 - RNA, 22 nt, Artificial Sequence
  ELANE RNA Guide
gcacccgcacccguuguguccc

SEQ ID NO: 1835 - RNA, 22 nt, Artificial Sequence
  ELANE RNA Guide
gcacccguuguguccccaggca

SEQ ID NO: 1836 - RNA, 22 nt, Artificial Sequence
  ELANE RNA Guide
gcacucagcacccgcacccguu

SEQ ID NO: 1837 - RNA, 22 nt, Artificial Sequence
  ELANE RNA Guide
gcaggcacucagcacccgcacc

SEQ ID NO: 1838 - RNA, 22 nt, Artificial Sequence
  ELANE RNA Guide
gccagcgcggugccuggggaca

SEQ ID NO: 1839 - RNA, 22 nt, Artificial Sequence
  ELANE RNA Guide
gccuggggacacaacgggugcg

SEQ ID NO: 1840 - RNA, 22 nt, Artificial Sequence
  ELANE RNA Guide
gcgcggugccuggggacacaac

SEQ ID NO: 1841 - RNA, 22 nt, Artificial Sequence
  ELANE RNA Guide
gcggugccuggggacacaacgg

SEQ ID NO: 1842 - RNA, 22 nt, Artificial Sequence
  ELANE RNA Guide
ggacacaacgggugcgggugcu

SEQ ID NO: 1843 - RNA, 22 nt, Artificial Sequence
  ELANE RNA Guide
ggcacucagcacccgcacccgu

SEQ ID NO: 1844 - RNA, 22 nt, Artificial Sequence
  ELANE RNA Guide
ggcaggcacucagcacccgcac

SEQ ID NO: 1845 - RNA, 22 nt, Artificial Sequence
  ELANE RNA Guide
gggacacaacgggugcgggugc

SEQ ID NO: 1846 - RNA, 22 nt, Artificial Sequence
  ELANE RNA Guide
ggggacacaacgggugcgggug

SEQ ID NO: 1847 - RNA, 22 nt, Artificial Sequence
  ELANE RNA Guide
ggugccuggggacacaacgggu

SEQ ID NO: 1848 - RNA, 22 nt, Artificial Sequence
  ELANE RNA Guide
gugccuggggacacaacgggug

SEQ ID NO: 1849 - RNA, 22 nt, Artificial Sequence
  ELANE RNA Guide
guuguguccccaggcaccgcgc

SEQ ID NO: 1850 - RNA, 22 nt, Artificial Sequence
  ELANE RNA Guide
ucagcacccgcacccguugugu

SEQ ID NO: 1851 - RNA, 22 nt, Artificial Sequence
  ELANE RNA Guide
ugccuggggacacaacgggugc

SEQ ID NO: 1852 - RNA, 22 nt, Artificial Sequence
  ELANE RNA Guide
uggggacacaacgggugcgggu

SEQ ID NO: 1853 - RNA, 20 nt, Artificial Sequence
  ELANE RNA Guide
aaucuccgaggccagcgcgg

SEQ ID NO: 1854 - RNA, 20 nt, Artificial Sequence
  ELANE RNA Guide
acaaucuccgaggccagcgc

SEQ ID NO: 1855 - RNA, 20 nt, Artificial Sequence
  ELANE RNA Guide
acccgguguguccccaggcc

SEQ ID NO: 1856 - RNA, 20 nt, Artificial Sequence
  ELANE RNA Guide
agcgcggggccuggggacac

SEQ ID NO: 1857 - RNA, 20 nt, Artificial Sequence
  ELANE RNA Guide
aucuccgaggccagcgcggg

SEQ ID NO: 1858 - RNA, 20 nt, Artificial Sequence
  ELANE RNA Guide
caaucuccgaggccagcgcg

SEQ ID NO: 1859 - RNA, 20 nt, Artificial Sequence
  ELANE RNA Guide
cacaaucuccgaggccagcg

SEQ ID NO: 1860 - RNA, 20 nt, Artificial Sequence
  ELANE RNA Guide
cacccgguguguccccaggc

SEQ ID NO: 1861 - RNA, 20 nt, Artificial Sequence
  ELANE RNA Guide
cagcgcggggccuggggaca

SEQ ID NO: 1862 - RNA, 20 nt, Artificial Sequence
  ELANE RNA Guide
ccccgcgcuggccucggaga

SEQ ID NO: 1863 - RNA, 20 nt, Artificial Sequence
  ELANE RNA Guide
cccgguguguccccaggccc

SEQ ID NO: 1864 - RNA, 20 nt, Artificial Sequence
  ELANE RNA Guide
ccgcacccggugugucccca

SEQ ID NO: 1865 - RNA, 20 nt, Artificial Sequence
  ELANE RNA Guide
ccgguguguccccaggcccc

SEQ ID NO: 1866 - RNA, 20 nt, Artificial Sequence
  ELANE RNA Guide
cgcacccgguguguccccag

SEQ ID NO: 1867 - RNA, 20 nt, Artificial Sequence
  ELANE RNA Guide
cgcggggccuggggacacac

SEQ ID NO: 1868 - RNA, 20 nt, Artificial Sequence
  ELANE RNA Guide
cggggccuggggacacaccg

SEQ ID NO: 1869 - RNA, 20 nt, Artificial Sequence
  ELANE RNA Guide
cgguguguccccaggccccg

SEQ ID NO: 1870 - RNA, 20 nt, Artificial Sequence
  ELANE RNA Guide
gcacccgguguguccccagg

SEQ ID NO: 1871 - RNA, 20 nt, Artificial Sequence
  ELANE RNA Guide
gcgcggggccuggggacaca

SEQ ID NO: 1872 - RNA, 20 nt, Artificial Sequence
  ELANE RNA Guide
gcggggccuggggacacacc

SEQ ID NO: 1873 - RNA, 20 nt, Artificial Sequence
  ELANE RNA Guide
gggccuggggacacaccggg

SEQ ID NO: 1874 - RNA, 20 nt, Artificial Sequence
  ELANE RNA Guide
ggggccuggggacacaccgg

SEQ ID NO: 1875 - RNA, 20 nt, Artificial Sequence
  ELANE RNA Guide
gguguguccccaggccccgc

SEQ ID NO: 1876 - RNA, 20 nt, Artificial Sequence
  ELANE RNA Guide
guguccccaggccccgcgcu

SEQ ID NO: 1877 - RNA, 20 nt, Artificial Sequence
  ELANE RNA Guide
guguguccccaggccccgcg

SEQ ID NO: 1878 - RNA, 20 nt, Artificial Sequence
  ELANE RNA Guide
ucuccgaggccagcgcgggg

SEQ ID NO: 1879 - RNA, 20 nt, Artificial Sequence
  ELANE RNA Guide
uguccccaggccccgcgcug

SEQ ID NO: 1880 - RNA, 20 nt, Artificial Sequence
  ELANE RNA Guide
uguguccccaggccccgcgc

SEQ ID NO: 1881 - RNA, 21 nt, Artificial Sequence
  ELANE RNA Guide
aaucuccgaggccagcgcggg

SEQ ID NO: 1882 - RNA, 21 nt, Artificial Sequence
  ELANE RNA Guide
acaaucuccgaggccagcgcg

SEQ ID NO: 1883 - RNA, 21 nt, Artificial Sequence
  ELANE RNA Guide
acccgguguguccccaggccc

SEQ ID NO: 1884 - RNA, 21 nt, Artificial Sequence
  ELANE RNA Guide
agcgcggggccuggggacaca

SEQ ID NO: 1885 - RNA, 21 nt, Artificial Sequence
  ELANE RNA Guide
aucuccgaggccagcgcgggg

SEQ ID NO: 1886 - RNA, 21 nt, Artificial Sequence
  ELANE RNA Guide
caaucuccgaggccagcgcgg

SEQ ID NO: 1887 - RNA, 21 nt, Artificial Sequence
  ELANE RNA Guide
cacaaucuccgaggccagcgc

SEQ ID NO: 1888 - RNA, 21 nt, Artificial Sequence
  ELANE RNA Guide
cacccgguguguccccaggcc

SEQ ID NO: 1889 - RNA, 21 nt, Artificial Sequence
  ELANE RNA Guide
ccacaaucuccgaggccagcg

SEQ ID NO: 1890 - RNA, 21 nt, Artificial Sequence
  ELANE RNA Guide
ccccgcgcuggccucggagau

SEQ ID NO: 1891 - RNA, 21 nt, Artificial Sequence
  ELANE RNA Guide
cccgcacccggugugucccca

SEQ ID NO: 1892 - RNA, 21 nt, Artificial Sequence
  ELANE RNA Guide
ccgcacccgguguguccccag

SEQ ID NO: 1893 - RNA, 21 nt, Artificial Sequence
  ELANE RNA Guide
cgcacccgguguguccccagg

SEQ ID NO: 1894 - RNA, 21 nt, Artificial Sequence
  ELANE RNA Guide
gcacccgguguguccccaggc

SEQ ID NO: 1895 - RNA, 21 nt, Artificial Sequence
  ELANE RNA Guide
gggccuggggacacaccgggu

SEQ ID NO: 1896 - RNA, 21 nt, Artificial Sequence
  ELANE RNA Guide
uguguccccaggccccgcgcu

SEQ ID NO: 1897 - RNA, 22 nt, Artificial Sequence
  ELANE RNA Guide
aaucuccgaggccagcgcgggg

SEQ ID NO: 1898 - RNA, 22 nt, Artificial Sequence
  ELANE RNA Guide
acaaucuccgaggccagcgcgg

SEQ ID NO: 1899 - RNA, 22 nt, Artificial Sequence
  ELANE RNA Guide
acccgcacccggugugucccca

SEQ ID NO: 1900 - RNA, 22 nt, Artificial Sequence
  ELANE RNA Guide
acccgguguguccccaggcccc

SEQ ID NO: 1901 - RNA, 22 nt, Artificial Sequence
  ELANE RNA Guide
agcgcggggccuggggacacac

SEQ ID NO: 1902 - RNA, 22 nt, Artificial Sequence
  ELANE RNA Guide
aucuccgaggccagcgcggggc

SEQ ID NO: 1903 - RNA, 22 nt, Artificial Sequence
  ELANE RNA Guide
caaucuccgaggccagcgcggg

SEQ ID NO: 1904 - RNA, 22 nt, Artificial Sequence
  ELANE RNA Guide
cacaaucuccgaggccagcgcg

SEQ ID NO: 1905 - RNA, 22 nt, Artificial Sequence
  ELANE RNA Guide
cacccgguguguccccaggccc

SEQ ID NO: 1906 - RNA, 22 nt, Artificial Sequence
  ELANE RNA Guide
cagcgcggggccuggggacaca

SEQ ID NO: 1907 - RNA, 22 nt, Artificial Sequence
  ELANE RNA Guide
ccacaaucuccgaggccagcgc

SEQ ID NO: 1908 - RNA, 22 nt, Artificial Sequence
  ELANE RNA Guide
cccacaaucuccgaggccagcg

SEQ ID NO: 1909 - RNA, 22 nt, Artificial Sequence
  ELANE RNA Guide
ccccgcgcuggccucggagauu

SEQ ID NO: 1910 - RNA, 22 nt, Artificial Sequence
  ELANE RNA Guide
cccgcacccgguguguccccag

SEQ ID NO: 1911 - RNA, 22 nt, Artificial Sequence
  ELANE RNA Guide
ccgcacccgguguguccccagg

SEQ ID NO: 1912 - RNA, 22 nt, Artificial Sequence
  ELANE RNA Guide
cgcacccgguguguccccaggc

SEQ ID NO: 1913 - RNA, 22 nt, Artificial Sequence
  ELANE RNA Guide
gcacccgguguguccccaggcc

SEQ ID NO: 1914 - RNA, 22 nt, Artificial Sequence
  ELANE RNA Guide
gccccgcgcuggccucggagau

SEQ ID NO: 1915 - RNA, 22 nt, Artificial Sequence
  ELANE RNA Guide
gggccuggggacacaccgggug

SEQ ID NO: 1916 - RNA, 22 nt, Artificial Sequence
  ELANE RNA Guide
ggggccuggggacacaccgggu

SEQ ID NO: 1917 - RNA, 22 nt, Artificial Sequence
  ELANE RNA Guide
guguguccccaggccccgcgcu

SEQ ID NO: 1918 - RNA, 22 nt, Artificial Sequence
  ELANE RNA Guide
uguguccccaggccccgcgcug

SEQ ID NO: 1919 - RNA, 20 nt, Artificial Sequence
  ELANE RNA Guide
aaucuccgaggccagcacgg

SEQ ID NO: 1920 - RNA, 20 nt, Artificial Sequence
  ELANE RNA Guide
acaaucuccgaggccagcac

SEQ ID NO: 1921 - RNA, 20 nt, Artificial Sequence
  ELANE RNA Guide
acccgguguguccccaggca

SEQ ID NO: 1922 - RNA, 20 nt, Artificial Sequence
  ELANE RNA Guide
accgugcuggccucggagau

SEQ ID NO: 1923 - RNA, 20 nt, Artificial Sequence
  ELANE RNA Guide
agcacggugccuggggacac

SEQ ID NO: 1924 - RNA, 20 nt, Artificial Sequence
  ELANE RNA Guide
aggcaccgugcuggccucgg

SEQ ID NO: 1925 - RNA, 20 nt, Artificial Sequence
  ELANE RNA Guide
aggccagcacggugccuggg

SEQ ID NO: 1926 - RNA, 20 nt, Artificial Sequence
  ELANE RNA Guide
aucuccgaggccagcacggu

SEQ ID NO: 1927 - RNA, 20 nt, Artificial Sequence
  ELANE RNA Guide
caaucuccgaggccagcacg

SEQ ID NO: 1928 - RNA, 20 nt, Artificial Sequence
  ELANE RNA Guide
cacaaucuccgaggccagca

SEQ ID NO: 1929 - RNA, 20 nt, Artificial Sequence
  ELANE RNA Guide
caccgugcuggccucggaga

SEQ ID NO: 1930 - RNA, 20 nt, Artificial Sequence
  ELANE RNA Guide
cacggugccuggggacacac

SEQ ID NO: 1931 - RNA, 20 nt, Artificial Sequence
  ELANE RNA Guide
cagcacggugccuggggaca

SEQ ID NO: 1932 - RNA, 20 nt, Artificial Sequence
  ELANE RNA Guide
caggcaccgugcuggccucg

SEQ ID NO: 1933 - RNA, 20 nt, Artificial Sequence
  ELANE RNA Guide
ccacaaucuccgaggccagc

SEQ ID NO: 1934 - RNA, 20 nt, Artificial Sequence
  ELANE RNA Guide
ccagcacggugccuggggac

SEQ ID NO: 1935 - RNA, 20 nt, Artificial Sequence
  ELANE RNA Guide
ccaggcaccgugcuggccuc

SEQ ID NO: 1936 - RNA, 20 nt, Artificial Sequence
  ELANE RNA Guide
cccacaaucuccgaggccag

SEQ ID NO: 1937 - RNA, 20 nt, Artificial Sequence
  ELANE RNA Guide
cccaggcaccgugcuggccu

SEQ ID NO: 1938 - RNA, 20 nt, Artificial Sequence
  ELANE RNA Guide
ccccacaaucuccgaggcca

SEQ ID NO: 1939 - RNA, 20 nt, Artificial Sequence
  ELANE RNA Guide
ccccaggcaccgugcuggcc

SEQ ID NO: 1940 - RNA, 20 nt, Artificial Sequence
  ELANE RNA Guide
cccccacaaucuccgaggcc

SEQ ID NO: 1941 - RNA, 20 nt, Artificial Sequence
  ELANE RNA Guide
cccgguguguccccaggcac

SEQ ID NO: 1942 - RNA, 20 nt, Artificial Sequence
  ELANE RNA Guide
ccgaggccagcacggugccu

SEQ ID NO: 1943 - RNA, 20 nt, Artificial Sequence
  ELANE RNA Guide
ccgguguguccccaggcacc

SEQ ID NO: 1944 - RNA, 20 nt, Artificial Sequence
  ELANE RNA Guide
ccgugcuggccucggagauu

SEQ ID NO: 1945 - RNA, 20 nt, Artificial Sequence
  ELANE RNA Guide
cgaggccagcacggugccug

SEQ ID NO: 1946 - RNA, 20 nt, Artificial Sequence
  ELANE RNA Guide
cgguguguccccaggcaccg

SEQ ID NO: 1947 - RNA, 20 nt, Artificial Sequence
  ELANE RNA Guide
cgugcuggccucggagauug

SEQ ID NO: 1948 - RNA, 20 nt, Artificial Sequence
  ELANE RNA Guide
cuccgaggccagcacggugc

SEQ ID NO: 1949 - RNA, 20 nt, Artificial Sequence
  ELANE RNA Guide
gaggccagcacggugccugg

SEQ ID NO: 1950 - RNA, 20 nt, Artificial Sequence
  ELANE RNA Guide
gcaccgugcuggccucggag

SEQ ID NO: 1951 - RNA, 20 nt, Artificial Sequence
  ELANE RNA Guide
gcacggugccuggggacaca

SEQ ID NO: 1952 - RNA, 20 nt, Artificial Sequence
  ELANE RNA Guide
gccagcacggugccugggga

SEQ ID NO: 1953 - RNA, 20 nt, Artificial Sequence
  ELANE RNA Guide
ggcaccgugcuggccucgga

SEQ ID NO: 1954 - RNA, 20 nt, Artificial Sequence
  ELANE RNA Guide
ggccagcacggugccugggg

SEQ ID NO: 1955 - RNA, 20 nt, Artificial Sequence
  ELANE RNA Guide
gguguguccccaggcaccgu

SEQ ID NO: 1956 - RNA, 20 nt, Artificial Sequence
  ELANE RNA Guide
guccccaggcaccgugcugg

SEQ ID NO: 1957 - RNA, 20 nt, Artificial Sequence
  ELANE RNA Guide
gugcuggccucggagauugu

SEQ ID NO: 1958 - RNA, 20 nt, Artificial Sequence
  ELANE RNA Guide
guguccccaggcaccgugcu

SEQ ID NO: 1959 - RNA, 20 nt, Artificial Sequence
  ELANE RNA Guide
guguguccccaggcaccgug

SEQ ID NO: 1960 - RNA, 20 nt, Artificial Sequence
  ELANE RNA Guide
uccccaggcaccgugcuggc

SEQ ID NO: 1961 - RNA, 20 nt, Artificial Sequence
  ELANE RNA Guide
uccgaggccagcacggugcc

SEQ ID NO: 1962 - RNA, 20 nt, Artificial Sequence
  ELANE RNA Guide
ucuccgaggccagcacggug

SEQ ID NO: 1963 - RNA, 20 nt, Artificial Sequence
  ELANE RNA Guide
uguccccaggcaccgugcug

SEQ ID NO: 1964 - RNA, 20 nt, Artificial Sequence
  ELANE RNA Guide
uguguccccaggcaccgugc

SEQ ID NO: 1965 - RNA, 21 nt, Artificial Sequence
  ELANE RNA Guide
aaucuccgaggccagcacggu

SEQ ID NO: 1966 - RNA, 21 nt, Artificial Sequence
  ELANE RNA Guide
acaaucuccgaggccagcacg

SEQ ID NO: 1967 - RNA, 21 nt, Artificial Sequence
  ELANE RNA Guide
acccgguguguccccaggcac

SEQ ID NO: 1968 - RNA, 21 nt, Artificial Sequence
  ELANE RNA Guide
accgugcuggccucggagauu

SEQ ID NO: 1969 - RNA, 21 nt, Artificial Sequence
  ELANE RNA Guide
agcacggugccuggggacaca

SEQ ID NO: 1970 - RNA, 21 nt, Artificial Sequence
  ELANE RNA Guide
aggcaccgugcuggccucgga

SEQ ID NO: 1971 - RNA, 21 nt, Artificial Sequence
  ELANE RNA Guide
aggccagcacggugccugggg

SEQ ID NO: 1972 - RNA, 21 nt, Artificial Sequence
  ELANE RNA Guide
aucuccgaggccagcacggug

SEQ ID NO: 1973 - RNA, 21 nt, Artificial Sequence
  ELANE RNA Guide
caaucuccgaggccagcacgg

SEQ ID NO: 1974 - RNA, 21 nt, Artificial Sequence
  ELANE RNA Guide
cacaaucuccgaggccagcac

SEQ ID NO: 1975 - RNA, 21 nt, Artificial Sequence
  ELANE RNA Guide
cacccgguguguccccaggca

SEQ ID NO: 1976 - RNA, 21 nt, Artificial Sequence
  ELANE RNA Guide
caccgugcuggccucggagau

SEQ ID NO: 1977 - RNA, 21 nt, Artificial Sequence
  ELANE RNA Guide
cacggugccuggggacacacc

SEQ ID NO: 1978 - RNA, 21 nt, Artificial Sequence
  ELANE RNA Guide
cagcacggugccuggggacac

SEQ ID NO: 1979 - RNA, 21 nt, Artificial Sequence
  ELANE RNA Guide
caggcaccgugcuggccucgg

SEQ ID NO: 1980 - RNA, 21 nt, Artificial Sequence
  ELANE RNA Guide
ccacaaucuccgaggccagca

SEQ ID NO: 1981 - RNA, 21 nt, Artificial Sequence
  ELANE RNA Guide
ccagcacggugccuggggaca

SEQ ID NO: 1982 - RNA, 21 nt, Artificial Sequence
  ELANE RNA Guide
ccaggcaccgugcuggccucg

SEQ ID NO: 1983 - RNA, 21 nt, Artificial Sequence
  ELANE RNA Guide
cccacaaucuccgaggccagc

SEQ ID NO: 1984 - RNA, 21 nt, Artificial Sequence
  ELANE RNA Guide
cccaggcaccgugcuggccuc

SEQ ID NO: 1985 - RNA, 21 nt, Artificial Sequence
  ELANE RNA Guide
ccccacaaucuccgaggccag

SEQ ID NO: 1986 - RNA, 21 nt, Artificial Sequence
  ELANE RNA Guide
ccccaggcaccgugcuggccu

SEQ ID NO: 1987 - RNA, 21 nt, Artificial Sequence
  ELANE RNA Guide
cccccacaaucuccgaggcca

SEQ ID NO: 1988 - RNA, 21 nt, Artificial Sequence
  ELANE RNA Guide
ccccccacaaucuccgaggcc

SEQ ID NO: 1989 - RNA, 21 nt, Artificial Sequence
  ELANE RNA Guide
cccgguguguccccaggcacc

SEQ ID NO: 1990 - RNA, 21 nt, Artificial Sequence
  ELANE RNA Guide
ccgaggccagcacggugccug

SEQ ID NO: 1991 - RNA, 21 nt, Artificial Sequence
  ELANE RNA Guide
ccgguguguccccaggcaccg

SEQ ID NO: 1992 - RNA, 21 nt, Artificial Sequence
  ELANE RNA Guide
ccgugcuggccucggagauug

SEQ ID NO: 1993 - RNA, 21 nt, Artificial Sequence
  ELANE RNA Guide
cgaggccagcacggugccugg

SEQ ID NO: 1994 - RNA, 21 nt, Artificial Sequence
  ELANE RNA Guide
cgguguguccccaggcaccgu

SEQ ID NO: 1995 - RNA, 21 nt, Artificial Sequence
  ELANE RNA Guide
cgugcuggccucggagauugu

SEQ ID NO: 1996 - RNA, 21 nt, Artificial Sequence
  ELANE RNA Guide
cuccgaggccagcacggugcc

SEQ ID NO: 1997 - RNA, 21 nt, Artificial Sequence
  ELANE RNA Guide
gaggccagcacggugccuggg

SEQ ID NO: 1998 - RNA, 21 nt, Artificial Sequence
  ELANE RNA Guide
gcaccgugcuggccucggaga

SEQ ID NO: 1999 - RNA, 21 nt, Artificial Sequence
  ELANE RNA Guide
gcacggugccuggggacacac

SEQ ID NO: 2000 - RNA, 21 nt, Artificial Sequence
  ELANE RNA Guide
gccagcacggugccuggggac

SEQ ID NO: 2001 - RNA, 21 nt, Artificial Sequence
  ELANE RNA Guide
ggcaccgugcuggccucggag

SEQ ID NO: 2002 - RNA, 21 nt, Artificial Sequence
  ELANE RNA Guide
ggccagcacggugccugggga

SEQ ID NO: 2003 - RNA, 21 nt, Artificial Sequence
  ELANE RNA Guide
gguguguccccaggcaccgug

SEQ ID NO: 2004 - RNA, 21 nt, Artificial Sequence
  ELANE RNA Guide
guccccaggcaccgugcuggc

SEQ ID NO: 2005 - RNA, 21 nt, Artificial Sequence
  ELANE RNA Guide
gugcuggccucggagauugug

SEQ ID NO: 2006 - RNA, 21 nt, Artificial Sequence
  ELANE RNA Guide
guguccccaggcaccgugcug

SEQ ID NO: 2007 - RNA, 21 nt, Artificial Sequence
  ELANE RNA Guide
guguguccccaggcaccgugc

SEQ ID NO: 2008 - RNA, 21 nt, Artificial Sequence
  ELANE RNA Guide
uccccaggcaccgugcuggcc

SEQ ID NO: 2009 - RNA, 21 nt, Artificial Sequence
  ELANE RNA Guide
uccgaggccagcacggugccu

SEQ ID NO: 2010 - RNA, 21 nt, Artificial Sequence
  ELANE RNA Guide
ucuccgaggccagcacggugc

SEQ ID NO: 2011 - RNA, 21 nt, Artificial Sequence
  ELANE RNA Guide
uguccccaggcaccgugcugg

SEQ ID NO: 2012 - RNA, 21 nt, Artificial Sequence
  ELANE RNA Guide
uguguccccaggcaccgugcu

SEQ ID NO: 2013 - RNA, 22 nt, Artificial Sequence
  ELANE RNA Guide
aaucuccgaggccagcacggug

SEQ ID NO: 2014 - RNA, 22 nt, Artificial Sequence
  ELANE RNA Guide
acaaucuccgaggccagcacgg

SEQ ID NO: 2015 - RNA, 22 nt, Artificial Sequence
  ELANE RNA Guide
acccgguguguccccaggcacc

SEQ ID NO: 2016 - RNA, 22 nt, Artificial Sequence
  ELANE RNA Guide
accgugcuggccucggagauug

SEQ ID NO: 2017 - RNA, 22 nt, Artificial Sequence
  ELANE RNA Guide
agcacggugccuggggacacac

SEQ ID NO: 2018 - RNA, 22 nt, Artificial Sequence
  ELANE RNA Guide
aggcaccgugcuggccucggag

SEQ ID NO: 2019 - RNA, 22 nt, Artificial Sequence
  ELANE RNA Guide
aggccagcacggugccugggga

SEQ ID NO: 2020 - RNA, 22 nt, Artificial Sequence
  ELANE RNA Guide
aucuccgaggccagcacggugc

SEQ ID NO: 2021 - RNA, 22 nt, Artificial Sequence
  ELANE RNA Guide
caaucuccgaggccagcacggu

SEQ ID NO: 2022 - RNA, 22 nt, Artificial Sequence
  ELANE RNA Guide
cacaaucuccgaggccagcacg

SEQ ID NO: 2023 - RNA, 22 nt, Artificial Sequence
  ELANE RNA Guide
cacccgguguguccccaggcac

SEQ ID NO: 2024 - RNA, 22 nt, Artificial Sequence
  ELANE RNA Guide
caccgugcuggccucggagauu

SEQ ID NO: 2025 - RNA, 22 nt, Artificial Sequence
  ELANE RNA Guide
cacggugccuggggacacaccg

SEQ ID NO: 2026 - RNA, 22 nt, Artificial Sequence
  ELANE RNA Guide
cagcacggugccuggggacaca

SEQ ID NO: 2027 - RNA, 22 nt, Artificial Sequence
  ELANE RNA Guide
caggcaccgugcuggccucgga

SEQ ID NO: 2028 - RNA, 22 nt, Artificial Sequence
  ELANE RNA Guide
ccacaaucuccgaggccagcac

SEQ ID NO: 2029 - RNA, 22 nt, Artificial Sequence
  ELANE RNA Guide
ccagcacggugccuggggacac

SEQ ID NO: 2030 - RNA, 22 nt, Artificial Sequence
  ELANE RNA Guide
ccaggcaccgugcuggccucgg

SEQ ID NO: 2031 - RNA, 22 nt, Artificial Sequence
  ELANE RNA Guide
cccacaaucuccgaggccagca

SEQ ID NO: 2032 - RNA, 22 nt, Artificial Sequence
  ELANE RNA Guide
cccaggcaccgugcuggccucg

SEQ ID NO: 2033 - RNA, 22 nt, Artificial Sequence
  ELANE RNA Guide
ccccacaaucuccgaggccagc

SEQ ID NO: 2034 - RNA, 22 nt, Artificial Sequence
  ELANE RNA Guide
ccccaggcaccgugcuggccuc

SEQ ID NO: 2035 - RNA, 22 nt, Artificial Sequence
  ELANE RNA Guide
cccccacaaucuccgaggccag

SEQ ID NO: 2036 - RNA, 22 nt, Artificial Sequence
  ELANE RNA Guide
ccccccacaaucuccgaggcca

SEQ ID NO: 2037 - RNA, 22 nt, Artificial Sequence
  ELANE RNA Guide
cccgguguguccccaggcaccg

SEQ ID NO: 2038 - RNA, 22 nt, Artificial Sequence
  ELANE RNA Guide
ccgaggccagcacggugccugg

SEQ ID NO: 2039 - RNA, 22 nt, Artificial Sequence
  ELANE RNA Guide
ccgguguguccccaggcaccgu

SEQ ID NO: 2040 - RNA, 22 nt, Artificial Sequence
  ELANE RNA Guide
ccgugcuggccucggagauugu

SEQ ID NO: 2041 - RNA, 22 nt, Artificial Sequence
  ELANE RNA Guide
cgaggccagcacggugccuggg

SEQ ID NO: 2042 - RNA, 22 nt, Artificial Sequence
  ELANE RNA Guide
cgguguguccccaggcaccgug

SEQ ID NO: 2043 - RNA, 22 nt, Artificial Sequence
  ELANE RNA Guide
cgugcuggccucggagauugug

SEQ ID NO: 2044 - RNA, 22 nt, Artificial Sequence
  ELANE RNA Guide
cuccgaggccagcacggugccu

SEQ ID NO: 2045 - RNA, 22 nt, Artificial Sequence
  ELANE RNA Guide
gaggccagcacggugccugggg

SEQ ID NO: 2046 - RNA, 22 nt, Artificial Sequence
  ELANE RNA Guide
gcacccgguguguccccaggca

SEQ ID NO: 2047 - RNA, 22 nt, Artificial Sequence
  ELANE RNA Guide
gcaccgugcuggccucggagau

SEQ ID NO: 2048 - RNA, 22 nt, Artificial Sequence
  ELANE RNA Guide
gcacggugccuggggacacacc

SEQ ID NO: 2049 - RNA, 22 nt, Artificial Sequence
  ELANE RNA Guide
gccagcacggugccuggggaca

SEQ ID NO: 2050 - RNA, 22 nt, Artificial Sequence
  ELANE RNA Guide
gccccccacaaucuccgaggcc

SEQ ID NO: 2051 - RNA, 22 nt, Artificial Sequence
  ELANE RNA Guide
ggcaccgugcuggccucggaga

SEQ ID NO: 2052 - RNA, 22 nt, Artificial Sequence
  ELANE RNA Guide
ggccagcacggugccuggggac

SEQ ID NO: 2053 - RNA, 22 nt, Artificial Sequence
  ELANE RNA Guide
gguguguccccaggcaccgugc

SEQ ID NO: 2054 - RNA, 22 nt, Artificial Sequence
  ELANE RNA Guide
guccccaggcaccgugcuggcc

SEQ ID NO: 2055 - RNA, 22 nt, Artificial Sequence
  ELANE RNA Guide
gugcuggccucggagauugugg

SEQ ID NO: 2056 - RNA, 22 nt, Artificial Sequence
  ELANE RNA Guide
guguccccaggcaccgugcugg

SEQ ID NO: 2057 - RNA, 22 nt, Artificial Sequence
  ELANE RNA Guide
guguguccccaggcaccgugcu

SEQ ID NO: 2058 - RNA, 22 nt, Artificial Sequence
  ELANE RNA Guide
uccccaggcaccgugcuggccu

SEQ ID NO: 2059 - RNA, 22 nt, Artificial Sequence
  ELANE RNA Guide
uccgaggccagcacggugccug

SEQ ID NO: 2060 - RNA, 22 nt, Artificial Sequence
  ELANE RNA Guide
ucuccgaggccagcacggugcc

SEQ ID NO: 2061 - RNA, 22 nt, Artificial Sequence
  ELANE RNA Guide
uguccccaggcaccgugcuggc

SEQ ID NO: 2062 - RNA, 22 nt, Artificial Sequence
  ELANE RNA Guide
uguguccccaggcaccgugcug

SEQ ID NO: 2063 - RNA, 20 nt, Artificial Sequence
  ELANE RNA Guide
aaucuccgaggccggcgcgg

SEQ ID NO: 2064 - RNA, 20 nt, Artificial Sequence
  ELANE RNA Guide
acaaucuccgaggccggcgc

SEQ ID NO: 2065 - RNA, 20 nt, Artificial Sequence
  ELANE RNA Guide
accgcgccggccucggagau

SEQ ID NO: 2066 - RNA, 20 nt, Artificial Sequence
  ELANE RNA Guide
aucuccgaggccggcgcggu

SEQ ID NO: 2067 - RNA, 20 nt, Artificial Sequence
  ELANE RNA Guide
caaucuccgaggccggcgcg

SEQ ID NO: 2068 - RNA, 20 nt, Artificial Sequence
  ELANE RNA Guide
cacaaucuccgaggccggcg

SEQ ID NO: 2069 - RNA, 20 nt, Artificial Sequence
  ELANE RNA Guide
caccgcgccggccucggaga

SEQ ID NO: 2070 - RNA, 20 nt, Artificial Sequence
  ELANE RNA Guide
ccacaaucuccgaggccggc

SEQ ID NO: 2071 - RNA, 20 nt, Artificial Sequence
  ELANE RNA Guide
cccacaaucuccgaggccgg

SEQ ID NO: 2072 - RNA, 20 nt, Artificial Sequence
  ELANE RNA Guide
ccccacaaucuccgaggccg

SEQ ID NO: 2073 - RNA, 20 nt, Artificial Sequence
  ELANE RNA Guide
ccccccacaaucuccgaggc

SEQ ID NO: 2074 - RNA, 20 nt, Artificial Sequence
  ELANE RNA Guide
ccgcgccggccucggagauu

SEQ ID NO: 2075 - RNA, 20 nt, Artificial Sequence
  ELANE RNA Guide
ccggccucggagauuguggg

SEQ ID NO: 2076 - RNA, 20 nt, Artificial Sequence
  ELANE RNA Guide
cgccggccucggagauugug

SEQ ID NO: 2077 - RNA, 20 nt, Artificial Sequence
  ELANE RNA Guide
cgcgccggccucggagauug

SEQ ID NO: 2078 - RNA, 20 nt, Artificial Sequence
  ELANE RNA Guide
cggcgcggugccuggggaca

SEQ ID NO: 2079 - RNA, 20 nt, Artificial Sequence
  ELANE RNA Guide
gccccccacaaucuccgagg

SEQ ID NO: 2080 - RNA, 20 nt, Artificial Sequence
  ELANE RNA Guide
gccggccucggagauugugg

SEQ ID NO: 2081 - RNA, 20 nt, Artificial Sequence
  ELANE RNA Guide
gcgccggccucggagauugu

SEQ ID NO: 2082 - RNA, 20 nt, Artificial Sequence
  ELANE RNA Guide
ggccccccacaaucuccgag

SEQ ID NO: 2083 - RNA, 20 nt, Artificial Sequence
  ELANE RNA Guide
gguguguccccaggcaccgc

SEQ ID NO: 2084 - RNA, 20 nt, Artificial Sequence
  ELANE RNA Guide
guguccccaggcaccgcgcc

SEQ ID NO: 2085 - RNA, 20 nt, Artificial Sequence
  ELANE RNA Guide
guguguccccaggcaccgcg

SEQ ID NO: 2086 - RNA, 20 nt, Artificial Sequence
  ELANE RNA Guide
ucuccgaggccggcgcggug

SEQ ID NO: 2087 - RNA, 20 nt, Artificial Sequence
  ELANE RNA Guide
uguccccaggcaccgcgccg

SEQ ID NO: 2088 - RNA, 20 nt, Artificial Sequence
  ELANE RNA Guide
uguguccccaggcaccgcgc

SEQ ID NO: 2089 - RNA, 21 nt, Artificial Sequence
  ELANE RNA Guide
aaucuccgaggccggcgcggu

SEQ ID NO: 2090 - RNA, 21 nt, Artificial Sequence
  ELANE RNA Guide
acaaucuccgaggccggcgcg

SEQ ID NO: 2091 - RNA, 21 nt, Artificial Sequence
  ELANE RNA Guide
accgcgccggccucggagauu

SEQ ID NO: 2092 - RNA, 21 nt, Artificial Sequence
  ELANE RNA Guide
aucuccgaggccggcgcggug

SEQ ID NO: 2093 - RNA, 21 nt, Artificial Sequence
  ELANE RNA Guide
caaucuccgaggccggcgcgg

SEQ ID NO: 2094 - RNA, 21 nt, Artificial Sequence
  ELANE RNA Guide
cacaaucuccgaggccggcgc

SEQ ID NO: 2095 - RNA, 21 nt, Artificial Sequence
  ELANE RNA Guide
caccgcgccggccucggagau

SEQ ID NO: 2096 - RNA, 21 nt, Artificial Sequence
  ELANE RNA Guide
ccacaaucuccgaggccggcg

SEQ ID NO: 2097 - RNA, 21 nt, Artificial Sequence
  ELANE RNA Guide
cccacaaucuccgaggccggc

SEQ ID NO: 2098 - RNA, 21 nt, Artificial Sequence
  ELANE RNA Guide
ccccacaaucuccgaggccgg

SEQ ID NO: 2099 - RNA, 21 nt, Artificial Sequence
  ELANE RNA Guide
cccccacaaucuccgaggccg

SEQ ID NO: 2100 - RNA, 21 nt, Artificial Sequence
  ELANE RNA Guide
ccgcgccggccucggagauug

SEQ ID NO: 2101 - RNA, 21 nt, Artificial Sequence
  ELANE RNA Guide
ccggccucggagauugugggg

SEQ ID NO: 2102 - RNA, 21 nt, Artificial Sequence
  ELANE RNA Guide
cgccggccucggagauugugg

SEQ ID NO: 2103 - RNA, 21 nt, Artificial Sequence
  ELANE RNA Guide
cgcgccggccucggagauugu

SEQ ID NO: 2104 - RNA, 21 nt, Artificial Sequence
  ELANE RNA Guide
cggccccccacaaucuccgag

SEQ ID NO: 2105 - RNA, 21 nt, Artificial Sequence
  ELANE RNA Guide
cgguguguccccaggcaccgc

SEQ ID NO: 2106 - RNA, 21 nt, Artificial Sequence
  ELANE RNA Guide
gccccccacaaucuccgaggc

SEQ ID NO: 2107 - RNA, 21 nt, Artificial Sequence
  ELANE RNA Guide
gccggccucggagauuguggg

SEQ ID NO: 2108 - RNA, 21 nt, Artificial Sequence
  ELANE RNA Guide
gcgccggccucggagauugug

SEQ ID NO: 2109 - RNA, 21 nt, Artificial Sequence
  ELANE RNA Guide
ggccccccacaaucuccgagg

SEQ ID NO: 2110 - RNA, 21 nt, Artificial Sequence
  ELANE RNA Guide
gguguguccccaggcaccgcg

SEQ ID NO: 2111 - RNA, 21 nt, Artificial Sequence
  ELANE RNA Guide
guguguccccaggcaccgcgc

SEQ ID NO: 2112 - RNA, 21 nt, Artificial Sequence
  ELANE RNA Guide
uguguccccaggcaccgcgcc

SEQ ID NO: 2113 - RNA, 22 nt, Artificial Sequence
  ELANE RNA Guide
aaucuccgaggccggcgcggug

SEQ ID NO: 2114 - RNA, 22 nt, Artificial Sequence
  ELANE RNA Guide
acaaucuccgaggccggcgcgg

SEQ ID NO: 2115 - RNA, 22 nt, Artificial Sequence
  ELANE RNA Guide
accgcgccggccucggagauug

SEQ ID NO: 2116 - RNA, 22 nt, Artificial Sequence
  ELANE RNA Guide
aucuccgaggccggcgcggugc

SEQ ID NO: 2117 - RNA, 22 nt, Artificial Sequence
  ELANE RNA Guide
caaucuccgaggccggcgcggu

SEQ ID NO: 2118 - RNA, 22 nt, Artificial Sequence
  ELANE RNA Guide
cacaaucuccgaggccggcgcg

SEQ ID NO: 2119 - RNA, 22 nt, Artificial Sequence
  ELANE RNA Guide
caccgcgccggccucggagauu

SEQ ID NO: 2120 - RNA, 22 nt, Artificial Sequence
  ELANE RNA Guide
ccacaaucuccgaggccggcgc

SEQ ID NO: 2121 - RNA, 22 nt, Artificial Sequence
  ELANE RNA Guide
cccacaaucuccgaggccggcg

SEQ ID NO: 2122 - RNA, 22 nt, Artificial Sequence
  ELANE RNA Guide
ccccacaaucuccgaggccggc

SEQ ID NO: 2123 - RNA, 22 nt, Artificial Sequence
  ELANE RNA Guide
cccccacaaucuccgaggccgg

SEQ ID NO: 2124 - RNA, 22 nt, Artificial Sequence
  ELANE RNA Guide
ccccccacaaucuccgaggccg

SEQ ID NO: 2125 - RNA, 22 nt, Artificial Sequence
  ELANE RNA Guide
ccgcgccggccucggagauugu

SEQ ID NO: 2126 - RNA, 22 nt, Artificial Sequence
  ELANE RNA Guide
ccggccccccacaaucuccgag

SEQ ID NO: 2127 - RNA, 22 nt, Artificial Sequence
  ELANE RNA Guide
ccggccucggagauuguggggg

SEQ ID NO: 2128 - RNA, 22 nt, Artificial Sequence
  ELANE RNA Guide
ccgguguguccccaggcaccgc

SEQ ID NO: 2129 - RNA, 22 nt, Artificial Sequence
  ELANE RNA Guide
cgccggccucggagauuguggg

SEQ ID NO: 2130 - RNA, 22 nt, Artificial Sequence
  ELANE RNA Guide
cgcgccggccucggagauugug

SEQ ID NO: 2131 - RNA, 22 nt, Artificial Sequence
  ELANE RNA Guide
cggccccccacaaucuccgagg

SEQ ID NO: 2132 - RNA, 22 nt, Artificial Sequence
  ELANE RNA Guide
cggcgcggugccuggggacaca

SEQ ID NO: 2133 - RNA, 22 nt, Artificial Sequence
  ELANE RNA Guide
cgguguguccccaggcaccgcg

SEQ ID NO: 2134 - RNA, 22 nt, Artificial Sequence
  ELANE RNA Guide
gcaccgcgccggccucggagau

SEQ ID NO: 2135 - RNA, 22 nt, Artificial Sequence
  ELANE RNA Guide
gccggccucggagauugugggg

SEQ ID NO: 2136 - RNA, 22 nt, Artificial Sequence
  ELANE RNA Guide
gcgccggccucggagauugugg

SEQ ID NO: 2137 - RNA, 22 nt, Artificial Sequence
  ELANE RNA Guide
ggccccccacaaucuccgaggc

SEQ ID NO: 2138 - RNA, 22 nt, Artificial Sequence
  ELANE RNA Guide
gguguguccccaggcaccgcgc

SEQ ID NO: 2139 - RNA, 22 nt, Artificial Sequence
  ELANE RNA Guide
guguguccccaggcaccgcgcc

SEQ ID NO: 2140 - RNA, 22 nt, Artificial Sequence
  ELANE RNA Guide
uguguccccaggcaccgcgccg

SEQ ID NO: 2141 - RNA, 20 nt, Artificial Sequence
  ELANE RNA Guide
accaucuccgaggccagcgc

SEQ ID NO: 2142 - RNA, 20 nt, Artificial Sequence
  ELANE RNA Guide
accgcgcuggccucggagau

SEQ ID NO: 2143 - RNA, 20 nt, Artificial Sequence
  ELANE RNA Guide
agaugguggggggccggcga

SEQ ID NO: 2144 - RNA, 20 nt, Artificial Sequence
  ELANE RNA Guide
augguggggggccggcgagc

SEQ ID NO: 2145 - RNA, 20 nt, Artificial Sequence
  ELANE RNA Guide
caccaucuccgaggccagcg

SEQ ID NO: 2146 - RNA, 20 nt, Artificial Sequence
  ELANE RNA Guide
caccgcgcuggccucggaga

SEQ ID NO: 2147 - RNA, 20 nt, Artificial Sequence
  ELANE RNA Guide
ccaccaucuccgaggccagc

SEQ ID NO: 2148 - RNA, 20 nt, Artificial Sequence
  ELANE RNA Guide
ccaucuccgaggccagcgcg

SEQ ID NO: 2149 - RNA, 20 nt, Artificial Sequence
  ELANE RNA Guide
cccaccaucuccgaggccag

SEQ ID NO: 2150 - RNA, 20 nt, Artificial Sequence
  ELANE RNA Guide
ccccaccaucuccgaggcca

SEQ ID NO: 2151 - RNA, 20 nt, Artificial Sequence
  ELANE RNA Guide
cccccaccaucuccgaggcc

SEQ ID NO: 2152 - RNA, 20 nt, Artificial Sequence
  ELANE RNA Guide
ccccccaccaucuccgaggc

SEQ ID NO: 2153 - RNA, 20 nt, Artificial Sequence
  ELANE RNA Guide
ccgcgcuggccucggagaug

SEQ ID NO: 2154 - RNA, 20 nt, Artificial Sequence
  ELANE RNA Guide
ccggccccccaccaucuccg

SEQ ID NO: 2155 - RNA, 20 nt, Artificial Sequence
  ELANE RNA Guide
ccucggagaugguggggggc

SEQ ID NO: 2156 - RNA, 20 nt, Artificial Sequence
  ELANE RNA Guide
cgccggccccccaccaucuc

SEQ ID NO: 2157 - RNA, 20 nt, Artificial Sequence
  ELANE RNA Guide
cgcgcuggccucggagaugg

SEQ ID NO: 2158 - RNA, 20 nt, Artificial Sequence
  ELANE RNA Guide
cgcuggccucggagauggug

SEQ ID NO: 2159 - RNA, 20 nt, Artificial Sequence
  ELANE RNA Guide
cggagaugguggggggccgg

SEQ ID NO: 2160 - RNA, 20 nt, Artificial Sequence
  ELANE RNA Guide
cggccccccaccaucuccga

SEQ ID NO: 2161 - RNA, 20 nt, Artificial Sequence
  ELANE RNA Guide
cucgccggccccccaccauc

SEQ ID NO: 2162 - RNA, 20 nt, Artificial Sequence
  ELANE RNA Guide
cucggagaugguggggggcc

SEQ ID NO: 2163 - RNA, 20 nt, Artificial Sequence
  ELANE RNA Guide
cuggccucggagaugguggg

SEQ ID NO: 2164 - RNA, 20 nt, Artificial Sequence
  ELANE RNA Guide
gagaugguggggggccggcg

SEQ ID NO: 2165 - RNA, 20 nt, Artificial Sequence
  ELANE RNA Guide
gaugguggggggccggcgag

SEQ ID NO: 2166 - RNA, 20 nt, Artificial Sequence
  ELANE RNA Guide
gcaccgcgcuggccucggag

SEQ ID NO: 2167 - RNA, 20 nt, Artificial Sequence
  ELANE RNA Guide
gccccccaccaucuccgagg

SEQ ID NO: 2168 - RNA, 20 nt, Artificial Sequence
  ELANE RNA Guide
gccggccccccaccaucucc

SEQ ID NO: 2169 - RNA, 20 nt, Artificial Sequence
  ELANE RNA Guide
gccucggagauggugggggg

SEQ ID NO: 2170 - RNA, 20 nt, Artificial Sequence
  ELANE RNA Guide
gcgcuggccucggagauggu

SEQ ID NO: 2171 - RNA, 20 nt, Artificial Sequence
  ELANE RNA Guide
gcucgccggccccccaccau

SEQ ID NO: 2172 - RNA, 20 nt, Artificial Sequence
  ELANE RNA Guide
gcuggccucggagauggugg

SEQ ID NO: 2173 - RNA, 20 nt, Artificial Sequence
  ELANE RNA Guide
ggagaugguggggggccggc

SEQ ID NO: 2174 - RNA, 20 nt, Artificial Sequence
  ELANE RNA Guide
ggcaccgcgcuggccucgga

SEQ ID NO: 2175 - RNA, 20 nt, Artificial Sequence
  ELANE RNA Guide
ggccccccaccaucuccgag

SEQ ID NO: 2176 - RNA, 20 nt, Artificial Sequence
  ELANE RNA Guide
ggccucggagaugguggggg

SEQ ID NO: 2177 - RNA, 20 nt, Artificial Sequence
  ELANE RNA Guide
ucgccggccccccaccaucu

SEQ ID NO: 2178 - RNA, 20 nt, Artificial Sequence
  ELANE RNA Guide
ucggagaugguggggggccg

SEQ ID NO: 2179 - RNA, 20 nt, Artificial Sequence
  ELANE RNA Guide
uggccucggagauggugggg

SEQ ID NO: 2180 - RNA, 21 nt, Artificial Sequence
  ELANE RNA Guide
accaucuccgaggccagcgcg

SEQ ID NO: 2181 - RNA, 21 nt, Artificial Sequence
  ELANE RNA Guide
accgcgcuggccucggagaug

SEQ ID NO: 2182 - RNA, 21 nt, Artificial Sequence
  ELANE RNA Guide
agaugguggggggccggcgag

SEQ ID NO: 2183 - RNA, 21 nt, Artificial Sequence
  ELANE RNA Guide
aggcaccgcgcuggccucgga

SEQ ID NO: 2184 - RNA, 21 nt, Artificial Sequence
  ELANE RNA Guide
caccaucuccgaggccagcgc

SEQ ID NO: 2185 - RNA, 21 nt, Artificial Sequence
  ELANE RNA Guide
caccgcgcuggccucggagau

SEQ ID NO: 2186 - RNA, 21 nt, Artificial Sequence
  ELANE RNA Guide
ccaccaucuccgaggccagcg

SEQ ID NO: 2187 - RNA, 21 nt, Artificial Sequence
  ELANE RNA Guide
ccaucuccgaggccagcgcgg

SEQ ID NO: 2188 - RNA, 21 nt, Artificial Sequence
  ELANE RNA Guide
cccaccaucuccgaggccagc

SEQ ID NO: 2189 - RNA, 21 nt, Artificial Sequence
  ELANE RNA Guide
ccccaccaucuccgaggccag

SEQ ID NO: 2190 - RNA, 21 nt, Artificial Sequence
  ELANE RNA Guide
cccccaccaucuccgaggcca

SEQ ID NO: 2191 - RNA, 21 nt, Artificial Sequence
  ELANE RNA Guide
ccccccaccaucuccgaggcc

SEQ ID NO: 2192 - RNA, 21 nt, Artificial Sequence
  ELANE RNA Guide
ccgcgcuggccucggagaugg

SEQ ID NO: 2193 - RNA, 21 nt, Artificial Sequence
  ELANE RNA Guide
ccggccccccaccaucuccga

SEQ ID NO: 2194 - RNA, 21 nt, Artificial Sequence
  ELANE RNA Guide
ccucggagaugguggggggcc

SEQ ID NO: 2195 - RNA, 21 nt, Artificial Sequence
  ELANE RNA Guide
cgcgcuggccucggagauggu

SEQ ID NO: 2196 - RNA, 21 nt, Artificial Sequence
  ELANE RNA Guide
cgcuggccucggagauggugg

SEQ ID NO: 2197 - RNA, 21 nt, Artificial Sequence
  ELANE RNA Guide
cggccccccaccaucuccgag

SEQ ID NO: 2198 - RNA, 21 nt, Artificial Sequence
  ELANE RNA Guide
cucgccggccccccaccaucu

SEQ ID NO: 2199 - RNA, 21 nt, Artificial Sequence
  ELANE RNA Guide
cucggagaugguggggggccg

SEQ ID NO: 2200 - RNA, 21 nt, Artificial Sequence
  ELANE RNA Guide
cuggccucggagauggugggg

SEQ ID NO: 2201 - RNA, 21 nt, Artificial Sequence
  ELANE RNA Guide
gagaugguggggggccggcga

SEQ ID NO: 2202 - RNA, 21 nt, Artificial Sequence
  ELANE RNA Guide
gcaccgcgcuggccucggaga

SEQ ID NO: 2203 - RNA, 21 nt, Artificial Sequence
  ELANE RNA Guide
gccccccaccaucuccgaggc

SEQ ID NO: 2204 - RNA, 21 nt, Artificial Sequence
  ELANE RNA Guide
gccucggagaugguggggggc

SEQ ID NO: 2205 - RNA, 21 nt, Artificial Sequence
  ELANE RNA Guide
gcgcuggccucggagauggug

SEQ ID NO: 2206 - RNA, 21 nt, Artificial Sequence
  ELANE RNA Guide
gcuggccucggagaugguggg

SEQ ID NO: 2207 - RNA, 21 nt, Artificial Sequence
  ELANE RNA Guide
ggccccccaccaucuccgagg

SEQ ID NO: 2208 - RNA, 21 nt, Artificial Sequence
  ELANE RNA Guide
ggccucggagauggugggggg

SEQ ID NO: 2209 - RNA, 21 nt, Artificial Sequence
  ELANE RNA Guide
ucgccggccccccaccaucuc

SEQ ID NO: 2210 - RNA, 21 nt, Artificial Sequence
  ELANE RNA Guide
ucggagaugguggggggccgg

SEQ ID NO: 2211 - RNA, 21 nt, Artificial Sequence
  ELANE RNA Guide
uggccucggagaugguggggg

SEQ ID NO: 2212 - RNA, 22 nt, Artificial Sequence
  ELANE RNA Guide
accaucuccgaggccagcgcgg

SEQ ID NO: 2213 - RNA, 22 nt, Artificial Sequence
  ELANE RNA Guide
accgcgcuggccucggagaugg

SEQ ID NO: 2214 - RNA, 22 nt, Artificial Sequence
  ELANE RNA Guide
agaugguggggggccggcgagc

SEQ ID NO: 2215 - RNA, 22 nt, Artificial Sequence
  ELANE RNA Guide
aggcaccgcgcuggccucggag

SEQ ID NO: 2216 - RNA, 22 nt, Artificial Sequence
  ELANE RNA Guide
caccaucuccgaggccagcgcg

SEQ ID NO: 2217 - RNA, 22 nt, Artificial Sequence
  ELANE RNA Guide
caccgcgcuggccucggagaug

SEQ ID NO: 2218 - RNA, 22 nt, Artificial Sequence
  ELANE RNA Guide
caggcaccgcgcuggccucgga

SEQ ID NO: 2219 - RNA, 22 nt, Artificial Sequence
  ELANE RNA Guide
ccaccaucuccgaggccagcgc

SEQ ID NO: 2220 - RNA, 22 nt, Artificial Sequence
  ELANE RNA Guide
ccaucuccgaggccagcgcggu

SEQ ID NO: 2221 - RNA, 22 nt, Artificial Sequence
  ELANE RNA Guide
cccaccaucuccgaggccagcg

SEQ ID NO: 2222 - RNA, 22 nt, Artificial Sequence
  ELANE RNA Guide
ccccaccaucuccgaggccagc

SEQ ID NO: 2223 - RNA, 22 nt, Artificial Sequence
  ELANE RNA Guide
cccccaccaucuccgaggccag

SEQ ID NO: 2224 - RNA, 22 nt, Artificial Sequence
  ELANE RNA Guide
ccccccaccaucuccgaggcca

SEQ ID NO: 2225 - RNA, 22 nt, Artificial Sequence
  ELANE RNA Guide
ccgcgcuggccucggagauggu

SEQ ID NO: 2226 - RNA, 22 nt, Artificial Sequence
  ELANE RNA Guide
ccggccccccaccaucuccgag

SEQ ID NO: 2227 - RNA, 22 nt, Artificial Sequence
  ELANE RNA Guide
ccucggagaugguggggggccg

SEQ ID NO: 2228 - RNA, 22 nt, Artificial Sequence
  ELANE RNA Guide
cgcgcuggccucggagauggug

SEQ ID NO: 2229 - RNA, 22 nt, Artificial Sequence
  ELANE RNA Guide
cgcuggccucggagaugguggg

SEQ ID NO: 2230 - RNA, 22 nt, Artificial Sequence
  ELANE RNA Guide
cggccccccaccaucuccgagg

SEQ ID NO: 2231 - RNA, 22 nt, Artificial Sequence
  ELANE RNA Guide
cucgccggccccccaccaucuc

SEQ ID NO: 2232 - RNA, 22 nt, Artificial Sequence
  ELANE RNA Guide
cucggagaugguggggggccgg

SEQ ID NO: 2233 - RNA, 22 nt, Artificial Sequence
  ELANE RNA Guide
cuggccucggagaugguggggg

SEQ ID NO: 2234 - RNA, 22 nt, Artificial Sequence
  ELANE RNA Guide
gagaugguggggggccggcgag

SEQ ID NO: 2235 - RNA, 22 nt, Artificial Sequence
  ELANE RNA Guide
gcaccgcgcuggccucggagau

SEQ ID NO: 2236 - RNA, 22 nt, Artificial Sequence
  ELANE RNA Guide
gccccccaccaucuccgaggcc

SEQ ID NO: 2237 - RNA, 22 nt, Artificial Sequence
  ELANE RNA Guide
gccggccccccaccaucuccga

SEQ ID NO: 2238 - RNA, 22 nt, Artificial Sequence
  ELANE RNA Guide
gccucggagaugguggggggcc

SEQ ID NO: 2239 - RNA, 22 nt, Artificial Sequence
  ELANE RNA Guide
gcgcuggccucggagauggugg

SEQ ID NO: 2240 - RNA, 22 nt, Artificial Sequence
  ELANE RNA Guide
gcucgccggccccccaccaucu

SEQ ID NO: 2241 - RNA, 22 nt, Artificial Sequence
  ELANE RNA Guide
gcuggccucggagauggugggg

SEQ ID NO: 2242 - RNA, 22 nt, Artificial Sequence
  ELANE RNA Guide
ggagaugguggggggccggcga

SEQ ID NO: 2243 - RNA, 22 nt, Artificial Sequence
  ELANE RNA Guide
ggcaccgcgcuggccucggaga

SEQ ID NO: 2244 - RNA, 22 nt, Artificial Sequence
  ELANE RNA Guide
ggccccccaccaucuccgaggc

SEQ ID NO: 2245 - RNA, 22 nt, Artificial Sequence
  ELANE RNA Guide
ggccucggagaugguggggggc

SEQ ID NO: 2246 - RNA, 22 nt, Artificial Sequence
  ELANE RNA Guide
ucgccggccccccaccaucucc

SEQ ID NO: 2247 - RNA, 22 nt, Artificial Sequence
  ELANE RNA Guide
ucggagaugguggggggccggc

SEQ ID NO: 2248 - RNA, 22 nt, Artificial Sequence
  ELANE RNA Guide
uggccucggagauggugggggg

SEQ ID NO: 2249 - RNA, 20 nt, Artificial Sequence
  ELANE RNA Guide
aagggccacacguggggccg

SEQ ID NO: 2250 - RNA, 20 nt, Artificial Sequence
  ELANE RNA Guide
acaccaugaagggccacacg

SEQ ID NO: 2251 - RNA, 20 nt, Artificial Sequence
  ELANE RNA Guide
acacguggggccgcgcucgc

SEQ ID NO: 2252 - RNA, 20 nt, Artificial Sequence
  ELANE RNA Guide
accaugaagggccacacgug

SEQ ID NO: 2253 - RNA, 20 nt, Artificial Sequence
  ELANE RNA Guide
acguguggcccuucauggug

SEQ ID NO: 2254 - RNA, 20 nt, Artificial Sequence
  ELANE RNA Guide
agcgcggccccacguguggc

SEQ ID NO: 2255 - RNA, 20 nt, Artificial Sequence
  ELANE RNA Guide
agggacaccaugaagggcca

SEQ ID NO: 2256 - RNA, 20 nt, Artificial Sequence
  ELANE RNA Guide
agggccacacguggggccgc

SEQ ID NO: 2257 - RNA, 20 nt, Artificial Sequence
  ELANE RNA Guide
augaagggccacacgugggg

SEQ ID NO: 2258 - RNA, 20 nt, Artificial Sequence
  ELANE RNA Guide
cacacguggggccgcgcucg

SEQ ID NO: 2259 - RNA, 20 nt, Artificial Sequence
  ELANE RNA Guide
caccaugaagggccacacgu

SEQ ID NO: 2260 - RNA, 20 nt, Artificial Sequence
  ELANE RNA Guide
cacguguggcccuucauggu

SEQ ID NO: 2261 - RNA, 20 nt, Artificial Sequence
  ELANE RNA Guide
cagggacaccaugaagggcc

SEQ ID NO: 2262 - RNA, 20 nt, Artificial Sequence
  ELANE RNA Guide
caugaagggccacacguggg

SEQ ID NO: 2263 - RNA, 20 nt, Artificial Sequence
  ELANE RNA Guide
ccacacguggggccgcgcuc

SEQ ID NO: 2264 - RNA, 20 nt, Artificial Sequence
  ELANE RNA Guide
ccacguguggcccuucaugg

SEQ ID NO: 2265 - RNA, 20 nt, Artificial Sequence
  ELANE RNA Guide
ccaugaagggccacacgugg

SEQ ID NO: 2266 - RNA, 20 nt, Artificial Sequence
  ELANE RNA Guide
cccacguguggcccuucaug

SEQ ID NO: 2267 - RNA, 20 nt, Artificial Sequence
  ELANE RNA Guide
ccccacguguggcccuucau

SEQ ID NO: 2268 - RNA, 20 nt, Artificial Sequence
  ELANE RNA Guide
cgagcgcggccccacgugug

SEQ ID NO: 2269 - RNA, 20 nt, Artificial Sequence
  ELANE RNA Guide
cggccccacguguggcccuu

SEQ ID NO: 2270 - RNA, 20 nt, Artificial Sequence
  ELANE RNA Guide
cguguggcccuucauggugu

SEQ ID NO: 2271 - RNA, 20 nt, Artificial Sequence
  ELANE RNA Guide
gaagggccacacguggggcc

SEQ ID NO: 2272 - RNA, 20 nt, Artificial Sequence
  ELANE RNA Guide
gacaccaugaagggccacac

SEQ ID NO: 2273 - RNA, 20 nt, Artificial Sequence
  ELANE RNA Guide
gagcgcggccccacgugugg

SEQ ID NO: 2274 - RNA, 20 nt, Artificial Sequence
  ELANE RNA Guide
gcagggacaccaugaagggc

SEQ ID NO: 2275 - RNA, 20 nt, Artificial Sequence
  ELANE RNA Guide
gccacacguggggccgcgcu

SEQ ID NO: 2276 - RNA, 20 nt, Artificial Sequence
  ELANE RNA Guide
gccccacguguggcccuuca

SEQ ID NO: 2277 - RNA, 20 nt, Artificial Sequence
  ELANE RNA Guide
gcgagcgcggccccacgugu

SEQ ID NO: 2278 - RNA, 20 nt, Artificial Sequence
  ELANE RNA Guide
gcggccccacguguggcccu

SEQ ID NO: 2279 - RNA, 20 nt, Artificial Sequence
  ELANE RNA Guide
ggacaccaugaagggccaca

SEQ ID NO: 2280 - RNA, 20 nt, Artificial Sequence
  ELANE RNA Guide
ggccccacguguggcccuuc

SEQ ID NO: 2281 - RNA, 20 nt, Artificial Sequence
  ELANE RNA Guide
gggacaccaugaagggccac

SEQ ID NO: 2282 - RNA, 20 nt, Artificial Sequence
  ELANE RNA Guide
guguggcccuucaugguguc

SEQ ID NO: 2283 - RNA, 20 nt, Artificial Sequence
  ELANE RNA Guide
ugaagggccacacguggggc

SEQ ID NO: 2284 - RNA, 21 nt, Artificial Sequence
  ELANE RNA Guide
aagggccacacguggggccgc

SEQ ID NO: 2285 - RNA, 21 nt, Artificial Sequence
  ELANE RNA Guide
acaccaugaagggccacacgu

SEQ ID NO: 2286 - RNA, 21 nt, Artificial Sequence
  ELANE RNA Guide
accaugaagggccacacgugg

SEQ ID NO: 2287 - RNA, 21 nt, Artificial Sequence
  ELANE RNA Guide
acguguggcccuucauggugu

SEQ ID NO: 2288 - RNA, 21 nt, Artificial Sequence
  ELANE RNA Guide
agggacaccaugaagggccac

SEQ ID NO: 2289 - RNA, 21 nt, Artificial Sequence
  ELANE RNA Guide
augaagggccacacguggggc

SEQ ID NO: 2290 - RNA, 21 nt, Artificial Sequence
  ELANE RNA Guide
caccaugaagggccacacgug

SEQ ID NO: 2291 - RNA, 21 nt, Artificial Sequence
  ELANE RNA Guide
cacguguggcccuucauggug

SEQ ID NO: 2292 - RNA, 21 nt, Artificial Sequence
  ELANE RNA Guide
cagggacaccaugaagggcca

SEQ ID NO: 2293 - RNA, 21 nt, Artificial Sequence
  ELANE RNA Guide
caugaagggccacacgugggg

SEQ ID NO: 2294 - RNA, 21 nt, Artificial Sequence
  ELANE RNA Guide
ccacguguggcccuucauggu

SEQ ID NO: 2295 - RNA, 21 nt, Artificial Sequence
  ELANE RNA Guide
ccaugaagggccacacguggg

SEQ ID NO: 2296 - RNA, 21 nt, Artificial Sequence
  ELANE RNA Guide
cccacguguggcccuucaugg

SEQ ID NO: 2297 - RNA, 21 nt, Artificial Sequence
  ELANE RNA Guide
ccccacguguggcccuucaug

SEQ ID NO: 2298 - RNA, 21 nt, Artificial Sequence
  ELANE RNA Guide
cggccccacguguggcccuuc

SEQ ID NO: 2299 - RNA, 21 nt, Artificial Sequence
  ELANE RNA Guide
cguguggcccuucaugguguc

SEQ ID NO: 2300 - RNA, 21 nt, Artificial Sequence
  ELANE RNA Guide
gaagggccacacguggggccg

SEQ ID NO: 2301 - RNA, 21 nt, Artificial Sequence
  ELANE RNA Guide
gacaccaugaagggccacacg

SEQ ID NO: 2302 - RNA, 21 nt, Artificial Sequence
  ELANE RNA Guide
gcagggacaccaugaagggcc

SEQ ID NO: 2303 - RNA, 21 nt, Artificial Sequence
  ELANE RNA Guide
gccccacguguggcccuucau

SEQ ID NO: 2304 - RNA, 21 nt, Artificial Sequence
  ELANE RNA Guide
gcggccccacguguggcccuu

SEQ ID NO: 2305 - RNA, 21 nt, Artificial Sequence
  ELANE RNA Guide
ggacaccaugaagggccacac

SEQ ID NO: 2306 - RNA, 21 nt, Artificial Sequence
  ELANE RNA Guide
ggccccacguguggcccuuca

SEQ ID NO: 2307 - RNA, 21 nt, Artificial Sequence
  ELANE RNA Guide
gggacaccaugaagggccaca

SEQ ID NO: 2308 - RNA, 21 nt, Artificial Sequence
  ELANE RNA Guide
guguggcccuucauggugucc

SEQ ID NO: 2309 - RNA, 21 nt, Artificial Sequence
  ELANE RNA Guide
ugaagggccacacguggggcc

SEQ ID NO: 2310 - RNA, 21 nt, Artificial Sequence
  ELANE RNA Guide
ugcagggacaccaugaagggc

SEQ ID NO: 2311 - RNA, 22 nt, Artificial Sequence
  ELANE RNA Guide
aagggccacacguggggccgcg

SEQ ID NO: 2312 - RNA, 22 nt, Artificial Sequence
  ELANE RNA Guide
acaccaugaagggccacacgug

SEQ ID NO: 2313 - RNA, 22 nt, Artificial Sequence
  ELANE RNA Guide
accaugaagggccacacguggg

SEQ ID NO: 2314 - RNA, 22 nt, Artificial Sequence
  ELANE RNA Guide
acguguggcccuucaugguguc

SEQ ID NO: 2315 - RNA, 22 nt, Artificial Sequence
  ELANE RNA Guide
agggacaccaugaagggccaca

SEQ ID NO: 2316 - RNA, 22 nt, Artificial Sequence
  ELANE RNA Guide
augaagggccacacguggggcc

SEQ ID NO: 2317 - RNA, 22 nt, Artificial Sequence
  ELANE RNA Guide
caccaugaagggccacacgugg

SEQ ID NO: 2318 - RNA, 22 nt, Artificial Sequence
  ELANE RNA Guide
cacguguggcccuucauggugu

SEQ ID NO: 2319 - RNA, 22 nt, Artificial Sequence
  ELANE RNA Guide
cagggacaccaugaagggccac

SEQ ID NO: 2320 - RNA, 22 nt, Artificial Sequence
  ELANE RNA Guide
caugaagggccacacguggggc

SEQ ID NO: 2321 - RNA, 22 nt, Artificial Sequence
  ELANE RNA Guide
ccacguguggcccuucauggug

SEQ ID NO: 2322 - RNA, 22 nt, Artificial Sequence
  ELANE RNA Guide
ccaugaagggccacacgugggg

SEQ ID NO: 2323 - RNA, 22 nt, Artificial Sequence
  ELANE RNA Guide
cccacguguggcccuucauggu

SEQ ID NO: 2324 - RNA, 22 nt, Artificial Sequence
  ELANE RNA Guide
ccccacguguggcccuucaugg

SEQ ID NO: 2325 - RNA, 22 nt, Artificial Sequence
  ELANE RNA Guide
cgcggccccacguguggcccuu

SEQ ID NO: 2326 - RNA, 22 nt, Artificial Sequence
  ELANE RNA Guide
cggccccacguguggcccuuca

SEQ ID NO: 2327 - RNA, 22 nt, Artificial Sequence
  ELANE RNA Guide
cguguggcccuucauggugucc

SEQ ID NO: 2328 - RNA, 22 nt, Artificial Sequence
  ELANE RNA Guide
cugcagggacaccaugaagggc

SEQ ID NO: 2329 - RNA, 22 nt, Artificial Sequence
  ELANE RNA Guide
gaagggccacacguggggccgc

SEQ ID NO: 2330 - RNA, 22 nt, Artificial Sequence
  ELANE RNA Guide
gacaccaugaagggccacacgu

SEQ ID NO: 2331 - RNA, 22 nt, Artificial Sequence
  ELANE RNA Guide
gcagggacaccaugaagggcca

SEQ ID NO: 2332 - RNA, 22 nt, Artificial Sequence
  ELANE RNA Guide
gccccacguguggcccuucaug

SEQ ID NO: 2333 - RNA, 22 nt, Artificial Sequence
  ELANE RNA Guide
gcggccccacguguggcccuuc

SEQ ID NO: 2334 - RNA, 22 nt, Artificial Sequence
  ELANE RNA Guide
ggacaccaugaagggccacacg

SEQ ID NO: 2335 - RNA, 22 nt, Artificial Sequence
  ELANE RNA Guide
ggccccacguguggcccuucau

SEQ ID NO: 2336 - RNA, 22 nt, Artificial Sequence
  ELANE RNA Guide
gggacaccaugaagggccacac

SEQ ID NO: 2337 - RNA, 22 nt, Artificial Sequence
  ELANE RNA Guide
guguggcccuucaugguguccc

SEQ ID NO: 2338 - RNA, 22 nt, Artificial Sequence
  ELANE RNA Guide
ugaagggccacacguggggccg

SEQ ID NO: 2339 - RNA, 22 nt, Artificial Sequence
  ELANE RNA Guide
ugcagggacaccaugaagggcc

SEQ ID NO: 2340 - RNA, 20 nt, Artificial Sequence
  ELANE RNA Guide
aagagccacgcguggggccg

SEQ ID NO: 2341 - RNA, 20 nt, Artificial Sequence
  ELANE RNA Guide
acaccaugaagagccacgcg

SEQ ID NO: 2342 - RNA, 20 nt, Artificial Sequence
  ELANE RNA Guide
accaugaagagccacgcgug

SEQ ID NO: 2343 - RNA, 20 nt, Artificial Sequence
  ELANE RNA Guide
acgcguggcucuucauggug

SEQ ID NO: 2344 - RNA, 20 nt, Artificial Sequence
  ELANE RNA Guide
agagccacgcguggggccgc

SEQ ID NO: 2345 - RNA, 20 nt, Artificial Sequence
  ELANE RNA Guide
agcugcagggacaccaugaa

SEQ ID NO: 2346 - RNA, 20 nt, Artificial Sequence
  ELANE RNA Guide
agggacaccaugaagagcca

SEQ ID NO: 2347 - RNA, 20 nt, Artificial Sequence
  ELANE RNA Guide
augaagagccacgcgugggg

SEQ ID NO: 2348 - RNA, 20 nt, Artificial Sequence
  ELANE RNA Guide
caccaugaagagccacgcgu

SEQ ID NO: 2349 - RNA, 20 nt, Artificial Sequence
  ELANE RNA Guide
cacgcguggcucuucauggu

SEQ ID NO: 2350 - RNA, 20 nt, Artificial Sequence
  ELANE RNA Guide
cagcugcagggacaccauga

SEQ ID NO: 2351 - RNA, 20 nt, Artificial Sequence
  ELANE RNA Guide
cagggacaccaugaagagcc

SEQ ID NO: 2352 - RNA, 20 nt, Artificial Sequence
  ELANE RNA Guide
caugaagagccacgcguggg

SEQ ID NO: 2353 - RNA, 20 nt, Artificial Sequence
  ELANE RNA Guide
ccacgcguggcucuucaugg

SEQ ID NO: 2354 - RNA, 20 nt, Artificial Sequence
  ELANE RNA Guide
ccaugaagagccacgcgugg

SEQ ID NO: 2355 - RNA, 20 nt, Artificial Sequence
  ELANE RNA Guide
cccacgcguggcucuucaug

SEQ ID NO: 2356 - RNA, 20 nt, Artificial Sequence
  ELANE RNA Guide
ccccacgcguggcucuucau

SEQ ID NO: 2357 - RNA, 20 nt, Artificial Sequence
  ELANE RNA Guide
cgcguggcucuucauggugu

SEQ ID NO: 2358 - RNA, 20 nt, Artificial Sequence
  ELANE RNA Guide
cggccccacgcguggcucuu

SEQ ID NO: 2359 - RNA, 20 nt, Artificial Sequence
  ELANE RNA Guide
cguggcucuucauggugucc

SEQ ID NO: 2360 - RNA, 20 nt, Artificial Sequence
  ELANE RNA Guide
cucuucauggugucccugca

SEQ ID NO: 2361 - RNA, 20 nt, Artificial Sequence
  ELANE RNA Guide
cugcagggacaccaugaaga

SEQ ID NO: 2362 - RNA, 20 nt, Artificial Sequence
  ELANE RNA Guide
gaagagccacgcguggggcc

SEQ ID NO: 2363 - RNA, 20 nt, Artificial Sequence
  ELANE RNA Guide
gacaccaugaagagccacgc

SEQ ID NO: 2364 - RNA, 20 nt, Artificial Sequence
  ELANE RNA Guide
gcagcugcagggacaccaug

SEQ ID NO: 2365 - RNA, 20 nt, Artificial Sequence
  ELANE RNA Guide
gcagggacaccaugaagagc

SEQ ID NO: 2366 - RNA, 20 nt, Artificial Sequence
  ELANE RNA Guide
gccccacgcguggcucuuca

SEQ ID NO: 2367 - RNA, 20 nt, Artificial Sequence
  ELANE RNA Guide
gcggccccacgcguggcucu

SEQ ID NO: 2368 - RNA, 20 nt, Artificial Sequence
  ELANE RNA Guide
gcguggcucuucaugguguc

SEQ ID NO: 2369 - RNA, 20 nt, Artificial Sequence
  ELANE RNA Guide
gcucuucauggugucccugc

SEQ ID NO: 2370 - RNA, 20 nt, Artificial Sequence
  ELANE RNA Guide
gcugcagggacaccaugaag

SEQ ID NO: 2371 - RNA, 20 nt, Artificial Sequence
  ELANE RNA Guide
ggacaccaugaagagccacg

SEQ ID NO: 2372 - RNA, 20 nt, Artificial Sequence
  ELANE RNA Guide
ggccccacgcguggcucuuc

SEQ ID NO: 2373 - RNA, 20 nt, Artificial Sequence
  ELANE RNA Guide
ggcucuucauggugucccug

SEQ ID NO: 2374 - RNA, 20 nt, Artificial Sequence
  ELANE RNA Guide
gggacaccaugaagagccac

SEQ ID NO: 2375 - RNA, 20 nt, Artificial Sequence
  ELANE RNA Guide
guggcucuucaugguguccc

SEQ ID NO: 2376 - RNA, 20 nt, Artificial Sequence
  ELANE RNA Guide
ugaagagccacgcguggggc

SEQ ID NO: 2377 - RNA, 20 nt, Artificial Sequence
  ELANE RNA Guide
ugcagggacaccaugaagag

SEQ ID NO: 2378 - RNA, 20 nt, Artificial Sequence
  ELANE RNA Guide
uggcucuucauggugucccu

SEQ ID NO: 2379 - RNA, 21 nt, Artificial Sequence
  ELANE RNA Guide
aagagccacgcguggggccgc

SEQ ID NO: 2380 - RNA, 21 nt, Artificial Sequence
  ELANE RNA Guide
acaccaugaagagccacgcgu

SEQ ID NO: 2381 - RNA, 21 nt, Artificial Sequence
  ELANE RNA Guide
accaugaagagccacgcgugg

SEQ ID NO: 2382 - RNA, 21 nt, Artificial Sequence
  ELANE RNA Guide
acgcguggcucuucauggugu

SEQ ID NO: 2383 - RNA, 21 nt, Artificial Sequence
  ELANE RNA Guide
agcugcagggacaccaugaag

SEQ ID NO: 2384 - RNA, 21 nt, Artificial Sequence
  ELANE RNA Guide
agggacaccaugaagagccac

SEQ ID NO: 2385 - RNA, 21 nt, Artificial Sequence
  ELANE RNA Guide
augaagagccacgcguggggc

SEQ ID NO: 2386 - RNA, 21 nt, Artificial Sequence
  ELANE RNA Guide
caccaugaagagccacgcgug

SEQ ID NO: 2387 - RNA, 21 nt, Artificial Sequence
  ELANE RNA Guide
cacgcguggcucuucauggug

SEQ ID NO: 2388 - RNA, 21 nt, Artificial Sequence
  ELANE RNA Guide
cagcugcagggacaccaugaa

SEQ ID NO: 2389 - RNA, 21 nt, Artificial Sequence
  ELANE RNA Guide
cagggacaccaugaagagcca

SEQ ID NO: 2390 - RNA, 21 nt, Artificial Sequence
  ELANE RNA Guide
caugaagagccacgcgugggg

SEQ ID NO: 2391 - RNA, 21 nt, Artificial Sequence
  ELANE RNA Guide
ccacgcguggcucuucauggu

SEQ ID NO: 2392 - RNA, 21 nt, Artificial Sequence
  ELANE RNA Guide
ccaugaagagccacgcguggg

SEQ ID NO: 2393 - RNA, 21 nt, Artificial Sequence
  ELANE RNA Guide
cccacgcguggcucuucaugg

SEQ ID NO: 2394 - RNA, 21 nt, Artificial Sequence
  ELANE RNA Guide
ccccacgcguggcucuucaug

SEQ ID NO: 2395 - RNA, 21 nt, Artificial Sequence
  ELANE RNA Guide
cgcagcugcagggacaccaug

SEQ ID NO: 2396 - RNA, 21 nt, Artificial Sequence
  ELANE RNA Guide
cgcguggcucuucaugguguc

SEQ ID NO: 2397 - RNA, 21 nt, Artificial Sequence
  ELANE RNA Guide
cggccccacgcguggcucuuc

SEQ ID NO: 2398 - RNA, 21 nt, Artificial Sequence
  ELANE RNA Guide
cguggcucuucaugguguccc

SEQ ID NO: 2399 - RNA, 21 nt, Artificial Sequence
  ELANE RNA Guide
cucuucauggugucccugcag

SEQ ID NO: 2400 - RNA, 21 nt, Artificial Sequence
  ELANE RNA Guide
cugcagggacaccaugaagag

SEQ ID NO: 2401 - RNA, 21 nt, Artificial Sequence
  ELANE RNA Guide
gaagagccacgcguggggccg

SEQ ID NO: 2402 - RNA, 21 nt, Artificial Sequence
  ELANE RNA Guide
gacaccaugaagagccacgcg

SEQ ID NO: 2403 - RNA, 21 nt, Artificial Sequence
  ELANE RNA Guide
gcagcugcagggacaccauga

SEQ ID NO: 2404 - RNA, 21 nt, Artificial Sequence
  ELANE RNA Guide
gcagggacaccaugaagagcc

SEQ ID NO: 2405 - RNA, 21 nt, Artificial Sequence
  ELANE RNA Guide
gccccacgcguggcucuucau

SEQ ID NO: 2406 - RNA, 21 nt, Artificial Sequence
  ELANE RNA Guide
gcggccccacgcguggcucuu

SEQ ID NO: 2407 - RNA, 21 nt, Artificial Sequence
  ELANE RNA Guide
gcguggcucuucauggugucc

SEQ ID NO: 2408 - RNA, 21 nt, Artificial Sequence
  ELANE RNA Guide
gcucuucauggugucccugca

SEQ ID NO: 2409 - RNA, 21 nt, Artificial Sequence
  ELANE RNA Guide
gcugcagggacaccaugaaga

SEQ ID NO: 2410 - RNA, 21 nt, Artificial Sequence
  ELANE RNA Guide
ggacaccaugaagagccacgc

SEQ ID NO: 2411 - RNA, 21 nt, Artificial Sequence
  ELANE RNA Guide
ggccccacgcguggcucuuca

SEQ ID NO: 2412 - RNA, 21 nt, Artificial Sequence
  ELANE RNA Guide
ggcucuucauggugucccugc

SEQ ID NO: 2413 - RNA, 21 nt, Artificial Sequence
  ELANE RNA Guide
gggacaccaugaagagccacg

SEQ ID NO: 2414 - RNA, 21 nt, Artificial Sequence
  ELANE RNA Guide
guggcucuucauggugucccu

SEQ ID NO: 2415 - RNA, 21 nt, Artificial Sequence
  ELANE RNA Guide
ugaagagccacgcguggggcc

SEQ ID NO: 2416 - RNA, 21 nt, Artificial Sequence
  ELANE RNA Guide
ugcagggacaccaugaagagc

SEQ ID NO: 2417 - RNA, 21 nt, Artificial Sequence
  ELANE RNA Guide
uggcucuucauggugucccug

SEQ ID NO: 2418 - RNA, 22 nt, Artificial Sequence
  ELANE RNA Guide
aagagccacgcguggggccgcg

SEQ ID NO: 2419 - RNA, 22 nt, Artificial Sequence
  ELANE RNA Guide
acaccaugaagagccacgcgug

SEQ ID NO: 2420 - RNA, 22 nt, Artificial Sequence
  ELANE RNA Guide
accaugaagagccacgcguggg

SEQ ID NO: 2421 - RNA, 22 nt, Artificial Sequence
  ELANE RNA Guide
acgcguggcucuucaugguguc

SEQ ID NO: 2422 - RNA, 22 nt, Artificial Sequence
  ELANE RNA Guide
agcugcagggacaccaugaaga

SEQ ID NO: 2423 - RNA, 22 nt, Artificial Sequence
  ELANE RNA Guide
agggacaccaugaagagccacg

SEQ ID NO: 2424 - RNA, 22 nt, Artificial Sequence
  ELANE RNA Guide
augaagagccacgcguggggcc

SEQ ID NO: 2425 - RNA, 22 nt, Artificial Sequence
  ELANE RNA Guide
caccaugaagagccacgcgugg

SEQ ID NO: 2426 - RNA, 22 nt, Artificial Sequence
  ELANE RNA Guide
cacgcguggcucuucauggugu

SEQ ID NO: 2427 - RNA, 22 nt, Artificial Sequence
  ELANE RNA Guide
cagcugcagggacaccaugaag

SEQ ID NO: 2428 - RNA, 22 nt, Artificial Sequence
  ELANE RNA Guide
cagggacaccaugaagagccac

SEQ ID NO: 2429 - RNA, 22 nt, Artificial Sequence
  ELANE RNA Guide
caugaagagccacgcguggggc

SEQ ID NO: 2430 - RNA, 22 nt, Artificial Sequence
  ELANE RNA Guide
ccacgcguggcucuucauggug

SEQ ID NO: 2431 - RNA, 22 nt, Artificial Sequence
  ELANE RNA Guide
ccaugaagagccacgcgugggg

SEQ ID NO: 2432 - RNA, 22 nt, Artificial Sequence
  ELANE RNA Guide
cccacgcguggcucuucauggu

SEQ ID NO: 2433 - RNA, 22 nt, Artificial Sequence
  ELANE RNA Guide
ccccacgcguggcucuucaugg

SEQ ID NO: 2434 - RNA, 22 nt, Artificial Sequence
  ELANE RNA Guide
cgcagcugcagggacaccauga

SEQ ID NO: 2435 - RNA, 22 nt, Artificial Sequence
  ELANE RNA Guide
cgcggccccacgcguggcucuu

SEQ ID NO: 2436 - RNA, 22 nt, Artificial Sequence
  ELANE RNA Guide
cgcguggcucuucauggugucc

SEQ ID NO: 2437 - RNA, 22 nt, Artificial Sequence
  ELANE RNA Guide
cggccccacgcguggcucuuca

SEQ ID NO: 2438 - RNA, 22 nt, Artificial Sequence
  ELANE RNA Guide
cguggcucuucauggugucccu

SEQ ID NO: 2439 - RNA, 22 nt, Artificial Sequence
  ELANE RNA Guide
cucuucauggugucccugcagc

SEQ ID NO: 2440 - RNA, 22 nt, Artificial Sequence
  ELANE RNA Guide
cugcagggacaccaugaagagc

SEQ ID NO: 2441 - RNA, 22 nt, Artificial Sequence
  ELANE RNA Guide
gaagagccacgcguggggccgc

SEQ ID NO: 2442 - RNA, 22 nt, Artificial Sequence
  ELANE RNA Guide
gacaccaugaagagccacgcgu

SEQ ID NO: 2443 - RNA, 22 nt, Artificial Sequence
  ELANE RNA Guide
gcagcugcagggacaccaugaa

SEQ ID NO: 2444 - RNA, 22 nt, Artificial Sequence
  ELANE RNA Guide
gcagggacaccaugaagagcca

SEQ ID NO: 2445 - RNA, 22 nt, Artificial Sequence
  ELANE RNA Guide
gccccacgcguggcucuucaug

SEQ ID NO: 2446 - RNA, 22 nt, Artificial Sequence
  ELANE RNA Guide
gcgcagcugcagggacaccaug

SEQ ID NO: 2447 - RNA, 22 nt, Artificial Sequence
  ELANE RNA Guide
gcggccccacgcguggcucuuc

SEQ ID NO: 2448 - RNA, 22 nt, Artificial Sequence
  ELANE RNA Guide
gcguggcucuucaugguguccc

SEQ ID NO: 2449 - RNA, 22 nt, Artificial Sequence
  ELANE RNA Guide
gcucuucauggugucccugcag

SEQ ID NO: 2450 - RNA, 22 nt, Artificial Sequence
  ELANE RNA Guide
gcugcagggacaccaugaagag

SEQ ID NO: 2451 - RNA, 22 nt, Artificial Sequence
  ELANE RNA Guide
ggacaccaugaagagccacgcg

SEQ ID NO: 2452 - RNA, 22 nt, Artificial Sequence
  ELANE RNA Guide
ggccccacgcguggcucuucau

SEQ ID NO: 2453 - RNA, 22 nt, Artificial Sequence
  ELANE RNA Guide
ggcucuucauggugucccugca

SEQ ID NO: 2454 - RNA, 22 nt, Artificial Sequence
  ELANE RNA Guide
gggacaccaugaagagccacgc

SEQ ID NO: 2455 - RNA, 22 nt, Artificial Sequence
  ELANE RNA Guide
guggcucuucauggugucccug

SEQ ID NO: 2456 - RNA, 22 nt, Artificial Sequence
  ELANE RNA Guide
ugaagagccacgcguggggccg

SEQ ID NO: 2457 - RNA, 22 nt, Artificial Sequence
  ELANE RNA Guide
ugcagggacaccaugaagagcc

SEQ ID NO: 2458 - RNA, 22 nt, Artificial Sequence
  ELANE RNA Guide
uggcucuucauggugucccugc

SEQ ID NO: 2459 - RNA, 20 nt, Artificial Sequence
  ELANE RNA Guide
acaccaugaggggccacgcg

SEQ ID NO: 2460 - RNA, 20 nt, Artificial Sequence
  ELANE RNA Guide
accaugaggggccacgcgug

SEQ ID NO: 2461 - RNA, 20 nt, Artificial Sequence
  ELANE RNA Guide
acgcguggccccucauggug

SEQ ID NO: 2462 - RNA, 20 nt, Artificial Sequence
  ELANE RNA Guide
agcugcagggacaccaugag

SEQ ID NO: 2463 - RNA, 20 nt, Artificial Sequence
  ELANE RNA Guide
agggacaccaugaggggcca

SEQ ID NO: 2464 - RNA, 20 nt, Artificial Sequence
  ELANE RNA Guide
augaggggccacgcgugggg

SEQ ID NO: 2465 - RNA, 20 nt, Artificial Sequence
  ELANE RNA Guide
caccaugaggggccacgcgu

SEQ ID NO: 2466 - RNA, 20 nt, Artificial Sequence
  ELANE RNA Guide
cacgcguggccccucauggu

SEQ ID NO: 2467 - RNA, 20 nt, Artificial Sequence
  ELANE RNA Guide
cagggacaccaugaggggcc

SEQ ID NO: 2468 - RNA, 20 nt, Artificial Sequence
  ELANE RNA Guide
caugaggggccacgcguggg

SEQ ID NO: 2469 - RNA, 20 nt, Artificial Sequence
  ELANE RNA Guide
ccacgcguggccccucaugg

SEQ ID NO: 2470 - RNA, 20 nt, Artificial Sequence
  ELANE RNA Guide
ccaugaggggccacgcgugg

SEQ ID NO: 2471 - RNA, 20 nt, Artificial Sequence
  ELANE RNA Guide
cccacgcguggccccucaug

SEQ ID NO: 2472 - RNA, 20 nt, Artificial Sequence
  ELANE RNA Guide
ccccacgcguggccccucau

SEQ ID NO: 2473 - RNA, 20 nt, Artificial Sequence
  ELANE RNA Guide
ccccucauggugucccugca

SEQ ID NO: 2474 - RNA, 20 nt, Artificial Sequence
  ELANE RNA Guide
cccucauggugucccugcag

SEQ ID NO: 2475 - RNA, 20 nt, Artificial Sequence
  ELANE RNA Guide
ccucauggugucccugcagc

SEQ ID NO: 2476 - RNA, 20 nt, Artificial Sequence
  ELANE RNA Guide
cgcagcugcagggacaccau

SEQ ID NO: 2477 - RNA, 20 nt, Artificial Sequence
  ELANE RNA Guide
cgcguggccccucauggugu

SEQ ID NO: 2478 - RNA, 20 nt, Artificial Sequence
  ELANE RNA Guide
cguggccccucauggugucc

SEQ ID NO: 2479 - RNA, 20 nt, Artificial Sequence
  ELANE RNA Guide
cugcagggacaccaugaggg

SEQ ID NO: 2480 - RNA, 20 nt, Artificial Sequence
  ELANE RNA Guide
gacaccaugaggggccacgc

SEQ ID NO: 2481 - RNA, 20 nt, Artificial Sequence
  ELANE RNA Guide
gcagggacaccaugaggggc

SEQ ID NO: 2482 - RNA, 20 nt, Artificial Sequence
  ELANE RNA Guide
gccccacgcguggccccuca

SEQ ID NO: 2483 - RNA, 20 nt, Artificial Sequence
  ELANE RNA Guide
gccccucauggugucccugc

SEQ ID NO: 2484 - RNA, 20 nt, Artificial Sequence
  ELANE RNA Guide
gcgcagcugcagggacacca

SEQ ID NO: 2485 - RNA, 20 nt, Artificial Sequence
  ELANE RNA Guide
gcguggccccucaugguguc

SEQ ID NO: 2486 - RNA, 20 nt, Artificial Sequence
  ELANE RNA Guide
gcugcagggacaccaugagg

SEQ ID NO: 2487 - RNA, 20 nt, Artificial Sequence
  ELANE RNA Guide
ggacaccaugaggggccacg

SEQ ID NO: 2488 - RNA, 20 nt, Artificial Sequence
  ELANE RNA Guide
ggccccucauggugucccug

SEQ ID NO: 2489 - RNA, 20 nt, Artificial Sequence
  ELANE RNA Guide
gggacaccaugaggggccac

SEQ ID NO: 2490 - RNA, 20 nt, Artificial Sequence
  ELANE RNA Guide
guggccccucaugguguccc

SEQ ID NO: 2491 - RNA, 20 nt, Artificial Sequence
  ELANE RNA Guide
ugaggggccacgcguggggc

SEQ ID NO: 2492 - RNA, 20 nt, Artificial Sequence
  ELANE RNA Guide
ugcagggacaccaugagggg

SEQ ID NO: 2493 - RNA, 20 nt, Artificial Sequence
  ELANE RNA Guide
uggccccucauggugucccu

SEQ ID NO: 2494 - RNA, 21 nt, Artificial Sequence
  ELANE RNA Guide
acaccaugaggggccacgcgu

SEQ ID NO: 2495 - RNA, 21 nt, Artificial Sequence
  ELANE RNA Guide
accaugaggggccacgcgugg

SEQ ID NO: 2496 - RNA, 21 nt, Artificial Sequence
  ELANE RNA Guide
acgcguggccccucauggugu

SEQ ID NO: 2497 - RNA, 21 nt, Artificial Sequence
  ELANE RNA Guide
agcugcagggacaccaugagg

SEQ ID NO: 2498 - RNA, 21 nt, Artificial Sequence
  ELANE RNA Guide
agggacaccaugaggggccac

SEQ ID NO: 2499 - RNA, 21 nt, Artificial Sequence
  ELANE RNA Guide
augaggggccacgcguggggc

SEQ ID NO: 2500 - RNA, 21 nt, Artificial Sequence
  ELANE RNA Guide
caccaugaggggccacgcgug

SEQ ID NO: 2501 - RNA, 21 nt, Artificial Sequence
  ELANE RNA Guide
cacgcguggccccucauggug

SEQ ID NO: 2502 - RNA, 21 nt, Artificial Sequence
  ELANE RNA Guide
cagcugcagggacaccaugag

SEQ ID NO: 2503 - RNA, 21 nt, Artificial Sequence
  ELANE RNA Guide
cagggacaccaugaggggcca

SEQ ID NO: 2504 - RNA, 21 nt, Artificial Sequence
  ELANE RNA Guide
caugaggggccacgcgugggg

SEQ ID NO: 2505 - RNA, 21 nt, Artificial Sequence
  ELANE RNA Guide
ccacgcguggccccucauggu

SEQ ID NO: 2506 - RNA, 21 nt, Artificial Sequence
  ELANE RNA Guide
ccaugaggggccacgcguggg

SEQ ID NO: 2507 - RNA, 21 nt, Artificial Sequence
  ELANE RNA Guide
cccacgcguggccccucaugg

SEQ ID NO: 2508 - RNA, 21 nt, Artificial Sequence
  ELANE RNA Guide
ccccacgcguggccccucaug

SEQ ID NO: 2509 - RNA, 21 nt, Artificial Sequence
  ELANE RNA Guide
ccccucauggugucccugcag

SEQ ID NO: 2510 - RNA, 21 nt, Artificial Sequence
  ELANE RNA Guide
cccucauggugucccugcagc

SEQ ID NO: 2511 - RNA, 21 nt, Artificial Sequence
  ELANE RNA Guide
ccucauggugucccugcagcu

SEQ ID NO: 2512 - RNA, 21 nt, Artificial Sequence
  ELANE RNA Guide
cgcgcagcugcagggacacca

SEQ ID NO: 2513 - RNA, 21 nt, Artificial Sequence
  ELANE RNA Guide
cgcguggccccucaugguguc

SEQ ID NO: 2514 - RNA, 21 nt, Artificial Sequence
  ELANE RNA Guide
cguggccccucaugguguccc

SEQ ID NO: 2515 - RNA, 21 nt, Artificial Sequence
  ELANE RNA Guide
cugcagggacaccaugagggg

SEQ ID NO: 2516 - RNA, 21 nt, Artificial Sequence
  ELANE RNA Guide
gacaccaugaggggccacgcg

SEQ ID NO: 2517 - RNA, 21 nt, Artificial Sequence
  ELANE RNA Guide
gcagggacaccaugaggggcc

SEQ ID NO: 2518 - RNA, 21 nt, Artificial Sequence
  ELANE RNA Guide
gccccacgcguggccccucau

SEQ ID NO: 2519 - RNA, 21 nt, Artificial Sequence
  ELANE RNA Guide
gccccucauggugucccugca

SEQ ID NO: 2520 - RNA, 21 nt, Artificial Sequence
  ELANE RNA Guide
gcgcagcugcagggacaccau

SEQ ID NO: 2521 - RNA, 21 nt, Artificial Sequence
  ELANE RNA Guide
gcguggccccucauggugucc

SEQ ID NO: 2522 - RNA, 21 nt, Artificial Sequence
  ELANE RNA Guide
gcugcagggacaccaugaggg

SEQ ID NO: 2523 - RNA, 21 nt, Artificial Sequence
  ELANE RNA Guide
ggacaccaugaggggccacgc

SEQ ID NO: 2524 - RNA, 21 nt, Artificial Sequence
  ELANE RNA Guide
ggccccucauggugucccugc

SEQ ID NO: 2525 - RNA, 21 nt, Artificial Sequence
  ELANE RNA Guide
gggacaccaugaggggccacg

SEQ ID NO: 2526 - RNA, 21 nt, Artificial Sequence
  ELANE RNA Guide
guggccccucauggugucccu

SEQ ID NO: 2527 - RNA, 21 nt, Artificial Sequence
  ELANE RNA Guide
ugcagggacaccaugaggggc

SEQ ID NO: 2528 - RNA, 21 nt, Artificial Sequence
  ELANE RNA Guide
uggccccucauggugucccug

SEQ ID NO: 2529 - RNA, 22 nt, Artificial Sequence
  ELANE RNA Guide
acaccaugaggggccacgcgug

SEQ ID NO: 2530 - RNA, 22 nt, Artificial Sequence
  ELANE RNA Guide
accaugaggggccacgcguggg

SEQ ID NO: 2531 - RNA, 22 nt, Artificial Sequence
  ELANE RNA Guide
acgcguggccccucaugguguc

SEQ ID NO: 2532 - RNA, 22 nt, Artificial Sequence
  ELANE RNA Guide
agcugcagggacaccaugaggg

SEQ ID NO: 2533 - RNA, 22 nt, Artificial Sequence
  ELANE RNA Guide
agggacaccaugaggggccacg

SEQ ID NO: 2534 - RNA, 22 nt, Artificial Sequence
  ELANE RNA Guide
augaggggccacgcguggggcc

SEQ ID NO: 2535 - RNA, 22 nt, Artificial Sequence
  ELANE RNA Guide
caccaugaggggccacgcgugg

SEQ ID NO: 2536 - RNA, 22 nt, Artificial Sequence
  ELANE RNA Guide
cacgcguggccccucauggugu

SEQ ID NO: 2537 - RNA, 22 nt, Artificial Sequence
  ELANE RNA Guide
cagcugcagggacaccaugagg

SEQ ID NO: 2538 - RNA, 22 nt, Artificial Sequence
  ELANE RNA Guide
cagggacaccaugaggggccac

SEQ ID NO: 2539 - RNA, 22 nt, Artificial Sequence
  ELANE RNA Guide
caugaggggccacgcguggggc

SEQ ID NO: 2540 - RNA, 22 nt, Artificial Sequence
  ELANE RNA Guide
ccacgcguggccccucauggug

SEQ ID NO: 2541 - RNA, 22 nt, Artificial Sequence
  ELANE RNA Guide
ccaugaggggccacgcgugggg

SEQ ID NO: 2542 - RNA, 22 nt, Artificial Sequence
  ELANE RNA Guide
cccacgcguggccccucauggu

SEQ ID NO: 2543 - RNA, 22 nt, Artificial Sequence
  ELANE RNA Guide
ccccacgcguggccccucaugg

SEQ ID NO: 2544 - RNA, 22 nt, Artificial Sequence
  ELANE RNA Guide
ccccucauggugucccugcagc

SEQ ID NO: 2545 - RNA, 22 nt, Artificial Sequence
  ELANE RNA Guide
cccucauggugucccugcagcu

SEQ ID NO: 2546 - RNA, 22 nt, Artificial Sequence
  ELANE RNA Guide
ccgcgcagcugcagggacacca

SEQ ID NO: 2547 - RNA, 22 nt, Artificial Sequence
  ELANE RNA Guide
ccucauggugucccugcagcug

SEQ ID NO: 2548 - RNA, 22 nt, Artificial Sequence
  ELANE RNA Guide
cgcgcagcugcagggacaccau

SEQ ID NO: 2549 - RNA, 22 nt, Artificial Sequence
  ELANE RNA Guide
cgcguggccccucauggugucc

SEQ ID NO: 2550 - RNA, 22 nt, Artificial Sequence
  ELANE RNA Guide
cguggccccucauggugucccu

SEQ ID NO: 2551 - RNA, 22 nt, Artificial Sequence
  ELANE RNA Guide
cugcagggacaccaugaggggc

SEQ ID NO: 2552 - RNA, 22 nt, Artificial Sequence
  ELANE RNA Guide
gacaccaugaggggccacgcgu

SEQ ID NO: 2553 - RNA, 22 nt, Artificial Sequence
  ELANE RNA Guide
gcagcugcagggacaccaugag

SEQ ID NO: 2554 - RNA, 22 nt, Artificial Sequence
  ELANE RNA Guide
gcagggacaccaugaggggcca

SEQ ID NO: 2555 - RNA, 22 nt, Artificial Sequence
  ELANE RNA Guide
gccccacgcguggccccucaug

SEQ ID NO: 2556 - RNA, 22 nt, Artificial Sequence
  ELANE RNA Guide
gccccucauggugucccugcag

SEQ ID NO: 2557 - RNA, 22 nt, Artificial Sequence
  ELANE RNA Guide
gcguggccccucaugguguccc

SEQ ID NO: 2558 - RNA, 22 nt, Artificial Sequence
  ELANE RNA Guide
gcugcagggacaccaugagggg

SEQ ID NO: 2559 - RNA, 22 nt, Artificial Sequence
  ELANE RNA Guide
ggacaccaugaggggccacgcg

SEQ ID NO: 2560 - RNA, 22 nt, Artificial Sequence
  ELANE RNA Guide
ggccccacgcguggccccucau

SEQ ID NO: 2561 - RNA, 22 nt, Artificial Sequence
  ELANE RNA Guide
ggccccucauggugucccugca

SEQ ID NO: 2562 - RNA, 22 nt, Artificial Sequence
  ELANE RNA Guide
gggacaccaugaggggccacgc

SEQ ID NO: 2563 - RNA, 22 nt, Artificial Sequence
  ELANE RNA Guide
guggccccucauggugucccug

SEQ ID NO: 2564 - RNA, 22 nt, Artificial Sequence
  ELANE RNA Guide
ugcagggacaccaugaggggcc

SEQ ID NO: 2565 - RNA, 22 nt, Artificial Sequence
  ELANE RNA Guide
uggccccucauggugucccugc

SEQ ID NO: 2566 - RNA, 20 nt, Artificial Sequence
  ELANE RNA Guide
acaccauuaagggccacgcg

SEQ ID NO: 2567 - RNA, 20 nt, Artificial Sequence
  ELANE RNA Guide
accauuaagggccacgcgug

SEQ ID NO: 2568 - RNA, 20 nt, Artificial Sequence
  ELANE RNA Guide
acgcguggcccuuaauggug

SEQ ID NO: 2569 - RNA, 20 nt, Artificial Sequence
  ELANE RNA Guide
agcugcagggacaccauuaa

SEQ ID NO: 2570 - RNA, 20 nt, Artificial Sequence
  ELANE RNA Guide
agggacaccauuaagggcca

SEQ ID NO: 2571 - RNA, 20 nt, Artificial Sequence
  ELANE RNA Guide
auuaagggccacgcgugggg

SEQ ID NO: 2572 - RNA, 20 nt, Artificial Sequence
  ELANE RNA Guide
caccauuaagggccacgcgu

SEQ ID NO: 2573 - RNA, 20 nt, Artificial Sequence
  ELANE RNA Guide
cacgcguggcccuuaauggu

SEQ ID NO: 2574 - RNA, 20 nt, Artificial Sequence
  ELANE RNA Guide
cagcugcagggacaccauua

SEQ ID NO: 2575 - RNA, 20 nt, Artificial Sequence
  ELANE RNA Guide
cagggacaccauuaagggcc

SEQ ID NO: 2576 - RNA, 20 nt, Artificial Sequence
  ELANE RNA Guide
cauuaagggccacgcguggg

SEQ ID NO: 2577 - RNA, 20 nt, Artificial Sequence
  ELANE RNA Guide
ccacgcguggcccuuaaugg

SEQ ID NO: 2578 - RNA, 20 nt, Artificial Sequence
  ELANE RNA Guide
ccauuaagggccacgcgugg

SEQ ID NO: 2579 - RNA, 20 nt, Artificial Sequence
  ELANE RNA Guide
cccacgcguggcccuuaaug

SEQ ID NO: 2580 - RNA, 20 nt, Artificial Sequence
  ELANE RNA Guide
ccccacgcguggcccuuaau

SEQ ID NO: 2581 - RNA, 20 nt, Artificial Sequence
  ELANE RNA Guide
cccuuaauggugucccugca

SEQ ID NO: 2582 - RNA, 20 nt, Artificial Sequence
  ELANE RNA Guide
ccgcgcagcugcagggacac

SEQ ID NO: 2583 - RNA, 20 nt, Artificial Sequence
  ELANE RNA Guide
ccuuaauggugucccugcag

SEQ ID NO: 2584 - RNA, 20 nt, Artificial Sequence
  ELANE RNA Guide
cgcgcagcugcagggacacc

SEQ ID NO: 2585 - RNA, 20 nt, Artificial Sequence
  ELANE RNA Guide
cgcguggcccuuaauggugu

SEQ ID NO: 2586 - RNA, 20 nt, Artificial Sequence
  ELANE RNA Guide
cggccccacgcguggcccuu

SEQ ID NO: 2587 - RNA, 20 nt, Artificial Sequence
  ELANE RNA Guide
cguggcccuuaauggugucc

SEQ ID NO: 2588 - RNA, 20 nt, Artificial Sequence
  ELANE RNA Guide
cugcagggacaccauuaagg

SEQ ID NO: 2589 - RNA, 20 nt, Artificial Sequence
  ELANE RNA Guide
cuuaauggugucccugcagc

SEQ ID NO: 2590 - RNA, 20 nt, Artificial Sequence
  ELANE RNA Guide
gacaccauuaagggccacgc

SEQ ID NO: 2591 - RNA, 20 nt, Artificial Sequence
  ELANE RNA Guide
gcagcugcagggacaccauu

SEQ ID NO: 2592 - RNA, 20 nt, Artificial Sequence
  ELANE RNA Guide
gcagggacaccauuaagggc

SEQ ID NO: 2593 - RNA, 20 nt, Artificial Sequence
  ELANE RNA Guide
gccccacgcguggcccuuaa

SEQ ID NO: 2594 - RNA, 20 nt, Artificial Sequence
  ELANE RNA Guide
gcccuuaauggugucccugc

SEQ ID NO: 2595 - RNA, 20 nt, Artificial Sequence
  ELANE RNA Guide
gcguggcccuuaaugguguc

SEQ ID NO: 2596 - RNA, 20 nt, Artificial Sequence
  ELANE RNA Guide
gcugcagggacaccauuaag

SEQ ID NO: 2597 - RNA, 20 nt, Artificial Sequence
  ELANE RNA Guide
ggacaccauuaagggccacg

SEQ ID NO: 2598 - RNA, 20 nt, Artificial Sequence
  ELANE RNA Guide
ggccccacgcguggcccuua

SEQ ID NO: 2599 - RNA, 20 nt, Artificial Sequence
  ELANE RNA Guide
ggcccuuaauggugucccug

SEQ ID NO: 2600 - RNA, 20 nt, Artificial Sequence
  ELANE RNA Guide
gggacaccauuaagggccac

SEQ ID NO: 2601 - RNA, 20 nt, Artificial Sequence
  ELANE RNA Guide
guggcccuuaaugguguccc

SEQ ID NO: 2602 - RNA, 20 nt, Artificial Sequence
  ELANE RNA Guide
uaauggugucccugcagcug

SEQ ID NO: 2603 - RNA, 20 nt, Artificial Sequence
  ELANE RNA Guide
ugcagggacaccauuaaggg

SEQ ID NO: 2604 - RNA, 20 nt, Artificial Sequence
  ELANE RNA Guide
uggcccuuaauggugucccu

SEQ ID NO: 2605 - RNA, 20 nt, Artificial Sequence
  ELANE RNA Guide
uuaagggccacgcguggggc

SEQ ID NO: 2606 - RNA, 20 nt, Artificial Sequence
  ELANE RNA Guide
uuaauggugucccugcagcu

SEQ ID NO: 2607 - RNA, 21 nt, Artificial Sequence
  ELANE RNA Guide
acaccauuaagggccacgcgu

SEQ ID NO: 2608 - RNA, 21 nt, Artificial Sequence
  ELANE RNA Guide
accauuaagggccacgcgugg

SEQ ID NO: 2609 - RNA, 21 nt, Artificial Sequence
  ELANE RNA Guide
acgcguggcccuuaauggugu

SEQ ID NO: 2610 - RNA, 21 nt, Artificial Sequence
  ELANE RNA Guide
agcugcagggacaccauuaag

SEQ ID NO: 2611 - RNA, 21 nt, Artificial Sequence
  ELANE RNA Guide
agggacaccauuaagggccac

SEQ ID NO: 2612 - RNA, 21 nt, Artificial Sequence
  ELANE RNA Guide
auuaagggccacgcguggggc

SEQ ID NO: 2613 - RNA, 21 nt, Artificial Sequence
  ELANE RNA Guide
caccauuaagggccacgcgug

SEQ ID NO: 2614 - RNA, 21 nt, Artificial Sequence
  ELANE RNA Guide
cacgcguggcccuuaauggug

SEQ ID NO: 2615 - RNA, 21 nt, Artificial Sequence
  ELANE RNA Guide
cagcugcagggacaccauuaa

SEQ ID NO: 2616 - RNA, 21 nt, Artificial Sequence
  ELANE RNA Guide
cagggacaccauuaagggcca

SEQ ID NO: 2617 - RNA, 21 nt, Artificial Sequence
  ELANE RNA Guide
cauuaagggccacgcgugggg

SEQ ID NO: 2618 - RNA, 21 nt, Artificial Sequence
  ELANE RNA Guide
ccacgcguggcccuuaauggu

SEQ ID NO: 2619 - RNA, 21 nt, Artificial Sequence
  ELANE RNA Guide
ccauuaagggccacgcguggg

SEQ ID NO: 2620 - RNA, 21 nt, Artificial Sequence
  ELANE RNA Guide
cccacgcguggcccuuaaugg

SEQ ID NO: 2621 - RNA, 21 nt, Artificial Sequence
  ELANE RNA Guide
ccccacgcguggcccuuaaug

SEQ ID NO: 2622 - RNA, 21 nt, Artificial Sequence
  ELANE RNA Guide
cccuuaauggugucccugcag

SEQ ID NO: 2623 - RNA, 21 nt, Artificial Sequence
  ELANE RNA Guide
ccgcgcagcugcagggacacc

SEQ ID NO: 2624 - RNA, 21 nt, Artificial Sequence
  ELANE RNA Guide
ccuuaauggugucccugcagc

SEQ ID NO: 2625 - RNA, 21 nt, Artificial Sequence
  ELANE RNA Guide
cgcagcugcagggacaccauu

SEQ ID NO: 2626 - RNA, 21 nt, Artificial Sequence
  ELANE RNA Guide
cgcguggcccuuaaugguguc

SEQ ID NO: 2627 - RNA, 21 nt, Artificial Sequence
  ELANE RNA Guide
cggccccacgcguggcccuua

SEQ ID NO: 2628 - RNA, 21 nt, Artificial Sequence
  ELANE RNA Guide
cguggcccuuaaugguguccc

SEQ ID NO: 2629 - RNA, 21 nt, Artificial Sequence
  ELANE RNA Guide
cugcagggacaccauuaaggg

SEQ ID NO: 2630 - RNA, 21 nt, Artificial Sequence
  ELANE RNA Guide
cuuaauggugucccugcagcu

SEQ ID NO: 2631 - RNA, 21 nt, Artificial Sequence
  ELANE RNA Guide
gacaccauuaagggccacgcg

SEQ ID NO: 2632 - RNA, 21 nt, Artificial Sequence
  ELANE RNA Guide
gcagcugcagggacaccauua

SEQ ID NO: 2633 - RNA, 21 nt, Artificial Sequence
  ELANE RNA Guide
gcagggacaccauuaagggcc

SEQ ID NO: 2634 - RNA, 21 nt, Artificial Sequence
  ELANE RNA Guide
gccccacgcguggcccuuaau

SEQ ID NO: 2635 - RNA, 21 nt, Artificial Sequence
  ELANE RNA Guide
gcccuuaauggugucccugca

SEQ ID NO: 2636 - RNA, 21 nt, Artificial Sequence
  ELANE RNA Guide
gcguggcccuuaauggugucc

SEQ ID NO: 2637 - RNA, 21 nt, Artificial Sequence
  ELANE RNA Guide
gcugcagggacaccauuaagg

SEQ ID NO: 2638 - RNA, 21 nt, Artificial Sequence
  ELANE RNA Guide
ggacaccauuaagggccacgc

SEQ ID NO: 2639 - RNA, 21 nt, Artificial Sequence
  ELANE RNA Guide
ggccccacgcguggcccuuaa

SEQ ID NO: 2640 - RNA, 21 nt, Artificial Sequence
  ELANE RNA Guide
ggcccuuaauggugucccugc

SEQ ID NO: 2641 - RNA, 21 nt, Artificial Sequence
  ELANE RNA Guide
gggacaccauuaagggccacg

SEQ ID NO: 2642 - RNA, 21 nt, Artificial Sequence
  ELANE RNA Guide
guggcccuuaauggugucccu

SEQ ID NO: 2643 - RNA, 21 nt, Artificial Sequence
  ELANE RNA Guide
uaauggugucccugcagcugc

SEQ ID NO: 2644 - RNA, 21 nt, Artificial Sequence
  ELANE RNA Guide
uccgcgcagcugcagggacac

SEQ ID NO: 2645 - RNA, 21 nt, Artificial Sequence
  ELANE RNA Guide
ugcagggacaccauuaagggc

SEQ ID NO: 2646 - RNA, 21 nt, Artificial Sequence
  ELANE RNA Guide
uggcccuuaauggugucccug

SEQ ID NO: 2647 - RNA, 21 nt, Artificial Sequence
  ELANE RNA Guide
uuaagggccacgcguggggcc

SEQ ID NO: 2648 - RNA, 21 nt, Artificial Sequence
  ELANE RNA Guide
uuaauggugucccugcagcug

SEQ ID NO: 2649 - RNA, 22 nt, Artificial Sequence
  ELANE RNA Guide
acaccauuaagggccacgcgug

SEQ ID NO: 2650 - RNA, 22 nt, Artificial Sequence
  ELANE RNA Guide
accauuaagggccacgcguggg

SEQ ID NO: 2651 - RNA, 22 nt, Artificial Sequence
  ELANE RNA Guide
acgcguggcccuuaaugguguc

SEQ ID NO: 2652 - RNA, 22 nt, Artificial Sequence
  ELANE RNA Guide
agcugcagggacaccauuaagg

SEQ ID NO: 2653 - RNA, 22 nt, Artificial Sequence
  ELANE RNA Guide
agggacaccauuaagggccacg

SEQ ID NO: 2654 - RNA, 22 nt, Artificial Sequence
  ELANE RNA Guide
auuaagggccacgcguggggcc

SEQ ID NO: 2655 - RNA, 22 nt, Artificial Sequence
  ELANE RNA Guide
caccauuaagggccacgcgugg

SEQ ID NO: 2656 - RNA, 22 nt, Artificial Sequence
  ELANE RNA Guide
cacgcguggcccuuaauggugu

SEQ ID NO: 2657 - RNA, 22 nt, Artificial Sequence
  ELANE RNA Guide
cagcugcagggacaccauuaag

SEQ ID NO: 2658 - RNA, 22 nt, Artificial Sequence
  ELANE RNA Guide
cagggacaccauuaagggccac

SEQ ID NO: 2659 - RNA, 22 nt, Artificial Sequence
  ELANE RNA Guide
cauuaagggccacgcguggggc

SEQ ID NO: 2660 - RNA, 22 nt, Artificial Sequence
  ELANE RNA Guide
ccacgcguggcccuuaauggug

SEQ ID NO: 2661 - RNA, 22 nt, Artificial Sequence
  ELANE RNA Guide
ccauuaagggccacgcgugggg

SEQ ID NO: 2662 - RNA, 22 nt, Artificial Sequence
  ELANE RNA Guide
cccacgcguggcccuuaauggu

SEQ ID NO: 2663 - RNA, 22 nt, Artificial Sequence
  ELANE RNA Guide
ccccacgcguggcccuuaaugg

SEQ ID NO: 2664 - RNA, 22 nt, Artificial Sequence
  ELANE RNA Guide
cccuuaauggugucccugcagc

SEQ ID NO: 2665 - RNA, 22 nt, Artificial Sequence
  ELANE RNA Guide
ccuuaauggugucccugcagcu

SEQ ID NO: 2666 - RNA, 22 nt, Artificial Sequence
  ELANE RNA Guide
cgcagcugcagggacaccauua

SEQ ID NO: 2667 - RNA, 22 nt, Artificial Sequence
  ELANE RNA Guide
cgcguggcccuuaauggugucc

SEQ ID NO: 2668 - RNA, 22 nt, Artificial Sequence
  ELANE RNA Guide
cggccccacgcguggcccuuaa

SEQ ID NO: 2669 - RNA, 22 nt, Artificial Sequence
  ELANE RNA Guide
cguggcccuuaauggugucccu

SEQ ID NO: 2670 - RNA, 22 nt, Artificial Sequence
  ELANE RNA Guide
cuccgcgcagcugcagggacac

SEQ ID NO: 2671 - RNA, 22 nt, Artificial Sequence
  ELANE RNA Guide
cugcagggacaccauuaagggc

SEQ ID NO: 2672 - RNA, 22 nt, Artificial Sequence
  ELANE RNA Guide
cuuaauggugucccugcagcug

SEQ ID NO: 2673 - RNA, 22 nt, Artificial Sequence
  ELANE RNA Guide
gacaccauuaagggccacgcgu

SEQ ID NO: 2674 - RNA, 22 nt, Artificial Sequence
  ELANE RNA Guide
gcagcugcagggacaccauuaa

SEQ ID NO: 2675 - RNA, 22 nt, Artificial Sequence
  ELANE RNA Guide
gcagggacaccauuaagggcca

SEQ ID NO: 2676 - RNA, 22 nt, Artificial Sequence
  ELANE RNA Guide
gccccacgcguggcccuuaaug

SEQ ID NO: 2677 - RNA, 22 nt, Artificial Sequence
  ELANE RNA Guide
gcccuuaauggugucccugcag

SEQ ID NO: 2678 - RNA, 22 nt, Artificial Sequence
  ELANE RNA Guide
gcgcagcugcagggacaccauu

SEQ ID NO: 2679 - RNA, 22 nt, Artificial Sequence
  ELANE RNA Guide
gcggccccacgcguggcccuua

SEQ ID NO: 2680 - RNA, 22 nt, Artificial Sequence
  ELANE RNA Guide
gcguggcccuuaaugguguccc

SEQ ID NO: 2681 - RNA, 22 nt, Artificial Sequence
  ELANE RNA Guide
gcugcagggacaccauuaaggg

SEQ ID NO: 2682 - RNA, 22 nt, Artificial Sequence
  ELANE RNA Guide
ggacaccauuaagggccacgcg

SEQ ID NO: 2683 - RNA, 22 nt, Artificial Sequence
  ELANE RNA Guide
ggccccacgcguggcccuuaau

SEQ ID NO: 2684 - RNA, 22 nt, Artificial Sequence
  ELANE RNA Guide
ggcccuuaauggugucccugca

SEQ ID NO: 2685 - RNA, 22 nt, Artificial Sequence
  ELANE RNA Guide
gggacaccauuaagggccacgc

SEQ ID NO: 2686 - RNA, 22 nt, Artificial Sequence
  ELANE RNA Guide
guggcccuuaauggugucccug

SEQ ID NO: 2687 - RNA, 22 nt, Artificial Sequence
  ELANE RNA Guide
uaauggugucccugcagcugcg

SEQ ID NO: 2688 - RNA, 22 nt, Artificial Sequence
  ELANE RNA Guide
uccgcgcagcugcagggacacc

SEQ ID NO: 2689 - RNA, 22 nt, Artificial Sequence
  ELANE RNA Guide
ugcagggacaccauuaagggcc

SEQ ID NO: 2690 - RNA, 22 nt, Artificial Sequence
  ELANE RNA Guide
uggcccuuaauggugucccugc

SEQ ID NO: 2691 - RNA, 22 nt, Artificial Sequence
  ELANE RNA Guide
uuaagggccacgcguggggccg

SEQ ID NO: 2692 - RNA, 22 nt, Artificial Sequence
  ELANE RNA Guide
uuaauggugucccugcagcugc

SEQ ID NO: 2693 - RNA, 20 nt, Artificial Sequence
  ELANE RNA Guide
acacccugaagggccacgcg

SEQ ID NO: 2694 - RNA, 20 nt, Artificial Sequence
  ELANE RNA Guide
acccugaagggccacgcgug

SEQ ID NO: 2695 - RNA, 20 nt, Artificial Sequence
  ELANE RNA Guide
acgcguggcccuucagggug

SEQ ID NO: 2696 - RNA, 20 nt, Artificial Sequence
  ELANE RNA Guide
agcugcagggacacccugaa

SEQ ID NO: 2697 - RNA, 20 nt, Artificial Sequence
  ELANE RNA Guide
agggacacccugaagggcca

SEQ ID NO: 2698 - RNA, 20 nt, Artificial Sequence
  ELANE RNA Guide
agggugucccugcagcugcg

SEQ ID NO: 2699 - RNA, 20 nt, Artificial Sequence
  ELANE RNA Guide
cacccugaagggccacgcgu

SEQ ID NO: 2700 - RNA, 20 nt, Artificial Sequence
  ELANE RNA Guide
cacgcguggcccuucagggu

SEQ ID NO: 2701 - RNA, 20 nt, Artificial Sequence
  ELANE RNA Guide
cagcugcagggacacccuga

SEQ ID NO: 2702 - RNA, 20 nt, Artificial Sequence
  ELANE RNA Guide
cagggacacccugaagggcc

SEQ ID NO: 2703 - RNA, 20 nt, Artificial Sequence
  ELANE RNA Guide
cagggugucccugcagcugc

SEQ ID NO: 2704 - RNA, 20 nt, Artificial Sequence
  ELANE RNA Guide
ccacgcguggcccuucaggg

SEQ ID NO: 2705 - RNA, 20 nt, Artificial Sequence
  ELANE RNA Guide
cccacgcguggcccuucagg

SEQ ID NO: 2706 - RNA, 20 nt, Artificial Sequence
  ELANE RNA Guide
ccccacgcguggcccuucag

SEQ ID NO: 2707 - RNA, 20 nt, Artificial Sequence
  ELANE RNA Guide
cccugaagggccacgcgugg

SEQ ID NO: 2708 - RNA, 20 nt, Artificial Sequence
  ELANE RNA Guide
cccuucagggugucccugca

SEQ ID NO: 2709 - RNA, 20 nt, Artificial Sequence
  ELANE RNA Guide
ccugaagggccacgcguggg

SEQ ID NO: 2710 - RNA, 20 nt, Artificial Sequence
  ELANE RNA Guide
ccuucagggugucccugcag

SEQ ID NO: 2711 - RNA, 20 nt, Artificial Sequence
  ELANE RNA Guide
cgcagcugcagggacacccu

SEQ ID NO: 2712 - RNA, 20 nt, Artificial Sequence
  ELANE RNA Guide
cgcguggcccuucagggugu

SEQ ID NO: 2713 - RNA, 20 nt, Artificial Sequence
  ELANE RNA Guide
cguggcccuucagggugucc

SEQ ID NO: 2714 - RNA, 20 nt, Artificial Sequence
  ELANE RNA Guide
cuccgcgcagcugcagggac

SEQ ID NO: 2715 - RNA, 20 nt, Artificial Sequence
  ELANE RNA Guide
cugcagggacacccugaagg

SEQ ID NO: 2716 - RNA, 20 nt, Artificial Sequence
  ELANE RNA Guide
cuucagggugucccugcagc

SEQ ID NO: 2717 - RNA, 20 nt, Artificial Sequence
  ELANE RNA Guide
gacacccugaagggccacgc

SEQ ID NO: 2718 - RNA, 20 nt, Artificial Sequence
  ELANE RNA Guide
gcagcugcagggacacccug

SEQ ID NO: 2719 - RNA, 20 nt, Artificial Sequence
  ELANE RNA Guide
gcagggacacccugaagggc

SEQ ID NO: 2720 - RNA, 20 nt, Artificial Sequence
  ELANE RNA Guide
gccccacgcguggcccuuca

SEQ ID NO: 2721 - RNA, 20 nt, Artificial Sequence
  ELANE RNA Guide
gcccuucagggugucccugc

SEQ ID NO: 2722 - RNA, 20 nt, Artificial Sequence
  ELANE RNA Guide
gcgcagcugcagggacaccc

SEQ ID NO: 2723 - RNA, 20 nt, Artificial Sequence
  ELANE RNA Guide
gcguggcccuucaggguguc

SEQ ID NO: 2724 - RNA, 20 nt, Artificial Sequence
  ELANE RNA Guide
gcugcagggacacccugaag

SEQ ID NO: 2725 - RNA, 20 nt, Artificial Sequence
  ELANE RNA Guide
ggacacccugaagggccacg

SEQ ID NO: 2726 - RNA, 20 nt, Artificial Sequence
  ELANE RNA Guide
ggccccacgcguggcccuuc

SEQ ID NO: 2727 - RNA, 20 nt, Artificial Sequence
  ELANE RNA Guide
ggcccuucagggugucccug

SEQ ID NO: 2728 - RNA, 20 nt, Artificial Sequence
  ELANE RNA Guide
gggacacccugaagggccac

SEQ ID NO: 2729 - RNA, 20 nt, Artificial Sequence
  ELANE RNA Guide
guggcccuucaggguguccc

SEQ ID NO: 2730 - RNA, 20 nt, Artificial Sequence
  ELANE RNA Guide
ucagggugucccugcagcug

SEQ ID NO: 2731 - RNA, 20 nt, Artificial Sequence
  ELANE RNA Guide
uccgcgcagcugcagggaca

SEQ ID NO: 2732 - RNA, 20 nt, Artificial Sequence
  ELANE RNA Guide
ugcagggacacccugaaggg

SEQ ID NO: 2733 - RNA, 20 nt, Artificial Sequence
  ELANE RNA Guide
uggcccuucagggugucccu

SEQ ID NO: 2734 - RNA, 20 nt, Artificial Sequence
  ELANE RNA Guide
uucagggugucccugcagcu

SEQ ID NO: 2735 - RNA, 21 nt, Artificial Sequence
  ELANE RNA Guide
acacccugaagggccacgcgu

SEQ ID NO: 2736 - RNA, 21 nt, Artificial Sequence
  ELANE RNA Guide
acccugaagggccacgcgugg

SEQ ID NO: 2737 - RNA, 21 nt, Artificial Sequence
  ELANE RNA Guide
acgcguggcccuucagggugu

SEQ ID NO: 2738 - RNA, 21 nt, Artificial Sequence
  ELANE RNA Guide
agcugcagggacacccugaag

SEQ ID NO: 2739 - RNA, 21 nt, Artificial Sequence
  ELANE RNA Guide
agggacacccugaagggccac

SEQ ID NO: 2740 - RNA, 21 nt, Artificial Sequence
  ELANE RNA Guide
agggugucccugcagcugcgc

SEQ ID NO: 2741 - RNA, 21 nt, Artificial Sequence
  ELANE RNA Guide
cacccugaagggccacgcgug

SEQ ID NO: 2742 - RNA, 21 nt, Artificial Sequence
  ELANE RNA Guide
cacgcguggcccuucagggug

SEQ ID NO: 2743 - RNA, 21 nt, Artificial Sequence
  ELANE RNA Guide
cagcugcagggacacccugaa

SEQ ID NO: 2744 - RNA, 21 nt, Artificial Sequence
  ELANE RNA Guide
cagggacacccugaagggcca

SEQ ID NO: 2745 - RNA, 21 nt, Artificial Sequence
  ELANE RNA Guide
cagggugucccugcagcugcg

SEQ ID NO: 2746 - RNA, 21 nt, Artificial Sequence
  ELANE RNA Guide
ccacgcguggcccuucagggu

SEQ ID NO: 2747 - RNA, 21 nt, Artificial Sequence
  ELANE RNA Guide
cccacgcguggcccuucaggg

SEQ ID NO: 2748 - RNA, 21 nt, Artificial Sequence
  ELANE RNA Guide
ccccacgcguggcccuucagg

SEQ ID NO: 2749 - RNA, 21 nt, Artificial Sequence
  ELANE RNA Guide
cccugaagggccacgcguggg

SEQ ID NO: 2750 - RNA, 21 nt, Artificial Sequence
  ELANE RNA Guide
cccuucagggugucccugcag

SEQ ID NO: 2751 - RNA, 21 nt, Artificial Sequence
  ELANE RNA Guide
ccuccgcgcagcugcagggac

SEQ ID NO: 2752 - RNA, 21 nt, Artificial Sequence
  ELANE RNA Guide
ccugaagggccacgcgugggg

SEQ ID NO: 2753 - RNA, 21 nt, Artificial Sequence
  ELANE RNA Guide
ccuucagggugucccugcagc

SEQ ID NO: 2754 - RNA, 21 nt, Artificial Sequence
  ELANE RNA Guide
cgcagcugcagggacacccug

SEQ ID NO: 2755 - RNA, 21 nt, Artificial Sequence
  ELANE RNA Guide
cgcgcagcugcagggacaccc

SEQ ID NO: 2756 - RNA, 21 nt, Artificial Sequence
  ELANE RNA Guide
cgcguggcccuucaggguguc

SEQ ID NO: 2757 - RNA, 21 nt, Artificial Sequence
  ELANE RNA Guide
cguggcccuucaggguguccc

SEQ ID NO: 2758 - RNA, 21 nt, Artificial Sequence
  ELANE RNA Guide
cuccgcgcagcugcagggaca

SEQ ID NO: 2759 - RNA, 21 nt, Artificial Sequence
  ELANE RNA Guide
cugcagggacacccugaaggg

SEQ ID NO: 2760 - RNA, 21 nt, Artificial Sequence
  ELANE RNA Guide
cuucagggugucccugcagcu

SEQ ID NO: 2761 - RNA, 21 nt, Artificial Sequence
  ELANE RNA Guide
gacacccugaagggccacgcg

SEQ ID NO: 2762 - RNA, 21 nt, Artificial Sequence
  ELANE RNA Guide
gcagcugcagggacacccuga

SEQ ID NO: 2763 - RNA, 21 nt, Artificial Sequence
  ELANE RNA Guide
gcagggacacccugaagggcc

SEQ ID NO: 2764 - RNA, 21 nt, Artificial Sequence
  ELANE RNA Guide
gccccacgcguggcccuucag

SEQ ID NO: 2765 - RNA, 21 nt, Artificial Sequence
  ELANE RNA Guide
gcccuucagggugucccugca

SEQ ID NO: 2766 - RNA, 21 nt, Artificial Sequence
  ELANE RNA Guide
gcgcagcugcagggacacccu

SEQ ID NO: 2767 - RNA, 21 nt, Artificial Sequence
  ELANE RNA Guide
gcguggcccuucagggugucc

SEQ ID NO: 2768 - RNA, 21 nt, Artificial Sequence
  ELANE RNA Guide
gcugcagggacacccugaagg

SEQ ID NO: 2769 - RNA, 21 nt, Artificial Sequence
  ELANE RNA Guide
ggacacccugaagggccacgc

SEQ ID NO: 2770 - RNA, 21 nt, Artificial Sequence
  ELANE RNA Guide
ggccccacgcguggcccuuca

SEQ ID NO: 2771 - RNA, 21 nt, Artificial Sequence
  ELANE RNA Guide
ggcccuucagggugucccugc

SEQ ID NO: 2772 - RNA, 21 nt, Artificial Sequence
  ELANE RNA Guide
gggacacccugaagggccacg

SEQ ID NO: 2773 - RNA, 21 nt, Artificial Sequence
  ELANE RNA Guide
guggcccuucagggugucccu

SEQ ID NO: 2774 - RNA, 21 nt, Artificial Sequence
  ELANE RNA Guide
ucagggugucccugcagcugc

SEQ ID NO: 2775 - RNA, 21 nt, Artificial Sequence
  ELANE RNA Guide
ugcagggacacccugaagggc

SEQ ID NO: 2776 - RNA, 21 nt, Artificial Sequence
  ELANE RNA Guide
uggcccuucagggugucccug

SEQ ID NO: 2777 - RNA, 21 nt, Artificial Sequence
  ELANE RNA Guide
uucagggugucccugcagcug

SEQ ID NO: 2778 - RNA, 22 nt, Artificial Sequence
  ELANE RNA Guide
acacccugaagggccacgcgug

SEQ ID NO: 2779 - RNA, 22 nt, Artificial Sequence
  ELANE RNA Guide
acccugaagggccacgcguggg

SEQ ID NO: 2780 - RNA, 22 nt, Artificial Sequence
  ELANE RNA Guide
acgcguggcccuucaggguguc

SEQ ID NO: 2781 - RNA, 22 nt, Artificial Sequence
  ELANE RNA Guide
agcugcagggacacccugaagg

SEQ ID NO: 2782 - RNA, 22 nt, Artificial Sequence
  ELANE RNA Guide
agggacacccugaagggccacg

SEQ ID NO: 2783 - RNA, 22 nt, Artificial Sequence
  ELANE RNA Guide
agggugucccugcagcugcgcg

SEQ ID NO: 2784 - RNA, 22 nt, Artificial Sequence
  ELANE RNA Guide
cacccugaagggccacgcgugg

SEQ ID NO: 2785 - RNA, 22 nt, Artificial Sequence
  ELANE RNA Guide
cacgcguggcccuucagggugu

SEQ ID NO: 2786 - RNA, 22 nt, Artificial Sequence
  ELANE RNA Guide
cagcugcagggacacccugaag

SEQ ID NO: 2787 - RNA, 22 nt, Artificial Sequence
  ELANE RNA Guide
cagggacacccugaagggccac

SEQ ID NO: 2788 - RNA, 22 nt, Artificial Sequence
  ELANE RNA Guide
cagggugucccugcagcugcgc

SEQ ID NO: 2789 - RNA, 22 nt, Artificial Sequence
  ELANE RNA Guide
ccacgcguggcccuucagggug

SEQ ID NO: 2790 - RNA, 22 nt, Artificial Sequence
  ELANE RNA Guide
cccacgcguggcccuucagggu

SEQ ID NO: 2791 - RNA, 22 nt, Artificial Sequence
  ELANE RNA Guide
ccccacgcguggcccuucaggg

SEQ ID NO: 2792 - RNA, 22 nt, Artificial Sequence
  ELANE RNA Guide
cccugaagggccacgcgugggg

SEQ ID NO: 2793 - RNA, 22 nt, Artificial Sequence
  ELANE RNA Guide
cccuucagggugucccugcagc

SEQ ID NO: 2794 - RNA, 22 nt, Artificial Sequence
  ELANE RNA Guide
ccgcgcagcugcagggacaccc

SEQ ID NO: 2795 - RNA, 22 nt, Artificial Sequence
  ELANE RNA Guide
ccuccgcgcagcugcagggaca

SEQ ID NO: 2796 - RNA, 22 nt, Artificial Sequence
  ELANE RNA Guide
ccugaagggccacgcguggggc

SEQ ID NO: 2797 - RNA, 22 nt, Artificial Sequence
  ELANE RNA Guide
ccuucagggugucccugcagcu

SEQ ID NO: 2798 - RNA, 22 nt, Artificial Sequence
  ELANE RNA Guide
cgcagcugcagggacacccuga

SEQ ID NO: 2799 - RNA, 22 nt, Artificial Sequence
  ELANE RNA Guide
cgcgcagcugcagggacacccu

SEQ ID NO: 2800 - RNA, 22 nt, Artificial Sequence
  ELANE RNA Guide
cgcguggcccuucagggugucc

SEQ ID NO: 2801 - RNA, 22 nt, Artificial Sequence
  ELANE RNA Guide
cggccccacgcguggcccuuca

SEQ ID NO: 2802 - RNA, 22 nt, Artificial Sequence
  ELANE RNA Guide
cguggcccuucagggugucccu

SEQ ID NO: 2803 - RNA, 22 nt, Artificial Sequence
  ELANE RNA Guide
cugcagggacacccugaagggc

SEQ ID NO: 2804 - RNA, 22 nt, Artificial Sequence
  ELANE RNA Guide
cuucagggugucccugcagcug

SEQ ID NO: 2805 - RNA, 22 nt, Artificial Sequence
  ELANE RNA Guide
gacacccugaagggccacgcgu

SEQ ID NO: 2806 - RNA, 22 nt, Artificial Sequence
  ELANE RNA Guide
gcagcugcagggacacccugaa

SEQ ID NO: 2807 - RNA, 22 nt, Artificial Sequence
  ELANE RNA Guide
gcagggacacccugaagggcca

SEQ ID NO: 2808 - RNA, 22 nt, Artificial Sequence
  ELANE RNA Guide
gccccacgcguggcccuucagg

SEQ ID NO: 2809 - RNA, 22 nt, Artificial Sequence
  ELANE RNA Guide
gcccuucagggugucccugcag

SEQ ID NO: 2810 - RNA, 22 nt, Artificial Sequence
  ELANE RNA Guide
gccuccgcgcagcugcagggac

SEQ ID NO: 2811 - RNA, 22 nt, Artificial Sequence
  ELANE RNA Guide
gcgcagcugcagggacacccug

SEQ ID NO: 2812 - RNA, 22 nt, Artificial Sequence
  ELANE RNA Guide
gcguggcccuucaggguguccc

SEQ ID NO: 2813 - RNA, 22 nt, Artificial Sequence
  ELANE RNA Guide
gcugcagggacacccugaaggg

SEQ ID NO: 2814 - RNA, 22 nt, Artificial Sequence
  ELANE RNA Guide
ggacacccugaagggccacgcg

SEQ ID NO: 2815 - RNA, 22 nt, Artificial Sequence
  ELANE RNA Guide
ggccccacgcguggcccuucag

SEQ ID NO: 2816 - RNA, 22 nt, Artificial Sequence
  ELANE RNA Guide
ggcccuucagggugucccugca

SEQ ID NO: 2817 - RNA, 22 nt, Artificial Sequence
  ELANE RNA Guide
gggacacccugaagggccacgc

SEQ ID NO: 2818 - RNA, 22 nt, Artificial Sequence
  ELANE RNA Guide
guggcccuucagggugucccug

SEQ ID NO: 2819 - RNA, 22 nt, Artificial Sequence
  ELANE RNA Guide
ucagggugucccugcagcugcg

SEQ ID NO: 2820 - RNA, 22 nt, Artificial Sequence
  ELANE RNA Guide
ugcagggacacccugaagggcc

SEQ ID NO: 2821 - RNA, 22 nt, Artificial Sequence
  ELANE RNA Guide
uggcccuucagggugucccugc

SEQ ID NO: 2822 - RNA, 22 nt, Artificial Sequence
  ELANE RNA Guide
uucagggugucccugcagcugc

SEQ ID NO: 2823 - RNA, 20 nt, Artificial Sequence
  ELANE RNA Guide
aaguggccuccgcgcagcug

SEQ ID NO: 2824 - RNA, 20 nt, Artificial Sequence
  ELANE RNA Guide
acgcguggcccuucauggug

SEQ ID NO: 2825 - RNA, 20 nt, Artificial Sequence
  ELANE RNA Guide
agcugcaccaugaagggcca

SEQ ID NO: 2826 - RNA, 20 nt, Artificial Sequence
  ELANE RNA Guide
aguggccuccgcgcagcugc

SEQ ID NO: 2827 - RNA, 20 nt, Artificial Sequence
  ELANE RNA Guide
auggugcagcugcgcggagg

SEQ ID NO: 2828 - RNA, 20 nt, Artificial Sequence
  ELANE RNA Guide
cacgcguggcccuucauggu

SEQ ID NO: 2829 - RNA, 20 nt, Artificial Sequence
  ELANE RNA Guide
cagcugcaccaugaagggcc

SEQ ID NO: 2830 - RNA, 20 nt, Artificial Sequence
  ELANE RNA Guide
cauggugcagcugcgcggag

SEQ ID NO: 2831 - RNA, 20 nt, Artificial Sequence
  ELANE RNA Guide
ccacgcguggcccuucaugg

SEQ ID NO: 2832 - RNA, 20 nt, Artificial Sequence
  ELANE RNA Guide
cccacgcguggcccuucaug

SEQ ID NO: 2833 - RNA, 20 nt, Artificial Sequence
  ELANE RNA Guide
cccuucauggugcagcugcg

SEQ ID NO: 2834 - RNA, 20 nt, Artificial Sequence
  ELANE RNA Guide
ccgcgcagcugcaccaugaa

SEQ ID NO: 2835 - RNA, 20 nt, Artificial Sequence
  ELANE RNA Guide
ccuccgcgcagcugcaccau

SEQ ID NO: 2836 - RNA, 20 nt, Artificial Sequence
  ELANE RNA Guide
ccuucauggugcagcugcgc

SEQ ID NO: 2837 - RNA, 20 nt, Artificial Sequence
  ELANE RNA Guide
cgcagcugcaccaugaaggg

SEQ ID NO: 2838 - RNA, 20 nt, Artificial Sequence
  ELANE RNA Guide
cgcgcagcugcaccaugaag

SEQ ID NO: 2839 - RNA, 20 nt, Artificial Sequence
  ELANE RNA Guide
cgcguggcccuucauggugc

SEQ ID NO: 2840 - RNA, 20 nt, Artificial Sequence
  ELANE RNA Guide
cguggcccuucauggugcag

SEQ ID NO: 2841 - RNA, 20 nt, Artificial Sequence
  ELANE RNA Guide
cuccgcgcagcugcaccaug

SEQ ID NO: 2842 - RNA, 20 nt, Artificial Sequence
  ELANE RNA Guide
cugcaccaugaagggccacg

SEQ ID NO: 2843 - RNA, 20 nt, Artificial Sequence
  ELANE RNA Guide
cuucauggugcagcugcgcg

SEQ ID NO: 2844 - RNA, 20 nt, Artificial Sequence
  ELANE RNA Guide
gaaguggccuccgcgcagcu

SEQ ID NO: 2845 - RNA, 20 nt, Artificial Sequence
  ELANE RNA Guide
gcaccaugaagggccacgcg

SEQ ID NO: 2846 - RNA, 20 nt, Artificial Sequence
  ELANE RNA Guide
gcagcugcaccaugaagggc

SEQ ID NO: 2847 - RNA, 20 nt, Artificial Sequence
  ELANE RNA Guide
gcccuucauggugcagcugc

SEQ ID NO: 2848 - RNA, 20 nt, Artificial Sequence
  ELANE RNA Guide
gccuccgcgcagcugcacca

SEQ ID NO: 2849 - RNA, 20 nt, Artificial Sequence
  ELANE RNA Guide
gcgcagcugcaccaugaagg

SEQ ID NO: 2850 - RNA, 20 nt, Artificial Sequence
  ELANE RNA Guide
gcguggcccuucauggugca

SEQ ID NO: 2851 - RNA, 20 nt, Artificial Sequence
  ELANE RNA Guide
gcugcaccaugaagggccac

SEQ ID NO: 2852 - RNA, 20 nt, Artificial Sequence
  ELANE RNA Guide
ggcccuucauggugcagcug

SEQ ID NO: 2853 - RNA, 20 nt, Artificial Sequence
  ELANE RNA Guide
ggccuccgcgcagcugcacc

SEQ ID NO: 2854 - RNA, 20 nt, Artificial Sequence
  ELANE RNA Guide
ggugcagcugcgcggaggcc

SEQ ID NO: 2855 - RNA, 20 nt, Artificial Sequence
  ELANE RNA Guide
guggcccuucauggugcagc

SEQ ID NO: 2856 - RNA, 20 nt, Artificial Sequence
  ELANE RNA Guide
guggccuccgcgcagcugca

SEQ ID NO: 2857 - RNA, 20 nt, Artificial Sequence
  ELANE RNA Guide
ucauggugcagcugcgcgga

SEQ ID NO: 2858 - RNA, 20 nt, Artificial Sequence
  ELANE RNA Guide
uccgcgcagcugcaccauga

SEQ ID NO: 2859 - RNA, 20 nt, Artificial Sequence
  ELANE RNA Guide
ugcaccaugaagggccacgc

SEQ ID NO: 2860 - RNA, 20 nt, Artificial Sequence
  ELANE RNA Guide
uggcccuucauggugcagcu

SEQ ID NO: 2861 - RNA, 20 nt, Artificial Sequence
  ELANE RNA Guide
uggccuccgcgcagcugcac

SEQ ID NO: 2862 - RNA, 20 nt, Artificial Sequence
  ELANE RNA Guide
uggugcagcugcgcggaggc

SEQ ID NO: 2863 - RNA, 20 nt, Artificial Sequence
  ELANE RNA Guide
uucauggugcagcugcgcgg

SEQ ID NO: 2864 - RNA, 21 nt, Artificial Sequence
  ELANE RNA Guide
aaguggccuccgcgcagcugc

SEQ ID NO: 2865 - RNA, 21 nt, Artificial Sequence
  ELANE RNA Guide
acgcguggcccuucauggugc

SEQ ID NO: 2866 - RNA, 21 nt, Artificial Sequence
  ELANE RNA Guide
agaaguggccuccgcgcagcu

SEQ ID NO: 2867 - RNA, 21 nt, Artificial Sequence
  ELANE RNA Guide
agcugcaccaugaagggccac

SEQ ID NO: 2868 - RNA, 21 nt, Artificial Sequence
  ELANE RNA Guide
aguggccuccgcgcagcugca

SEQ ID NO: 2869 - RNA, 21 nt, Artificial Sequence
  ELANE RNA Guide
auggugcagcugcgcggaggc

SEQ ID NO: 2870 - RNA, 21 nt, Artificial Sequence
  ELANE RNA Guide
cacgcguggcccuucauggug

SEQ ID NO: 2871 - RNA, 21 nt, Artificial Sequence
  ELANE RNA Guide
cagcugcaccaugaagggcca

SEQ ID NO: 2872 - RNA, 21 nt, Artificial Sequence
  ELANE RNA Guide
cauggugcagcugcgcggagg

SEQ ID NO: 2873 - RNA, 21 nt, Artificial Sequence
  ELANE RNA Guide
ccacgcguggcccuucauggu

SEQ ID NO: 2874 - RNA, 21 nt, Artificial Sequence
  ELANE RNA Guide
cccacgcguggcccuucaugg

SEQ ID NO: 2875 - RNA, 21 nt, Artificial Sequence
  ELANE RNA Guide
ccccacgcguggcccuucaug

SEQ ID NO: 2876 - RNA, 21 nt, Artificial Sequence
  ELANE RNA Guide
cccuucauggugcagcugcgc

SEQ ID NO: 2877 - RNA, 21 nt, Artificial Sequence
  ELANE RNA Guide
ccgcgcagcugcaccaugaag

SEQ ID NO: 2878 - RNA, 21 nt, Artificial Sequence
  ELANE RNA Guide
ccuccgcgcagcugcaccaug

SEQ ID NO: 2879 - RNA, 21 nt, Artificial Sequence
  ELANE RNA Guide
ccuucauggugcagcugcgcg

SEQ ID NO: 2880 - RNA, 21 nt, Artificial Sequence
  ELANE RNA Guide
cgcagcugcaccaugaagggc

SEQ ID NO: 2881 - RNA, 21 nt, Artificial Sequence
  ELANE RNA Guide
cgcgcagcugcaccaugaagg

SEQ ID NO: 2882 - RNA, 21 nt, Artificial Sequence
  ELANE RNA Guide
cgcguggcccuucauggugca

SEQ ID NO: 2883 - RNA, 21 nt, Artificial Sequence
  ELANE RNA Guide
cguggcccuucauggugcagc

SEQ ID NO: 2884 - RNA, 21 nt, Artificial Sequence
  ELANE RNA Guide
cuccgcgcagcugcaccauga

SEQ ID NO: 2885 - RNA, 21 nt, Artificial Sequence
  ELANE RNA Guide
cugcaccaugaagggccacgc

SEQ ID NO: 2886 - RNA, 21 nt, Artificial Sequence
  ELANE RNA Guide
cuucauggugcagcugcgcgg

SEQ ID NO: 2887 - RNA, 21 nt, Artificial Sequence
  ELANE RNA Guide
gaaguggccuccgcgcagcug

SEQ ID NO: 2888 - RNA, 21 nt, Artificial Sequence
  ELANE RNA Guide
gcaccaugaagggccacgcgu

SEQ ID NO: 2889 - RNA, 21 nt, Artificial Sequence
  ELANE RNA Guide
gcagcugcaccaugaagggcc

SEQ ID NO: 2890 - RNA, 21 nt, Artificial Sequence
  ELANE RNA Guide
gcccuucauggugcagcugcg

SEQ ID NO: 2891 - RNA, 21 nt, Artificial Sequence
  ELANE RNA Guide
gccuccgcgcagcugcaccau

SEQ ID NO: 2892 - RNA, 21 nt, Artificial Sequence
  ELANE RNA Guide
gcgcagcugcaccaugaaggg

SEQ ID NO: 2893 - RNA, 21 nt, Artificial Sequence
  ELANE RNA Guide
gcguggcccuucauggugcag

SEQ ID NO: 2894 - RNA, 21 nt, Artificial Sequence
  ELANE RNA Guide
gcugcaccaugaagggccacg

SEQ ID NO: 2895 - RNA, 21 nt, Artificial Sequence
  ELANE RNA Guide
ggcccuucauggugcagcugc

SEQ ID NO: 2896 - RNA, 21 nt, Artificial Sequence
  ELANE RNA Guide
ggccuccgcgcagcugcacca

SEQ ID NO: 2897 - RNA, 21 nt, Artificial Sequence
  ELANE RNA Guide
ggugcagcugcgcggaggcca

SEQ ID NO: 2898 - RNA, 21 nt, Artificial Sequence
  ELANE RNA Guide
guggcccuucauggugcagcu

SEQ ID NO: 2899 - RNA, 21 nt, Artificial Sequence
  ELANE RNA Guide
guggccuccgcgcagcugcac

SEQ ID NO: 2900 - RNA, 21 nt, Artificial Sequence
  ELANE RNA Guide
ucauggugcagcugcgcggag

SEQ ID NO: 2901 - RNA, 21 nt, Artificial Sequence
  ELANE RNA Guide
uccgcgcagcugcaccaugaa

SEQ ID NO: 2902 - RNA, 21 nt, Artificial Sequence
  ELANE RNA Guide
ugcaccaugaagggccacgcg

SEQ ID NO: 2903 - RNA, 21 nt, Artificial Sequence
  ELANE RNA Guide
uggcccuucauggugcagcug

SEQ ID NO: 2904 - RNA, 21 nt, Artificial Sequence
  ELANE RNA Guide
uggccuccgcgcagcugcacc

SEQ ID NO: 2905 - RNA, 21 nt, Artificial Sequence
  ELANE RNA Guide
uggugcagcugcgcggaggcc

SEQ ID NO: 2906 - RNA, 21 nt, Artificial Sequence
  ELANE RNA Guide
uucauggugcagcugcgcgga

SEQ ID NO: 2907 - RNA, 22 nt, Artificial Sequence
  ELANE RNA Guide
aaguggccuccgcgcagcugca

SEQ ID NO: 2908 - RNA, 22 nt, Artificial Sequence
  ELANE RNA Guide
acgcguggcccuucauggugca

SEQ ID NO: 2909 - RNA, 22 nt, Artificial Sequence
  ELANE RNA Guide
agaaguggccuccgcgcagcug

SEQ ID NO: 2910 - RNA, 22 nt, Artificial Sequence
  ELANE RNA Guide
agcugcaccaugaagggccacg

SEQ ID NO: 2911 - RNA, 22 nt, Artificial Sequence
  ELANE RNA Guide
aguggccuccgcgcagcugcac

SEQ ID NO: 2912 - RNA, 22 nt, Artificial Sequence
  ELANE RNA Guide
auggugcagcugcgcggaggcc

SEQ ID NO: 2913 - RNA, 22 nt, Artificial Sequence
  ELANE RNA Guide
cacgcguggcccuucauggugc

SEQ ID NO: 2914 - RNA, 22 nt, Artificial Sequence
  ELANE RNA Guide
cagaaguggccuccgcgcagcu

SEQ ID NO: 2915 - RNA, 22 nt, Artificial Sequence
  ELANE RNA Guide
cagcugcaccaugaagggccac

SEQ ID NO: 2916 - RNA, 22 nt, Artificial Sequence
  ELANE RNA Guide
cauggugcagcugcgcggaggc

SEQ ID NO: 2917 - RNA, 22 nt, Artificial Sequence
  ELANE RNA Guide
ccacgcguggcccuucauggug

SEQ ID NO: 2918 - RNA, 22 nt, Artificial Sequence
  ELANE RNA Guide
cccacgcguggcccuucauggu

SEQ ID NO: 2919 - RNA, 22 nt, Artificial Sequence
  ELANE RNA Guide
ccccacgcguggcccuucaugg

SEQ ID NO: 2920 - RNA, 22 nt, Artificial Sequence
  ELANE RNA Guide
cccuucauggugcagcugcgcg

SEQ ID NO: 2921 - RNA, 22 nt, Artificial Sequence
  ELANE RNA Guide
ccgcgcagcugcaccaugaagg

SEQ ID NO: 2922 - RNA, 22 nt, Artificial Sequence
  ELANE RNA Guide
ccuccgcgcagcugcaccauga

SEQ ID NO: 2923 - RNA, 22 nt, Artificial Sequence
  ELANE RNA Guide
ccuucauggugcagcugcgcgg

SEQ ID NO: 2924 - RNA, 22 nt, Artificial Sequence
  ELANE RNA Guide
cgcagcugcaccaugaagggcc

SEQ ID NO: 2925 - RNA, 22 nt, Artificial Sequence
  ELANE RNA Guide
cgcgcagcugcaccaugaaggg

SEQ ID NO: 2926 - RNA, 22 nt, Artificial Sequence
  ELANE RNA Guide
cgcguggcccuucauggugcag

SEQ ID NO: 2927 - RNA, 22 nt, Artificial Sequence
  ELANE RNA Guide
cguggcccuucauggugcagcu

SEQ ID NO: 2928 - RNA, 22 nt, Artificial Sequence
  ELANE RNA Guide
cuccgcgcagcugcaccaugaa

SEQ ID NO: 2929 - RNA, 22 nt, Artificial Sequence
  ELANE RNA Guide
cugcaccaugaagggccacgcg

SEQ ID NO: 2930 - RNA, 22 nt, Artificial Sequence
  ELANE RNA Guide
cuucauggugcagcugcgcgga

SEQ ID NO: 2931 - RNA, 22 nt, Artificial Sequence
  ELANE RNA Guide
gaaguggccuccgcgcagcugc

SEQ ID NO: 2932 - RNA, 22 nt, Artificial Sequence
  ELANE RNA Guide
gcaccaugaagggccacgcgug

SEQ ID NO: 2933 - RNA, 22 nt, Artificial Sequence
  ELANE RNA Guide
gcagcugcaccaugaagggcca

SEQ ID NO: 2934 - RNA, 22 nt, Artificial Sequence
  ELANE RNA Guide
gccccacgcguggcccuucaug

SEQ ID NO: 2935 - RNA, 22 nt, Artificial Sequence
  ELANE RNA Guide
gcccuucauggugcagcugcgc

SEQ ID NO: 2936 - RNA, 22 nt, Artificial Sequence
  ELANE RNA Guide
gccuccgcgcagcugcaccaug

SEQ ID NO: 2937 - RNA, 22 nt, Artificial Sequence
  ELANE RNA Guide
gcgcagcugcaccaugaagggc

SEQ ID NO: 2938 - RNA, 22 nt, Artificial Sequence
  ELANE RNA Guide
gcguggcccuucauggugcagc

SEQ ID NO: 2939 - RNA, 22 nt, Artificial Sequence
  ELANE RNA Guide
gcugcaccaugaagggccacgc

SEQ ID NO: 2940 - RNA, 22 nt, Artificial Sequence
  ELANE RNA Guide
ggcccuucauggugcagcugcg

SEQ ID NO: 2941 - RNA, 22 nt, Artificial Sequence
  ELANE RNA Guide
ggccuccgcgcagcugcaccau

SEQ ID NO: 2942 - RNA, 22 nt, Artificial Sequence
  ELANE RNA Guide
ggugcagcugcgcggaggccac

SEQ ID NO: 2943 - RNA, 22 nt, Artificial Sequence
  ELANE RNA Guide
guggcccuucauggugcagcug

SEQ ID NO: 2944 - RNA, 22 nt, Artificial Sequence
  ELANE RNA Guide
guggccuccgcgcagcugcacc

SEQ ID NO: 2945 - RNA, 22 nt, Artificial Sequence
  ELANE RNA Guide
ucauggugcagcugcgcggagg

SEQ ID NO: 2946 - RNA, 22 nt, Artificial Sequence
  ELANE RNA Guide
uccgcgcagcugcaccaugaag

SEQ ID NO: 2947 - RNA, 22 nt, Artificial Sequence
  ELANE RNA Guide
ugcaccaugaagggccacgcgu

SEQ ID NO: 2948 - RNA, 22 nt, Artificial Sequence
  ELANE RNA Guide
uggcccuucauggugcagcugc

SEQ ID NO: 2949 - RNA, 22 nt, Artificial Sequence
  ELANE RNA Guide
uggccuccgcgcagcugcacca

SEQ ID NO: 2950 - RNA, 22 nt, Artificial Sequence
  ELANE RNA Guide
uggugcagcugcgcggaggcca

SEQ ID NO: 2951 - RNA, 22 nt, Artificial Sequence
  ELANE RNA Guide
uucauggugcagcugcgcggag

SEQ ID NO: 2952 - RNA, 20 nt, Artificial Sequence
  ELANE RNA Guide
acaucaugaagggccacgcg

SEQ ID NO: 2953 - RNA, 20 nt, Artificial Sequence
  ELANE RNA Guide
acgcguggcccuucaugaug

SEQ ID NO: 2954 - RNA, 20 nt, Artificial Sequence
  ELANE RNA Guide
agcugcagggacaucaugaa

SEQ ID NO: 2955 - RNA, 20 nt, Artificial Sequence
  ELANE RNA Guide
agggacaucaugaagggcca

SEQ ID NO: 2956 - RNA, 20 nt, Artificial Sequence
  ELANE RNA Guide
aucaugaagggccacgcgug

SEQ ID NO: 2957 - RNA, 20 nt, Artificial Sequence
  ELANE RNA Guide
augaugucccugcagcugcg

SEQ ID NO: 2958 - RNA, 20 nt, Artificial Sequence
  ELANE RNA Guide
cacgcguggcccuucaugau

SEQ ID NO: 2959 - RNA, 20 nt, Artificial Sequence
  ELANE RNA Guide
cagcugcagggacaucauga

SEQ ID NO: 2960 - RNA, 20 nt, Artificial Sequence
  ELANE RNA Guide
cagggacaucaugaagggcc

SEQ ID NO: 2961 - RNA, 20 nt, Artificial Sequence
  ELANE RNA Guide
caucaugaagggccacgcgu

SEQ ID NO: 2962 - RNA, 20 nt, Artificial Sequence
  ELANE RNA Guide
caugaugucccugcagcugc

SEQ ID NO: 2963 - RNA, 20 nt, Artificial Sequence
  ELANE RNA Guide
ccacgcguggcccuucauga

SEQ ID NO: 2964 - RNA, 20 nt, Artificial Sequence
  ELANE RNA Guide
ccccacgcguggcccuucau

SEQ ID NO: 2965 - RNA, 20 nt, Artificial Sequence
  ELANE RNA Guide
cccuucaugaugucccugca

SEQ ID NO: 2966 - RNA, 20 nt, Artificial Sequence
  ELANE RNA Guide
ccgcgcagcugcagggacau

SEQ ID NO: 2967 - RNA, 20 nt, Artificial Sequence
  ELANE RNA Guide
ccuccgcgcagcugcaggga

SEQ ID NO: 2968 - RNA, 20 nt, Artificial Sequence
  ELANE RNA Guide
ccuucaugaugucccugcag

SEQ ID NO: 2969 - RNA, 20 nt, Artificial Sequence
  ELANE RNA Guide
cgcagcugcagggacaucau

SEQ ID NO: 2970 - RNA, 20 nt, Artificial Sequence
  ELANE RNA Guide
cgcgcagcugcagggacauc

SEQ ID NO: 2971 - RNA, 20 nt, Artificial Sequence
  ELANE RNA Guide
cgcguggcccuucaugaugu

SEQ ID NO: 2972 - RNA, 20 nt, Artificial Sequence
  ELANE RNA Guide
cguggcccuucaugaugucc

SEQ ID NO: 2973 - RNA, 20 nt, Artificial Sequence
  ELANE RNA Guide
cugcagggacaucaugaagg

SEQ ID NO: 2974 - RNA, 20 nt, Artificial Sequence
  ELANE RNA Guide
cuucaugaugucccugcagc

SEQ ID NO: 2975 - RNA, 20 nt, Artificial Sequence
  ELANE RNA Guide
gacaucaugaagggccacgc

SEQ ID NO: 2976 - RNA, 20 nt, Artificial Sequence
  ELANE RNA Guide
gaugucccugcagcugcgcg

SEQ ID NO: 2977 - RNA, 20 nt, Artificial Sequence
  ELANE RNA Guide
gcagcugcagggacaucaug

SEQ ID NO: 2978 - RNA, 20 nt, Artificial Sequence
  ELANE RNA Guide
gcagggacaucaugaagggc

SEQ ID NO: 2979 - RNA, 20 nt, Artificial Sequence
  ELANE RNA Guide
gcccuucaugaugucccugc

SEQ ID NO: 2980 - RNA, 20 nt, Artificial Sequence
  ELANE RNA Guide
gccuccgcgcagcugcaggg

SEQ ID NO: 2981 - RNA, 20 nt, Artificial Sequence
  ELANE RNA Guide
gcgcagcugcagggacauca

SEQ ID NO: 2982 - RNA, 20 nt, Artificial Sequence
  ELANE RNA Guide
gcguggcccuucaugauguc

SEQ ID NO: 2983 - RNA, 20 nt, Artificial Sequence
  ELANE RNA Guide
gcugcagggacaucaugaag

SEQ ID NO: 2984 - RNA, 20 nt, Artificial Sequence
  ELANE RNA Guide
ggacaucaugaagggccacg

SEQ ID NO: 2985 - RNA, 20 nt, Artificial Sequence
  ELANE RNA Guide
ggcccuucaugaugucccug

SEQ ID NO: 2986 - RNA, 20 nt, Artificial Sequence
  ELANE RNA Guide
gggacaucaugaagggccac

SEQ ID NO: 2987 - RNA, 20 nt, Artificial Sequence
  ELANE RNA Guide
guggcccuucaugauguccc

SEQ ID NO: 2988 - RNA, 20 nt, Artificial Sequence
  ELANE RNA Guide
ucaugaugucccugcagcug

SEQ ID NO: 2989 - RNA, 20 nt, Artificial Sequence
  ELANE RNA Guide
ugaugucccugcagcugcgc

SEQ ID NO: 2990 - RNA, 20 nt, Artificial Sequence
  ELANE RNA Guide
ugcagggacaucaugaaggg

SEQ ID NO: 2991 - RNA, 20 nt, Artificial Sequence
  ELANE RNA Guide
uggcccuucaugaugucccu

SEQ ID NO: 2992 - RNA, 20 nt, Artificial Sequence
  ELANE RNA Guide
uucaugaugucccugcagcu

SEQ ID NO: 2993 - RNA, 21 nt, Artificial Sequence
  ELANE RNA Guide
acaucaugaagggccacgcgu

SEQ ID NO: 2994 - RNA, 21 nt, Artificial Sequence
  ELANE RNA Guide
acgcguggcccuucaugaugu

SEQ ID NO: 2995 - RNA, 21 nt, Artificial Sequence
  ELANE RNA Guide
agcugcagggacaucaugaag

SEQ ID NO: 2996 - RNA, 21 nt, Artificial Sequence
  ELANE RNA Guide
agggacaucaugaagggccac

SEQ ID NO: 2997 - RNA, 21 nt, Artificial Sequence
  ELANE RNA Guide
aucaugaagggccacgcgugg

SEQ ID NO: 2998 - RNA, 21 nt, Artificial Sequence
  ELANE RNA Guide
augaugucccugcagcugcgc

SEQ ID NO: 2999 - RNA, 21 nt, Artificial Sequence
  ELANE RNA Guide
cacgcguggcccuucaugaug

SEQ ID NO: 3000 - RNA, 21 nt, Artificial Sequence
  ELANE RNA Guide
cagcugcagggacaucaugaa

SEQ ID NO: 3001 - RNA, 21 nt, Artificial Sequence
  ELANE RNA Guide
cagggacaucaugaagggcca

SEQ ID NO: 3002 - RNA, 21 nt, Artificial Sequence
  ELANE RNA Guide
caucaugaagggccacgcgug

SEQ ID NO: 3003 - RNA, 21 nt, Artificial Sequence
  ELANE RNA Guide
caugaugucccugcagcugcg

SEQ ID NO: 3004 - RNA, 21 nt, Artificial Sequence
  ELANE RNA Guide
ccacgcguggcccuucaugau

SEQ ID NO: 3005 - RNA, 21 nt, Artificial Sequence
  ELANE RNA Guide
cccacgcguggcccuucauga

SEQ ID NO: 3006 - RNA, 21 nt, Artificial Sequence
  ELANE RNA Guide
cccuucaugaugucccugcag

SEQ ID NO: 3007 - RNA, 21 nt, Artificial Sequence
  ELANE RNA Guide
ccgcgcagcugcagggacauc

SEQ ID NO: 3008 - RNA, 21 nt, Artificial Sequence
  ELANE RNA Guide
ccuucaugaugucccugcagc

SEQ ID NO: 3009 - RNA, 21 nt, Artificial Sequence
  ELANE RNA Guide
cgcagcugcagggacaucaug

SEQ ID NO: 3010 - RNA, 21 nt, Artificial Sequence
  ELANE RNA Guide
cgcgcagcugcagggacauca

SEQ ID NO: 3011 - RNA, 21 nt, Artificial Sequence
  ELANE RNA Guide
cgcguggcccuucaugauguc

SEQ ID NO: 3012 - RNA, 21 nt, Artificial Sequence
  ELANE RNA Guide
cguggcccuucaugauguccc

SEQ ID NO: 3013 - RNA, 21 nt, Artificial Sequence
  ELANE RNA Guide
cugcagggacaucaugaaggg

SEQ ID NO: 3014 - RNA, 21 nt, Artificial Sequence
  ELANE RNA Guide
cuucaugaugucccugcagcu

SEQ ID NO: 3015 - RNA, 21 nt, Artificial Sequence
  ELANE RNA Guide
gacaucaugaagggccacgcg

SEQ ID NO: 3016 - RNA, 21 nt, Artificial Sequence
  ELANE RNA Guide
gaugucccugcagcugcgcgg

SEQ ID NO: 3017 - RNA, 21 nt, Artificial Sequence
  ELANE RNA Guide
gcagcugcagggacaucauga

SEQ ID NO: 3018 - RNA, 21 nt, Artificial Sequence
  ELANE RNA Guide
gcagggacaucaugaagggcc

SEQ ID NO: 3019 - RNA, 21 nt, Artificial Sequence
  ELANE RNA Guide
gccccacgcguggcccuucau

SEQ ID NO: 3020 - RNA, 21 nt, Artificial Sequence
  ELANE RNA Guide
gcccuucaugaugucccugca

SEQ ID NO: 3021 - RNA, 21 nt, Artificial Sequence
  ELANE RNA Guide
gccuccgcgcagcugcaggga

SEQ ID NO: 3022 - RNA, 21 nt, Artificial Sequence
  ELANE RNA Guide
gcgcagcugcagggacaucau

SEQ ID NO: 3023 - RNA, 21 nt, Artificial Sequence
  ELANE RNA Guide
gcguggcccuucaugaugucc

SEQ ID NO: 3024 - RNA, 21 nt, Artificial Sequence
  ELANE RNA Guide
gcugcagggacaucaugaagg

SEQ ID NO: 3025 - RNA, 21 nt, Artificial Sequence
  ELANE RNA Guide
ggacaucaugaagggccacgc

SEQ ID NO: 3026 - RNA, 21 nt, Artificial Sequence
  ELANE RNA Guide
ggcccuucaugaugucccugc

SEQ ID NO: 3027 - RNA, 21 nt, Artificial Sequence
  ELANE RNA Guide
gggacaucaugaagggccacg

SEQ ID NO: 3028 - RNA, 21 nt, Artificial Sequence
  ELANE RNA Guide
guggcccuucaugaugucccu

SEQ ID NO: 3029 - RNA, 21 nt, Artificial Sequence
  ELANE RNA Guide
ucaugaugucccugcagcugc

SEQ ID NO: 3030 - RNA, 21 nt, Artificial Sequence
  ELANE RNA Guide
uccgcgcagcugcagggacau

SEQ ID NO: 3031 - RNA, 21 nt, Artificial Sequence
  ELANE RNA Guide
ugaugucccugcagcugcgcg

SEQ ID NO: 3032 - RNA, 21 nt, Artificial Sequence
  ELANE RNA Guide
ugcagggacaucaugaagggc

SEQ ID NO: 3033 - RNA, 21 nt, Artificial Sequence
  ELANE RNA Guide
uggcccuucaugaugucccug

SEQ ID NO: 3034 - RNA, 21 nt, Artificial Sequence
  ELANE RNA Guide
uucaugaugucccugcagcug

SEQ ID NO: 3035 - RNA, 22 nt, Artificial Sequence
  ELANE RNA Guide
acaucaugaagggccacgcgug

SEQ ID NO: 3036 - RNA, 22 nt, Artificial Sequence
  ELANE RNA Guide
acgcguggcccuucaugauguc

SEQ ID NO: 3037 - RNA, 22 nt, Artificial Sequence
  ELANE RNA Guide
agcugcagggacaucaugaagg

SEQ ID NO: 3038 - RNA, 22 nt, Artificial Sequence
  ELANE RNA Guide
agggacaucaugaagggccacg

SEQ ID NO: 3039 - RNA, 22 nt, Artificial Sequence
  ELANE RNA Guide
aucaugaagggccacgcguggg

SEQ ID NO: 3040 - RNA, 22 nt, Artificial Sequence
  ELANE RNA Guide
augaugucccugcagcugcgcg

SEQ ID NO: 3041 - RNA, 22 nt, Artificial Sequence
  ELANE RNA Guide
cacgcguggcccuucaugaugu

SEQ ID NO: 3042 - RNA, 22 nt, Artificial Sequence
  ELANE RNA Guide
cagcugcagggacaucaugaag

SEQ ID NO: 3043 - RNA, 22 nt, Artificial Sequence
  ELANE RNA Guide
cagggacaucaugaagggccac

SEQ ID NO: 3044 - RNA, 22 nt, Artificial Sequence
  ELANE RNA Guide
caucaugaagggccacgcgugg

SEQ ID NO: 3045 - RNA, 22 nt, Artificial Sequence
  ELANE RNA Guide
caugaugucccugcagcugcgc

SEQ ID NO: 3046 - RNA, 22 nt, Artificial Sequence
  ELANE RNA Guide
ccacgcguggcccuucaugaug

SEQ ID NO: 3047 - RNA, 22 nt, Artificial Sequence
  ELANE RNA Guide
cccacgcguggcccuucaugau

SEQ ID NO: 3048 - RNA, 22 nt, Artificial Sequence
  ELANE RNA Guide
ccccacgcguggcccuucauga

SEQ ID NO: 3049 - RNA, 22 nt, Artificial Sequence
  ELANE RNA Guide
cccuucaugaugucccugcagc

SEQ ID NO: 3050 - RNA, 22 nt, Artificial Sequence
  ELANE RNA Guide
ccgcgcagcugcagggacauca

SEQ ID NO: 3051 - RNA, 22 nt, Artificial Sequence
  ELANE RNA Guide
ccuucaugaugucccugcagcu

SEQ ID NO: 3052 - RNA, 22 nt, Artificial Sequence
  ELANE RNA Guide
cgcagcugcagggacaucauga

SEQ ID NO: 3053 - RNA, 22 nt, Artificial Sequence
  ELANE RNA Guide
cgcgcagcugcagggacaucau

SEQ ID NO: 3054 - RNA, 22 nt, Artificial Sequence
  ELANE RNA Guide
cgcguggcccuucaugaugucc

SEQ ID NO: 3055 - RNA, 22 nt, Artificial Sequence
  ELANE RNA Guide
cguggcccuucaugaugucccu

SEQ ID NO: 3056 - RNA, 22 nt, Artificial Sequence
  ELANE RNA Guide
cuccgcgcagcugcagggacau

SEQ ID NO: 3057 - RNA, 22 nt, Artificial Sequence
  ELANE RNA Guide
cugcagggacaucaugaagggc

SEQ ID NO: 3058 - RNA, 22 nt, Artificial Sequence
  ELANE RNA Guide
cuucaugaugucccugcagcug

SEQ ID NO: 3059 - RNA, 22 nt, Artificial Sequence
  ELANE RNA Guide
gacaucaugaagggccacgcgu

SEQ ID NO: 3060 - RNA, 22 nt, Artificial Sequence
  ELANE RNA Guide
gaugucccugcagcugcgcgga

SEQ ID NO: 3061 - RNA, 22 nt, Artificial Sequence
  ELANE RNA Guide
gcagcugcagggacaucaugaa

SEQ ID NO: 3062 - RNA, 22 nt, Artificial Sequence
  ELANE RNA Guide
gcagggacaucaugaagggcca

SEQ ID NO: 3063 - RNA, 22 nt, Artificial Sequence
  ELANE RNA Guide
gcccuucaugaugucccugcag

SEQ ID NO: 3064 - RNA, 22 nt, Artificial Sequence
  ELANE RNA Guide
gcgcagcugcagggacaucaug

SEQ ID NO: 3065 - RNA, 22 nt, Artificial Sequence
  ELANE RNA Guide
gcguggcccuucaugauguccc

SEQ ID NO: 3066 - RNA, 22 nt, Artificial Sequence
  ELANE RNA Guide
gcugcagggacaucaugaaggg

SEQ ID NO: 3067 - RNA, 22 nt, Artificial Sequence
  ELANE RNA Guide
ggacaucaugaagggccacgcg

SEQ ID NO: 3068 - RNA, 22 nt, Artificial Sequence
  ELANE RNA Guide
ggccccacgcguggcccuucau

SEQ ID NO: 3069 - RNA, 22 nt, Artificial Sequence
  ELANE RNA Guide
ggcccuucaugaugucccugca

SEQ ID NO: 3070 - RNA, 22 nt, Artificial Sequence
  ELANE RNA Guide
ggccuccgcgcagcugcaggga

SEQ ID NO: 3071 - RNA, 22 nt, Artificial Sequence
  ELANE RNA Guide
gggacaucaugaagggccacgc

SEQ ID NO: 3072 - RNA, 22 nt, Artificial Sequence
  ELANE RNA Guide
guggcccuucaugaugucccug

SEQ ID NO: 3073 - RNA, 22 nt, Artificial Sequence
  ELANE RNA Guide
ucaugaugucccugcagcugcg

SEQ ID NO: 3074 - RNA, 22 nt, Artificial Sequence
  ELANE RNA Guide
uccgcgcagcugcagggacauc

SEQ ID NO: 3075 - RNA, 22 nt, Artificial Sequence
  ELANE RNA Guide
ugaugucccugcagcugcgcgg

SEQ ID NO: 3076 - RNA, 22 nt, Artificial Sequence
  ELANE RNA Guide
ugcagggacaucaugaagggcc

SEQ ID NO: 3077 - RNA, 22 nt, Artificial Sequence
  ELANE RNA Guide
uggcccuucaugaugucccugc

SEQ ID NO: 3078 - RNA, 22 nt, Artificial Sequence
  ELANE RNA Guide
uggccuccgcgcagcugcaggg

SEQ ID NO: 3079 - RNA, 22 nt, Artificial Sequence
  ELANE RNA Guide
uucaugaugucccugcagcugc

SEQ ID NO: 3080 - RNA, 20 nt, Artificial Sequence
  ELANE RNA Guide
acagcaugaagggccacgcg

SEQ ID NO: 3081 - RNA, 20 nt, Artificial Sequence
  ELANE RNA Guide
acgcguggcccuucaugcug

SEQ ID NO: 3082 - RNA, 20 nt, Artificial Sequence
  ELANE RNA Guide
agcaugaagggccacgcgug

SEQ ID NO: 3083 - RNA, 20 nt, Artificial Sequence
  ELANE RNA Guide
agcugcagggacagcaugaa

SEQ ID NO: 3084 - RNA, 20 nt, Artificial Sequence
  ELANE RNA Guide
agggacagcaugaagggcca

SEQ ID NO: 3085 - RNA, 20 nt, Artificial Sequence
  ELANE RNA Guide
augcugucccugcagcugcg

SEQ ID NO: 3086 - RNA, 20 nt, Artificial Sequence
  ELANE RNA Guide
cacgcguggcccuucaugcu

SEQ ID NO: 3087 - RNA, 20 nt, Artificial Sequence
  ELANE RNA Guide
cagcaugaagggccacgcgu

SEQ ID NO: 3088 - RNA, 20 nt, Artificial Sequence
  ELANE RNA Guide
cagcugcagggacagcauga

SEQ ID NO: 3089 - RNA, 20 nt, Artificial Sequence
  ELANE RNA Guide
cagggacagcaugaagggcc

SEQ ID NO: 3090 - RNA, 20 nt, Artificial Sequence
  ELANE RNA Guide
caugcugucccugcagcugc

SEQ ID NO: 3091 - RNA, 20 nt, Artificial Sequence
  ELANE RNA Guide
ccacgcguggcccuucaugc

SEQ ID NO: 3092 - RNA, 20 nt, Artificial Sequence
  ELANE RNA Guide
cccuucaugcugucccugca

SEQ ID NO: 3093 - RNA, 20 nt, Artificial Sequence
  ELANE RNA Guide
ccgcgcagcugcagggacag

SEQ ID NO: 3094 - RNA, 20 nt, Artificial Sequence
  ELANE RNA Guide
ccuucaugcugucccugcag

SEQ ID NO: 3095 - RNA, 20 nt, Artificial Sequence
  ELANE RNA Guide
cgcagcugcagggacagcau

SEQ ID NO: 3096 - RNA, 20 nt, Artificial Sequence
  ELANE RNA Guide
cgcgcagcugcagggacagc

SEQ ID NO: 3097 - RNA, 20 nt, Artificial Sequence
  ELANE RNA Guide
cgcguggcccuucaugcugu

SEQ ID NO: 3098 - RNA, 20 nt, Artificial Sequence
  ELANE RNA Guide
cguggcccuucaugcugucc

SEQ ID NO: 3099 - RNA, 20 nt, Artificial Sequence
  ELANE RNA Guide
cugcagggacagcaugaagg

SEQ ID NO: 3100 - RNA, 20 nt, Artificial Sequence
  ELANE RNA Guide
cuucaugcugucccugcagc

SEQ ID NO: 3101 - RNA, 20 nt, Artificial Sequence
  ELANE RNA Guide
gacagcaugaagggccacgc

SEQ ID NO: 3102 - RNA, 20 nt, Artificial Sequence
  ELANE RNA Guide
gcagcugcagggacagcaug

SEQ ID NO: 3103 - RNA, 20 nt, Artificial Sequence
  ELANE RNA Guide
gcagggacagcaugaagggc

SEQ ID NO: 3104 - RNA, 20 nt, Artificial Sequence
  ELANE RNA Guide
gcccuucaugcugucccugc

SEQ ID NO: 3105 - RNA, 20 nt, Artificial Sequence
  ELANE RNA Guide
gcgcagcugcagggacagca

SEQ ID NO: 3106 - RNA, 20 nt, Artificial Sequence
  ELANE RNA Guide
gcguggcccuucaugcuguc

SEQ ID NO: 3107 - RNA, 20 nt, Artificial Sequence
  ELANE RNA Guide
gcugcagggacagcaugaag

SEQ ID NO: 3108 - RNA, 20 nt, Artificial Sequence
  ELANE RNA Guide
gcugucccugcagcugcgcg

SEQ ID NO: 3109 - RNA, 20 nt, Artificial Sequence
  ELANE RNA Guide
ggacagcaugaagggccacg

SEQ ID NO: 3110 - RNA, 20 nt, Artificial Sequence
  ELANE RNA Guide
ggcccuucaugcugucccug

SEQ ID NO: 3111 - RNA, 20 nt, Artificial Sequence
  ELANE RNA Guide
gggacagcaugaagggccac

SEQ ID NO: 3112 - RNA, 20 nt, Artificial Sequence
  ELANE RNA Guide
guggcccuucaugcuguccc

SEQ ID NO: 3113 - RNA, 20 nt, Artificial Sequence
  ELANE RNA Guide
ucaugcugucccugcagcug

SEQ ID NO: 3114 - RNA, 20 nt, Artificial Sequence
  ELANE RNA Guide
ugcagggacagcaugaaggg

SEQ ID NO: 3115 - RNA, 20 nt, Artificial Sequence
  ELANE RNA Guide
ugcugucccugcagcugcgc

SEQ ID NO: 3116 - RNA, 20 nt, Artificial Sequence
  ELANE RNA Guide
uggcccuucaugcugucccu

SEQ ID NO: 3117 - RNA, 20 nt, Artificial Sequence
  ELANE RNA Guide
uucaugcugucccugcagcu

SEQ ID NO: 3118 - RNA, 21 nt, Artificial Sequence
  ELANE RNA Guide
acagcaugaagggccacgcgu

SEQ ID NO: 3119 - RNA, 21 nt, Artificial Sequence
  ELANE RNA Guide
acgcguggcccuucaugcugu

SEQ ID NO: 3120 - RNA, 21 nt, Artificial Sequence
  ELANE RNA Guide
agcaugaagggccacgcgugg

SEQ ID NO: 3121 - RNA, 21 nt, Artificial Sequence
  ELANE RNA Guide
agcugcagggacagcaugaag

SEQ ID NO: 3122 - RNA, 21 nt, Artificial Sequence
  ELANE RNA Guide
agggacagcaugaagggccac

SEQ ID NO: 3123 - RNA, 21 nt, Artificial Sequence
  ELANE RNA Guide
augcugucccugcagcugcgc

SEQ ID NO: 3124 - RNA, 21 nt, Artificial Sequence
  ELANE RNA Guide
cacgcguggcccuucaugcug

SEQ ID NO: 3125 - RNA, 21 nt, Artificial Sequence
  ELANE RNA Guide
cagcaugaagggccacgcgug

SEQ ID NO: 3126 - RNA, 21 nt, Artificial Sequence
  ELANE RNA Guide
cagcugcagggacagcaugaa

SEQ ID NO: 3127 - RNA, 21 nt, Artificial Sequence
  ELANE RNA Guide
cagggacagcaugaagggcca

SEQ ID NO: 3128 - RNA, 21 nt, Artificial Sequence
  ELANE RNA Guide
caugcugucccugcagcugcg

SEQ ID NO: 3129 - RNA, 21 nt, Artificial Sequence
  ELANE RNA Guide
ccacgcguggcccuucaugcu

SEQ ID NO: 3130 - RNA, 21 nt, Artificial Sequence
  ELANE RNA Guide
cccacgcguggcccuucaugc

SEQ ID NO: 3131 - RNA, 21 nt, Artificial Sequence
  ELANE RNA Guide
cccuucaugcugucccugcag

SEQ ID NO: 3132 - RNA, 21 nt, Artificial Sequence
  ELANE RNA Guide
ccgcgcagcugcagggacagc

SEQ ID NO: 3133 - RNA, 21 nt, Artificial Sequence
  ELANE RNA Guide
ccuucaugcugucccugcagc

SEQ ID NO: 3134 - RNA, 21 nt, Artificial Sequence
  ELANE RNA Guide
cgcagcugcagggacagcaug

SEQ ID NO: 3135 - RNA, 21 nt, Artificial Sequence
  ELANE RNA Guide
cgcgcagcugcagggacagca

SEQ ID NO: 3136 - RNA, 21 nt, Artificial Sequence
  ELANE RNA Guide
cgcguggcccuucaugcuguc

SEQ ID NO: 3137 - RNA, 21 nt, Artificial Sequence
  ELANE RNA Guide
cguggcccuucaugcuguccc

SEQ ID NO: 3138 - RNA, 21 nt, Artificial Sequence
  ELANE RNA Guide
cugcagggacagcaugaaggg

SEQ ID NO: 3139 - RNA, 21 nt, Artificial Sequence
  ELANE RNA Guide
cuucaugcugucccugcagcu

SEQ ID NO: 3140 - RNA, 21 nt, Artificial Sequence
  ELANE RNA Guide
gacagcaugaagggccacgcg

SEQ ID NO: 3141 - RNA, 21 nt, Artificial Sequence
  ELANE RNA Guide
gcagcugcagggacagcauga

SEQ ID NO: 3142 - RNA, 21 nt, Artificial Sequence
  ELANE RNA Guide
gcagggacagcaugaagggcc

SEQ ID NO: 3143 - RNA, 21 nt, Artificial Sequence
  ELANE RNA Guide
gcccuucaugcugucccugca

SEQ ID NO: 3144 - RNA, 21 nt, Artificial Sequence
  ELANE RNA Guide
gcgcagcugcagggacagcau

SEQ ID NO: 3145 - RNA, 21 nt, Artificial Sequence
  ELANE RNA Guide
gcguggcccuucaugcugucc

SEQ ID NO: 3146 - RNA, 21 nt, Artificial Sequence
  ELANE RNA Guide
gcugcagggacagcaugaagg

SEQ ID NO: 3147 - RNA, 21 nt, Artificial Sequence
  ELANE RNA Guide
gcugucccugcagcugcgcgg

SEQ ID NO: 3148 - RNA, 21 nt, Artificial Sequence
  ELANE RNA Guide
ggacagcaugaagggccacgc

SEQ ID NO: 3149 - RNA, 21 nt, Artificial Sequence
  ELANE RNA Guide
ggcccuucaugcugucccugc

SEQ ID NO: 3150 - RNA, 21 nt, Artificial Sequence
  ELANE RNA Guide
gggacagcaugaagggccacg

SEQ ID NO: 3151 - RNA, 21 nt, Artificial Sequence
  ELANE RNA Guide
guggcccuucaugcugucccu

SEQ ID NO: 3152 - RNA, 21 nt, Artificial Sequence
  ELANE RNA Guide
ucaugcugucccugcagcugc

SEQ ID NO: 3153 - RNA, 21 nt, Artificial Sequence
  ELANE RNA Guide
uccgcgcagcugcagggacag

SEQ ID NO: 3154 - RNA, 21 nt, Artificial Sequence
  ELANE RNA Guide
ugcagggacagcaugaagggc

SEQ ID NO: 3155 - RNA, 21 nt, Artificial Sequence
  ELANE RNA Guide
ugcugucccugcagcugcgcg

SEQ ID NO: 3156 - RNA, 21 nt, Artificial Sequence
  ELANE RNA Guide
uggcccuucaugcugucccug

SEQ ID NO: 3157 - RNA, 21 nt, Artificial Sequence
  ELANE RNA Guide
uucaugcugucccugcagcug

SEQ ID NO: 3158 - RNA, 22 nt, Artificial Sequence
  ELANE RNA Guide
acagcaugaagggccacgcgug

SEQ ID NO: 3159 - RNA, 22 nt, Artificial Sequence
  ELANE RNA Guide
acgcguggcccuucaugcuguc

SEQ ID NO: 3160 - RNA, 22 nt, Artificial Sequence
  ELANE RNA Guide
agcaugaagggccacgcguggg

SEQ ID NO: 3161 - RNA, 22 nt, Artificial Sequence
  ELANE RNA Guide
agcugcagggacagcaugaagg

SEQ ID NO: 3162 - RNA, 22 nt, Artificial Sequence
  ELANE RNA Guide
agggacagcaugaagggccacg

SEQ ID NO: 3163 - RNA, 22 nt, Artificial Sequence
  ELANE RNA Guide
augcugucccugcagcugcgcg

SEQ ID NO: 3164 - RNA, 22 nt, Artificial Sequence
  ELANE RNA Guide
cacgcguggcccuucaugcugu

SEQ ID NO: 3165 - RNA, 22 nt, Artificial Sequence
  ELANE RNA Guide
cagcaugaagggccacgcgugg

SEQ ID NO: 3166 - RNA, 22 nt, Artificial Sequence
  ELANE RNA Guide
cagcugcagggacagcaugaag

SEQ ID NO: 3167 - RNA, 22 nt, Artificial Sequence
  ELANE RNA Guide
cagggacagcaugaagggccac

SEQ ID NO: 3168 - RNA, 22 nt, Artificial Sequence
  ELANE RNA Guide
caugcugucccugcagcugcgc

SEQ ID NO: 3169 - RNA, 22 nt, Artificial Sequence
  ELANE RNA Guide
ccacgcguggcccuucaugcug

SEQ ID NO: 3170 - RNA, 22 nt, Artificial Sequence
  ELANE RNA Guide
cccacgcguggcccuucaugcu

SEQ ID NO: 3171 - RNA, 22 nt, Artificial Sequence
  ELANE RNA Guide
ccccacgcguggcccuucaugc

SEQ ID NO: 3172 - RNA, 22 nt, Artificial Sequence
  ELANE RNA Guide
cccuucaugcugucccugcagc

SEQ ID NO: 3173 - RNA, 22 nt, Artificial Sequence
  ELANE RNA Guide
ccgcgcagcugcagggacagca

SEQ ID NO: 3174 - RNA, 22 nt, Artificial Sequence
  ELANE RNA Guide
ccuucaugcugucccugcagcu

SEQ ID NO: 3175 - RNA, 22 nt, Artificial Sequence
  ELANE RNA Guide
cgcagcugcagggacagcauga

SEQ ID NO: 3176 - RNA, 22 nt, Artificial Sequence
  ELANE RNA Guide
cgcgcagcugcagggacagcau

SEQ ID NO: 3177 - RNA, 22 nt, Artificial Sequence
  ELANE RNA Guide
cgcguggcccuucaugcugucc

SEQ ID NO: 3178 - RNA, 22 nt, Artificial Sequence
  ELANE RNA Guide
cguggcccuucaugcugucccu

SEQ ID NO: 3179 - RNA, 22 nt, Artificial Sequence
  ELANE RNA Guide
cuccgcgcagcugcagggacag

SEQ ID NO: 3180 - RNA, 22 nt, Artificial Sequence
  ELANE RNA Guide
cugcagggacagcaugaagggc

SEQ ID NO: 3181 - RNA, 22 nt, Artificial Sequence
  ELANE RNA Guide
cuucaugcugucccugcagcug

SEQ ID NO: 3182 - RNA, 22 nt, Artificial Sequence
  ELANE RNA Guide
gacagcaugaagggccacgcgu

SEQ ID NO: 3183 - RNA, 22 nt, Artificial Sequence
  ELANE RNA Guide
gcagcugcagggacagcaugaa

SEQ ID NO: 3184 - RNA, 22 nt, Artificial Sequence
  ELANE RNA Guide
gcagggacagcaugaagggcca

SEQ ID NO: 3185 - RNA, 22 nt, Artificial Sequence
  ELANE RNA Guide
gcccuucaugcugucccugcag

SEQ ID NO: 3186 - RNA, 22 nt, Artificial Sequence
  ELANE RNA Guide
gcgcagcugcagggacagcaug

SEQ ID NO: 3187 - RNA, 22 nt, Artificial Sequence
  ELANE RNA Guide
gcguggcccuucaugcuguccc

SEQ ID NO: 3188 - RNA, 22 nt, Artificial Sequence
  ELANE RNA Guide
gcugcagggacagcaugaaggg

SEQ ID NO: 3189 - RNA, 22 nt, Artificial Sequence
  ELANE RNA Guide
gcugucccugcagcugcgcgga

SEQ ID NO: 3190 - RNA, 22 nt, Artificial Sequence
  ELANE RNA Guide
ggacagcaugaagggccacgcg

SEQ ID NO: 3191 - RNA, 22 nt, Artificial Sequence
  ELANE RNA Guide
ggcccuucaugcugucccugca

SEQ ID NO: 3192 - RNA, 22 nt, Artificial Sequence
  ELANE RNA Guide
gggacagcaugaagggccacgc

SEQ ID NO: 3193 - RNA, 22 nt, Artificial Sequence
  ELANE RNA Guide
guggcccuucaugcugucccug

SEQ ID NO: 3194 - RNA, 22 nt, Artificial Sequence
  ELANE RNA Guide
ucaugcugucccugcagcugcg

SEQ ID NO: 3195 - RNA, 22 nt, Artificial Sequence
  ELANE RNA Guide
uccgcgcagcugcagggacagc

SEQ ID NO: 3196 - RNA, 22 nt, Artificial Sequence
  ELANE RNA Guide
ugcagggacagcaugaagggcc

SEQ ID NO: 3197 - RNA, 22 nt, Artificial Sequence
  ELANE RNA Guide
ugcugucccugcagcugcgcgg

SEQ ID NO: 3198 - RNA, 22 nt, Artificial Sequence
  ELANE RNA Guide
uggcccuucaugcugucccugc

SEQ ID NO: 3199 - RNA, 22 nt, Artificial Sequence
  ELANE RNA Guide
uucaugcugucccugcagcugc

SEQ ID NO: 3200 - RNA, 20 nt, Artificial Sequence
  ELANE RNA Guide
aacaugaagggccacgcgug

SEQ ID NO: 3201 - RNA, 20 nt, Artificial Sequence
  ELANE RNA Guide
acaacaugaagggccacgcg

SEQ ID NO: 3202 - RNA, 20 nt, Artificial Sequence
  ELANE RNA Guide
acgcguggcccuucauguug

SEQ ID NO: 3203 - RNA, 20 nt, Artificial Sequence
  ELANE RNA Guide
agcugcagggacaacaugaa

SEQ ID NO: 3204 - RNA, 20 nt, Artificial Sequence
  ELANE RNA Guide
agggacaacaugaagggcca

SEQ ID NO: 3205 - RNA, 20 nt, Artificial Sequence
  ELANE RNA Guide
auguugucccugcagcugcg

SEQ ID NO: 3206 - RNA, 20 nt, Artificial Sequence
  ELANE RNA Guide
caacaugaagggccacgcgu

SEQ ID NO: 3207 - RNA, 20 nt, Artificial Sequence
  ELANE RNA Guide
cacgcguggcccuucauguu

SEQ ID NO: 3208 - RNA, 20 nt, Artificial Sequence
  ELANE RNA Guide
cagcugcagggacaacauga

SEQ ID NO: 3209 - RNA, 20 nt, Artificial Sequence
  ELANE RNA Guide
cagggacaacaugaagggcc

SEQ ID NO: 3210 - RNA, 20 nt, Artificial Sequence
  ELANE RNA Guide
cauguugucccugcagcugc

SEQ ID NO: 3211 - RNA, 20 nt, Artificial Sequence
  ELANE RNA Guide
ccacgcguggcccuucaugu

SEQ ID NO: 3212 - RNA, 20 nt, Artificial Sequence
  ELANE RNA Guide
cccuucauguugucccugca

SEQ ID NO: 3213 - RNA, 20 nt, Artificial Sequence
  ELANE RNA Guide
ccgcgcagcugcagggacaa

SEQ ID NO: 3214 - RNA, 20 nt, Artificial Sequence
  ELANE RNA Guide
ccuucauguugucccugcag

SEQ ID NO: 3215 - RNA, 20 nt, Artificial Sequence
  ELANE RNA Guide
cgcagcugcagggacaacau

SEQ ID NO: 3216 - RNA, 20 nt, Artificial Sequence
  ELANE RNA Guide
cgcgcagcugcagggacaac

SEQ ID NO: 3217 - RNA, 20 nt, Artificial Sequence
  ELANE RNA Guide
cgcguggcccuucauguugu

SEQ ID NO: 3218 - RNA, 20 nt, Artificial Sequence
  ELANE RNA Guide
cguggcccuucauguugucc

SEQ ID NO: 3219 - RNA, 20 nt, Artificial Sequence
  ELANE RNA Guide
cugcagggacaacaugaagg

SEQ ID NO: 3220 - RNA, 20 nt, Artificial Sequence
  ELANE RNA Guide
cuucauguugucccugcagc

SEQ ID NO: 3221 - RNA, 20 nt, Artificial Sequence
  ELANE RNA Guide
gacaacaugaagggccacgc

SEQ ID NO: 3222 - RNA, 20 nt, Artificial Sequence
  ELANE RNA Guide
gcagcugcagggacaacaug

SEQ ID NO: 3223 - RNA, 20 nt, Artificial Sequence
  ELANE RNA Guide
gcagggacaacaugaagggc

SEQ ID NO: 3224 - RNA, 20 nt, Artificial Sequence
  ELANE RNA Guide
gcccuucauguugucccugc

SEQ ID NO: 3225 - RNA, 20 nt, Artificial Sequence
  ELANE RNA Guide
gcgcagcugcagggacaaca

SEQ ID NO: 3226 - RNA, 20 nt, Artificial Sequence
  ELANE RNA Guide
gcguggcccuucauguuguc

SEQ ID NO: 3227 - RNA, 20 nt, Artificial Sequence
  ELANE RNA Guide
gcugcagggacaacaugaag

SEQ ID NO: 3228 - RNA, 20 nt, Artificial Sequence
  ELANE RNA Guide
ggacaacaugaagggccacg

SEQ ID NO: 3229 - RNA, 20 nt, Artificial Sequence
  ELANE RNA Guide
ggcccuucauguugucccug

SEQ ID NO: 3230 - RNA, 20 nt, Artificial Sequence
  ELANE RNA Guide
gggacaacaugaagggccac

SEQ ID NO: 3231 - RNA, 20 nt, Artificial Sequence
  ELANE RNA Guide
guggcccuucauguuguccc

SEQ ID NO: 3232 - RNA, 20 nt, Artificial Sequence
  ELANE RNA Guide
guugucccugcagcugcgcg

SEQ ID NO: 3233 - RNA, 20 nt, Artificial Sequence
  ELANE RNA Guide
ucauguugucccugcagcug

SEQ ID NO: 3234 - RNA, 20 nt, Artificial Sequence
  ELANE RNA Guide
ugcagggacaacaugaaggg

SEQ ID NO: 3235 - RNA, 20 nt, Artificial Sequence
  ELANE RNA Guide
uggcccuucauguugucccu

SEQ ID NO: 3236 - RNA, 20 nt, Artificial Sequence
  ELANE RNA Guide
uguugucccugcagcugcgc

SEQ ID NO: 3237 - RNA, 20 nt, Artificial Sequence
  ELANE RNA Guide
uucauguugucccugcagcu

SEQ ID NO: 3238 - RNA, 21 nt, Artificial Sequence
  ELANE RNA Guide
aacaugaagggccacgcgugg

SEQ ID NO: 3239 - RNA, 21 nt, Artificial Sequence
  ELANE RNA Guide
acaacaugaagggccacgcgu

SEQ ID NO: 3240 - RNA, 21 nt, Artificial Sequence
  ELANE RNA Guide
acgcguggcccuucauguugu

SEQ ID NO: 3241 - RNA, 21 nt, Artificial Sequence
  ELANE RNA Guide
agcugcagggacaacaugaag

SEQ ID NO: 3242 - RNA, 21 nt, Artificial Sequence
  ELANE RNA Guide
agggacaacaugaagggccac

SEQ ID NO: 3243 - RNA, 21 nt, Artificial Sequence
  ELANE RNA Guide
auguugucccugcagcugcgc

SEQ ID NO: 3244 - RNA, 21 nt, Artificial Sequence
  ELANE RNA Guide
caacaugaagggccacgcgug

SEQ ID NO: 3245 - RNA, 21 nt, Artificial Sequence
  ELANE RNA Guide
cacgcguggcccuucauguug

SEQ ID NO: 3246 - RNA, 21 nt, Artificial Sequence
  ELANE RNA Guide
cagcugcagggacaacaugaa

SEQ ID NO: 3247 - RNA, 21 nt, Artificial Sequence
  ELANE RNA Guide
cagggacaacaugaagggcca

SEQ ID NO: 3248 - RNA, 21 nt, Artificial Sequence
  ELANE RNA Guide
cauguugucccugcagcugcg

SEQ ID NO: 3249 - RNA, 21 nt, Artificial Sequence
  ELANE RNA Guide
ccacgcguggcccuucauguu

SEQ ID NO: 3250 - RNA, 21 nt, Artificial Sequence
  ELANE RNA Guide
cccacgcguggcccuucaugu

SEQ ID NO: 3251 - RNA, 21 nt, Artificial Sequence
  ELANE RNA Guide
cccuucauguugucccugcag

SEQ ID NO: 3252 - RNA, 21 nt, Artificial Sequence
  ELANE RNA Guide
ccgcgcagcugcagggacaac

SEQ ID NO: 3253 - RNA, 21 nt, Artificial Sequence
  ELANE RNA Guide
ccuucauguugucccugcagc

SEQ ID NO: 3254 - RNA, 21 nt, Artificial Sequence
  ELANE RNA Guide
cgcagcugcagggacaacaug

SEQ ID NO: 3255 - RNA, 21 nt, Artificial Sequence
  ELANE RNA Guide
cgcgcagcugcagggacaaca

SEQ ID NO: 3256 - RNA, 21 nt, Artificial Sequence
  ELANE RNA Guide
cgcguggcccuucauguuguc

SEQ ID NO: 3257 - RNA, 21 nt, Artificial Sequence
  ELANE RNA Guide
cguggcccuucauguuguccc

SEQ ID NO: 3258 - RNA, 21 nt, Artificial Sequence
  ELANE RNA Guide
cugcagggacaacaugaaggg

SEQ ID NO: 3259 - RNA, 21 nt, Artificial Sequence
  ELANE RNA Guide
cuucauguugucccugcagcu

SEQ ID NO: 3260 - RNA, 21 nt, Artificial Sequence
  ELANE RNA Guide
gacaacaugaagggccacgcg

SEQ ID NO: 3261 - RNA, 21 nt, Artificial Sequence
  ELANE RNA Guide
gcagcugcagggacaacauga

SEQ ID NO: 3262 - RNA, 21 nt, Artificial Sequence
  ELANE RNA Guide
gcagggacaacaugaagggcc

SEQ ID NO: 3263 - RNA, 21 nt, Artificial Sequence
  ELANE RNA Guide
gcccuucauguugucccugca

SEQ ID NO: 3264 - RNA, 21 nt, Artificial Sequence
  ELANE RNA Guide
gcgcagcugcagggacaacau

SEQ ID NO: 3265 - RNA, 21 nt, Artificial Sequence
  ELANE RNA Guide
gcguggcccuucauguugucc

SEQ ID NO: 3266 - RNA, 21 nt, Artificial Sequence
  ELANE RNA Guide
gcugcagggacaacaugaagg

SEQ ID NO: 3267 - RNA, 21 nt, Artificial Sequence
  ELANE RNA Guide
ggacaacaugaagggccacgc

SEQ ID NO: 3268 - RNA, 21 nt, Artificial Sequence
  ELANE RNA Guide
ggcccuucauguugucccugc

SEQ ID NO: 3269 - RNA, 21 nt, Artificial Sequence
  ELANE RNA Guide
gggacaacaugaagggccacg

SEQ ID NO: 3270 - RNA, 21 nt, Artificial Sequence
  ELANE RNA Guide
guggcccuucauguugucccu

SEQ ID NO: 3271 - RNA, 21 nt, Artificial Sequence
  ELANE RNA Guide
guugucccugcagcugcgcgg

SEQ ID NO: 3272 - RNA, 21 nt, Artificial Sequence
  ELANE RNA Guide
ucauguugucccugcagcugc

SEQ ID NO: 3273 - RNA, 21 nt, Artificial Sequence
  ELANE RNA Guide
uccgcgcagcugcagggacaa

SEQ ID NO: 3274 - RNA, 21 nt, Artificial Sequence
  ELANE RNA Guide
ugcagggacaacaugaagggc

SEQ ID NO: 3275 - RNA, 21 nt, Artificial Sequence
  ELANE RNA Guide
uggcccuucauguugucccug

SEQ ID NO: 3276 - RNA, 21 nt, Artificial Sequence
  ELANE RNA Guide
uguugucccugcagcugcgcg

SEQ ID NO: 3277 - RNA, 21 nt, Artificial Sequence
  ELANE RNA Guide
uucauguugucccugcagcug

SEQ ID NO: 3278 - RNA, 22 nt, Artificial Sequence
  ELANE RNA Guide
aacaugaagggccacgcguggg

SEQ ID NO: 3279 - RNA, 22 nt, Artificial Sequence
  ELANE RNA Guide
acaacaugaagggccacgcgug

SEQ ID NO: 3280 - RNA, 22 nt, Artificial Sequence
  ELANE RNA Guide
acgcguggcccuucauguuguc

SEQ ID NO: 3281 - RNA, 22 nt, Artificial Sequence
  ELANE RNA Guide
agcugcagggacaacaugaagg

SEQ ID NO: 3282 - RNA, 22 nt, Artificial Sequence
  ELANE RNA Guide
agggacaacaugaagggccacg

SEQ ID NO: 3283 - RNA, 22 nt, Artificial Sequence
  ELANE RNA Guide
auguugucccugcagcugcgcg

SEQ ID NO: 3284 - RNA, 22 nt, Artificial Sequence
  ELANE RNA Guide
caacaugaagggccacgcgugg

SEQ ID NO: 3285 - RNA, 22 nt, Artificial Sequence
  ELANE RNA Guide
cacgcguggcccuucauguugu

SEQ ID NO: 3286 - RNA, 22 nt, Artificial Sequence
  ELANE RNA Guide
cagcugcagggacaacaugaag

SEQ ID NO: 3287 - RNA, 22 nt, Artificial Sequence
  ELANE RNA Guide
cagggacaacaugaagggccac

SEQ ID NO: 3288 - RNA, 22 nt, Artificial Sequence
  ELANE RNA Guide
cauguugucccugcagcugcgc

SEQ ID NO: 3289 - RNA, 22 nt, Artificial Sequence
  ELANE RNA Guide
ccacgcguggcccuucauguug

SEQ ID NO: 3290 - RNA, 22 nt, Artificial Sequence
  ELANE RNA Guide
cccacgcguggcccuucauguu

SEQ ID NO: 3291 - RNA, 22 nt, Artificial Sequence
  ELANE RNA Guide
ccccacgcguggcccuucaugu

SEQ ID NO: 3292 - RNA, 22 nt, Artificial Sequence
  ELANE RNA Guide
cccuucauguugucccugcagc

SEQ ID NO: 3293 - RNA, 22 nt, Artificial Sequence
  ELANE RNA Guide
ccgcgcagcugcagggacaaca

SEQ ID NO: 3294 - RNA, 22 nt, Artificial Sequence
  ELANE RNA Guide
ccuucauguugucccugcagcu

SEQ ID NO: 3295 - RNA, 22 nt, Artificial Sequence
  ELANE RNA Guide
cgcagcugcagggacaacauga

SEQ ID NO: 3296 - RNA, 22 nt, Artificial Sequence
  ELANE RNA Guide
cgcgcagcugcagggacaacau

SEQ ID NO: 3297 - RNA, 22 nt, Artificial Sequence
  ELANE RNA Guide
cgcguggcccuucauguugucc

SEQ ID NO: 3298 - RNA, 22 nt, Artificial Sequence
  ELANE RNA Guide
cguggcccuucauguugucccu

SEQ ID NO: 3299 - RNA, 22 nt, Artificial Sequence
  ELANE RNA Guide
cuccgcgcagcugcagggacaa

SEQ ID NO: 3300 - RNA, 22 nt, Artificial Sequence
  ELANE RNA Guide
cugcagggacaacaugaagggc

SEQ ID NO: 3301 - RNA, 22 nt, Artificial Sequence
  ELANE RNA Guide
cuucauguugucccugcagcug

SEQ ID NO: 3302 - RNA, 22 nt, Artificial Sequence
  ELANE RNA Guide
gacaacaugaagggccacgcgu

SEQ ID NO: 3303 - RNA, 22 nt, Artificial Sequence
  ELANE RNA Guide
gcagcugcagggacaacaugaa

SEQ ID NO: 3304 - RNA, 22 nt, Artificial Sequence
  ELANE RNA Guide
gcagggacaacaugaagggcca

SEQ ID NO: 3305 - RNA, 22 nt, Artificial Sequence
  ELANE RNA Guide
gcccuucauguugucccugcag

SEQ ID NO: 3306 - RNA, 22 nt, Artificial Sequence
  ELANE RNA Guide
gcgcagcugcagggacaacaug

SEQ ID NO: 3307 - RNA, 22 nt, Artificial Sequence
  ELANE RNA Guide
gcguggcccuucauguuguccc

SEQ ID NO: 3308 - RNA, 22 nt, Artificial Sequence
  ELANE RNA Guide
gcugcagggacaacaugaaggg

SEQ ID NO: 3309 - RNA, 22 nt, Artificial Sequence
  ELANE RNA Guide
ggacaacaugaagggccacgcg

SEQ ID NO: 3310 - RNA, 22 nt, Artificial Sequence
  ELANE RNA Guide
ggcccuucauguugucccugca

SEQ ID NO: 3311 - RNA, 22 nt, Artificial Sequence
  ELANE RNA Guide
gggacaacaugaagggccacgc

SEQ ID NO: 3312 - RNA, 22 nt, Artificial Sequence
  ELANE RNA Guide
guggcccuucauguugucccug

SEQ ID NO: 3313 - RNA, 22 nt, Artificial Sequence
  ELANE RNA Guide
guugucccugcagcugcgcgga

SEQ ID NO: 3314 - RNA, 22 nt, Artificial Sequence
  ELANE RNA Guide
ucauguugucccugcagcugcg

SEQ ID NO: 3315 - RNA, 22 nt, Artificial Sequence
  ELANE RNA Guide
uccgcgcagcugcagggacaac

SEQ ID NO: 3316 - RNA, 22 nt, Artificial Sequence
  ELANE RNA Guide
ugcagggacaacaugaagggcc

SEQ ID NO: 3317 - RNA, 22 nt, Artificial Sequence
  ELANE RNA Guide
uggcccuucauguugucccugc

SEQ ID NO: 3318 - RNA, 22 nt, Artificial Sequence
  ELANE RNA Guide
uguugucccugcagcugcgcgg

SEQ ID NO: 3319 - RNA, 22 nt, Artificial Sequence
  ELANE RNA Guide
uucauguugucccugcagcugc

SEQ ID NO: 3320 - RNA, 20 nt, Artificial Sequence
  ELANE RNA Guide
acgcguggcccuucauggag

SEQ ID NO: 3321 - RNA, 20 nt, Artificial Sequence
  ELANE RNA Guide
acuccaugaagggccacgcg

SEQ ID NO: 3322 - RNA, 20 nt, Artificial Sequence
  ELANE RNA Guide
agcugcagggacuccaugaa

SEQ ID NO: 3323 - RNA, 20 nt, Artificial Sequence
  ELANE RNA Guide
agggacuccaugaagggcca

SEQ ID NO: 3324 - RNA, 20 nt, Artificial Sequence
  ELANE RNA Guide
auggagucccugcagcugcg

SEQ ID NO: 3325 - RNA, 20 nt, Artificial Sequence
  ELANE RNA Guide
cacgcguggcccuucaugga

SEQ ID NO: 3326 - RNA, 20 nt, Artificial Sequence
  ELANE RNA Guide
cagcugcagggacuccauga

SEQ ID NO: 3327 - RNA, 20 nt, Artificial Sequence
  ELANE RNA Guide
cagggacuccaugaagggcc

SEQ ID NO: 3328 - RNA, 20 nt, Artificial Sequence
  ELANE RNA Guide
cauggagucccugcagcugc

SEQ ID NO: 3329 - RNA, 20 nt, Artificial Sequence
  ELANE RNA Guide
cccuucauggagucccugca

SEQ ID NO: 3330 - RNA, 20 nt, Artificial Sequence
  ELANE RNA Guide
ccgcgcagcugcagggacuc

SEQ ID NO: 3331 - RNA, 20 nt, Artificial Sequence
  ELANE RNA Guide
ccuucauggagucccugcag

SEQ ID NO: 3332 - RNA, 20 nt, Artificial Sequence
  ELANE RNA Guide
cgcagcugcagggacuccau

SEQ ID NO: 3333 - RNA, 20 nt, Artificial Sequence
  ELANE RNA Guide
cgcgcagcugcagggacucc

SEQ ID NO: 3334 - RNA, 20 nt, Artificial Sequence
  ELANE RNA Guide
cgcguggcccuucauggagu

SEQ ID NO: 3335 - RNA, 20 nt, Artificial Sequence
  ELANE RNA Guide
cguggcccuucauggagucc

SEQ ID NO: 3336 - RNA, 20 nt, Artificial Sequence
  ELANE RNA Guide
cuccaugaagggccacgcgu

SEQ ID NO: 3337 - RNA, 20 nt, Artificial Sequence
  ELANE RNA Guide
cugcagggacuccaugaagg

SEQ ID NO: 3338 - RNA, 20 nt, Artificial Sequence
  ELANE RNA Guide
cuucauggagucccugcagc

SEQ ID NO: 3339 - RNA, 20 nt, Artificial Sequence
  ELANE RNA Guide
gacuccaugaagggccacgc

SEQ ID NO: 3340 - RNA, 20 nt, Artificial Sequence
  ELANE RNA Guide
gagucccugcagcugcgcgg

SEQ ID NO: 3341 - RNA, 20 nt, Artificial Sequence
  ELANE RNA Guide
gcagcugcagggacuccaug

SEQ ID NO: 3342 - RNA, 20 nt, Artificial Sequence
  ELANE RNA Guide
gcagggacuccaugaagggc

SEQ ID NO: 3343 - RNA, 20 nt, Artificial Sequence
  ELANE RNA Guide
gcccuucauggagucccugc

SEQ ID NO: 3344 - RNA, 20 nt, Artificial Sequence
  ELANE RNA Guide
gcgcagcugcagggacucca

SEQ ID NO: 3345 - RNA, 20 nt, Artificial Sequence
  ELANE RNA Guide
gcguggcccuucauggaguc

SEQ ID NO: 3346 - RNA, 20 nt, Artificial Sequence
  ELANE RNA Guide
gcugcagggacuccaugaag

SEQ ID NO: 3347 - RNA, 20 nt, Artificial Sequence
  ELANE RNA Guide
ggacuccaugaagggccacg

SEQ ID NO: 3348 - RNA, 20 nt, Artificial Sequence
  ELANE RNA Guide
ggagucccugcagcugcgcg

SEQ ID NO: 3349 - RNA, 20 nt, Artificial Sequence
  ELANE RNA Guide
ggcccuucauggagucccug

SEQ ID NO: 3350 - RNA, 20 nt, Artificial Sequence
  ELANE RNA Guide
ggccuccgcgcagcugcagg

SEQ ID NO: 3351 - RNA, 20 nt, Artificial Sequence
  ELANE RNA Guide
gggacuccaugaagggccac

SEQ ID NO: 3352 - RNA, 20 nt, Artificial Sequence
  ELANE RNA Guide
guggcccuucauggaguccc

SEQ ID NO: 3353 - RNA, 20 nt, Artificial Sequence
  ELANE RNA Guide
ucauggagucccugcagcug

SEQ ID NO: 3354 - RNA, 20 nt, Artificial Sequence
  ELANE RNA Guide
uccgcgcagcugcagggacu

SEQ ID NO: 3355 - RNA, 20 nt, Artificial Sequence
  ELANE RNA Guide
ugcagggacuccaugaaggg

SEQ ID NO: 3356 - RNA, 20 nt, Artificial Sequence
  ELANE RNA Guide
uggagucccugcagcugcgc

SEQ ID NO: 3357 - RNA, 20 nt, Artificial Sequence
  ELANE RNA Guide
uggcccuucauggagucccu

SEQ ID NO: 3358 - RNA, 20 nt, Artificial Sequence
  ELANE RNA Guide
uucauggagucccugcagcu

SEQ ID NO: 3359 - RNA, 21 nt, Artificial Sequence
  ELANE RNA Guide
acgcguggcccuucauggagu

SEQ ID NO: 3360 - RNA, 21 nt, Artificial Sequence
  ELANE RNA Guide
acuccaugaagggccacgcgu

SEQ ID NO: 3361 - RNA, 21 nt, Artificial Sequence
  ELANE RNA Guide
agcugcagggacuccaugaag

SEQ ID NO: 3362 - RNA, 21 nt, Artificial Sequence
  ELANE RNA Guide
agggacuccaugaagggccac

SEQ ID NO: 3363 - RNA, 21 nt, Artificial Sequence
  ELANE RNA Guide
auggagucccugcagcugcgc

SEQ ID NO: 3364 - RNA, 21 nt, Artificial Sequence
  ELANE RNA Guide
cacgcguggcccuucauggag

SEQ ID NO: 3365 - RNA, 21 nt, Artificial Sequence
  ELANE RNA Guide
cagcugcagggacuccaugaa

SEQ ID NO: 3366 - RNA, 21 nt, Artificial Sequence
  ELANE RNA Guide
cagggacuccaugaagggcca

SEQ ID NO: 3367 - RNA, 21 nt, Artificial Sequence
  ELANE RNA Guide
cauggagucccugcagcugcg

SEQ ID NO: 3368 - RNA, 21 nt, Artificial Sequence
  ELANE RNA Guide
ccacgcguggcccuucaugga

SEQ ID NO: 3369 - RNA, 21 nt, Artificial Sequence
  ELANE RNA Guide
cccuucauggagucccugcag

SEQ ID NO: 3370 - RNA, 21 nt, Artificial Sequence
  ELANE RNA Guide
ccgcgcagcugcagggacucc

SEQ ID NO: 3371 - RNA, 21 nt, Artificial Sequence
  ELANE RNA Guide
ccuucauggagucccugcagc

SEQ ID NO: 3372 - RNA, 21 nt, Artificial Sequence
  ELANE RNA Guide
cgcagcugcagggacuccaug

SEQ ID NO: 3373 - RNA, 21 nt, Artificial Sequence
  ELANE RNA Guide
cgcgcagcugcagggacucca

SEQ ID NO: 3374 - RNA, 21 nt, Artificial Sequence
  ELANE RNA Guide
cgcguggcccuucauggaguc

SEQ ID NO: 3375 - RNA, 21 nt, Artificial Sequence
  ELANE RNA Guide
cguggcccuucauggaguccc

SEQ ID NO: 3376 - RNA, 21 nt, Artificial Sequence
  ELANE RNA Guide
cuccaugaagggccacgcgug

SEQ ID NO: 3377 - RNA, 21 nt, Artificial Sequence
  ELANE RNA Guide
cuccgcgcagcugcagggacu

SEQ ID NO: 3378 - RNA, 21 nt, Artificial Sequence
  ELANE RNA Guide
cugcagggacuccaugaaggg

SEQ ID NO: 3379 - RNA, 21 nt, Artificial Sequence
  ELANE RNA Guide
cuucauggagucccugcagcu

SEQ ID NO: 3380 - RNA, 21 nt, Artificial Sequence
  ELANE RNA Guide
gacuccaugaagggccacgcg

SEQ ID NO: 3381 - RNA, 21 nt, Artificial Sequence
  ELANE RNA Guide
gagucccugcagcugcgcgga

SEQ ID NO: 3382 - RNA, 21 nt, Artificial Sequence
  ELANE RNA Guide
gcagcugcagggacuccauga

SEQ ID NO: 3383 - RNA, 21 nt, Artificial Sequence
  ELANE RNA Guide
gcagggacuccaugaagggcc

SEQ ID NO: 3384 - RNA, 21 nt, Artificial Sequence
  ELANE RNA Guide
gcccuucauggagucccugca

SEQ ID NO: 3385 - RNA, 21 nt, Artificial Sequence
  ELANE RNA Guide
gcgcagcugcagggacuccau

SEQ ID NO: 3386 - RNA, 21 nt, Artificial Sequence
  ELANE RNA Guide
gcguggcccuucauggagucc

SEQ ID NO: 3387 - RNA, 21 nt, Artificial Sequence
  ELANE RNA Guide
gcugcagggacuccaugaagg

SEQ ID NO: 3388 - RNA, 21 nt, Artificial Sequence
  ELANE RNA Guide
ggacuccaugaagggccacgc

SEQ ID NO: 3389 - RNA, 21 nt, Artificial Sequence
  ELANE RNA Guide
ggagucccugcagcugcgcgg

SEQ ID NO: 3390 - RNA, 21 nt, Artificial Sequence
  ELANE RNA Guide
ggcccuucauggagucccugc

SEQ ID NO: 3391 - RNA, 21 nt, Artificial Sequence
  ELANE RNA Guide
gggacuccaugaagggccacg

SEQ ID NO: 3392 - RNA, 21 nt, Artificial Sequence
  ELANE RNA Guide
guggcccuucauggagucccu

SEQ ID NO: 3393 - RNA, 21 nt, Artificial Sequence
  ELANE RNA Guide
ucauggagucccugcagcugc

SEQ ID NO: 3394 - RNA, 21 nt, Artificial Sequence
  ELANE RNA Guide
uccgcgcagcugcagggacuc

SEQ ID NO: 3395 - RNA, 21 nt, Artificial Sequence
  ELANE RNA Guide
ugcagggacuccaugaagggc

SEQ ID NO: 3396 - RNA, 21 nt, Artificial Sequence
  ELANE RNA Guide
uggagucccugcagcugcgcg

SEQ ID NO: 3397 - RNA, 21 nt, Artificial Sequence
  ELANE RNA Guide
uggcccuucauggagucccug

SEQ ID NO: 3398 - RNA, 21 nt, Artificial Sequence
  ELANE RNA Guide
uggccuccgcgcagcugcagg

SEQ ID NO: 3399 - RNA, 21 nt, Artificial Sequence
  ELANE RNA Guide
uucauggagucccugcagcug

SEQ ID NO: 3400 - RNA, 22 nt, Artificial Sequence
  ELANE RNA Guide
acgcguggcccuucauggaguc

SEQ ID NO: 3401 - RNA, 22 nt, Artificial Sequence
  ELANE RNA Guide
acuccaugaagggccacgcgug

SEQ ID NO: 3402 - RNA, 22 nt, Artificial Sequence
  ELANE RNA Guide
agcugcagggacuccaugaagg

SEQ ID NO: 3403 - RNA, 22 nt, Artificial Sequence
  ELANE RNA Guide
agggacuccaugaagggccacg

SEQ ID NO: 3404 - RNA, 22 nt, Artificial Sequence
  ELANE RNA Guide
auggagucccugcagcugcgcg

SEQ ID NO: 3405 - RNA, 22 nt, Artificial Sequence
  ELANE RNA Guide
cacgcguggcccuucauggagu

SEQ ID NO: 3406 - RNA, 22 nt, Artificial Sequence
  ELANE RNA Guide
cagcugcagggacuccaugaag

SEQ ID NO: 3407 - RNA, 22 nt, Artificial Sequence
  ELANE RNA Guide
cagggacuccaugaagggccac

SEQ ID NO: 3408 - RNA, 22 nt, Artificial Sequence
  ELANE RNA Guide
cauggagucccugcagcugcgc

SEQ ID NO: 3409 - RNA, 22 nt, Artificial Sequence
  ELANE RNA Guide
ccacgcguggcccuucauggag

SEQ ID NO: 3410 - RNA, 22 nt, Artificial Sequence
  ELANE RNA Guide
cccacgcguggcccuucaugga

SEQ ID NO: 3411 - RNA, 22 nt, Artificial Sequence
  ELANE RNA Guide
cccuucauggagucccugcagc

SEQ ID NO: 3412 - RNA, 22 nt, Artificial Sequence
  ELANE RNA Guide
ccgcgcagcugcagggacucca

SEQ ID NO: 3413 - RNA, 22 nt, Artificial Sequence
  ELANE RNA Guide
ccuccgcgcagcugcagggacu

SEQ ID NO: 3414 - RNA, 22 nt, Artificial Sequence
  ELANE RNA Guide
ccuucauggagucccugcagcu

SEQ ID NO: 3415 - RNA, 22 nt, Artificial Sequence
  ELANE RNA Guide
cgcagcugcagggacuccauga

SEQ ID NO: 3416 - RNA, 22 nt, Artificial Sequence
  ELANE RNA Guide
cgcgcagcugcagggacuccau

SEQ ID NO: 3417 - RNA, 22 nt, Artificial Sequence
  ELANE RNA Guide
cgcguggcccuucauggagucc

SEQ ID NO: 3418 - RNA, 22 nt, Artificial Sequence
  ELANE RNA Guide
cguggcccuucauggagucccu

SEQ ID NO: 3419 - RNA, 22 nt, Artificial Sequence
  ELANE RNA Guide
cuccaugaagggccacgcgugg

SEQ ID NO: 3420 - RNA, 22 nt, Artificial Sequence
  ELANE RNA Guide
cuccgcgcagcugcagggacuc

SEQ ID NO: 3421 - RNA, 22 nt, Artificial Sequence
  ELANE RNA Guide
cugcagggacuccaugaagggc

SEQ ID NO: 3422 - RNA, 22 nt, Artificial Sequence
  ELANE RNA Guide
cuucauggagucccugcagcug

SEQ ID NO: 3423 - RNA, 22 nt, Artificial Sequence
  ELANE RNA Guide
gacuccaugaagggccacgcgu

SEQ ID NO: 3424 - RNA, 22 nt, Artificial Sequence
  ELANE RNA Guide
gagucccugcagcugcgcggag

SEQ ID NO: 3425 - RNA, 22 nt, Artificial Sequence
  ELANE RNA Guide
gcagcugcagggacuccaugaa

SEQ ID NO: 3426 - RNA, 22 nt, Artificial Sequence
  ELANE RNA Guide
gcagggacuccaugaagggcca

SEQ ID NO: 3427 - RNA, 22 nt, Artificial Sequence
  ELANE RNA Guide
gcccuucauggagucccugcag

SEQ ID NO: 3428 - RNA, 22 nt, Artificial Sequence
  ELANE RNA Guide
gcgcagcugcagggacuccaug

SEQ ID NO: 3429 - RNA, 22 nt, Artificial Sequence
  ELANE RNA Guide
gcguggcccuucauggaguccc

SEQ ID NO: 3430 - RNA, 22 nt, Artificial Sequence
  ELANE RNA Guide
gcugcagggacuccaugaaggg

SEQ ID NO: 3431 - RNA, 22 nt, Artificial Sequence
  ELANE RNA Guide
ggacuccaugaagggccacgcg

SEQ ID NO: 3432 - RNA, 22 nt, Artificial Sequence
  ELANE RNA Guide
ggagucccugcagcugcgcgga

SEQ ID NO: 3433 - RNA, 22 nt, Artificial Sequence
  ELANE RNA Guide
ggcccuucauggagucccugca

SEQ ID NO: 3434 - RNA, 22 nt, Artificial Sequence
  ELANE RNA Guide
gggacuccaugaagggccacgc

SEQ ID NO: 3435 - RNA, 22 nt, Artificial Sequence
  ELANE RNA Guide
guggcccuucauggagucccug

SEQ ID NO: 3436 - RNA, 22 nt, Artificial Sequence
  ELANE RNA Guide
guggccuccgcgcagcugcagg

SEQ ID NO: 3437 - RNA, 22 nt, Artificial Sequence
  ELANE RNA Guide
ucauggagucccugcagcugcg

SEQ ID NO: 3438 - RNA, 22 nt, Artificial Sequence
  ELANE RNA Guide
uccgcgcagcugcagggacucc

SEQ ID NO: 3439 - RNA, 22 nt, Artificial Sequence
  ELANE RNA Guide
ugcagggacuccaugaagggcc

SEQ ID NO: 3440 - RNA, 22 nt, Artificial Sequence
  ELANE RNA Guide
uggagucccugcagcugcgcgg

SEQ ID NO: 3441 - RNA, 22 nt, Artificial Sequence
  ELANE RNA Guide
uggcccuucauggagucccugc

SEQ ID NO: 3442 - RNA, 22 nt, Artificial Sequence
  ELANE RNA Guide
uucauggagucccugcagcugc

SEQ ID NO: 3443 - RNA, 20 nt, Artificial Sequence
  ELANE RNA Guide
agcugcagguacaccaugaa

SEQ ID NO: 3444 - RNA, 20 nt, Artificial Sequence
  ELANE RNA Guide
agguacaccaugaagggcca

SEQ ID NO: 3445 - RNA, 20 nt, Artificial Sequence
  ELANE RNA Guide
augguguaccugcagcugcg

SEQ ID NO: 3446 - RNA, 20 nt, Artificial Sequence
  ELANE RNA Guide
cagcugcagguacaccauga

SEQ ID NO: 3447 - RNA, 20 nt, Artificial Sequence
  ELANE RNA Guide
cagguacaccaugaagggcc

SEQ ID NO: 3448 - RNA, 20 nt, Artificial Sequence
  ELANE RNA Guide
caugguguaccugcagcugc

SEQ ID NO: 3449 - RNA, 20 nt, Artificial Sequence
  ELANE RNA Guide
cccuucaugguguaccugca

SEQ ID NO: 3450 - RNA, 20 nt, Artificial Sequence
  ELANE RNA Guide
ccgcgcagcugcagguacac

SEQ ID NO: 3451 - RNA, 20 nt, Artificial Sequence
  ELANE RNA Guide
ccuccgcgcagcugcaggua

SEQ ID NO: 3452 - RNA, 20 nt, Artificial Sequence
  ELANE RNA Guide
ccuucaugguguaccugcag

SEQ ID NO: 3453 - RNA, 20 nt, Artificial Sequence
  ELANE RNA Guide
cgcagcugcagguacaccau

SEQ ID NO: 3454 - RNA, 20 nt, Artificial Sequence
  ELANE RNA Guide
cgcgcagcugcagguacacc

SEQ ID NO: 3455 - RNA, 20 nt, Artificial Sequence
  ELANE RNA Guide
cgcguggcccuucauggugu

SEQ ID NO: 3456 - RNA, 20 nt, Artificial Sequence
  ELANE RNA Guide
cguggcccuucaugguguac

SEQ ID NO: 3457 - RNA, 20 nt, Artificial Sequence
  ELANE RNA Guide
cuccgcgcagcugcagguac

SEQ ID NO: 3458 - RNA, 20 nt, Artificial Sequence
  ELANE RNA Guide
cugcagguacaccaugaagg

SEQ ID NO: 3459 - RNA, 20 nt, Artificial Sequence
  ELANE RNA Guide
cuucaugguguaccugcagc

SEQ ID NO: 3460 - RNA, 20 nt, Artificial Sequence
  ELANE RNA Guide
gcagcugcagguacaccaug

SEQ ID NO: 3461 - RNA, 20 nt, Artificial Sequence
  ELANE RNA Guide
gcagguacaccaugaagggc

SEQ ID NO: 3462 - RNA, 20 nt, Artificial Sequence
  ELANE RNA Guide
gcccuucaugguguaccugc

SEQ ID NO: 3463 - RNA, 20 nt, Artificial Sequence
  ELANE RNA Guide
gccuccgcgcagcugcaggu

SEQ ID NO: 3464 - RNA, 20 nt, Artificial Sequence
  ELANE RNA Guide
gcgcagcugcagguacacca

SEQ ID NO: 3465 - RNA, 20 nt, Artificial Sequence
  ELANE RNA Guide
gcguggcccuucauggugua

SEQ ID NO: 3466 - RNA, 20 nt, Artificial Sequence
  ELANE RNA Guide
gcugcagguacaccaugaag

SEQ ID NO: 3467 - RNA, 20 nt, Artificial Sequence
  ELANE RNA Guide
ggcccuucaugguguaccug

SEQ ID NO: 3468 - RNA, 20 nt, Artificial Sequence
  ELANE RNA Guide
gguacaccaugaagggccac

SEQ ID NO: 3469 - RNA, 20 nt, Artificial Sequence
  ELANE RNA Guide
gguguaccugcagcugcgcg

SEQ ID NO: 3470 - RNA, 20 nt, Artificial Sequence
  ELANE RNA Guide
guacaccaugaagggccacg

SEQ ID NO: 3471 - RNA, 20 nt, Artificial Sequence
  ELANE RNA Guide
guaccugcagcugcgcggag

SEQ ID NO: 3472 - RNA, 20 nt, Artificial Sequence
  ELANE RNA Guide
guggcccuucaugguguacc

SEQ ID NO: 3473 - RNA, 20 nt, Artificial Sequence
  ELANE RNA Guide
guguaccugcagcugcgcgg

SEQ ID NO: 3474 - RNA, 20 nt, Artificial Sequence
  ELANE RNA Guide
uaccugcagcugcgcggagg

SEQ ID NO: 3475 - RNA, 20 nt, Artificial Sequence
  ELANE RNA Guide
ucaugguguaccugcagcug

SEQ ID NO: 3476 - RNA, 20 nt, Artificial Sequence
  ELANE RNA Guide
uccgcgcagcugcagguaca

SEQ ID NO: 3477 - RNA, 20 nt, Artificial Sequence
  ELANE RNA Guide
ugcagguacaccaugaaggg

SEQ ID NO: 3478 - RNA, 20 nt, Artificial Sequence
  ELANE RNA Guide
uggcccuucaugguguaccu

SEQ ID NO: 3479 - RNA, 20 nt, Artificial Sequence
  ELANE RNA Guide
uggccuccgcgcagcugcag

SEQ ID NO: 3480 - RNA, 20 nt, Artificial Sequence
  ELANE RNA Guide
ugguguaccugcagcugcgc

SEQ ID NO: 3481 - RNA, 20 nt, Artificial Sequence
  ELANE RNA Guide
uguaccugcagcugcgcgga

SEQ ID NO: 3482 - RNA, 20 nt, Artificial Sequence
  ELANE RNA Guide
uucaugguguaccugcagcu

SEQ ID NO: 3483 - RNA, 21 nt, Artificial Sequence
  ELANE RNA Guide
acgcguggcccuucauggugu

SEQ ID NO: 3484 - RNA, 21 nt, Artificial Sequence
  ELANE RNA Guide
agcugcagguacaccaugaag

SEQ ID NO: 3485 - RNA, 21 nt, Artificial Sequence
  ELANE RNA Guide
agguacaccaugaagggccac

SEQ ID NO: 3486 - RNA, 21 nt, Artificial Sequence
  ELANE RNA Guide
augguguaccugcagcugcgc

SEQ ID NO: 3487 - RNA, 21 nt, Artificial Sequence
  ELANE RNA Guide
cagcugcagguacaccaugaa

SEQ ID NO: 3488 - RNA, 21 nt, Artificial Sequence
  ELANE RNA Guide
cagguacaccaugaagggcca

SEQ ID NO: 3489 - RNA, 21 nt, Artificial Sequence
  ELANE RNA Guide
caugguguaccugcagcugcg

SEQ ID NO: 3490 - RNA, 21 nt, Artificial Sequence
  ELANE RNA Guide
cccuucaugguguaccugcag

SEQ ID NO: 3491 - RNA, 21 nt, Artificial Sequence
  ELANE RNA Guide
ccgcgcagcugcagguacacc

SEQ ID NO: 3492 - RNA, 21 nt, Artificial Sequence
  ELANE RNA Guide
ccuccgcgcagcugcagguac

SEQ ID NO: 3493 - RNA, 21 nt, Artificial Sequence
  ELANE RNA Guide
ccuucaugguguaccugcagc

SEQ ID NO: 3494 - RNA, 21 nt, Artificial Sequence
  ELANE RNA Guide
cgcagcugcagguacaccaug

SEQ ID NO: 3495 - RNA, 21 nt, Artificial Sequence
  ELANE RNA Guide
cgcgcagcugcagguacacca

SEQ ID NO: 3496 - RNA, 21 nt, Artificial Sequence
  ELANE RNA Guide
cgcguggcccuucauggugua

SEQ ID NO: 3497 - RNA, 21 nt, Artificial Sequence
  ELANE RNA Guide
cguggcccuucaugguguacc

SEQ ID NO: 3498 - RNA, 21 nt, Artificial Sequence
  ELANE RNA Guide
cuccgcgcagcugcagguaca

SEQ ID NO: 3499 - RNA, 21 nt, Artificial Sequence
  ELANE RNA Guide
cugcagguacaccaugaaggg

SEQ ID NO: 3500 - RNA, 21 nt, Artificial Sequence
  ELANE RNA Guide
cuucaugguguaccugcagcu

SEQ ID NO: 3501 - RNA, 21 nt, Artificial Sequence
  ELANE RNA Guide
gcagcugcagguacaccauga

SEQ ID NO: 3502 - RNA, 21 nt, Artificial Sequence
  ELANE RNA Guide
gcagguacaccaugaagggcc

SEQ ID NO: 3503 - RNA, 21 nt, Artificial Sequence
  ELANE RNA Guide
gcccuucaugguguaccugca

SEQ ID NO: 3504 - RNA, 21 nt, Artificial Sequence
  ELANE RNA Guide
gccuccgcgcagcugcaggua

SEQ ID NO: 3505 - RNA, 21 nt, Artificial Sequence
  ELANE RNA Guide
gcgcagcugcagguacaccau

SEQ ID NO: 3506 - RNA, 21 nt, Artificial Sequence
  ELANE RNA Guide
gcguggcccuucaugguguac

SEQ ID NO: 3507 - RNA, 21 nt, Artificial Sequence
  ELANE RNA Guide
gcugcagguacaccaugaagg

SEQ ID NO: 3508 - RNA, 21 nt, Artificial Sequence
  ELANE RNA Guide
ggcccuucaugguguaccugc

SEQ ID NO: 3509 - RNA, 21 nt, Artificial Sequence
  ELANE RNA Guide
ggccuccgcgcagcugcaggu

SEQ ID NO: 3510 - RNA, 21 nt, Artificial Sequence
  ELANE RNA Guide
gguacaccaugaagggccacg

SEQ ID NO: 3511 - RNA, 21 nt, Artificial Sequence
  ELANE RNA Guide
gguguaccugcagcugcgcgg

SEQ ID NO: 3512 - RNA, 21 nt, Artificial Sequence
  ELANE RNA Guide
guacaccaugaagggccacgc

SEQ ID NO: 3513 - RNA, 21 nt, Artificial Sequence
  ELANE RNA Guide
guaccugcagcugcgcggagg

SEQ ID NO: 3514 - RNA, 21 nt, Artificial Sequence
  ELANE RNA Guide
guggcccuucaugguguaccu

SEQ ID NO: 3515 - RNA, 21 nt, Artificial Sequence
  ELANE RNA Guide
guggccuccgcgcagcugcag

SEQ ID NO: 3516 - RNA, 21 nt, Artificial Sequence
  ELANE RNA Guide
guguaccugcagcugcgcgga

SEQ ID NO: 3517 - RNA, 21 nt, Artificial Sequence
  ELANE RNA Guide
uaccugcagcugcgcggaggc

SEQ ID NO: 3518 - RNA, 21 nt, Artificial Sequence
  ELANE RNA Guide
ucaugguguaccugcagcugc

SEQ ID NO: 3519 - RNA, 21 nt, Artificial Sequence
  ELANE RNA Guide
uccgcgcagcugcagguacac

SEQ ID NO: 3520 - RNA, 21 nt, Artificial Sequence
  ELANE RNA Guide
ugcagguacaccaugaagggc

SEQ ID NO: 3521 - RNA, 21 nt, Artificial Sequence
  ELANE RNA Guide
uggcccuucaugguguaccug

SEQ ID NO: 3522 - RNA, 21 nt, Artificial Sequence
  ELANE RNA Guide
ugguguaccugcagcugcgcg

SEQ ID NO: 3523 - RNA, 21 nt, Artificial Sequence
  ELANE RNA Guide
uguaccugcagcugcgcggag

SEQ ID NO: 3524 - RNA, 21 nt, Artificial Sequence
  ELANE RNA Guide
uucaugguguaccugcagcug

SEQ ID NO: 3525 - RNA, 22 nt, Artificial Sequence
  ELANE RNA Guide
acgcguggcccuucauggugua

SEQ ID NO: 3526 - RNA, 22 nt, Artificial Sequence
  ELANE RNA Guide
agcugcagguacaccaugaagg

SEQ ID NO: 3527 - RNA, 22 nt, Artificial Sequence
  ELANE RNA Guide
agguacaccaugaagggccacg

SEQ ID NO: 3528 - RNA, 22 nt, Artificial Sequence
  ELANE RNA Guide
aguggccuccgcgcagcugcag

SEQ ID NO: 3529 - RNA, 22 nt, Artificial Sequence
  ELANE RNA Guide
augguguaccugcagcugcgcg

SEQ ID NO: 3530 - RNA, 22 nt, Artificial Sequence
  ELANE RNA Guide
cacgcguggcccuucauggugu

SEQ ID NO: 3531 - RNA, 22 nt, Artificial Sequence
  ELANE RNA Guide
cagcugcagguacaccaugaag

SEQ ID NO: 3532 - RNA, 22 nt, Artificial Sequence
  ELANE RNA Guide
cagguacaccaugaagggccac

SEQ ID NO: 3533 - RNA, 22 nt, Artificial Sequence
  ELANE RNA Guide
caugguguaccugcagcugcgc

SEQ ID NO: 3534 - RNA, 22 nt, Artificial Sequence
  ELANE RNA Guide
cccuucaugguguaccugcagc

SEQ ID NO: 3535 - RNA, 22 nt, Artificial Sequence
  ELANE RNA Guide
ccgcgcagcugcagguacacca

SEQ ID NO: 3536 - RNA, 22 nt, Artificial Sequence
  ELANE RNA Guide
ccuccgcgcagcugcagguaca

SEQ ID NO: 3537 - RNA, 22 nt, Artificial Sequence
  ELANE RNA Guide
ccuucaugguguaccugcagcu

SEQ ID NO: 3538 - RNA, 22 nt, Artificial Sequence
  ELANE RNA Guide
cgcagcugcagguacaccauga

SEQ ID NO: 3539 - RNA, 22 nt, Artificial Sequence
  ELANE RNA Guide
cgcgcagcugcagguacaccau

SEQ ID NO: 3540 - RNA, 22 nt, Artificial Sequence
  ELANE RNA Guide
cgcguggcccuucaugguguac

SEQ ID NO: 3541 - RNA, 22 nt, Artificial Sequence
  ELANE RNA Guide
cguggcccuucaugguguaccu

SEQ ID NO: 3542 - RNA, 22 nt, Artificial Sequence
  ELANE RNA Guide
cuccgcgcagcugcagguacac

SEQ ID NO: 3543 - RNA, 22 nt, Artificial Sequence
  ELANE RNA Guide
cugcagguacaccaugaagggc

SEQ ID NO: 3544 - RNA, 22 nt, Artificial Sequence
  ELANE RNA Guide
cuucaugguguaccugcagcug

SEQ ID NO: 3545 - RNA, 22 nt, Artificial Sequence
  ELANE RNA Guide
gcagcugcagguacaccaugaa

SEQ ID NO: 3546 - RNA, 22 nt, Artificial Sequence
  ELANE RNA Guide
gcagguacaccaugaagggcca

SEQ ID NO: 3547 - RNA, 22 nt, Artificial Sequence
  ELANE RNA Guide
gcccuucaugguguaccugcag

SEQ ID NO: 3548 - RNA, 22 nt, Artificial Sequence
  ELANE RNA Guide
gccuccgcgcagcugcagguac

SEQ ID NO: 3549 - RNA, 22 nt, Artificial Sequence
  ELANE RNA Guide
gcgcagcugcagguacaccaug

SEQ ID NO: 3550 - RNA, 22 nt, Artificial Sequence
  ELANE RNA Guide
gcguggcccuucaugguguacc

SEQ ID NO: 3551 - RNA, 22 nt, Artificial Sequence
  ELANE RNA Guide
gcugcagguacaccaugaaggg

SEQ ID NO: 3552 - RNA, 22 nt, Artificial Sequence
  ELANE RNA Guide
ggcccuucaugguguaccugca

SEQ ID NO: 3553 - RNA, 22 nt, Artificial Sequence
  ELANE RNA Guide
ggccuccgcgcagcugcaggua

SEQ ID NO: 3554 - RNA, 22 nt, Artificial Sequence
  ELANE RNA Guide
gguacaccaugaagggccacgc

SEQ ID NO: 3555 - RNA, 22 nt, Artificial Sequence
  ELANE RNA Guide
gguguaccugcagcugcgcgga

SEQ ID NO: 3556 - RNA, 22 nt, Artificial Sequence
  ELANE RNA Guide
guacaccaugaagggccacgcg

SEQ ID NO: 3557 - RNA, 22 nt, Artificial Sequence
  ELANE RNA Guide
guaccugcagcugcgcggaggc

SEQ ID NO: 3558 - RNA, 22 nt, Artificial Sequence
  ELANE RNA Guide
guggcccuucaugguguaccug

SEQ ID NO: 3559 - RNA, 22 nt, Artificial Sequence
  ELANE RNA Guide
guguaccugcagcugcgcggag

SEQ ID NO: 3560 - RNA, 22 nt, Artificial Sequence
  ELANE RNA Guide
uaccugcagcugcgcggaggcc

SEQ ID NO: 3561 - RNA, 22 nt, Artificial Sequence
  ELANE RNA Guide
ucaugguguaccugcagcugcg

SEQ ID NO: 3562 - RNA, 22 nt, Artificial Sequence
  ELANE RNA Guide
uccgcgcagcugcagguacacc

SEQ ID NO: 3563 - RNA, 22 nt, Artificial Sequence
  ELANE RNA Guide
ugcagguacaccaugaagggcc

SEQ ID NO: 3564 - RNA, 22 nt, Artificial Sequence
  ELANE RNA Guide
uggcccuucaugguguaccugc

SEQ ID NO: 3565 - RNA, 22 nt, Artificial Sequence
  ELANE RNA Guide
uggccuccgcgcagcugcaggu

SEQ ID NO: 3566 - RNA, 22 nt, Artificial Sequence
  ELANE RNA Guide
ugguguaccugcagcugcgcgg

SEQ ID NO: 3567 - RNA, 22 nt, Artificial Sequence
  ELANE RNA Guide
uguaccugcagcugcgcggagg

SEQ ID NO: 3568 - RNA, 22 nt, Artificial Sequence
  ELANE RNA Guide
uucaugguguaccugcagcugc

SEQ ID NO: 3569 - RNA, 20 nt, Artificial Sequence
  ELANE RNA Guide
agcugcaggcacaccaugaa

SEQ ID NO: 3570 - RNA, 20 nt, Artificial Sequence
  ELANE RNA Guide
aggcacaccaugaagggcca

SEQ ID NO: 3571 - RNA, 20 nt, Artificial Sequence
  ELANE RNA Guide
auggugugccugcagcugcg

SEQ ID NO: 3572 - RNA, 20 nt, Artificial Sequence
  ELANE RNA Guide
cagcugcaggcacaccauga

SEQ ID NO: 3573 - RNA, 20 nt, Artificial Sequence
  ELANE RNA Guide
caggcacaccaugaagggcc

SEQ ID NO: 3574 - RNA, 20 nt, Artificial Sequence
  ELANE RNA Guide
cauggugugccugcagcugc

SEQ ID NO: 3575 - RNA, 20 nt, Artificial Sequence
  ELANE RNA Guide
cccuucauggugugccugca

SEQ ID NO: 3576 - RNA, 20 nt, Artificial Sequence
  ELANE RNA Guide
ccgcgcagcugcaggcacac

SEQ ID NO: 3577 - RNA, 20 nt, Artificial Sequence
  ELANE RNA Guide
ccuccgcgcagcugcaggca

SEQ ID NO: 3578 - RNA, 20 nt, Artificial Sequence
  ELANE RNA Guide
ccuucauggugugccugcag

SEQ ID NO: 3579 - RNA, 20 nt, Artificial Sequence
  ELANE RNA Guide
cgcagcugcaggcacaccau

SEQ ID NO: 3580 - RNA, 20 nt, Artificial Sequence
  ELANE RNA Guide
cgcgcagcugcaggcacacc

SEQ ID NO: 3581 - RNA, 20 nt, Artificial Sequence
  ELANE RNA Guide
cguggcccuucauggugugc

SEQ ID NO: 3582 - RNA, 20 nt, Artificial Sequence
  ELANE RNA Guide
cuccgcgcagcugcaggcac

SEQ ID NO: 3583 - RNA, 20 nt, Artificial Sequence
  ELANE RNA Guide
cugcaggcacaccaugaagg

SEQ ID NO: 3584 - RNA, 20 nt, Artificial Sequence
  ELANE RNA Guide
cuucauggugugccugcagc

SEQ ID NO: 3585 - RNA, 20 nt, Artificial Sequence
  ELANE RNA Guide
gcacaccaugaagggccacg

SEQ ID NO: 3586 - RNA, 20 nt, Artificial Sequence
  ELANE RNA Guide
gcagcugcaggcacaccaug

SEQ ID NO: 3587 - RNA, 20 nt, Artificial Sequence
  ELANE RNA Guide
gcaggcacaccaugaagggc

SEQ ID NO: 3588 - RNA, 20 nt, Artificial Sequence
  ELANE RNA Guide
gcccuucauggugugccugc

SEQ ID NO: 3589 - RNA, 20 nt, Artificial Sequence
  ELANE RNA Guide
gccuccgcgcagcugcaggc

SEQ ID NO: 3590 - RNA, 20 nt, Artificial Sequence
  ELANE RNA Guide
gcgcagcugcaggcacacca

SEQ ID NO: 3591 - RNA, 20 nt, Artificial Sequence
  ELANE RNA Guide
gcguggcccuucauggugug

SEQ ID NO: 3592 - RNA, 20 nt, Artificial Sequence
  ELANE RNA Guide
gcugcaggcacaccaugaag

SEQ ID NO: 3593 - RNA, 20 nt, Artificial Sequence
  ELANE RNA Guide
ggcacaccaugaagggccac

SEQ ID NO: 3594 - RNA, 20 nt, Artificial Sequence
  ELANE RNA Guide
ggcccuucauggugugccug

SEQ ID NO: 3595 - RNA, 20 nt, Artificial Sequence
  ELANE RNA Guide
ggugugccugcagcugcgcg

SEQ ID NO: 3596 - RNA, 20 nt, Artificial Sequence
  ELANE RNA Guide
gugccugcagcugcgcggag

SEQ ID NO: 3597 - RNA, 20 nt, Artificial Sequence
  ELANE RNA Guide
guggcccuucauggugugcc

SEQ ID NO: 3598 - RNA, 20 nt, Artificial Sequence
  ELANE RNA Guide
gugugccugcagcugcgcgg

SEQ ID NO: 3599 - RNA, 20 nt, Artificial Sequence
  ELANE RNA Guide
ucauggugugccugcagcug

SEQ ID NO: 3600 - RNA, 20 nt, Artificial Sequence
  ELANE RNA Guide
uccgcgcagcugcaggcaca

SEQ ID NO: 3601 - RNA, 20 nt, Artificial Sequence
  ELANE RNA Guide
ugcaggcacaccaugaaggg

SEQ ID NO: 3602 - RNA, 20 nt, Artificial Sequence
  ELANE RNA Guide
ugccugcagcugcgcggagg

SEQ ID NO: 3603 - RNA, 20 nt, Artificial Sequence
  ELANE RNA Guide
uggcccuucauggugugccu

SEQ ID NO: 3604 - RNA, 20 nt, Artificial Sequence
  ELANE RNA Guide
uggugugccugcagcugcgc

SEQ ID NO: 3605 - RNA, 20 nt, Artificial Sequence
  ELANE RNA Guide
ugugccugcagcugcgcgga

SEQ ID NO: 3606 - RNA, 20 nt, Artificial Sequence
  ELANE RNA Guide
uucauggugugccugcagcu

SEQ ID NO: 3607 - RNA, 21 nt, Artificial Sequence
  ELANE RNA Guide
agcugcaggcacaccaugaag

SEQ ID NO: 3608 - RNA, 21 nt, Artificial Sequence
  ELANE RNA Guide
aggcacaccaugaagggccac

SEQ ID NO: 3609 - RNA, 21 nt, Artificial Sequence
  ELANE RNA Guide
auggugugccugcagcugcgc

SEQ ID NO: 3610 - RNA, 21 nt, Artificial Sequence
  ELANE RNA Guide
cagcugcaggcacaccaugaa

SEQ ID NO: 3611 - RNA, 21 nt, Artificial Sequence
  ELANE RNA Guide
caggcacaccaugaagggcca

SEQ ID NO: 3612 - RNA, 21 nt, Artificial Sequence
  ELANE RNA Guide
cauggugugccugcagcugcg

SEQ ID NO: 3613 - RNA, 21 nt, Artificial Sequence
  ELANE RNA Guide
cccuucauggugugccugcag

SEQ ID NO: 3614 - RNA, 21 nt, Artificial Sequence
  ELANE RNA Guide
ccgcgcagcugcaggcacacc

SEQ ID NO: 3615 - RNA, 21 nt, Artificial Sequence
  ELANE RNA Guide
ccuccgcgcagcugcaggcac

SEQ ID NO: 3616 - RNA, 21 nt, Artificial Sequence
  ELANE RNA Guide
ccuucauggugugccugcagc

SEQ ID NO: 3617 - RNA, 21 nt, Artificial Sequence
  ELANE RNA Guide
cgcagcugcaggcacaccaug

SEQ ID NO: 3618 - RNA, 21 nt, Artificial Sequence
  ELANE RNA Guide
cgcgcagcugcaggcacacca

SEQ ID NO: 3619 - RNA, 21 nt, Artificial Sequence
  ELANE RNA Guide
cgcguggcccuucauggugug

SEQ ID NO: 3620 - RNA, 21 nt, Artificial Sequence
  ELANE RNA Guide
cguggcccuucauggugugcc

SEQ ID NO: 3621 - RNA, 21 nt, Artificial Sequence
  ELANE RNA Guide
cuccgcgcagcugcaggcaca

SEQ ID NO: 3622 - RNA, 21 nt, Artificial Sequence
  ELANE RNA Guide
cugcaggcacaccaugaaggg

SEQ ID NO: 3623 - RNA, 21 nt, Artificial Sequence
  ELANE RNA Guide
cuucauggugugccugcagcu

SEQ ID NO: 3624 - RNA, 21 nt, Artificial Sequence
  ELANE RNA Guide
gcacaccaugaagggccacgc

SEQ ID NO: 3625 - RNA, 21 nt, Artificial Sequence
  ELANE RNA Guide
gcagcugcaggcacaccauga

SEQ ID NO: 3626 - RNA, 21 nt, Artificial Sequence
  ELANE RNA Guide
gcaggcacaccaugaagggcc

SEQ ID NO: 3627 - RNA, 21 nt, Artificial Sequence
  ELANE RNA Guide
gcccuucauggugugccugca

SEQ ID NO: 3628 - RNA, 21 nt, Artificial Sequence
  ELANE RNA Guide
gccuccgcgcagcugcaggca

SEQ ID NO: 3629 - RNA, 21 nt, Artificial Sequence
  ELANE RNA Guide
gcgcagcugcaggcacaccau

SEQ ID NO: 3630 - RNA, 21 nt, Artificial Sequence
  ELANE RNA Guide
gcguggcccuucauggugugc

SEQ ID NO: 3631 - RNA, 21 nt, Artificial Sequence
  ELANE RNA Guide
gcugcaggcacaccaugaagg

SEQ ID NO: 3632 - RNA, 21 nt, Artificial Sequence
  ELANE RNA Guide
ggcacaccaugaagggccacg

SEQ ID NO: 3633 - RNA, 21 nt, Artificial Sequence
  ELANE RNA Guide
ggcccuucauggugugccugc

SEQ ID NO: 3634 - RNA, 21 nt, Artificial Sequence
  ELANE RNA Guide
ggugugccugcagcugcgcgg

SEQ ID NO: 3635 - RNA, 21 nt, Artificial Sequence
  ELANE RNA Guide
gugccugcagcugcgcggagg

SEQ ID NO: 3636 - RNA, 21 nt, Artificial Sequence
  ELANE RNA Guide
guggcccuucauggugugccu

SEQ ID NO: 3637 - RNA, 21 nt, Artificial Sequence
  ELANE RNA Guide
gugugccugcagcugcgcgga

SEQ ID NO: 3638 - RNA, 21 nt, Artificial Sequence
  ELANE RNA Guide
ucauggugugccugcagcugc

SEQ ID NO: 3639 - RNA, 21 nt, Artificial Sequence
  ELANE RNA Guide
uccgcgcagcugcaggcacac

SEQ ID NO: 3640 - RNA, 21 nt, Artificial Sequence
  ELANE RNA Guide
ugcaggcacaccaugaagggc

SEQ ID NO: 3641 - RNA, 21 nt, Artificial Sequence
  ELANE RNA Guide
ugccugcagcugcgcggaggc

SEQ ID NO: 3642 - RNA, 21 nt, Artificial Sequence
  ELANE RNA Guide
uggcccuucauggugugccug

SEQ ID NO: 3643 - RNA, 21 nt, Artificial Sequence
  ELANE RNA Guide
uggugugccugcagcugcgcg

SEQ ID NO: 3644 - RNA, 21 nt, Artificial Sequence
  ELANE RNA Guide
ugugccugcagcugcgcggag

SEQ ID NO: 3645 - RNA, 21 nt, Artificial Sequence
  ELANE RNA Guide
uucauggugugccugcagcug

SEQ ID NO: 3646 - RNA, 22 nt, Artificial Sequence
  ELANE RNA Guide
acgcguggcccuucauggugug

SEQ ID NO: 3647 - RNA, 22 nt, Artificial Sequence
  ELANE RNA Guide
agcugcaggcacaccaugaagg

SEQ ID NO: 3648 - RNA, 22 nt, Artificial Sequence
  ELANE RNA Guide
aggcacaccaugaagggccacg

SEQ ID NO: 3649 - RNA, 22 nt, Artificial Sequence
  ELANE RNA Guide
auggugugccugcagcugcgcg

SEQ ID NO: 3650 - RNA, 22 nt, Artificial Sequence
  ELANE RNA Guide
cagcugcaggcacaccaugaag

SEQ ID NO: 3651 - RNA, 22 nt, Artificial Sequence
  ELANE RNA Guide
caggcacaccaugaagggccac

SEQ ID NO: 3652 - RNA, 22 nt, Artificial Sequence
  ELANE RNA Guide
cauggugugccugcagcugcgc

SEQ ID NO: 3653 - RNA, 22 nt, Artificial Sequence
  ELANE RNA Guide
cccuucauggugugccugcagc

SEQ ID NO: 3654 - RNA, 22 nt, Artificial Sequence
  ELANE RNA Guide
ccgcgcagcugcaggcacacca

SEQ ID NO: 3655 - RNA, 22 nt, Artificial Sequence
  ELANE RNA Guide
ccuccgcgcagcugcaggcaca

SEQ ID NO: 3656 - RNA, 22 nt, Artificial Sequence
  ELANE RNA Guide
ccuucauggugugccugcagcu

SEQ ID NO: 3657 - RNA, 22 nt, Artificial Sequence
  ELANE RNA Guide
cgcagcugcaggcacaccauga

SEQ ID NO: 3658 - RNA, 22 nt, Artificial Sequence
  ELANE RNA Guide
cgcgcagcugcaggcacaccau

SEQ ID NO: 3659 - RNA, 22 nt, Artificial Sequence
  ELANE RNA Guide
cgcguggcccuucauggugugc

SEQ ID NO: 3660 - RNA, 22 nt, Artificial Sequence
  ELANE RNA Guide
cguggcccuucauggugugccu

SEQ ID NO: 3661 - RNA, 22 nt, Artificial Sequence
  ELANE RNA Guide
cuccgcgcagcugcaggcacac

SEQ ID NO: 3662 - RNA, 22 nt, Artificial Sequence
  ELANE RNA Guide
cugcaggcacaccaugaagggc

SEQ ID NO: 3663 - RNA, 22 nt, Artificial Sequence
  ELANE RNA Guide
cuucauggugugccugcagcug

SEQ ID NO: 3664 - RNA, 22 nt, Artificial Sequence
  ELANE RNA Guide
gcacaccaugaagggccacgcg

SEQ ID NO: 3665 - RNA, 22 nt, Artificial Sequence
  ELANE RNA Guide
gcagcugcaggcacaccaugaa

SEQ ID NO: 3666 - RNA, 22 nt, Artificial Sequence
  ELANE RNA Guide
gcaggcacaccaugaagggcca

SEQ ID NO: 3667 - RNA, 22 nt, Artificial Sequence
  ELANE RNA Guide
gcccuucauggugugccugcag

SEQ ID NO: 3668 - RNA, 22 nt, Artificial Sequence
  ELANE RNA Guide
gccuccgcgcagcugcaggcac

SEQ ID NO: 3669 - RNA, 22 nt, Artificial Sequence
  ELANE RNA Guide
gcgcagcugcaggcacaccaug

SEQ ID NO: 3670 - RNA, 22 nt, Artificial Sequence
  ELANE RNA Guide
gcguggcccuucauggugugcc

SEQ ID NO: 3671 - RNA, 22 nt, Artificial Sequence
  ELANE RNA Guide
gcugcaggcacaccaugaaggg

SEQ ID NO: 3672 - RNA, 22 nt, Artificial Sequence
  ELANE RNA Guide
ggcacaccaugaagggccacgc

SEQ ID NO: 3673 - RNA, 22 nt, Artificial Sequence
  ELANE RNA Guide
ggcccuucauggugugccugca

SEQ ID NO: 3674 - RNA, 22 nt, Artificial Sequence
  ELANE RNA Guide
ggccuccgcgcagcugcaggca

SEQ ID NO: 3675 - RNA, 22 nt, Artificial Sequence
  ELANE RNA Guide
ggugugccugcagcugcgcgga

SEQ ID NO: 3676 - RNA, 22 nt, Artificial Sequence
  ELANE RNA Guide
gugccugcagcugcgcggaggc

SEQ ID NO: 3677 - RNA, 22 nt, Artificial Sequence
  ELANE RNA Guide
guggcccuucauggugugccug

SEQ ID NO: 3678 - RNA, 22 nt, Artificial Sequence
  ELANE RNA Guide
gugugccugcagcugcgcggag

SEQ ID NO: 3679 - RNA, 22 nt, Artificial Sequence
  ELANE RNA Guide
ucauggugugccugcagcugcg

SEQ ID NO: 3680 - RNA, 22 nt, Artificial Sequence
  ELANE RNA Guide
uccgcgcagcugcaggcacacc

SEQ ID NO: 3681 - RNA, 22 nt, Artificial Sequence
  ELANE RNA Guide
ugcaggcacaccaugaagggcc

SEQ ID NO: 3682 - RNA, 22 nt, Artificial Sequence
  ELANE RNA Guide
ugccugcagcugcgcggaggcc

SEQ ID NO: 3683 - RNA, 22 nt, Artificial Sequence
  ELANE RNA Guide
uggcccuucauggugugccugc

SEQ ID NO: 3684 - RNA, 22 nt, Artificial Sequence
  ELANE RNA Guide
uggccuccgcgcagcugcaggc

SEQ ID NO: 3685 - RNA, 22 nt, Artificial Sequence
  ELANE RNA Guide
uggugugccugcagcugcgcgg

SEQ ID NO: 3686 - RNA, 22 nt, Artificial Sequence
  ELANE RNA Guide
ugugccugcagcugcgcggagg

SEQ ID NO: 3687 - RNA, 22 nt, Artificial Sequence
  ELANE RNA Guide
uucauggugugccugcagcugc

SEQ ID NO: 3688 - RNA, 20 nt, Artificial Sequence
  ELANE RNA Guide
agcugcaggaacaccaugaa

SEQ ID NO: 3689 - RNA, 20 nt, Artificial Sequence
  ELANE RNA Guide
aggaacaccaugaagggcca

SEQ ID NO: 3690 - RNA, 20 nt, Artificial Sequence
  ELANE RNA Guide
augguguuccugcagcugcg

SEQ ID NO: 3691 - RNA, 20 nt, Artificial Sequence
  ELANE RNA Guide
cagcugcaggaacaccauga

SEQ ID NO: 3692 - RNA, 20 nt, Artificial Sequence
  ELANE RNA Guide
caggaacaccaugaagggcc

SEQ ID NO: 3693 - RNA, 20 nt, Artificial Sequence
  ELANE RNA Guide
caugguguuccugcagcugc

SEQ ID NO: 3694 - RNA, 20 nt, Artificial Sequence
  ELANE RNA Guide
cccuucaugguguuccugca

SEQ ID NO: 3695 - RNA, 20 nt, Artificial Sequence
  ELANE RNA Guide
ccgcgcagcugcaggaacac

SEQ ID NO: 3696 - RNA, 20 nt, Artificial Sequence
  ELANE RNA Guide
ccuccgcgcagcugcaggaa

SEQ ID NO: 3697 - RNA, 20 nt, Artificial Sequence
  ELANE RNA Guide
ccuucaugguguuccugcag

SEQ ID NO: 3698 - RNA, 20 nt, Artificial Sequence
  ELANE RNA Guide
cgcagcugcaggaacaccau

SEQ ID NO: 3699 - RNA, 20 nt, Artificial Sequence
  ELANE RNA Guide
cgcgcagcugcaggaacacc

SEQ ID NO: 3700 - RNA, 20 nt, Artificial Sequence
  ELANE RNA Guide
cguggcccuucaugguguuc

SEQ ID NO: 3701 - RNA, 20 nt, Artificial Sequence
  ELANE RNA Guide
cuccgcgcagcugcaggaac

SEQ ID NO: 3702 - RNA, 20 nt, Artificial Sequence
  ELANE RNA Guide
cugcaggaacaccaugaagg

SEQ ID NO: 3703 - RNA, 20 nt, Artificial Sequence
  ELANE RNA Guide
cuucaugguguuccugcagc

SEQ ID NO: 3704 - RNA, 20 nt, Artificial Sequence
  ELANE RNA Guide
gaacaccaugaagggccacg

SEQ ID NO: 3705 - RNA, 20 nt, Artificial Sequence
  ELANE RNA Guide
gcagcugcaggaacaccaug

SEQ ID NO: 3706 - RNA, 20 nt, Artificial Sequence
  ELANE RNA Guide
gcaggaacaccaugaagggc

SEQ ID NO: 3707 - RNA, 20 nt, Artificial Sequence
  ELANE RNA Guide
gcccuucaugguguuccugc

SEQ ID NO: 3708 - RNA, 20 nt, Artificial Sequence
  ELANE RNA Guide
gccuccgcgcagcugcagga

SEQ ID NO: 3709 - RNA, 20 nt, Artificial Sequence
  ELANE RNA Guide
gcgcagcugcaggaacacca

SEQ ID NO: 3710 - RNA, 20 nt, Artificial Sequence
  ELANE RNA Guide
gcguggcccuucaugguguu

SEQ ID NO: 3711 - RNA, 20 nt, Artificial Sequence
  ELANE RNA Guide
gcugcaggaacaccaugaag

SEQ ID NO: 3712 - RNA, 20 nt, Artificial Sequence
  ELANE RNA Guide
ggaacaccaugaagggccac

SEQ ID NO: 3713 - RNA, 20 nt, Artificial Sequence
  ELANE RNA Guide
ggcccuucaugguguuccug

SEQ ID NO: 3714 - RNA, 20 nt, Artificial Sequence
  ELANE RNA Guide
gguguuccugcagcugcgcg

SEQ ID NO: 3715 - RNA, 20 nt, Artificial Sequence
  ELANE RNA Guide
guggcccuucaugguguucc

SEQ ID NO: 3716 - RNA, 20 nt, Artificial Sequence
  ELANE RNA Guide
guguuccugcagcugcgcgg

SEQ ID NO: 3717 - RNA, 20 nt, Artificial Sequence
  ELANE RNA Guide
guuccugcagcugcgcggag

SEQ ID NO: 3718 - RNA, 20 nt, Artificial Sequence
  ELANE RNA Guide
ucaugguguuccugcagcug

SEQ ID NO: 3719 - RNA, 20 nt, Artificial Sequence
  ELANE RNA Guide
uccgcgcagcugcaggaaca

SEQ ID NO: 3720 - RNA, 20 nt, Artificial Sequence
  ELANE RNA Guide
ugcaggaacaccaugaaggg

SEQ ID NO: 3721 - RNA, 20 nt, Artificial Sequence
  ELANE RNA Guide
uggcccuucaugguguuccu

SEQ ID NO: 3722 - RNA, 20 nt, Artificial Sequence
  ELANE RNA Guide
ugguguuccugcagcugcgc

SEQ ID NO: 3723 - RNA, 20 nt, Artificial Sequence
  ELANE RNA Guide
uguuccugcagcugcgcgga

SEQ ID NO: 3724 - RNA, 20 nt, Artificial Sequence
  ELANE RNA Guide
uucaugguguuccugcagcu

SEQ ID NO: 3725 - RNA, 20 nt, Artificial Sequence
  ELANE RNA Guide
uuccugcagcugcgcggagg

SEQ ID NO: 3726 - RNA, 21 nt, Artificial Sequence
  ELANE RNA Guide
agcugcaggaacaccaugaag

SEQ ID NO: 3727 - RNA, 21 nt, Artificial Sequence
  ELANE RNA Guide
aggaacaccaugaagggccac

SEQ ID NO: 3728 - RNA, 21 nt, Artificial Sequence
  ELANE RNA Guide
augguguuccugcagcugcgc

SEQ ID NO: 3729 - RNA, 21 nt, Artificial Sequence
  ELANE RNA Guide
cagcugcaggaacaccaugaa

SEQ ID NO: 3730 - RNA, 21 nt, Artificial Sequence
  ELANE RNA Guide
caggaacaccaugaagggcca

SEQ ID NO: 3731 - RNA, 21 nt, Artificial Sequence
  ELANE RNA Guide
caugguguuccugcagcugcg

SEQ ID NO: 3732 - RNA, 21 nt, Artificial Sequence
  ELANE RNA Guide
cccuucaugguguuccugcag

SEQ ID NO: 3733 - RNA, 21 nt, Artificial Sequence
  ELANE RNA Guide
ccgcgcagcugcaggaacacc

SEQ ID NO: 3734 - RNA, 21 nt, Artificial Sequence
  ELANE RNA Guide
ccuccgcgcagcugcaggaac

SEQ ID NO: 3735 - RNA, 21 nt, Artificial Sequence
  ELANE RNA Guide
ccuucaugguguuccugcagc

SEQ ID NO: 3736 - RNA, 21 nt, Artificial Sequence
  ELANE RNA Guide
cgcagcugcaggaacaccaug

SEQ ID NO: 3737 - RNA, 21 nt, Artificial Sequence
  ELANE RNA Guide
cgcgcagcugcaggaacacca

SEQ ID NO: 3738 - RNA, 21 nt, Artificial Sequence
  ELANE RNA Guide
cgcguggcccuucaugguguu

SEQ ID NO: 3739 - RNA, 21 nt, Artificial Sequence
  ELANE RNA Guide
cguggcccuucaugguguucc

SEQ ID NO: 3740 - RNA, 21 nt, Artificial Sequence
  ELANE RNA Guide
cuccgcgcagcugcaggaaca

SEQ ID NO: 3741 - RNA, 21 nt, Artificial Sequence
  ELANE RNA Guide
cugcaggaacaccaugaaggg

SEQ ID NO: 3742 - RNA, 21 nt, Artificial Sequence
  ELANE RNA Guide
cuucaugguguuccugcagcu

SEQ ID NO: 3743 - RNA, 21 nt, Artificial Sequence
  ELANE RNA Guide
gaacaccaugaagggccacgc

SEQ ID NO: 3744 - RNA, 21 nt, Artificial Sequence
  ELANE RNA Guide
gcagcugcaggaacaccauga

SEQ ID NO: 3745 - RNA, 21 nt, Artificial Sequence
  ELANE RNA Guide
gcaggaacaccaugaagggcc

SEQ ID NO: 3746 - RNA, 21 nt, Artificial Sequence
  ELANE RNA Guide
gcccuucaugguguuccugca

SEQ ID NO: 3747 - RNA, 21 nt, Artificial Sequence
  ELANE RNA Guide
gccuccgcgcagcugcaggaa

SEQ ID NO: 3748 - RNA, 21 nt, Artificial Sequence
  ELANE RNA Guide
gcgcagcugcaggaacaccau

SEQ ID NO: 3749 - RNA, 21 nt, Artificial Sequence
  ELANE RNA Guide
gcguggcccuucaugguguuc

SEQ ID NO: 3750 - RNA, 21 nt, Artificial Sequence
  ELANE RNA Guide
gcugcaggaacaccaugaagg

SEQ ID NO: 3751 - RNA, 21 nt, Artificial Sequence
  ELANE RNA Guide
ggaacaccaugaagggccacg

SEQ ID NO: 3752 - RNA, 21 nt, Artificial Sequence
  ELANE RNA Guide
ggcccuucaugguguuccugc

SEQ ID NO: 3753 - RNA, 21 nt, Artificial Sequence
  ELANE RNA Guide
ggccuccgcgcagcugcagga

SEQ ID NO: 3754 - RNA, 21 nt, Artificial Sequence
  ELANE RNA Guide
gguguuccugcagcugcgcgg

SEQ ID NO: 3755 - RNA, 21 nt, Artificial Sequence
  ELANE RNA Guide
guggcccuucaugguguuccu

SEQ ID NO: 3756 - RNA, 21 nt, Artificial Sequence
  ELANE RNA Guide
guguuccugcagcugcgcgga

SEQ ID NO: 3757 - RNA, 21 nt, Artificial Sequence
  ELANE RNA Guide
guuccugcagcugcgcggagg

SEQ ID NO: 3758 - RNA, 21 nt, Artificial Sequence
  ELANE RNA Guide
ucaugguguuccugcagcugc

SEQ ID NO: 3759 - RNA, 21 nt, Artificial Sequence
  ELANE RNA Guide
uccgcgcagcugcaggaacac

SEQ ID NO: 3760 - RNA, 21 nt, Artificial Sequence
  ELANE RNA Guide
ugcaggaacaccaugaagggc

SEQ ID NO: 3761 - RNA, 21 nt, Artificial Sequence
  ELANE RNA Guide
uggcccuucaugguguuccug

SEQ ID NO: 3762 - RNA, 21 nt, Artificial Sequence
  ELANE RNA Guide
ugguguuccugcagcugcgcg

SEQ ID NO: 3763 - RNA, 21 nt, Artificial Sequence
  ELANE RNA Guide
uguuccugcagcugcgcggag

SEQ ID NO: 3764 - RNA, 21 nt, Artificial Sequence
  ELANE RNA Guide
uucaugguguuccugcagcug

SEQ ID NO: 3765 - RNA, 21 nt, Artificial Sequence
  ELANE RNA Guide
uuccugcagcugcgcggaggc

SEQ ID NO: 3766 - RNA, 22 nt, Artificial Sequence
  ELANE RNA Guide
acgcguggcccuucaugguguu

SEQ ID NO: 3767 - RNA, 22 nt, Artificial Sequence
  ELANE RNA Guide
agcugcaggaacaccaugaagg

SEQ ID NO: 3768 - RNA, 22 nt, Artificial Sequence
  ELANE RNA Guide
aggaacaccaugaagggccacg

SEQ ID NO: 3769 - RNA, 22 nt, Artificial Sequence
  ELANE RNA Guide
augguguuccugcagcugcgcg

SEQ ID NO: 3770 - RNA, 22 nt, Artificial Sequence
  ELANE RNA Guide
cagcugcaggaacaccaugaag

SEQ ID NO: 3771 - RNA, 22 nt, Artificial Sequence
  ELANE RNA Guide
caggaacaccaugaagggccac

SEQ ID NO: 3772 - RNA, 22 nt, Artificial Sequence
  ELANE RNA Guide
caugguguuccugcagcugcgc

SEQ ID NO: 3773 - RNA, 22 nt, Artificial Sequence
  ELANE RNA Guide
cccuucaugguguuccugcagc

SEQ ID NO: 3774 - RNA, 22 nt, Artificial Sequence
  ELANE RNA Guide
ccgcgcagcugcaggaacacca

SEQ ID NO: 3775 - RNA, 22 nt, Artificial Sequence
  ELANE RNA Guide
ccuccgcgcagcugcaggaaca

SEQ ID NO: 3776 - RNA, 22 nt, Artificial Sequence
  ELANE RNA Guide
ccuucaugguguuccugcagcu

SEQ ID NO: 3777 - RNA, 22 nt, Artificial Sequence
  ELANE RNA Guide
cgcagcugcaggaacaccauga

SEQ ID NO: 3778 - RNA, 22 nt, Artificial Sequence
  ELANE RNA Guide
cgcgcagcugcaggaacaccau

SEQ ID NO: 3779 - RNA, 22 nt, Artificial Sequence
  ELANE RNA Guide
cgcguggcccuucaugguguuc

SEQ ID NO: 3780 - RNA, 22 nt, Artificial Sequence
  ELANE RNA Guide
cguggcccuucaugguguuccu

SEQ ID NO: 3781 - RNA, 22 nt, Artificial Sequence
  ELANE RNA Guide
cuccgcgcagcugcaggaacac

SEQ ID NO: 3782 - RNA, 22 nt, Artificial Sequence
  ELANE RNA Guide
cugcaggaacaccaugaagggc

SEQ ID NO: 3783 - RNA, 22 nt, Artificial Sequence
  ELANE RNA Guide
cuucaugguguuccugcagcug

SEQ ID NO: 3784 - RNA, 22 nt, Artificial Sequence
  ELANE RNA Guide
gaacaccaugaagggccacgcg

SEQ ID NO: 3785 - RNA, 22 nt, Artificial Sequence
  ELANE RNA Guide
gcagcugcaggaacaccaugaa

SEQ ID NO: 3786 - RNA, 22 nt, Artificial Sequence
  ELANE RNA Guide
gcaggaacaccaugaagggcca

SEQ ID NO: 3787 - RNA, 22 nt, Artificial Sequence
  ELANE RNA Guide
gcccuucaugguguuccugcag

SEQ ID NO: 3788 - RNA, 22 nt, Artificial Sequence
  ELANE RNA Guide
gccuccgcgcagcugcaggaac

SEQ ID NO: 3789 - RNA, 22 nt, Artificial Sequence
  ELANE RNA Guide
gcgcagcugcaggaacaccaug

SEQ ID NO: 3790 - RNA, 22 nt, Artificial Sequence
  ELANE RNA Guide
gcguggcccuucaugguguucc

SEQ ID NO: 3791 - RNA, 22 nt, Artificial Sequence
  ELANE RNA Guide
gcugcaggaacaccaugaaggg

SEQ ID NO: 3792 - RNA, 22 nt, Artificial Sequence
  ELANE RNA Guide
ggaacaccaugaagggccacgc

SEQ ID NO: 3793 - RNA, 22 nt, Artificial Sequence
  ELANE RNA Guide
ggcccuucaugguguuccugca

SEQ ID NO: 3794 - RNA, 22 nt, Artificial Sequence
  ELANE RNA Guide
ggccuccgcgcagcugcaggaa

SEQ ID NO: 3795 - RNA, 22 nt, Artificial Sequence
  ELANE RNA Guide
gguguuccugcagcugcgcgga

SEQ ID NO: 3796 - RNA, 22 nt, Artificial Sequence
  ELANE RNA Guide
guggcccuucaugguguuccug

SEQ ID NO: 3797 - RNA, 22 nt, Artificial Sequence
  ELANE RNA Guide
guguuccugcagcugcgcggag

SEQ ID NO: 3798 - RNA, 22 nt, Artificial Sequence
  ELANE RNA Guide
guuccugcagcugcgcggaggc

SEQ ID NO: 3799 - RNA, 22 nt, Artificial Sequence
  ELANE RNA Guide
ucaugguguuccugcagcugcg

SEQ ID NO: 3800 - RNA, 22 nt, Artificial Sequence
  ELANE RNA Guide
uccgcgcagcugcaggaacacc

SEQ ID NO: 3801 - RNA, 22 nt, Artificial Sequence
  ELANE RNA Guide
ugcaggaacaccaugaagggcc

SEQ ID NO: 3802 - RNA, 22 nt, Artificial Sequence
  ELANE RNA Guide
uggcccuucaugguguuccugc

SEQ ID NO: 3803 - RNA, 22 nt, Artificial Sequence
  ELANE RNA Guide
uggccuccgcgcagcugcagga

SEQ ID NO: 3804 - RNA, 22 nt, Artificial Sequence
  ELANE RNA Guide
ugguguuccugcagcugcgcgg

SEQ ID NO: 3805 - RNA, 22 nt, Artificial Sequence
  ELANE RNA Guide
uguuccugcagcugcgcggagg

SEQ ID NO: 3806 - RNA, 22 nt, Artificial Sequence
  ELANE RNA Guide
uucaugguguuccugcagcugc

SEQ ID NO: 3807 - RNA, 22 nt, Artificial Sequence
  ELANE RNA Guide
uuccugcagcugcgcggaggcc

SEQ ID NO: 3808 - RNA, 20 nt, Artificial Sequence
  ELANE RNA Guide
agaaguggccuccgcgcagc

SEQ ID NO: 3809 - RNA, 20 nt, Artificial Sequence
  ELANE RNA Guide
agcugcggggacaccaugaa

SEQ ID NO: 3810 - RNA, 20 nt, Artificial Sequence
  ELANE RNA Guide
augguguccccgcagcugcg

SEQ ID NO: 3811 - RNA, 20 nt, Artificial Sequence
  ELANE RNA Guide
cagcugcggggacaccauga

SEQ ID NO: 3812 - RNA, 20 nt, Artificial Sequence
  ELANE RNA Guide
caugguguccccgcagcugc

SEQ ID NO: 3813 - RNA, 20 nt, Artificial Sequence
  ELANE RNA Guide
cccuucaugguguccccgca

SEQ ID NO: 3814 - RNA, 20 nt, Artificial Sequence
  ELANE RNA Guide
ccgcagcugcgcggaggcca

SEQ ID NO: 3815 - RNA, 20 nt, Artificial Sequence
  ELANE RNA Guide
ccgcgcagcugcggggacac

SEQ ID NO: 3816 - RNA, 20 nt, Artificial Sequence
  ELANE RNA Guide
ccuccgcgcagcugcgggga

SEQ ID NO: 3817 - RNA, 20 nt, Artificial Sequence
  ELANE RNA Guide
ccuucaugguguccccgcag

SEQ ID NO: 3818 - RNA, 20 nt, Artificial Sequence
  ELANE RNA Guide
cgcagcugcggggacaccau

SEQ ID NO: 3819 - RNA, 20 nt, Artificial Sequence
  ELANE RNA Guide
cgcgcagcugcggggacacc

SEQ ID NO: 3820 - RNA, 20 nt, Artificial Sequence
  ELANE RNA Guide
cggggacaccaugaagggcc

SEQ ID NO: 3821 - RNA, 20 nt, Artificial Sequence
  ELANE RNA Guide
cguggcccuucauggugucc

SEQ ID NO: 3822 - RNA, 20 nt, Artificial Sequence
  ELANE RNA Guide
cuccgcgcagcugcggggac

SEQ ID NO: 3823 - RNA, 20 nt, Artificial Sequence
  ELANE RNA Guide
cugcggggacaccaugaagg

SEQ ID NO: 3824 - RNA, 20 nt, Artificial Sequence
  ELANE RNA Guide
cuucaugguguccccgcagc

SEQ ID NO: 3825 - RNA, 20 nt, Artificial Sequence
  ELANE RNA Guide
gcagcugcggggacaccaug

SEQ ID NO: 3826 - RNA, 20 nt, Artificial Sequence
  ELANE RNA Guide
gcccuucaugguguccccgc

SEQ ID NO: 3827 - RNA, 20 nt, Artificial Sequence
  ELANE RNA Guide
gcgcagcugcggggacacca

SEQ ID NO: 3828 - RNA, 20 nt, Artificial Sequence
  ELANE RNA Guide
gcggggacaccaugaagggc

SEQ ID NO: 3829 - RNA, 20 nt, Artificial Sequence
  ELANE RNA Guide
gcguggcccuucaugguguc

SEQ ID NO: 3830 - RNA, 20 nt, Artificial Sequence
  ELANE RNA Guide
gcugcggggacaccaugaag

SEQ ID NO: 3831 - RNA, 20 nt, Artificial Sequence
  ELANE RNA Guide
ggcccuucaugguguccccg

SEQ ID NO: 3832 - RNA, 20 nt, Artificial Sequence
  ELANE RNA Guide
gguguccccgcagcugcgcg

SEQ ID NO: 3833 - RNA, 20 nt, Artificial Sequence
  ELANE RNA Guide
guccccgcagcugcgcggag

SEQ ID NO: 3834 - RNA, 20 nt, Artificial Sequence
  ELANE RNA Guide
guggcccuucaugguguccc

SEQ ID NO: 3835 - RNA, 20 nt, Artificial Sequence
  ELANE RNA Guide
guggccuccgcgcagcugcg

SEQ ID NO: 3836 - RNA, 20 nt, Artificial Sequence
  ELANE RNA Guide
guguccccgcagcugcgcgg

SEQ ID NO: 3837 - RNA, 20 nt, Artificial Sequence
  ELANE RNA Guide
ucaugguguccccgcagcug

SEQ ID NO: 3838 - RNA, 20 nt, Artificial Sequence
  ELANE RNA Guide
uccccgcagcugcgcggagg

SEQ ID NO: 3839 - RNA, 20 nt, Artificial Sequence
  ELANE RNA Guide
uccgcgcagcugcggggaca

SEQ ID NO: 3840 - RNA, 20 nt, Artificial Sequence
  ELANE RNA Guide
ugcggggacaccaugaaggg

SEQ ID NO: 3841 - RNA, 20 nt, Artificial Sequence
  ELANE RNA Guide
uggcccuucauggugucccc

SEQ ID NO: 3842 - RNA, 20 nt, Artificial Sequence
  ELANE RNA Guide
uggccuccgcgcagcugcgg

SEQ ID NO: 3843 - RNA, 20 nt, Artificial Sequence
  ELANE RNA Guide
ugguguccccgcagcugcgc

SEQ ID NO: 3844 - RNA, 20 nt, Artificial Sequence
  ELANE RNA Guide
uguccccgcagcugcgcgga

SEQ ID NO: 3845 - RNA, 20 nt, Artificial Sequence
  ELANE RNA Guide
uucaugguguccccgcagcu

SEQ ID NO: 3846 - RNA, 21 nt, Artificial Sequence
  ELANE RNA Guide
agcugcggggacaccaugaag

SEQ ID NO: 3847 - RNA, 21 nt, Artificial Sequence
  ELANE RNA Guide
aguggccuccgcgcagcugcg

SEQ ID NO: 3848 - RNA, 21 nt, Artificial Sequence
  ELANE RNA Guide
augguguccccgcagcugcgc

SEQ ID NO: 3849 - RNA, 21 nt, Artificial Sequence
  ELANE RNA Guide
cagaaguggccuccgcgcagc

SEQ ID NO: 3850 - RNA, 21 nt, Artificial Sequence
  ELANE RNA Guide
cagcugcggggacaccaugaa

SEQ ID NO: 3851 - RNA, 21 nt, Artificial Sequence
  ELANE RNA Guide
caugguguccccgcagcugcg

SEQ ID NO: 3852 - RNA, 21 nt, Artificial Sequence
  ELANE RNA Guide
cccuucaugguguccccgcag

SEQ ID NO: 3853 - RNA, 21 nt, Artificial Sequence
  ELANE RNA Guide
ccuucaugguguccccgcagc

SEQ ID NO: 3854 - RNA, 21 nt, Artificial Sequence
  ELANE RNA Guide
cgcagcugcggggacaccaug

SEQ ID NO: 3855 - RNA, 21 nt, Artificial Sequence
  ELANE RNA Guide
cgcgcagcugcggggacacca

SEQ ID NO: 3856 - RNA, 21 nt, Artificial Sequence
  ELANE RNA Guide
cgcguggcccuucaugguguc

SEQ ID NO: 3857 - RNA, 21 nt, Artificial Sequence
  ELANE RNA Guide
cggggacaccaugaagggcca

SEQ ID NO: 3858 - RNA, 21 nt, Artificial Sequence
  ELANE RNA Guide
cguggcccuucaugguguccc

SEQ ID NO: 3859 - RNA, 21 nt, Artificial Sequence
  ELANE RNA Guide
cuccgcgcagcugcggggaca

SEQ ID NO: 3860 - RNA, 21 nt, Artificial Sequence
  ELANE RNA Guide
cugcggggacaccaugaaggg

SEQ ID NO: 3861 - RNA, 21 nt, Artificial Sequence
  ELANE RNA Guide
cuucaugguguccccgcagcu

SEQ ID NO: 3862 - RNA, 21 nt, Artificial Sequence
  ELANE RNA Guide
gcagcugcggggacaccauga

SEQ ID NO: 3863 - RNA, 21 nt, Artificial Sequence
  ELANE RNA Guide
gcccuucaugguguccccgca

SEQ ID NO: 3864 - RNA, 21 nt, Artificial Sequence
  ELANE RNA Guide
gcgcagcugcggggacaccau

SEQ ID NO: 3865 - RNA, 21 nt, Artificial Sequence
  ELANE RNA Guide
gcggggacaccaugaagggcc

SEQ ID NO: 3866 - RNA, 21 nt, Artificial Sequence
  ELANE RNA Guide
gcguggcccuucauggugucc

SEQ ID NO: 3867 - RNA, 21 nt, Artificial Sequence
  ELANE RNA Guide
gcugcggggacaccaugaagg

SEQ ID NO: 3868 - RNA, 21 nt, Artificial Sequence
  ELANE RNA Guide
ggcccuucaugguguccccgc

SEQ ID NO: 3869 - RNA, 21 nt, Artificial Sequence
  ELANE RNA Guide
guggcccuucauggugucccc

SEQ ID NO: 3870 - RNA, 21 nt, Artificial Sequence
  ELANE RNA Guide
guguccccgcagcugcgcgga

SEQ ID NO: 3871 - RNA, 21 nt, Artificial Sequence
  ELANE RNA Guide
ucaugguguccccgcagcugc

SEQ ID NO: 3872 - RNA, 21 nt, Artificial Sequence
  ELANE RNA Guide
uccgcgcagcugcggggacac

SEQ ID NO: 3873 - RNA, 21 nt, Artificial Sequence
  ELANE RNA Guide
ugcggggacaccaugaagggc

SEQ ID NO: 3874 - RNA, 21 nt, Artificial Sequence
  ELANE RNA Guide
uggcccuucaugguguccccg

SEQ ID NO: 3875 - RNA, 21 nt, Artificial Sequence
  ELANE RNA Guide
ugguguccccgcagcugcgcg

SEQ ID NO: 3876 - RNA, 21 nt, Artificial Sequence
  ELANE RNA Guide
uguccccgcagcugcgcggag

SEQ ID NO: 3877 - RNA, 21 nt, Artificial Sequence
  ELANE RNA Guide
uucaugguguccccgcagcug

SEQ ID NO: 3878 - RNA, 22 nt, Artificial Sequence
  ELANE RNA Guide
aaguggccuccgcgcagcugcg

SEQ ID NO: 3879 - RNA, 22 nt, Artificial Sequence
  ELANE RNA Guide
acgcguggcccuucaugguguc

SEQ ID NO: 3880 - RNA, 22 nt, Artificial Sequence
  ELANE RNA Guide
agcugcggggacaccaugaagg

SEQ ID NO: 3881 - RNA, 22 nt, Artificial Sequence
  ELANE RNA Guide
aguggccuccgcgcagcugcgg

SEQ ID NO: 3882 - RNA, 22 nt, Artificial Sequence
  ELANE RNA Guide
augguguccccgcagcugcgcg

SEQ ID NO: 3883 - RNA, 22 nt, Artificial Sequence
  ELANE RNA Guide
cagcugcggggacaccaugaag

SEQ ID NO: 3884 - RNA, 22 nt, Artificial Sequence
  ELANE RNA Guide
caugguguccccgcagcugcgc

SEQ ID NO: 3885 - RNA, 22 nt, Artificial Sequence
  ELANE RNA Guide
cccuucaugguguccccgcagc

SEQ ID NO: 3886 - RNA, 22 nt, Artificial Sequence
  ELANE RNA Guide
ccgcagcugcgcggaggccacu

SEQ ID NO: 3887 - RNA, 22 nt, Artificial Sequence
  ELANE RNA Guide
ccgcgcagcugcggggacacca

SEQ ID NO: 3888 - RNA, 22 nt, Artificial Sequence
  ELANE RNA Guide
ccuccgcgcagcugcggggaca

SEQ ID NO: 3889 - RNA, 22 nt, Artificial Sequence
  ELANE RNA Guide
ccuucaugguguccccgcagcu

SEQ ID NO: 3890 - RNA, 22 nt, Artificial Sequence
  ELANE RNA Guide
cgcagcugcggggacaccauga

SEQ ID NO: 3891 - RNA, 22 nt, Artificial Sequence
  ELANE RNA Guide
cgcgcagcugcggggacaccau

SEQ ID NO: 3892 - RNA, 22 nt, Artificial Sequence
  ELANE RNA Guide
cgcguggcccuucauggugucc

SEQ ID NO: 3893 - RNA, 22 nt, Artificial Sequence
  ELANE RNA Guide
cggggacaccaugaagggccac

SEQ ID NO: 3894 - RNA, 22 nt, Artificial Sequence
  ELANE RNA Guide
cguggcccuucauggugucccc

SEQ ID NO: 3895 - RNA, 22 nt, Artificial Sequence
  ELANE RNA Guide
cuccgcgcagcugcggggacac

SEQ ID NO: 3896 - RNA, 22 nt, Artificial Sequence
  ELANE RNA Guide
cugcggggacaccaugaagggc

SEQ ID NO: 3897 - RNA, 22 nt, Artificial Sequence
  ELANE RNA Guide
cuucaugguguccccgcagcug

SEQ ID NO: 3898 - RNA, 22 nt, Artificial Sequence
  ELANE RNA Guide
gcagaaguggccuccgcgcagc

SEQ ID NO: 3899 - RNA, 22 nt, Artificial Sequence
  ELANE RNA Guide
gcagcugcggggacaccaugaa

SEQ ID NO: 3900 - RNA, 22 nt, Artificial Sequence
  ELANE RNA Guide
gcccuucaugguguccccgcag

SEQ ID NO: 3901 - RNA, 22 nt, Artificial Sequence
  ELANE RNA Guide
gcgcagcugcggggacaccaug

SEQ ID NO: 3902 - RNA, 22 nt, Artificial Sequence
  ELANE RNA Guide
gcggggacaccaugaagggcca

SEQ ID NO: 3903 - RNA, 22 nt, Artificial Sequence
  ELANE RNA Guide
gcguggcccuucaugguguccc

SEQ ID NO: 3904 - RNA, 22 nt, Artificial Sequence
  ELANE RNA Guide
gcugcggggacaccaugaaggg

SEQ ID NO: 3905 - RNA, 22 nt, Artificial Sequence
  ELANE RNA Guide
ggcccuucaugguguccccgca

SEQ ID NO: 3906 - RNA, 22 nt, Artificial Sequence
  ELANE RNA Guide
gguguccccgcagcugcgcgga

SEQ ID NO: 3907 - RNA, 22 nt, Artificial Sequence
  ELANE RNA Guide
guggcccuucaugguguccccg

SEQ ID NO: 3908 - RNA, 22 nt, Artificial Sequence
  ELANE RNA Guide
guguccccgcagcugcgcggag

SEQ ID NO: 3909 - RNA, 22 nt, Artificial Sequence
  ELANE RNA Guide
ucaugguguccccgcagcugcg

SEQ ID NO: 3910 - RNA, 22 nt, Artificial Sequence
  ELANE RNA Guide
uccgcgcagcugcggggacacc

SEQ ID NO: 3911 - RNA, 22 nt, Artificial Sequence
  ELANE RNA Guide
ugcggggacaccaugaagggcc

SEQ ID NO: 3912 - RNA, 22 nt, Artificial Sequence
  ELANE RNA Guide
uggcccuucaugguguccccgc

SEQ ID NO: 3913 - RNA, 22 nt, Artificial Sequence
  ELANE RNA Guide
ugguguccccgcagcugcgcgg

SEQ ID NO: 3914 - RNA, 22 nt, Artificial Sequence
  ELANE RNA Guide
uguccccgcagcugcgcggagg

SEQ ID NO: 3915 - RNA, 22 nt, Artificial Sequence
  ELANE RNA Guide
uucaugguguccccgcagcugc

SEQ ID NO: 3916 - RNA, 20 nt, Artificial Sequence
  ELANE RNA Guide
agcugccgggacaccaugaa

SEQ ID NO: 3917 - RNA, 20 nt, Artificial Sequence
  ELANE RNA Guide
auggugucccggcagcugcg

SEQ ID NO: 3918 - RNA, 20 nt, Artificial Sequence
  ELANE RNA Guide
cagcugccgggacaccauga

SEQ ID NO: 3919 - RNA, 20 nt, Artificial Sequence
  ELANE RNA Guide
cauggugucccggcagcugc

SEQ ID NO: 3920 - RNA, 20 nt, Artificial Sequence
  ELANE RNA Guide
cccuucauggugucccggca

SEQ ID NO: 3921 - RNA, 20 nt, Artificial Sequence
  ELANE RNA Guide
ccgcgcagcugccgggacac

SEQ ID NO: 3922 - RNA, 20 nt, Artificial Sequence
  ELANE RNA Guide
ccgggacaccaugaagggcc

SEQ ID NO: 3923 - RNA, 20 nt, Artificial Sequence
  ELANE RNA Guide
ccuccgcgcagcugccggga

SEQ ID NO: 3924 - RNA, 20 nt, Artificial Sequence
  ELANE RNA Guide
ccuucauggugucccggcag

SEQ ID NO: 3925 - RNA, 20 nt, Artificial Sequence
  ELANE RNA Guide
cgcagcugccgggacaccau

SEQ ID NO: 3926 - RNA, 20 nt, Artificial Sequence
  ELANE RNA Guide
cgcgcagcugccgggacacc

SEQ ID NO: 3927 - RNA, 20 nt, Artificial Sequence
  ELANE RNA Guide
cggcagcugcgcggaggcca

SEQ ID NO: 3928 - RNA, 20 nt, Artificial Sequence
  ELANE RNA Guide
cuccgcgcagcugccgggac

SEQ ID NO: 3929 - RNA, 20 nt, Artificial Sequence
  ELANE RNA Guide
cugccgggacaccaugaagg

SEQ ID NO: 3930 - RNA, 20 nt, Artificial Sequence
  ELANE RNA Guide
cuucauggugucccggcagc

SEQ ID NO: 3931 - RNA, 20 nt, Artificial Sequence
  ELANE RNA Guide
gcagcugccgggacaccaug

SEQ ID NO: 3932 - RNA, 20 nt, Artificial Sequence
  ELANE RNA Guide
gcccuucauggugucccggc

SEQ ID NO: 3933 - RNA, 20 nt, Artificial Sequence
  ELANE RNA Guide
gccgggacaccaugaagggc

SEQ ID NO: 3934 - RNA, 20 nt, Artificial Sequence
  ELANE RNA Guide
gcgcagcugccgggacacca

SEQ ID NO: 3935 - RNA, 20 nt, Artificial Sequence
  ELANE RNA Guide
gcugccgggacaccaugaag

SEQ ID NO: 3936 - RNA, 20 nt, Artificial Sequence
  ELANE RNA Guide
ggcccuucauggugucccgg

SEQ ID NO: 3937 - RNA, 20 nt, Artificial Sequence
  ELANE RNA Guide
ggugucccggcagcugcgcg

SEQ ID NO: 3938 - RNA, 20 nt, Artificial Sequence
  ELANE RNA Guide
gucccggcagcugcgcggag

SEQ ID NO: 3939 - RNA, 20 nt, Artificial Sequence
  ELANE RNA Guide
guggccuccgcgcagcugcc

SEQ ID NO: 3940 - RNA, 20 nt, Artificial Sequence
  ELANE RNA Guide
gugucccggcagcugcgcgg

SEQ ID NO: 3941 - RNA, 20 nt, Artificial Sequence
  ELANE RNA Guide
ucauggugucccggcagcug

SEQ ID NO: 3942 - RNA, 20 nt, Artificial Sequence
  ELANE RNA Guide
ucccggcagcugcgcggagg

SEQ ID NO: 3943 - RNA, 20 nt, Artificial Sequence
  ELANE RNA Guide
uccgcgcagcugccgggaca

SEQ ID NO: 3944 - RNA, 20 nt, Artificial Sequence
  ELANE RNA Guide
ugccgggacaccaugaaggg

SEQ ID NO: 3945 - RNA, 20 nt, Artificial Sequence
  ELANE RNA Guide
uggcccuucauggugucccg

SEQ ID NO: 3946 - RNA, 20 nt, Artificial Sequence
  ELANE RNA Guide
uggccuccgcgcagcugccg

SEQ ID NO: 3947 - RNA, 20 nt, Artificial Sequence
  ELANE RNA Guide
uggugucccggcagcugcgc

SEQ ID NO: 3948 - RNA, 20 nt, Artificial Sequence
  ELANE RNA Guide
ugucccggcagcugcgcgga

SEQ ID NO: 3949 - RNA, 20 nt, Artificial Sequence
  ELANE RNA Guide
uucauggugucccggcagcu

SEQ ID NO: 3950 - RNA, 21 nt, Artificial Sequence
  ELANE RNA Guide
agcugccgggacaccaugaag

SEQ ID NO: 3951 - RNA, 21 nt, Artificial Sequence
  ELANE RNA Guide
aguggccuccgcgcagcugcc

SEQ ID NO: 3952 - RNA, 21 nt, Artificial Sequence
  ELANE RNA Guide
auggugucccggcagcugcgc

SEQ ID NO: 3953 - RNA, 21 nt, Artificial Sequence
  ELANE RNA Guide
cagcugccgggacaccaugaa

SEQ ID NO: 3954 - RNA, 21 nt, Artificial Sequence
  ELANE RNA Guide
cauggugucccggcagcugcg

SEQ ID NO: 3955 - RNA, 21 nt, Artificial Sequence
  ELANE RNA Guide
cccuucauggugucccggcag

SEQ ID NO: 3956 - RNA, 21 nt, Artificial Sequence
  ELANE RNA Guide
ccgggacaccaugaagggcca

SEQ ID NO: 3957 - RNA, 21 nt, Artificial Sequence
  ELANE RNA Guide
ccuucauggugucccggcagc

SEQ ID NO: 3958 - RNA, 21 nt, Artificial Sequence
  ELANE RNA Guide
cgcagcugccgggacaccaug

SEQ ID NO: 3959 - RNA, 21 nt, Artificial Sequence
  ELANE RNA Guide
cgcgcagcugccgggacacca

SEQ ID NO: 3960 - RNA, 21 nt, Artificial Sequence
  ELANE RNA Guide
cuccgcgcagcugccgggaca

SEQ ID NO: 3961 - RNA, 21 nt, Artificial Sequence
  ELANE RNA Guide
cugccgggacaccaugaaggg

SEQ ID NO: 3962 - RNA, 21 nt, Artificial Sequence
  ELANE RNA Guide
cuucauggugucccggcagcu

SEQ ID NO: 3963 - RNA, 21 nt, Artificial Sequence
  ELANE RNA Guide
gcagcugccgggacaccauga

SEQ ID NO: 3964 - RNA, 21 nt, Artificial Sequence
  ELANE RNA Guide
gcccuucauggugucccggca

SEQ ID NO: 3965 - RNA, 21 nt, Artificial Sequence
  ELANE RNA Guide
gccgggacaccaugaagggcc

SEQ ID NO: 3966 - RNA, 21 nt, Artificial Sequence
  ELANE RNA Guide
gcgcagcugccgggacaccau

SEQ ID NO: 3967 - RNA, 21 nt, Artificial Sequence
  ELANE RNA Guide
gcugccgggacaccaugaagg

SEQ ID NO: 3968 - RNA, 21 nt, Artificial Sequence
  ELANE RNA Guide
ggcccuucauggugucccggc

SEQ ID NO: 3969 - RNA, 21 nt, Artificial Sequence
  ELANE RNA Guide
guggcccuucauggugucccg

SEQ ID NO: 3970 - RNA, 21 nt, Artificial Sequence
  ELANE RNA Guide
gugucccggcagcugcgcgga

SEQ ID NO: 3971 - RNA, 21 nt, Artificial Sequence
  ELANE RNA Guide
ucauggugucccggcagcugc

SEQ ID NO: 3972 - RNA, 21 nt, Artificial Sequence
  ELANE RNA Guide
uccgcgcagcugccgggacac

SEQ ID NO: 3973 - RNA, 21 nt, Artificial Sequence
  ELANE RNA Guide
ugccgggacaccaugaagggc

SEQ ID NO: 3974 - RNA, 21 nt, Artificial Sequence
  ELANE RNA Guide
uggcccuucauggugucccgg

SEQ ID NO: 3975 - RNA, 21 nt, Artificial Sequence
  ELANE RNA Guide
uggugucccggcagcugcgcg

SEQ ID NO: 3976 - RNA, 21 nt, Artificial Sequence
  ELANE RNA Guide
ugucccggcagcugcgcggag

SEQ ID NO: 3977 - RNA, 21 nt, Artificial Sequence
  ELANE RNA Guide
uucauggugucccggcagcug

SEQ ID NO: 3978 - RNA, 22 nt, Artificial Sequence
  ELANE RNA Guide
aaguggccuccgcgcagcugcc

SEQ ID NO: 3979 - RNA, 22 nt, Artificial Sequence
  ELANE RNA Guide
agcugccgggacaccaugaagg

SEQ ID NO: 3980 - RNA, 22 nt, Artificial Sequence
  ELANE RNA Guide
aguggccuccgcgcagcugccg

SEQ ID NO: 3981 - RNA, 22 nt, Artificial Sequence
  ELANE RNA Guide
auggugucccggcagcugcgcg

SEQ ID NO: 3982 - RNA, 22 nt, Artificial Sequence
  ELANE RNA Guide
cagcugccgggacaccaugaag

SEQ ID NO: 3983 - RNA, 22 nt, Artificial Sequence
  ELANE RNA Guide
cauggugucccggcagcugcgc

SEQ ID NO: 3984 - RNA, 22 nt, Artificial Sequence
  ELANE RNA Guide
cccuucauggugucccggcagc

SEQ ID NO: 3985 - RNA, 22 nt, Artificial Sequence
  ELANE RNA Guide
ccgcgcagcugccgggacacca

SEQ ID NO: 3986 - RNA, 22 nt, Artificial Sequence
  ELANE RNA Guide
ccgggacaccaugaagggccac

SEQ ID NO: 3987 - RNA, 22 nt, Artificial Sequence
  ELANE RNA Guide
ccuccgcgcagcugccgggaca

SEQ ID NO: 3988 - RNA, 22 nt, Artificial Sequence
  ELANE RNA Guide
ccuucauggugucccggcagcu

SEQ ID NO: 3989 - RNA, 22 nt, Artificial Sequence
  ELANE RNA Guide
cgcagcugccgggacaccauga

SEQ ID NO: 3990 - RNA, 22 nt, Artificial Sequence
  ELANE RNA Guide
cgcgcagcugccgggacaccau

SEQ ID NO: 3991 - RNA, 22 nt, Artificial Sequence
  ELANE RNA Guide
cggcagcugcgcggaggccacu

SEQ ID NO: 3992 - RNA, 22 nt, Artificial Sequence
  ELANE RNA Guide
cguggcccuucauggugucccg

SEQ ID NO: 3993 - RNA, 22 nt, Artificial Sequence
  ELANE RNA Guide
cuccgcgcagcugccgggacac

SEQ ID NO: 3994 - RNA, 22 nt, Artificial Sequence
  ELANE RNA Guide
cugccgggacaccaugaagggc

SEQ ID NO: 3995 - RNA, 22 nt, Artificial Sequence
  ELANE RNA Guide
cuucauggugucccggcagcug

SEQ ID NO: 3996 - RNA, 22 nt, Artificial Sequence
  ELANE RNA Guide
gcagcugccgggacaccaugaa

SEQ ID NO: 3997 - RNA, 22 nt, Artificial Sequence
  ELANE RNA Guide
gcccuucauggugucccggcag

SEQ ID NO: 3998 - RNA, 22 nt, Artificial Sequence
  ELANE RNA Guide
gccgggacaccaugaagggcca

SEQ ID NO: 3999 - RNA, 22 nt, Artificial Sequence
  ELANE RNA Guide
gcgcagcugccgggacaccaug

SEQ ID NO: 4000 - RNA, 22 nt, Artificial Sequence
  ELANE RNA Guide
gcugccgggacaccaugaaggg

SEQ ID NO: 4001 - RNA, 22 nt, Artificial Sequence
  ELANE RNA Guide
ggcccuucauggugucccggca

SEQ ID NO: 4002 - RNA, 22 nt, Artificial Sequence
  ELANE RNA Guide
ggugucccggcagcugcgcgga

SEQ ID NO: 4003 - RNA, 22 nt, Artificial Sequence
  ELANE RNA Guide
guggcccuucauggugucccgg

SEQ ID NO: 4004 - RNA, 22 nt, Artificial Sequence
  ELANE RNA Guide
gugucccggcagcugcgcggag

SEQ ID NO: 4005 - RNA, 22 nt, Artificial Sequence
  ELANE RNA Guide
ucauggugucccggcagcugcg

SEQ ID NO: 4006 - RNA, 22 nt, Artificial Sequence
  ELANE RNA Guide
uccgcgcagcugccgggacacc

SEQ ID NO: 4007 - RNA, 22 nt, Artificial Sequence
  ELANE RNA Guide
ugccgggacaccaugaagggcc

SEQ ID NO: 4008 - RNA, 22 nt, Artificial Sequence
  ELANE RNA Guide
uggcccuucauggugucccggc

SEQ ID NO: 4009 - RNA, 22 nt, Artificial Sequence
  ELANE RNA Guide
uggugucccggcagcugcgcgg

SEQ ID NO: 4010 - RNA, 22 nt, Artificial Sequence
  ELANE RNA Guide
ugucccggcagcugcgcggagg

SEQ ID NO: 4011 - RNA, 22 nt, Artificial Sequence
  ELANE RNA Guide
uucauggugucccggcagcugc

SEQ ID NO: 4012 - RNA, 20 nt, Artificial Sequence
  ELANE RNA Guide
aaguggccuccgcgcggcug

SEQ ID NO: 4013 - RNA, 20 nt, Artificial Sequence
  ELANE RNA Guide
agaaguggccuccgcgcggc

SEQ ID NO: 4014 - RNA, 20 nt, Artificial Sequence
  ELANE RNA Guide
agccgcgcggaggccacuuc

SEQ ID NO: 4015 - RNA, 20 nt, Artificial Sequence
  ELANE RNA Guide
aguggccuccgcgcggcugc

SEQ ID NO: 4016 - RNA, 20 nt, Artificial Sequence
  ELANE RNA Guide
auggugucccugcagccgcg

SEQ ID NO: 4017 - RNA, 20 nt, Artificial Sequence
  ELANE RNA Guide
cagaaguggccuccgcgcgg

SEQ ID NO: 4018 - RNA, 20 nt, Artificial Sequence
  ELANE RNA Guide
cagccgcgcggaggccacuu

SEQ ID NO: 4019 - RNA, 20 nt, Artificial Sequence
  ELANE RNA Guide
cauggugucccugcagccgc

SEQ ID NO: 4020 - RNA, 20 nt, Artificial Sequence
  ELANE RNA Guide
cccuucauggugucccugca

SEQ ID NO: 4021 - RNA, 20 nt, Artificial Sequence
  ELANE RNA Guide
ccgcagaaguggccuccgcg

SEQ ID NO: 4022 - RNA, 20 nt, Artificial Sequence
  ELANE RNA Guide
ccgcgcggaggccacuucug

SEQ ID NO: 4023 - RNA, 20 nt, Artificial Sequence
  ELANE RNA Guide
ccgcgcggcugcagggacac

SEQ ID NO: 4024 - RNA, 20 nt, Artificial Sequence
  ELANE RNA Guide
ccuccgcgcggcugcaggga

SEQ ID NO: 4025 - RNA, 20 nt, Artificial Sequence
  ELANE RNA Guide
ccuucauggugucccugcag

SEQ ID NO: 4026 - RNA, 20 nt, Artificial Sequence
  ELANE RNA Guide
cgcagaaguggccuccgcgc

SEQ ID NO: 4027 - RNA, 20 nt, Artificial Sequence
  ELANE RNA Guide
cgccgcagaaguggccuccg

SEQ ID NO: 4028 - RNA, 20 nt, Artificial Sequence
  ELANE RNA Guide
cgcgcggcugcagggacacc

SEQ ID NO: 4029 - RNA, 20 nt, Artificial Sequence
  ELANE RNA Guide
cgcggcugcagggacaccau

SEQ ID NO: 4030 - RNA, 20 nt, Artificial Sequence
  ELANE RNA Guide
cggcugcagggacaccauga

SEQ ID NO: 4031 - RNA, 20 nt, Artificial Sequence
  ELANE RNA Guide
cuccgcgcggcugcagggac

SEQ ID NO: 4032 - RNA, 20 nt, Artificial Sequence
  ELANE RNA Guide
cugcagccgcgcggaggcca

SEQ ID NO: 4033 - RNA, 20 nt, Artificial Sequence
  ELANE RNA Guide
cuucauggugucccugcagc

SEQ ID NO: 4034 - RNA, 20 nt, Artificial Sequence
  ELANE RNA Guide
gaaguggccuccgcgcggcu

SEQ ID NO: 4035 - RNA, 20 nt, Artificial Sequence
  ELANE RNA Guide
gcagaaguggccuccgcgcg

SEQ ID NO: 4036 - RNA, 20 nt, Artificial Sequence
  ELANE RNA Guide
gcagccgcgcggaggccacu

SEQ ID NO: 4037 - RNA, 20 nt, Artificial Sequence
  ELANE RNA Guide
gcccuucauggugucccugc

SEQ ID NO: 4038 - RNA, 20 nt, Artificial Sequence
  ELANE RNA Guide
gccgcagaaguggccuccgc

SEQ ID NO: 4039 - RNA, 20 nt, Artificial Sequence
  ELANE RNA Guide
gccgcgcggaggccacuucu

SEQ ID NO: 4040 - RNA, 20 nt, Artificial Sequence
  ELANE RNA Guide
gcgcggcugcagggacacca

SEQ ID NO: 4041 - RNA, 20 nt, Artificial Sequence
  ELANE RNA Guide
gcggcugcagggacaccaug

SEQ ID NO: 4042 - RNA, 20 nt, Artificial Sequence
  ELANE RNA Guide
ggugucccugcagccgcgcg

SEQ ID NO: 4043 - RNA, 20 nt, Artificial Sequence
  ELANE RNA Guide
gucccugcagccgcgcggag

SEQ ID NO: 4044 - RNA, 20 nt, Artificial Sequence
  ELANE RNA Guide
guggccuccgcgcggcugca

SEQ ID NO: 4045 - RNA, 20 nt, Artificial Sequence
  ELANE RNA Guide
gugucccugcagccgcgcgg

SEQ ID NO: 4046 - RNA, 20 nt, Artificial Sequence
  ELANE RNA Guide
ucauggugucccugcagccg

SEQ ID NO: 4047 - RNA, 20 nt, Artificial Sequence
  ELANE RNA Guide
ucccugcagccgcgcggagg

SEQ ID NO: 4048 - RNA, 20 nt, Artificial Sequence
  ELANE RNA Guide
uccgcgcggcugcagggaca

SEQ ID NO: 4049 - RNA, 20 nt, Artificial Sequence
  ELANE RNA Guide
ugcagccgcgcggaggccac

SEQ ID NO: 4050 - RNA, 20 nt, Artificial Sequence
  ELANE RNA Guide
uggccuccgcgcggcugcag

SEQ ID NO: 4051 - RNA, 20 nt, Artificial Sequence
  ELANE RNA Guide
uggugucccugcagccgcgc

SEQ ID NO: 4052 - RNA, 20 nt, Artificial Sequence
  ELANE RNA Guide
ugucccugcagccgcgcgga

SEQ ID NO: 4053 - RNA, 20 nt, Artificial Sequence
  ELANE RNA Guide
uucauggugucccugcagcc

SEQ ID NO: 4054 - RNA, 21 nt, Artificial Sequence
  ELANE RNA Guide
aaguggccuccgcgcggcugc

SEQ ID NO: 4055 - RNA, 21 nt, Artificial Sequence
  ELANE RNA Guide
agaaguggccuccgcgcggcu

SEQ ID NO: 4056 - RNA, 21 nt, Artificial Sequence
  ELANE RNA Guide
agccgcgcggaggccacuucu

SEQ ID NO: 4057 - RNA, 21 nt, Artificial Sequence
  ELANE RNA Guide
aguggccuccgcgcggcugca

SEQ ID NO: 4058 - RNA, 21 nt, Artificial Sequence
  ELANE RNA Guide
auggugucccugcagccgcgc

SEQ ID NO: 4059 - RNA, 21 nt, Artificial Sequence
  ELANE RNA Guide
cagaaguggccuccgcgcggc

SEQ ID NO: 4060 - RNA, 21 nt, Artificial Sequence
  ELANE RNA Guide
cagccgcgcggaggccacuuc

SEQ ID NO: 4061 - RNA, 21 nt, Artificial Sequence
  ELANE RNA Guide
cauggugucccugcagccgcg

SEQ ID NO: 4062 - RNA, 21 nt, Artificial Sequence
  ELANE RNA Guide
cccuucauggugucccugcag

SEQ ID NO: 4063 - RNA, 21 nt, Artificial Sequence
  ELANE RNA Guide
ccgcagaaguggccuccgcgc

SEQ ID NO: 4064 - RNA, 21 nt, Artificial Sequence
  ELANE RNA Guide
ccgcgcggaggccacuucugc

SEQ ID NO: 4065 - RNA, 21 nt, Artificial Sequence
  ELANE RNA Guide
ccuucauggugucccugcagc

SEQ ID NO: 4066 - RNA, 21 nt, Artificial Sequence
  ELANE RNA Guide
cgcagaaguggccuccgcgcg

SEQ ID NO: 4067 - RNA, 21 nt, Artificial Sequence
  ELANE RNA Guide
cgccgcagaaguggccuccgc

SEQ ID NO: 4068 - RNA, 21 nt, Artificial Sequence
  ELANE RNA Guide
cgcgcggcugcagggacacca

SEQ ID NO: 4069 - RNA, 21 nt, Artificial Sequence
  ELANE RNA Guide
cgcggcugcagggacaccaug

SEQ ID NO: 4070 - RNA, 21 nt, Artificial Sequence
  ELANE RNA Guide
cggcugcagggacaccaugaa

SEQ ID NO: 4071 - RNA, 21 nt, Artificial Sequence
  ELANE RNA Guide
cuccgcgcggcugcagggaca

SEQ ID NO: 4072 - RNA, 21 nt, Artificial Sequence
  ELANE RNA Guide
cuucauggugucccugcagcc

SEQ ID NO: 4073 - RNA, 21 nt, Artificial Sequence
  ELANE RNA Guide
gaaguggccuccgcgcggcug

SEQ ID NO: 4074 - RNA, 21 nt, Artificial Sequence
  ELANE RNA Guide
gcagaaguggccuccgcgcgg

SEQ ID NO: 4075 - RNA, 21 nt, Artificial Sequence
  ELANE RNA Guide
gcagccgcgcggaggccacuu

SEQ ID NO: 4076 - RNA, 21 nt, Artificial Sequence
  ELANE RNA Guide
gcccuucauggugucccugca

SEQ ID NO: 4077 - RNA, 21 nt, Artificial Sequence
  ELANE RNA Guide
gccgcagaaguggccuccgcg

SEQ ID NO: 4078 - RNA, 21 nt, Artificial Sequence
  ELANE RNA Guide
gccgcgcggaggccacuucug

SEQ ID NO: 4079 - RNA, 21 nt, Artificial Sequence
  ELANE RNA Guide
gcgccgcagaaguggccuccg

SEQ ID NO: 4080 - RNA, 21 nt, Artificial Sequence
  ELANE RNA Guide
gcgcggcugcagggacaccau

SEQ ID NO: 4081 - RNA, 21 nt, Artificial Sequence
  ELANE RNA Guide
gcggcugcagggacaccauga

SEQ ID NO: 4082 - RNA, 21 nt, Artificial Sequence
  ELANE RNA Guide
ggcccuucauggugucccugc

SEQ ID NO: 4083 - RNA, 21 nt, Artificial Sequence
  ELANE RNA Guide
gugucccugcagccgcgcgga

SEQ ID NO: 4084 - RNA, 21 nt, Artificial Sequence
  ELANE RNA Guide
ucauggugucccugcagccgc

SEQ ID NO: 4085 - RNA, 21 nt, Artificial Sequence
  ELANE RNA Guide
uccgcgcggcugcagggacac

SEQ ID NO: 4086 - RNA, 21 nt, Artificial Sequence
  ELANE RNA Guide
ugcagccgcgcggaggccacu

SEQ ID NO: 4087 - RNA, 21 nt, Artificial Sequence
  ELANE RNA Guide
uggugucccugcagccgcgcg

SEQ ID NO: 4088 - RNA, 21 nt, Artificial Sequence
  ELANE RNA Guide
ugucccugcagccgcgcggag

SEQ ID NO: 4089 - RNA, 21 nt, Artificial Sequence
  ELANE RNA Guide
uucauggugucccugcagccg

SEQ ID NO: 4090 - RNA, 22 nt, Artificial Sequence
  ELANE RNA Guide
aaguggccuccgcgcggcugca

SEQ ID NO: 4091 - RNA, 22 nt, Artificial Sequence
  ELANE RNA Guide
agaaguggccuccgcgcggcug

SEQ ID NO: 4092 - RNA, 22 nt, Artificial Sequence
  ELANE RNA Guide
agccgcgcggaggccacuucug

SEQ ID NO: 4093 - RNA, 22 nt, Artificial Sequence
  ELANE RNA Guide
aguggccuccgcgcggcugcag

SEQ ID NO: 4094 - RNA, 22 nt, Artificial Sequence
  ELANE RNA Guide
auggugucccugcagccgcgcg

SEQ ID NO: 4095 - RNA, 22 nt, Artificial Sequence
  ELANE RNA Guide
cagaaguggccuccgcgcggcu

SEQ ID NO: 4096 - RNA, 22 nt, Artificial Sequence
  ELANE RNA Guide
cagccgcgcggaggccacuucu

SEQ ID NO: 4097 - RNA, 22 nt, Artificial Sequence
  ELANE RNA Guide
cauggugucccugcagccgcgc

SEQ ID NO: 4098 - RNA, 22 nt, Artificial Sequence
  ELANE RNA Guide
cccuucauggugucccugcagc

SEQ ID NO: 4099 - RNA, 22 nt, Artificial Sequence
  ELANE RNA Guide
ccgcagaaguggccuccgcgcg

SEQ ID NO: 4100 - RNA, 22 nt, Artificial Sequence
  ELANE RNA Guide
ccgcgcggaggccacuucugcg

SEQ ID NO: 4101 - RNA, 22 nt, Artificial Sequence
  ELANE RNA Guide
ccgcgcggcugcagggacacca

SEQ ID NO: 4102 - RNA, 22 nt, Artificial Sequence
  ELANE RNA Guide
ccuccgcgcggcugcagggaca

SEQ ID NO: 4103 - RNA, 22 nt, Artificial Sequence
  ELANE RNA Guide
ccuucauggugucccugcagcc

SEQ ID NO: 4104 - RNA, 22 nt, Artificial Sequence
  ELANE RNA Guide
cgcagaaguggccuccgcgcgg

SEQ ID NO: 4105 - RNA, 22 nt, Artificial Sequence
  ELANE RNA Guide
cgccgcagaaguggccuccgcg

SEQ ID NO: 4106 - RNA, 22 nt, Artificial Sequence
  ELANE RNA Guide
cgcgcggcugcagggacaccau

SEQ ID NO: 4107 - RNA, 22 nt, Artificial Sequence
  ELANE RNA Guide
cgcggcugcagggacaccauga

SEQ ID NO: 4108 - RNA, 22 nt, Artificial Sequence
  ELANE RNA Guide
cggcugcagggacaccaugaag

SEQ ID NO: 4109 - RNA, 22 nt, Artificial Sequence
  ELANE RNA Guide
cuccgcgcggcugcagggacac

SEQ ID NO: 4110 - RNA, 22 nt, Artificial Sequence
  ELANE RNA Guide
cugcagccgcgcggaggccacu

SEQ ID NO: 4111 - RNA, 22 nt, Artificial Sequence
  ELANE RNA Guide
cuucauggugucccugcagccg

SEQ ID NO: 4112 - RNA, 22 nt, Artificial Sequence
  ELANE RNA Guide
gaaguggccuccgcgcggcugc

SEQ ID NO: 4113 - RNA, 22 nt, Artificial Sequence
  ELANE RNA Guide
gcagaaguggccuccgcgcggc

SEQ ID NO: 4114 - RNA, 22 nt, Artificial Sequence
  ELANE RNA Guide
gcagccgcgcggaggccacuuc

SEQ ID NO: 4115 - RNA, 22 nt, Artificial Sequence
  ELANE RNA Guide
gcccuucauggugucccugcag

SEQ ID NO: 4116 - RNA, 22 nt, Artificial Sequence
  ELANE RNA Guide
gccgcagaaguggccuccgcgc

SEQ ID NO: 4117 - RNA, 22 nt, Artificial Sequence
  ELANE RNA Guide
gccgcgcggaggccacuucugc

SEQ ID NO: 4118 - RNA, 22 nt, Artificial Sequence
  ELANE RNA Guide
gcgccgcagaaguggccuccgc

SEQ ID NO: 4119 - RNA, 22 nt, Artificial Sequence
  ELANE RNA Guide
gcgcggcugcagggacaccaug

SEQ ID NO: 4120 - RNA, 22 nt, Artificial Sequence
  ELANE RNA Guide
gcggcugcagggacaccaugaa

SEQ ID NO: 4121 - RNA, 22 nt, Artificial Sequence
  ELANE RNA Guide
ggcccuucauggugucccugca

SEQ ID NO: 4122 - RNA, 22 nt, Artificial Sequence
  ELANE RNA Guide
ggcgccgcagaaguggccuccg

SEQ ID NO: 4123 - RNA, 22 nt, Artificial Sequence
  ELANE RNA Guide
ggugucccugcagccgcgcgga

SEQ ID NO: 4124 - RNA, 22 nt, Artificial Sequence
  ELANE RNA Guide
gugucccugcagccgcgcggag

SEQ ID NO: 4125 - RNA, 22 nt, Artificial Sequence
  ELANE RNA Guide
ucauggugucccugcagccgcg

SEQ ID NO: 4126 - RNA, 22 nt, Artificial Sequence
  ELANE RNA Guide
uccgcgcggcugcagggacacc

SEQ ID NO: 4127 - RNA, 22 nt, Artificial Sequence
  ELANE RNA Guide
ugcagccgcgcggaggccacuu

SEQ ID NO: 4128 - RNA, 22 nt, Artificial Sequence
  ELANE RNA Guide
uggcccuucauggugucccugc

SEQ ID NO: 4129 - RNA, 22 nt, Artificial Sequence
  ELANE RNA Guide
uggugucccugcagccgcgcgg

SEQ ID NO: 4130 - RNA, 22 nt, Artificial Sequence
  ELANE RNA Guide
ugucccugcagccgcgcggagg

SEQ ID NO: 4131 - RNA, 22 nt, Artificial Sequence
  ELANE RNA Guide
uucauggugucccugcagccgc

SEQ ID NO: 4132 - RNA, 20 nt, Artificial Sequence
  ELANE RNA Guide
aaguagccuccgcgcagcug

SEQ ID NO: 4133 - RNA, 20 nt, Artificial Sequence
  ELANE RNA Guide
aaucaggguggcgccgcaga

SEQ ID NO: 4134 - RNA, 20 nt, Artificial Sequence
  ELANE RNA Guide
agaaguagccuccgcgcagc

SEQ ID NO: 4135 - RNA, 20 nt, Artificial Sequence
  ELANE RNA Guide
agcugcgcggaggcuacuuc

SEQ ID NO: 4136 - RNA, 20 nt, Artificial Sequence
  ELANE RNA Guide
aggcuacuucugcggcgcca

SEQ ID NO: 4137 - RNA, 20 nt, Artificial Sequence
  ELANE RNA Guide
aggguggcgccgcagaagua

SEQ ID NO: 4138 - RNA, 20 nt, Artificial Sequence
  ELANE RNA Guide
aguagccuccgcgcagcugc

SEQ ID NO: 4139 - RNA, 20 nt, Artificial Sequence
  ELANE RNA Guide
aucaggguggcgccgcagaa

SEQ ID NO: 4140 - RNA, 20 nt, Artificial Sequence
  ELANE RNA Guide
cagaaguagccuccgcgcag

SEQ ID NO: 4141 - RNA, 20 nt, Artificial Sequence
  ELANE RNA Guide
cagcugcgcggaggcuacuu

SEQ ID NO: 4142 - RNA, 20 nt, Artificial Sequence
  ELANE RNA Guide
caggguggcgccgcagaagu

SEQ ID NO: 4143 - RNA, 20 nt, Artificial Sequence
  ELANE RNA Guide
cccugcagcugcgcggaggc

SEQ ID NO: 4144 - RNA, 20 nt, Artificial Sequence
  ELANE RNA Guide
ccgcagaaguagccuccgcg

SEQ ID NO: 4145 - RNA, 20 nt, Artificial Sequence
  ELANE RNA Guide
ccugcagcugcgcggaggcu

SEQ ID NO: 4146 - RNA, 20 nt, Artificial Sequence
  ELANE RNA Guide
cgcagaaguagccuccgcgc

SEQ ID NO: 4147 - RNA, 20 nt, Artificial Sequence
  ELANE RNA Guide
cgccgcagaaguagccuccg

SEQ ID NO: 4148 - RNA, 20 nt, Artificial Sequence
  ELANE RNA Guide
cgcggaggcuacuucugcgg

SEQ ID NO: 4149 - RNA, 20 nt, Artificial Sequence
  ELANE RNA Guide
cggaggcuacuucugcggcg

SEQ ID NO: 4150 - RNA, 20 nt, Artificial Sequence
  ELANE RNA Guide
cuacuucugcggcgccaccc

SEQ ID NO: 4151 - RNA, 20 nt, Artificial Sequence
  ELANE RNA Guide
cugcagcugcgcggaggcua

SEQ ID NO: 4152 - RNA, 20 nt, Artificial Sequence
  ELANE RNA Guide
cugcgcggaggcuacuucug

SEQ ID NO: 4153 - RNA, 20 nt, Artificial Sequence
  ELANE RNA Guide
gaaguagccuccgcgcagcu

SEQ ID NO: 4154 - RNA, 20 nt, Artificial Sequence
  ELANE RNA Guide
gaggcuacuucugcggcgcc

SEQ ID NO: 4155 - RNA, 20 nt, Artificial Sequence
  ELANE RNA Guide
gcagaaguagccuccgcgca

SEQ ID NO: 4156 - RNA, 20 nt, Artificial Sequence
  ELANE RNA Guide
gcagcugcgcggaggcuacu

SEQ ID NO: 4157 - RNA, 20 nt, Artificial Sequence
  ELANE RNA Guide
gccgcagaaguagccuccgc

SEQ ID NO: 4158 - RNA, 20 nt, Artificial Sequence
  ELANE RNA Guide
gcgccgcagaaguagccucc

SEQ ID NO: 4159 - RNA, 20 nt, Artificial Sequence
  ELANE RNA Guide
gcgcggaggcuacuucugcg

SEQ ID NO: 4160 - RNA, 20 nt, Artificial Sequence
  ELANE RNA Guide
gcggaggcuacuucugcggc

SEQ ID NO: 4161 - RNA, 20 nt, Artificial Sequence
  ELANE RNA Guide
gcuacuucugcggcgccacc

SEQ ID NO: 4162 - RNA, 20 nt, Artificial Sequence
  ELANE RNA Guide
gcugcgcggaggcuacuucu

SEQ ID NO: 4163 - RNA, 20 nt, Artificial Sequence
  ELANE RNA Guide
ggaggcuacuucugcggcgc

SEQ ID NO: 4164 - RNA, 20 nt, Artificial Sequence
  ELANE RNA Guide
ggcgccgcagaaguagccuc

SEQ ID NO: 4165 - RNA, 20 nt, Artificial Sequence
  ELANE RNA Guide
ggcuacuucugcggcgccac

SEQ ID NO: 4166 - RNA, 20 nt, Artificial Sequence
  ELANE RNA Guide
ggguggcgccgcagaaguag

SEQ ID NO: 4167 - RNA, 20 nt, Artificial Sequence
  ELANE RNA Guide
gguggcgccgcagaaguagc

SEQ ID NO: 4168 - RNA, 20 nt, Artificial Sequence
  ELANE RNA Guide
guagccuccgcgcagcugca

SEQ ID NO: 4169 - RNA, 20 nt, Artificial Sequence
  ELANE RNA Guide
gucccugcagcugcgcggag

SEQ ID NO: 4170 - RNA, 20 nt, Artificial Sequence
  ELANE RNA Guide
guggcgccgcagaaguagcc

SEQ ID NO: 4171 - RNA, 20 nt, Artificial Sequence
  ELANE RNA Guide
uagccuccgcgcagcugcag

SEQ ID NO: 4172 - RNA, 20 nt, Artificial Sequence
  ELANE RNA Guide
ucaggguggcgccgcagaag

SEQ ID NO: 4173 - RNA, 20 nt, Artificial Sequence
  ELANE RNA Guide
ucccugcagcugcgcggagg

SEQ ID NO: 4174 - RNA, 20 nt, Artificial Sequence
  ELANE RNA Guide
ugcagcugcgcggaggcuac

SEQ ID NO: 4175 - RNA, 20 nt, Artificial Sequence
  ELANE RNA Guide
ugcgcggaggcuacuucugc

SEQ ID NO: 4176 - RNA, 20 nt, Artificial Sequence
  ELANE RNA Guide
uggcgccgcagaaguagccu

SEQ ID NO: 4177 - RNA, 20 nt, Artificial Sequence
  ELANE RNA Guide
ugucccugcagcugcgcgga

SEQ ID NO: 4178 - RNA, 21 nt, Artificial Sequence
  ELANE RNA Guide
aaguagccuccgcgcagcugc

SEQ ID NO: 4179 - RNA, 21 nt, Artificial Sequence
  ELANE RNA Guide
aaucaggguggcgccgcagaa

SEQ ID NO: 4180 - RNA, 21 nt, Artificial Sequence
  ELANE RNA Guide
agaaguagccuccgcgcagcu

SEQ ID NO: 4181 - RNA, 21 nt, Artificial Sequence
  ELANE RNA Guide
agcugcgcggaggcuacuucu

SEQ ID NO: 4182 - RNA, 21 nt, Artificial Sequence
  ELANE RNA Guide
aggcuacuucugcggcgccac

SEQ ID NO: 4183 - RNA, 21 nt, Artificial Sequence
  ELANE RNA Guide
aggguggcgccgcagaaguag

SEQ ID NO: 4184 - RNA, 21 nt, Artificial Sequence
  ELANE RNA Guide
aguagccuccgcgcagcugca

SEQ ID NO: 4185 - RNA, 21 nt, Artificial Sequence
  ELANE RNA Guide
aucaggguggcgccgcagaag

SEQ ID NO: 4186 - RNA, 21 nt, Artificial Sequence
  ELANE RNA Guide
caaucaggguggcgccgcaga

SEQ ID NO: 4187 - RNA, 21 nt, Artificial Sequence
  ELANE RNA Guide
cagaaguagccuccgcgcagc

SEQ ID NO: 4188 - RNA, 21 nt, Artificial Sequence
  ELANE RNA Guide
cagcugcgcggaggcuacuuc

SEQ ID NO: 4189 - RNA, 21 nt, Artificial Sequence
  ELANE RNA Guide
caggguggcgccgcagaagua

SEQ ID NO: 4190 - RNA, 21 nt, Artificial Sequence
  ELANE RNA Guide
cccugcagcugcgcggaggcu

SEQ ID NO: 4191 - RNA, 21 nt, Artificial Sequence
  ELANE RNA Guide
ccgcagaaguagccuccgcgc

SEQ ID NO: 4192 - RNA, 21 nt, Artificial Sequence
  ELANE RNA Guide
ccugcagcugcgcggaggcua

SEQ ID NO: 4193 - RNA, 21 nt, Artificial Sequence
  ELANE RNA Guide
cgcagaaguagccuccgcgca

SEQ ID NO: 4194 - RNA, 21 nt, Artificial Sequence
  ELANE RNA Guide
cgccgcagaaguagccuccgc

SEQ ID NO: 4195 - RNA, 21 nt, Artificial Sequence
  ELANE RNA Guide
cgcggaggcuacuucugcggc

SEQ ID NO: 4196 - RNA, 21 nt, Artificial Sequence
  ELANE RNA Guide
cggaggcuacuucugcggcgc

SEQ ID NO: 4197 - RNA, 21 nt, Artificial Sequence
  ELANE RNA Guide
cuacuucugcggcgccacccu

SEQ ID NO: 4198 - RNA, 21 nt, Artificial Sequence
  ELANE RNA Guide
cugcagcugcgcggaggcuac

SEQ ID NO: 4199 - RNA, 21 nt, Artificial Sequence
  ELANE RNA Guide
cugcgcggaggcuacuucugc

SEQ ID NO: 4200 - RNA, 21 nt, Artificial Sequence
  ELANE RNA Guide
gaaguagccuccgcgcagcug

SEQ ID NO: 4201 - RNA, 21 nt, Artificial Sequence
  ELANE RNA Guide
gaggcuacuucugcggcgcca

SEQ ID NO: 4202 - RNA, 21 nt, Artificial Sequence
  ELANE RNA Guide
gcagaaguagccuccgcgcag

SEQ ID NO: 4203 - RNA, 21 nt, Artificial Sequence
  ELANE RNA Guide
gcagcugcgcggaggcuacuu

SEQ ID NO: 4204 - RNA, 21 nt, Artificial Sequence
  ELANE RNA Guide
gccgcagaaguagccuccgcg

SEQ ID NO: 4205 - RNA, 21 nt, Artificial Sequence
  ELANE RNA Guide
gcgccgcagaaguagccuccg

SEQ ID NO: 4206 - RNA, 21 nt, Artificial Sequence
  ELANE RNA Guide
gcgcggaggcuacuucugcgg

SEQ ID NO: 4207 - RNA, 21 nt, Artificial Sequence
  ELANE RNA Guide
gcggaggcuacuucugcggcg

SEQ ID NO: 4208 - RNA, 21 nt, Artificial Sequence
  ELANE RNA Guide
gcuacuucugcggcgccaccc

SEQ ID NO: 4209 - RNA, 21 nt, Artificial Sequence
  ELANE RNA Guide
gcugcgcggaggcuacuucug

SEQ ID NO: 4210 - RNA, 21 nt, Artificial Sequence
  ELANE RNA Guide
ggaggcuacuucugcggcgcc

SEQ ID NO: 4211 - RNA, 21 nt, Artificial Sequence
  ELANE RNA Guide
ggcgccgcagaaguagccucc

SEQ ID NO: 4212 - RNA, 21 nt, Artificial Sequence
  ELANE RNA Guide
ggcuacuucugcggcgccacc

SEQ ID NO: 4213 - RNA, 21 nt, Artificial Sequence
  ELANE RNA Guide
ggguggcgccgcagaaguagc

SEQ ID NO: 4214 - RNA, 21 nt, Artificial Sequence
  ELANE RNA Guide
gguggcgccgcagaaguagcc

SEQ ID NO: 4215 - RNA, 21 nt, Artificial Sequence
  ELANE RNA Guide
guagccuccgcgcagcugcag

SEQ ID NO: 4216 - RNA, 21 nt, Artificial Sequence
  ELANE RNA Guide
gucccugcagcugcgcggagg

SEQ ID NO: 4217 - RNA, 21 nt, Artificial Sequence
  ELANE RNA Guide
guggcgccgcagaaguagccu

SEQ ID NO: 4218 - RNA, 21 nt, Artificial Sequence
  ELANE RNA Guide
gugucccugcagcugcgcgga

SEQ ID NO: 4219 - RNA, 21 nt, Artificial Sequence
  ELANE RNA Guide
uagccuccgcgcagcugcagg

SEQ ID NO: 4220 - RNA, 21 nt, Artificial Sequence
  ELANE RNA Guide
ucaggguggcgccgcagaagu

SEQ ID NO: 4221 - RNA, 21 nt, Artificial Sequence
  ELANE RNA Guide
ucccugcagcugcgcggaggc

SEQ ID NO: 4222 - RNA, 21 nt, Artificial Sequence
  ELANE RNA Guide
ugcagcugcgcggaggcuacu

SEQ ID NO: 4223 - RNA, 21 nt, Artificial Sequence
  ELANE RNA Guide
ugcgcggaggcuacuucugcg

SEQ ID NO: 4224 - RNA, 21 nt, Artificial Sequence
  ELANE RNA Guide
uggcgccgcagaaguagccuc

SEQ ID NO: 4225 - RNA, 21 nt, Artificial Sequence
  ELANE RNA Guide
ugucccugcagcugcgcggag

SEQ ID NO: 4226 - RNA, 22 nt, Artificial Sequence
  ELANE RNA Guide
aaguagccuccgcgcagcugca

SEQ ID NO: 4227 - RNA, 22 nt, Artificial Sequence
  ELANE RNA Guide
aaucaggguggcgccgcagaag

SEQ ID NO: 4228 - RNA, 22 nt, Artificial Sequence
  ELANE RNA Guide
agaaguagccuccgcgcagcug

SEQ ID NO: 4229 - RNA, 22 nt, Artificial Sequence
  ELANE RNA Guide
agcugcgcggaggcuacuucug

SEQ ID NO: 4230 - RNA, 22 nt, Artificial Sequence
  ELANE RNA Guide
aggcuacuucugcggcgccacc

SEQ ID NO: 4231 - RNA, 22 nt, Artificial Sequence
  ELANE RNA Guide
aggguggcgccgcagaaguagc

SEQ ID NO: 4232 - RNA, 22 nt, Artificial Sequence
  ELANE RNA Guide
aguagccuccgcgcagcugcag

SEQ ID NO: 4233 - RNA, 22 nt, Artificial Sequence
  ELANE RNA Guide
aucaggguggcgccgcagaagu

SEQ ID NO: 4234 - RNA, 22 nt, Artificial Sequence
  ELANE RNA Guide
caaucaggguggcgccgcagaa

SEQ ID NO: 4235 - RNA, 22 nt, Artificial Sequence
  ELANE RNA Guide
cagaaguagccuccgcgcagcu

SEQ ID NO: 4236 - RNA, 22 nt, Artificial Sequence
  ELANE RNA Guide
cagcugcgcggaggcuacuucu

SEQ ID NO: 4237 - RNA, 22 nt, Artificial Sequence
  ELANE RNA Guide
caggguggcgccgcagaaguag

SEQ ID NO: 4238 - RNA, 22 nt, Artificial Sequence
  ELANE RNA Guide
cccugcagcugcgcggaggcua

SEQ ID NO: 4239 - RNA, 22 nt, Artificial Sequence
  ELANE RNA Guide
ccgcagaaguagccuccgcgca

SEQ ID NO: 4240 - RNA, 22 nt, Artificial Sequence
  ELANE RNA Guide
ccugcagcugcgcggaggcuac

SEQ ID NO: 4241 - RNA, 22 nt, Artificial Sequence
  ELANE RNA Guide
cgcagaaguagccuccgcgcag

SEQ ID NO: 4242 - RNA, 22 nt, Artificial Sequence
  ELANE RNA Guide
cgccgcagaaguagccuccgcg

SEQ ID NO: 4243 - RNA, 22 nt, Artificial Sequence
  ELANE RNA Guide
cgcggaggcuacuucugcggcg

SEQ ID NO: 4244 - RNA, 22 nt, Artificial Sequence
  ELANE RNA Guide
cggaggcuacuucugcggcgcc

SEQ ID NO: 4245 - RNA, 22 nt, Artificial Sequence
  ELANE RNA Guide
cuacuucugcggcgccacccug

SEQ ID NO: 4246 - RNA, 22 nt, Artificial Sequence
  ELANE RNA Guide
cugcagcugcgcggaggcuacu

SEQ ID NO: 4247 - RNA, 22 nt, Artificial Sequence
  ELANE RNA Guide
cugcgcggaggcuacuucugcg

SEQ ID NO: 4248 - RNA, 22 nt, Artificial Sequence
  ELANE RNA Guide
gaaguagccuccgcgcagcugc

SEQ ID NO: 4249 - RNA, 22 nt, Artificial Sequence
  ELANE RNA Guide
gaggcuacuucugcggcgccac

SEQ ID NO: 4250 - RNA, 22 nt, Artificial Sequence
  ELANE RNA Guide
gcaaucaggguggcgccgcaga

SEQ ID NO: 4251 - RNA, 22 nt, Artificial Sequence
  ELANE RNA Guide
gcagaaguagccuccgcgcagc

SEQ ID NO: 4252 - RNA, 22 nt, Artificial Sequence
  ELANE RNA Guide
gcagcugcgcggaggcuacuuc

SEQ ID NO: 4253 - RNA, 22 nt, Artificial Sequence
  ELANE RNA Guide
gccgcagaaguagccuccgcgc

SEQ ID NO: 4254 - RNA, 22 nt, Artificial Sequence
  ELANE RNA Guide
gcgccgcagaaguagccuccgc

SEQ ID NO: 4255 - RNA, 22 nt, Artificial Sequence
  ELANE RNA Guide
gcgcggaggcuacuucugcggc

SEQ ID NO: 4256 - RNA, 22 nt, Artificial Sequence
  ELANE RNA Guide
gcggaggcuacuucugcggcgc

SEQ ID NO: 4257 - RNA, 22 nt, Artificial Sequence
  ELANE RNA Guide
gcuacuucugcggcgccacccu

SEQ ID NO: 4258 - RNA, 22 nt, Artificial Sequence
  ELANE RNA Guide
gcugcgcggaggcuacuucugc

SEQ ID NO: 4259 - RNA, 22 nt, Artificial Sequence
  ELANE RNA Guide
ggaggcuacuucugcggcgcca

SEQ ID NO: 4260 - RNA, 22 nt, Artificial Sequence
  ELANE RNA Guide
ggcgccgcagaaguagccuccg

SEQ ID NO: 4261 - RNA, 22 nt, Artificial Sequence
  ELANE RNA Guide
ggcuacuucugcggcgccaccc

SEQ ID NO: 4262 - RNA, 22 nt, Artificial Sequence
  ELANE RNA Guide
ggguggcgccgcagaaguagcc

SEQ ID NO: 4263 - RNA, 22 nt, Artificial Sequence
  ELANE RNA Guide
gguggcgccgcagaaguagccu

SEQ ID NO: 4264 - RNA, 22 nt, Artificial Sequence
  ELANE RNA Guide
ggugucccugcagcugcgcgga

SEQ ID NO: 4265 - RNA, 22 nt, Artificial Sequence
  ELANE RNA Guide
guagccuccgcgcagcugcagg

SEQ ID NO: 4266 - RNA, 22 nt, Artificial Sequence
  ELANE RNA Guide
gucccugcagcugcgcggaggc

SEQ ID NO: 4267 - RNA, 22 nt, Artificial Sequence
  ELANE RNA Guide
guggcgccgcagaaguagccuc

SEQ ID NO: 4268 - RNA, 22 nt, Artificial Sequence
  ELANE RNA Guide
gugucccugcagcugcgcggag

SEQ ID NO: 4269 - RNA, 22 nt, Artificial Sequence
  ELANE RNA Guide
uagccuccgcgcagcugcaggg

SEQ ID NO: 4270 - RNA, 22 nt, Artificial Sequence
  ELANE RNA Guide
ucaggguggcgccgcagaagua

SEQ ID NO: 4271 - RNA, 22 nt, Artificial Sequence
  ELANE RNA Guide
ucccugcagcugcgcggaggcu

SEQ ID NO: 4272 - RNA, 22 nt, Artificial Sequence
  ELANE RNA Guide
ugcagcugcgcggaggcuacuu

SEQ ID NO: 4273 - RNA, 22 nt, Artificial Sequence
  ELANE RNA Guide
ugcgcggaggcuacuucugcgg

SEQ ID NO: 4274 - RNA, 22 nt, Artificial Sequence
  ELANE RNA Guide
uggcgccgcagaaguagccucc

SEQ ID NO: 4275 - RNA, 22 nt, Artificial Sequence
  ELANE RNA Guide
ugucccugcagcugcgcggagg

SEQ ID NO: 4276 - RNA, 20 nt, Artificial Sequence
  ELANE RNA Guide
aagaggccuccgcgcagcug

SEQ ID NO: 4277 - RNA, 20 nt, Artificial Sequence
  ELANE RNA Guide
agaagaggccuccgcgcagc

SEQ ID NO: 4278 - RNA, 20 nt, Artificial Sequence
  ELANE RNA Guide
agaggccuccgcgcagcugc

SEQ ID NO: 4279 - RNA, 20 nt, Artificial Sequence
  ELANE RNA Guide
agcugcgcggaggccucuuc

SEQ ID NO: 4280 - RNA, 20 nt, Artificial Sequence
  ELANE RNA Guide
aggccucuucugcggcgcca

SEQ ID NO: 4281 - RNA, 20 nt, Artificial Sequence
  ELANE RNA Guide
aggguggcgccgcagaagag

SEQ ID NO: 4282 - RNA, 20 nt, Artificial Sequence
  ELANE RNA Guide
caaucaggguggcgccgcag

SEQ ID NO: 4283 - RNA, 20 nt, Artificial Sequence
  ELANE RNA Guide
cagaagaggccuccgcgcag

SEQ ID NO: 4284 - RNA, 20 nt, Artificial Sequence
  ELANE RNA Guide
cagcugcgcggaggccucuu

SEQ ID NO: 4285 - RNA, 20 nt, Artificial Sequence
  ELANE RNA Guide
caggguggcgccgcagaaga

SEQ ID NO: 4286 - RNA, 20 nt, Artificial Sequence
  ELANE RNA Guide
ccgcagaagaggccuccgcg

SEQ ID NO: 4287 - RNA, 20 nt, Artificial Sequence
  ELANE RNA Guide
ccucuucugcggcgccaccc

SEQ ID NO: 4288 - RNA, 20 nt, Artificial Sequence
  ELANE RNA Guide
ccugcagcugcgcggaggcc

SEQ ID NO: 4289 - RNA, 20 nt, Artificial Sequence
  ELANE RNA Guide
cgcagaagaggccuccgcgc

SEQ ID NO: 4290 - RNA, 20 nt, Artificial Sequence
  ELANE RNA Guide
cgccgcagaagaggccuccg

SEQ ID NO: 4291 - RNA, 20 nt, Artificial Sequence
  ELANE RNA Guide
cgcggaggccucuucugcgg

SEQ ID NO: 4292 - RNA, 20 nt, Artificial Sequence
  ELANE RNA Guide
cggaggccucuucugcggcg

SEQ ID NO: 4293 - RNA, 20 nt, Artificial Sequence
  ELANE RNA Guide
cucuucugcggcgccacccu

SEQ ID NO: 4294 - RNA, 20 nt, Artificial Sequence
  ELANE RNA Guide
cugcagcugcgcggaggccu

SEQ ID NO: 4295 - RNA, 20 nt, Artificial Sequence
  ELANE RNA Guide
cugcgcggaggccucuucug

SEQ ID NO: 4296 - RNA, 20 nt, Artificial Sequence
  ELANE RNA Guide
gaagaggccuccgcgcagcu

SEQ ID NO: 4297 - RNA, 20 nt, Artificial Sequence
  ELANE RNA Guide
gaggccuccgcgcagcugca

SEQ ID NO: 4298 - RNA, 20 nt, Artificial Sequence
  ELANE RNA Guide
gaggccucuucugcggcgcc

SEQ ID NO: 4299 - RNA, 20 nt, Artificial Sequence
  ELANE RNA Guide
gcagaagaggccuccgcgca

SEQ ID NO: 4300 - RNA, 20 nt, Artificial Sequence
  ELANE RNA Guide
gcagcugcgcggaggccucu

SEQ ID NO: 4301 - RNA, 20 nt, Artificial Sequence
  ELANE RNA Guide
gccgcagaagaggccuccgc

SEQ ID NO: 4302 - RNA, 20 nt, Artificial Sequence
  ELANE RNA Guide
gccucuucugcggcgccacc

SEQ ID NO: 4303 - RNA, 20 nt, Artificial Sequence
  ELANE RNA Guide
gcgccgcagaagaggccucc

SEQ ID NO: 4304 - RNA, 20 nt, Artificial Sequence
  ELANE RNA Guide
gcgcggaggccucuucugcg

SEQ ID NO: 4305 - RNA, 20 nt, Artificial Sequence
  ELANE RNA Guide
gcggaggccucuucugcggc

SEQ ID NO: 4306 - RNA, 20 nt, Artificial Sequence
  ELANE RNA Guide
gcugcgcggaggccucuucu

SEQ ID NO: 4307 - RNA, 20 nt, Artificial Sequence
  ELANE RNA Guide
ggaggccucuucugcggcgc

SEQ ID NO: 4308 - RNA, 20 nt, Artificial Sequence
  ELANE RNA Guide
ggccucuucugcggcgccac

SEQ ID NO: 4309 - RNA, 20 nt, Artificial Sequence
  ELANE RNA Guide
ggcgccgcagaagaggccuc

SEQ ID NO: 4310 - RNA, 20 nt, Artificial Sequence
  ELANE RNA Guide
ggguggcgccgcagaagagg

SEQ ID NO: 4311 - RNA, 20 nt, Artificial Sequence
  ELANE RNA Guide
gguggcgccgcagaagaggc

SEQ ID NO: 4312 - RNA, 20 nt, Artificial Sequence
  ELANE RNA Guide
guggcgccgcagaagaggcc

SEQ ID NO: 4313 - RNA, 20 nt, Artificial Sequence
  ELANE RNA Guide
ugcagcugcgcggaggccuc

SEQ ID NO: 4314 - RNA, 20 nt, Artificial Sequence
  ELANE RNA Guide
ugcgcggaggccucuucugc

SEQ ID NO: 4315 - RNA, 20 nt, Artificial Sequence
  ELANE RNA Guide
uggcgccgcagaagaggccu

SEQ ID NO: 4316 - RNA, 21 nt, Artificial Sequence
  ELANE RNA Guide
aagaggccuccgcgcagcugc

SEQ ID NO: 4317 - RNA, 21 nt, Artificial Sequence
  ELANE RNA Guide
agaagaggccuccgcgcagcu

SEQ ID NO: 4318 - RNA, 21 nt, Artificial Sequence
  ELANE RNA Guide
agaggccuccgcgcagcugca

SEQ ID NO: 4319 - RNA, 21 nt, Artificial Sequence
  ELANE RNA Guide
agcugcgcggaggccucuucu

SEQ ID NO: 4320 - RNA, 21 nt, Artificial Sequence
  ELANE RNA Guide
aggccucuucugcggcgccac

SEQ ID NO: 4321 - RNA, 21 nt, Artificial Sequence
  ELANE RNA Guide
aggguggcgccgcagaagagg

SEQ ID NO: 4322 - RNA, 21 nt, Artificial Sequence
  ELANE RNA Guide
cagaagaggccuccgcgcagc

SEQ ID NO: 4323 - RNA, 21 nt, Artificial Sequence
  ELANE RNA Guide
cagcugcgcggaggccucuuc

SEQ ID NO: 4324 - RNA, 21 nt, Artificial Sequence
  ELANE RNA Guide
caggguggcgccgcagaagag

SEQ ID NO: 4325 - RNA, 21 nt, Artificial Sequence
  ELANE RNA Guide
ccgcagaagaggccuccgcgc

SEQ ID NO: 4326 - RNA, 21 nt, Artificial Sequence
  ELANE RNA Guide
ccucuucugcggcgccacccu

SEQ ID NO: 4327 - RNA, 21 nt, Artificial Sequence
  ELANE RNA Guide
ccugcagcugcgcggaggccu

SEQ ID NO: 4328 - RNA, 21 nt, Artificial Sequence
  ELANE RNA Guide
cgcagaagaggccuccgcgca

SEQ ID NO: 4329 - RNA, 21 nt, Artificial Sequence
  ELANE RNA Guide
cgccgcagaagaggccuccgc

SEQ ID NO: 4330 - RNA, 21 nt, Artificial Sequence
  ELANE RNA Guide
cgcggaggccucuucugcggc

SEQ ID NO: 4331 - RNA, 21 nt, Artificial Sequence
  ELANE RNA Guide
cggaggccucuucugcggcgc

SEQ ID NO: 4332 - RNA, 21 nt, Artificial Sequence
  ELANE RNA Guide
cucuucugcggcgccacccug

SEQ ID NO: 4333 - RNA, 21 nt, Artificial Sequence
  ELANE RNA Guide
cugcagcugcgcggaggccuc

SEQ ID NO: 4334 - RNA, 21 nt, Artificial Sequence
  ELANE RNA Guide
cugcgcggaggccucuucugc

SEQ ID NO: 4335 - RNA, 21 nt, Artificial Sequence
  ELANE RNA Guide
gaagaggccuccgcgcagcug

SEQ ID NO: 4336 - RNA, 21 nt, Artificial Sequence
  ELANE RNA Guide
gaggccuccgcgcagcugcag

SEQ ID NO: 4337 - RNA, 21 nt, Artificial Sequence
  ELANE RNA Guide
gaggccucuucugcggcgcca

SEQ ID NO: 4338 - RNA, 21 nt, Artificial Sequence
  ELANE RNA Guide
gcaaucaggguggcgccgcag

SEQ ID NO: 4339 - RNA, 21 nt, Artificial Sequence
  ELANE RNA Guide
gcagaagaggccuccgcgcag

SEQ ID NO: 4340 - RNA, 21 nt, Artificial Sequence
  ELANE RNA Guide
gcagcugcgcggaggccucuu

SEQ ID NO: 4341 - RNA, 21 nt, Artificial Sequence
  ELANE RNA Guide
gccgcagaagaggccuccgcg

SEQ ID NO: 4342 - RNA, 21 nt, Artificial Sequence
  ELANE RNA Guide
gccucuucugcggcgccaccc

SEQ ID NO: 4343 - RNA, 21 nt, Artificial Sequence
  ELANE RNA Guide
gcgccgcagaagaggccuccg

SEQ ID NO: 4344 - RNA, 21 nt, Artificial Sequence
  ELANE RNA Guide
gcgcggaggccucuucugcgg

SEQ ID NO: 4345 - RNA, 21 nt, Artificial Sequence
  ELANE RNA Guide
gcggaggccucuucugcggcg

SEQ ID NO: 4346 - RNA, 21 nt, Artificial Sequence
  ELANE RNA Guide
gcugcgcggaggccucuucug

SEQ ID NO: 4347 - RNA, 21 nt, Artificial Sequence
  ELANE RNA Guide
ggaggccucuucugcggcgcc

SEQ ID NO: 4348 - RNA, 21 nt, Artificial Sequence
  ELANE RNA Guide
ggccucuucugcggcgccacc

SEQ ID NO: 4349 - RNA, 21 nt, Artificial Sequence
  ELANE RNA Guide
ggcgccgcagaagaggccucc

SEQ ID NO: 4350 - RNA, 21 nt, Artificial Sequence
  ELANE RNA Guide
ggguggcgccgcagaagaggc

SEQ ID NO: 4351 - RNA, 21 nt, Artificial Sequence
  ELANE RNA Guide
gguggcgccgcagaagaggcc

SEQ ID NO: 4352 - RNA, 21 nt, Artificial Sequence
  ELANE RNA Guide
guggcgccgcagaagaggccu

SEQ ID NO: 4353 - RNA, 21 nt, Artificial Sequence
  ELANE RNA Guide
ucaggguggcgccgcagaaga

SEQ ID NO: 4354 - RNA, 21 nt, Artificial Sequence
  ELANE RNA Guide
ugcagcugcgcggaggccucu

SEQ ID NO: 4355 - RNA, 21 nt, Artificial Sequence
  ELANE RNA Guide
ugcgcggaggccucuucugcg

SEQ ID NO: 4356 - RNA, 21 nt, Artificial Sequence
  ELANE RNA Guide
uggcgccgcagaagaggccuc

SEQ ID NO: 4357 - RNA, 22 nt, Artificial Sequence
  ELANE RNA Guide
aagaggccuccgcgcagcugca

SEQ ID NO: 4358 - RNA, 22 nt, Artificial Sequence
  ELANE RNA Guide
agaagaggccuccgcgcagcug

SEQ ID NO: 4359 - RNA, 22 nt, Artificial Sequence
  ELANE RNA Guide
agaggccuccgcgcagcugcag

SEQ ID NO: 4360 - RNA, 22 nt, Artificial Sequence
  ELANE RNA Guide
agcugcgcggaggccucuucug

SEQ ID NO: 4361 - RNA, 22 nt, Artificial Sequence
  ELANE RNA Guide
aggccucuucugcggcgccacc

SEQ ID NO: 4362 - RNA, 22 nt, Artificial Sequence
  ELANE RNA Guide
aggguggcgccgcagaagaggc

SEQ ID NO: 4363 - RNA, 22 nt, Artificial Sequence
  ELANE RNA Guide
aucaggguggcgccgcagaaga

SEQ ID NO: 4364 - RNA, 22 nt, Artificial Sequence
  ELANE RNA Guide
cagaagaggccuccgcgcagcu

SEQ ID NO: 4365 - RNA, 22 nt, Artificial Sequence
  ELANE RNA Guide
cagcugcgcggaggccucuucu

SEQ ID NO: 4366 - RNA, 22 nt, Artificial Sequence
  ELANE RNA Guide
caggguggcgccgcagaagagg

SEQ ID NO: 4367 - RNA, 22 nt, Artificial Sequence
  ELANE RNA Guide
cccugcagcugcgcggaggccu

SEQ ID NO: 4368 - RNA, 22 nt, Artificial Sequence
  ELANE RNA Guide
ccgcagaagaggccuccgcgca

SEQ ID NO: 4369 - RNA, 22 nt, Artificial Sequence
  ELANE RNA Guide
ccucuucugcggcgccacccug

SEQ ID NO: 4370 - RNA, 22 nt, Artificial Sequence
  ELANE RNA Guide
ccugcagcugcgcggaggccuc

SEQ ID NO: 4371 - RNA, 22 nt, Artificial Sequence
  ELANE RNA Guide
cgcaaucaggguggcgccgcag

SEQ ID NO: 4372 - RNA, 22 nt, Artificial Sequence
  ELANE RNA Guide
cgcagaagaggccuccgcgcag

SEQ ID NO: 4373 - RNA, 22 nt, Artificial Sequence
  ELANE RNA Guide
cgccgcagaagaggccuccgcg

SEQ ID NO: 4374 - RNA, 22 nt, Artificial Sequence
  ELANE RNA Guide
cgcggaggccucuucugcggcg

SEQ ID NO: 4375 - RNA, 22 nt, Artificial Sequence
  ELANE RNA Guide
cggaggccucuucugcggcgcc

SEQ ID NO: 4376 - RNA, 22 nt, Artificial Sequence
  ELANE RNA Guide
cucuucugcggcgccacccuga

SEQ ID NO: 4377 - RNA, 22 nt, Artificial Sequence
  ELANE RNA Guide
cugcagcugcgcggaggccucu

SEQ ID NO: 4378 - RNA, 22 nt, Artificial Sequence
  ELANE RNA Guide
cugcgcggaggccucuucugcg

SEQ ID NO: 4379 - RNA, 22 nt, Artificial Sequence
  ELANE RNA Guide
gaagaggccuccgcgcagcugc

SEQ ID NO: 4380 - RNA, 22 nt, Artificial Sequence
  ELANE RNA Guide
gaggccuccgcgcagcugcagg

SEQ ID NO: 4381 - RNA, 22 nt, Artificial Sequence
  ELANE RNA Guide
gaggccucuucugcggcgccac

SEQ ID NO: 4382 - RNA, 22 nt, Artificial Sequence
  ELANE RNA Guide
gcagaagaggccuccgcgcagc

SEQ ID NO: 4383 - RNA, 22 nt, Artificial Sequence
  ELANE RNA Guide
gcagcugcgcggaggccucuuc

SEQ ID NO: 4384 - RNA, 22 nt, Artificial Sequence
  ELANE RNA Guide
gccgcagaagaggccuccgcgc

SEQ ID NO: 4385 - RNA, 22 nt, Artificial Sequence
  ELANE RNA Guide
gccucuucugcggcgccacccu

SEQ ID NO: 4386 - RNA, 22 nt, Artificial Sequence
  ELANE RNA Guide
gcgccgcagaagaggccuccgc

SEQ ID NO: 4387 - RNA, 22 nt, Artificial Sequence
  ELANE RNA Guide
gcgcggaggccucuucugcggc

SEQ ID NO: 4388 - RNA, 22 nt, Artificial Sequence
  ELANE RNA Guide
gcggaggccucuucugcggcgc

SEQ ID NO: 4389 - RNA, 22 nt, Artificial Sequence
  ELANE RNA Guide
gcugcgcggaggccucuucugc

SEQ ID NO: 4390 - RNA, 22 nt, Artificial Sequence
  ELANE RNA Guide
ggaggccucuucugcggcgcca

SEQ ID NO: 4391 - RNA, 22 nt, Artificial Sequence
  ELANE RNA Guide
ggccucuucugcggcgccaccc

SEQ ID NO: 4392 - RNA, 22 nt, Artificial Sequence
  ELANE RNA Guide
ggcgccgcagaagaggccuccg

SEQ ID NO: 4393 - RNA, 22 nt, Artificial Sequence
  ELANE RNA Guide
ggguggcgccgcagaagaggcc

SEQ ID NO: 4394 - RNA, 22 nt, Artificial Sequence
  ELANE RNA Guide
gguggcgccgcagaagaggccu

SEQ ID NO: 4395 - RNA, 22 nt, Artificial Sequence
  ELANE RNA Guide
guggcgccgcagaagaggccuc

SEQ ID NO: 4396 - RNA, 22 nt, Artificial Sequence
  ELANE RNA Guide
ucaggguggcgccgcagaagag

SEQ ID NO: 4397 - RNA, 22 nt, Artificial Sequence
  ELANE RNA Guide
ucccugcagcugcgcggaggcc

SEQ ID NO: 4398 - RNA, 22 nt, Artificial Sequence
  ELANE RNA Guide
ugcagcugcgcggaggccucuu

SEQ ID NO: 4399 - RNA, 22 nt, Artificial Sequence
  ELANE RNA Guide
ugcgcggaggccucuucugcgg

SEQ ID NO: 4400 - RNA, 22 nt, Artificial Sequence
  ELANE RNA Guide
uggcgccgcagaagaggccucc

SEQ ID NO: 4401 - RNA, 20 nt, Artificial Sequence
  ELANE RNA Guide
aauucugcggcgccacccug

SEQ ID NO: 4402 - RNA, 20 nt, Artificial Sequence
  ELANE RNA Guide
aauuggccuccgcgcagcug

SEQ ID NO: 4403 - RNA, 20 nt, Artificial Sequence
  ELANE RNA Guide
agaauuggccuccgcgcagc

SEQ ID NO: 4404 - RNA, 20 nt, Artificial Sequence
  ELANE RNA Guide
agcugcgcggaggccaauuc

SEQ ID NO: 4405 - RNA, 20 nt, Artificial Sequence
  ELANE RNA Guide
aggccaauucugcggcgcca

SEQ ID NO: 4406 - RNA, 20 nt, Artificial Sequence
  ELANE RNA Guide
aggguggcgccgcagaauug

SEQ ID NO: 4407 - RNA, 20 nt, Artificial Sequence
  ELANE RNA Guide
auuggccuccgcgcagcugc

SEQ ID NO: 4408 - RNA, 20 nt, Artificial Sequence
  ELANE RNA Guide
caauucugcggcgccacccu

SEQ ID NO: 4409 - RNA, 20 nt, Artificial Sequence
  ELANE RNA Guide
cagaauuggccuccgcgcag

SEQ ID NO: 4410 - RNA, 20 nt, Artificial Sequence
  ELANE RNA Guide
cagcugcgcggaggccaauu

SEQ ID NO: 4411 - RNA, 20 nt, Artificial Sequence
  ELANE RNA Guide
caggguggcgccgcagaauu

SEQ ID NO: 4412 - RNA, 20 nt, Artificial Sequence
  ELANE RNA Guide
ccaauucugcggcgccaccc

SEQ ID NO: 4413 - RNA, 20 nt, Artificial Sequence
  ELANE RNA Guide
ccgcagaauuggccuccgcg

SEQ ID NO: 4414 - RNA, 20 nt, Artificial Sequence
  ELANE RNA Guide
cgcagaauuggccuccgcgc

SEQ ID NO: 4415 - RNA, 20 nt, Artificial Sequence
  ELANE RNA Guide
cgccgcagaauuggccuccg

SEQ ID NO: 4416 - RNA, 20 nt, Artificial Sequence
  ELANE RNA Guide
cgcggaggccaauucugcgg

SEQ ID NO: 4417 - RNA, 20 nt, Artificial Sequence
  ELANE RNA Guide
cggaggccaauucugcggcg

SEQ ID NO: 4418 - RNA, 20 nt, Artificial Sequence
  ELANE RNA Guide
cugcagcugcgcggaggcca

SEQ ID NO: 4419 - RNA, 20 nt, Artificial Sequence
  ELANE RNA Guide
cugcgcggaggccaauucug

SEQ ID NO: 4420 - RNA, 20 nt, Artificial Sequence
  ELANE RNA Guide
gaauuggccuccgcgcagcu

SEQ ID NO: 4421 - RNA, 20 nt, Artificial Sequence
  ELANE RNA Guide
gaggccaauucugcggcgcc

SEQ ID NO: 4422 - RNA, 20 nt, Artificial Sequence
  ELANE RNA Guide
gcaaucaggguggcgccgca

SEQ ID NO: 4423 - RNA, 20 nt, Artificial Sequence
  ELANE RNA Guide
gcagaauuggccuccgcgca

SEQ ID NO: 4424 - RNA, 20 nt, Artificial Sequence
  ELANE RNA Guide
gcagcugcgcggaggccaau

SEQ ID NO: 4425 - RNA, 20 nt, Artificial Sequence
  ELANE RNA Guide
gccaauucugcggcgccacc

SEQ ID NO: 4426 - RNA, 20 nt, Artificial Sequence
  ELANE RNA Guide
gccgcagaauuggccuccgc

SEQ ID NO: 4427 - RNA, 20 nt, Artificial Sequence
  ELANE RNA Guide
gcgccgcagaauuggccucc

SEQ ID NO: 4428 - RNA, 20 nt, Artificial Sequence
  ELANE RNA Guide
gcgcggaggccaauucugcg

SEQ ID NO: 4429 - RNA, 20 nt, Artificial Sequence
  ELANE RNA Guide
gcggaggccaauucugcggc

SEQ ID NO: 4430 - RNA, 20 nt, Artificial Sequence
  ELANE RNA Guide
gcugcgcggaggccaauucu

SEQ ID NO: 4431 - RNA, 20 nt, Artificial Sequence
  ELANE RNA Guide
ggaggccaauucugcggcgc

SEQ ID NO: 4432 - RNA, 20 nt, Artificial Sequence
  ELANE RNA Guide
ggccaauucugcggcgccac

SEQ ID NO: 4433 - RNA, 20 nt, Artificial Sequence
  ELANE RNA Guide
ggcgccgcagaauuggccuc

SEQ ID NO: 4434 - RNA, 20 nt, Artificial Sequence
  ELANE RNA Guide
ggguggcgccgcagaauugg

SEQ ID NO: 4435 - RNA, 20 nt, Artificial Sequence
  ELANE RNA Guide
gguggcgccgcagaauuggc

SEQ ID NO: 4436 - RNA, 20 nt, Artificial Sequence
  ELANE RNA Guide
guggcgccgcagaauuggcc

SEQ ID NO: 4437 - RNA, 20 nt, Artificial Sequence
  ELANE RNA Guide
ucaggguggcgccgcagaau

SEQ ID NO: 4438 - RNA, 20 nt, Artificial Sequence
  ELANE RNA Guide
ugcagcugcgcggaggccaa

SEQ ID NO: 4439 - RNA, 20 nt, Artificial Sequence
  ELANE RNA Guide
ugcgcggaggccaauucugc

SEQ ID NO: 4440 - RNA, 20 nt, Artificial Sequence
  ELANE RNA Guide
uggcgccgcagaauuggccu

SEQ ID NO: 4441 - RNA, 21 nt, Artificial Sequence
  ELANE RNA Guide
aauucugcggcgccacccuga

SEQ ID NO: 4442 - RNA, 21 nt, Artificial Sequence
  ELANE RNA Guide
aauuggccuccgcgcagcugc

SEQ ID NO: 4443 - RNA, 21 nt, Artificial Sequence
  ELANE RNA Guide
agaauuggccuccgcgcagcu

SEQ ID NO: 4444 - RNA, 21 nt, Artificial Sequence
  ELANE RNA Guide
agcugcgcggaggccaauucu

SEQ ID NO: 4445 - RNA, 21 nt, Artificial Sequence
  ELANE RNA Guide
aggccaauucugcggcgccac

SEQ ID NO: 4446 - RNA, 21 nt, Artificial Sequence
  ELANE RNA Guide
aggguggcgccgcagaauugg

SEQ ID NO: 4447 - RNA, 21 nt, Artificial Sequence
  ELANE RNA Guide
aucaggguggcgccgcagaau

SEQ ID NO: 4448 - RNA, 21 nt, Artificial Sequence
  ELANE RNA Guide
auuggccuccgcgcagcugca

SEQ ID NO: 4449 - RNA, 21 nt, Artificial Sequence
  ELANE RNA Guide
caauucugcggcgccacccug

SEQ ID NO: 4450 - RNA, 21 nt, Artificial Sequence
  ELANE RNA Guide
cagaauuggccuccgcgcagc

SEQ ID NO: 4451 - RNA, 21 nt, Artificial Sequence
  ELANE RNA Guide
cagcugcgcggaggccaauuc

SEQ ID NO: 4452 - RNA, 21 nt, Artificial Sequence
  ELANE RNA Guide
caggguggcgccgcagaauug

SEQ ID NO: 4453 - RNA, 21 nt, Artificial Sequence
  ELANE RNA Guide
ccaauucugcggcgccacccu

SEQ ID NO: 4454 - RNA, 21 nt, Artificial Sequence
  ELANE RNA Guide
ccgcagaauuggccuccgcgc

SEQ ID NO: 4455 - RNA, 21 nt, Artificial Sequence
  ELANE RNA Guide
ccugcagcugcgcggaggcca

SEQ ID NO: 4456 - RNA, 21 nt, Artificial Sequence
  ELANE RNA Guide
cgcaaucaggguggcgccgca

SEQ ID NO: 4457 - RNA, 21 nt, Artificial Sequence
  ELANE RNA Guide
cgcagaauuggccuccgcgca

SEQ ID NO: 4458 - RNA, 21 nt, Artificial Sequence
  ELANE RNA Guide
cgccgcagaauuggccuccgc

SEQ ID NO: 4459 - RNA, 21 nt, Artificial Sequence
  ELANE RNA Guide
cgcggaggccaauucugcggc

SEQ ID NO: 4460 - RNA, 21 nt, Artificial Sequence
  ELANE RNA Guide
cggaggccaauucugcggcgc

SEQ ID NO: 4461 - RNA, 21 nt, Artificial Sequence
  ELANE RNA Guide
cugcagcugcgcggaggccaa

SEQ ID NO: 4462 - RNA, 21 nt, Artificial Sequence
  ELANE RNA Guide
cugcgcggaggccaauucugc

SEQ ID NO: 4463 - RNA, 21 nt, Artificial Sequence
  ELANE RNA Guide
gaauuggccuccgcgcagcug

SEQ ID NO: 4464 - RNA, 21 nt, Artificial Sequence
  ELANE RNA Guide
gaggccaauucugcggcgcca

SEQ ID NO: 4465 - RNA, 21 nt, Artificial Sequence
  ELANE RNA Guide
gcagaauuggccuccgcgcag

SEQ ID NO: 4466 - RNA, 21 nt, Artificial Sequence
  ELANE RNA Guide
gcagcugcgcggaggccaauu

SEQ ID NO: 4467 - RNA, 21 nt, Artificial Sequence
  ELANE RNA Guide
gccaauucugcggcgccaccc

SEQ ID NO: 4468 - RNA, 21 nt, Artificial Sequence
  ELANE RNA Guide
gccgcagaauuggccuccgcg

SEQ ID NO: 4469 - RNA, 21 nt, Artificial Sequence
  ELANE RNA Guide
gcgccgcagaauuggccuccg

SEQ ID NO: 4470 - RNA, 21 nt, Artificial Sequence
  ELANE RNA Guide
gcgcggaggccaauucugcgg

SEQ ID NO: 4471 - RNA, 21 nt, Artificial Sequence
  ELANE RNA Guide
gcggaggccaauucugcggcg

SEQ ID NO: 4472 - RNA, 21 nt, Artificial Sequence
  ELANE RNA Guide
gcugcgcggaggccaauucug

SEQ ID NO: 4473 - RNA, 21 nt, Artificial Sequence
  ELANE RNA Guide
ggaggccaauucugcggcgcc

SEQ ID NO: 4474 - RNA, 21 nt, Artificial Sequence
  ELANE RNA Guide
ggccaauucugcggcgccacc

SEQ ID NO: 4475 - RNA, 21 nt, Artificial Sequence
  ELANE RNA Guide
ggcgccgcagaauuggccucc

SEQ ID NO: 4476 - RNA, 21 nt, Artificial Sequence
  ELANE RNA Guide
ggguggcgccgcagaauuggc

SEQ ID NO: 4477 - RNA, 21 nt, Artificial Sequence
  ELANE RNA Guide
gguggcgccgcagaauuggcc

SEQ ID NO: 4478 - RNA, 21 nt, Artificial Sequence
  ELANE RNA Guide
guggcgccgcagaauuggccu

SEQ ID NO: 4479 - RNA, 21 nt, Artificial Sequence
  ELANE RNA Guide
ucaggguggcgccgcagaauu

SEQ ID NO: 4480 - RNA, 21 nt, Artificial Sequence
  ELANE RNA Guide
ugcagcugcgcggaggccaau

SEQ ID NO: 4481 - RNA, 21 nt, Artificial Sequence
  ELANE RNA Guide
ugcgcggaggccaauucugcg

SEQ ID NO: 4482 - RNA, 21 nt, Artificial Sequence
  ELANE RNA Guide
uggcgccgcagaauuggccuc

SEQ ID NO: 4483 - RNA, 22 nt, Artificial Sequence
  ELANE RNA Guide
aaucaggguggcgccgcagaau

SEQ ID NO: 4484 - RNA, 22 nt, Artificial Sequence
  ELANE RNA Guide
aauucugcggcgccacccugau

SEQ ID NO: 4485 - RNA, 22 nt, Artificial Sequence
  ELANE RNA Guide
aauuggccuccgcgcagcugca

SEQ ID NO: 4486 - RNA, 22 nt, Artificial Sequence
  ELANE RNA Guide
agaauuggccuccgcgcagcug

SEQ ID NO: 4487 - RNA, 22 nt, Artificial Sequence
  ELANE RNA Guide
agcugcgcggaggccaauucug

SEQ ID NO: 4488 - RNA, 22 nt, Artificial Sequence
  ELANE RNA Guide
aggccaauucugcggcgccacc

SEQ ID NO: 4489 - RNA, 22 nt, Artificial Sequence
  ELANE RNA Guide
aggguggcgccgcagaauuggc

SEQ ID NO: 4490 - RNA, 22 nt, Artificial Sequence
  ELANE RNA Guide
aucaggguggcgccgcagaauu

SEQ ID NO: 4491 - RNA, 22 nt, Artificial Sequence
  ELANE RNA Guide
auuggccuccgcgcagcugcag

SEQ ID NO: 4492 - RNA, 22 nt, Artificial Sequence
  ELANE RNA Guide
caauucugcggcgccacccuga

SEQ ID NO: 4493 - RNA, 22 nt, Artificial Sequence
  ELANE RNA Guide
cagaauuggccuccgcgcagcu

SEQ ID NO: 4494 - RNA, 22 nt, Artificial Sequence
  ELANE RNA Guide
cagcugcgcggaggccaauucu

SEQ ID NO: 4495 - RNA, 22 nt, Artificial Sequence
  ELANE RNA Guide
caggguggcgccgcagaauugg

SEQ ID NO: 4496 - RNA, 22 nt, Artificial Sequence
  ELANE RNA Guide
ccaauucugcggcgccacccug

SEQ ID NO: 4497 - RNA, 22 nt, Artificial Sequence
  ELANE RNA Guide
cccugcagcugcgcggaggcca

SEQ ID NO: 4498 - RNA, 22 nt, Artificial Sequence
  ELANE RNA Guide
ccgcagaauuggccuccgcgca

SEQ ID NO: 4499 - RNA, 22 nt, Artificial Sequence
  ELANE RNA Guide
ccugcagcugcgcggaggccaa

SEQ ID NO: 4500 - RNA, 22 nt, Artificial Sequence
  ELANE RNA Guide
cgcagaauuggccuccgcgcag

SEQ ID NO: 4501 - RNA, 22 nt, Artificial Sequence
  ELANE RNA Guide
cgccgcagaauuggccuccgcg

SEQ ID NO: 4502 - RNA, 22 nt, Artificial Sequence
  ELANE RNA Guide
cgcggaggccaauucugcggcg

SEQ ID NO: 4503 - RNA, 22 nt, Artificial Sequence
  ELANE RNA Guide
cggaggccaauucugcggcgcc

SEQ ID NO: 4504 - RNA, 22 nt, Artificial Sequence
  ELANE RNA Guide
cugcagcugcgcggaggccaau

SEQ ID NO: 4505 - RNA, 22 nt, Artificial Sequence
  ELANE RNA Guide
cugcgcggaggccaauucugcg

SEQ ID NO: 4506 - RNA, 22 nt, Artificial Sequence
  ELANE RNA Guide
gaauuggccuccgcgcagcugc

SEQ ID NO: 4507 - RNA, 22 nt, Artificial Sequence
  ELANE RNA Guide
gaggccaauucugcggcgccac

SEQ ID NO: 4508 - RNA, 22 nt, Artificial Sequence
  ELANE RNA Guide
gcagaauuggccuccgcgcagc

SEQ ID NO: 4509 - RNA, 22 nt, Artificial Sequence
  ELANE RNA Guide
gcagcugcgcggaggccaauuc

SEQ ID NO: 4510 - RNA, 22 nt, Artificial Sequence
  ELANE RNA Guide
gccaauucugcggcgccacccu

SEQ ID NO: 4511 - RNA, 22 nt, Artificial Sequence
  ELANE RNA Guide
gccgcagaauuggccuccgcgc

SEQ ID NO: 4512 - RNA, 22 nt, Artificial Sequence
  ELANE RNA Guide
gcgcaaucaggguggcgccgca

SEQ ID NO: 4513 - RNA, 22 nt, Artificial Sequence
  ELANE RNA Guide
gcgccgcagaauuggccuccgc

SEQ ID NO: 4514 - RNA, 22 nt, Artificial Sequence
  ELANE RNA Guide
gcgcggaggccaauucugcggc

SEQ ID NO: 4515 - RNA, 22 nt, Artificial Sequence
  ELANE RNA Guide
gcggaggccaauucugcggcgc

SEQ ID NO: 4516 - RNA, 22 nt, Artificial Sequence
  ELANE RNA Guide
gcugcgcggaggccaauucugc

SEQ ID NO: 4517 - RNA, 22 nt, Artificial Sequence
  ELANE RNA Guide
ggaggccaauucugcggcgcca

SEQ ID NO: 4518 - RNA, 22 nt, Artificial Sequence
  ELANE RNA Guide
ggccaauucugcggcgccaccc

SEQ ID NO: 4519 - RNA, 22 nt, Artificial Sequence
  ELANE RNA Guide
ggcgccgcagaauuggccuccg

SEQ ID NO: 4520 - RNA, 22 nt, Artificial Sequence
  ELANE RNA Guide
ggguggcgccgcagaauuggcc

SEQ ID NO: 4521 - RNA, 22 nt, Artificial Sequence
  ELANE RNA Guide
gguggcgccgcagaauuggccu

SEQ ID NO: 4522 - RNA, 22 nt, Artificial Sequence
  ELANE RNA Guide
guggcgccgcagaauuggccuc

SEQ ID NO: 4523 - RNA, 22 nt, Artificial Sequence
  ELANE RNA Guide
ucaggguggcgccgcagaauug

SEQ ID NO: 4524 - RNA, 22 nt, Artificial Sequence
  ELANE RNA Guide
ugcagcugcgcggaggccaauu

SEQ ID NO: 4525 - RNA, 22 nt, Artificial Sequence
  ELANE RNA Guide
ugcgcggaggccaauucugcgg

SEQ ID NO: 4526 - RNA, 22 nt, Artificial Sequence
  ELANE RNA Guide
uggcgccgcagaauuggccucc

SEQ ID NO: 4527 - RNA, 20 nt, Artificial Sequence
  ELANE RNA Guide
aaucaggguggcgccgcuga

SEQ ID NO: 4528 - RNA, 20 nt, Artificial Sequence
  ELANE RNA Guide
acuucagcggcgccacccug

SEQ ID NO: 4529 - RNA, 20 nt, Artificial Sequence
  ELANE RNA Guide
agcugcgcggaggccacuuc

SEQ ID NO: 4530 - RNA, 20 nt, Artificial Sequence
  ELANE RNA Guide
aggccacuucagcggcgcca

SEQ ID NO: 4531 - RNA, 20 nt, Artificial Sequence
  ELANE RNA Guide
aggguggcgccgcugaagug

SEQ ID NO: 4532 - RNA, 20 nt, Artificial Sequence
  ELANE RNA Guide
aucaggguggcgccgcugaa

SEQ ID NO: 4533 - RNA, 20 nt, Artificial Sequence
  ELANE RNA Guide
caaucaggguggcgccgcug

SEQ ID NO: 4534 - RNA, 20 nt, Artificial Sequence
  ELANE RNA Guide
cacuucagcggcgccacccu

SEQ ID NO: 4535 - RNA, 20 nt, Artificial Sequence
  ELANE RNA Guide
cagcggcgccacccugauug

SEQ ID NO: 4536 - RNA, 20 nt, Artificial Sequence
  ELANE RNA Guide
cagcugcgcggaggccacuu

SEQ ID NO: 4537 - RNA, 20 nt, Artificial Sequence
  ELANE RNA Guide
caggguggcgccgcugaagu

SEQ ID NO: 4538 - RNA, 20 nt, Artificial Sequence
  ELANE RNA Guide
ccacuucagcggcgccaccc

SEQ ID NO: 4539 - RNA, 20 nt, Artificial Sequence
  ELANE RNA Guide
ccgcugaaguggccuccgcg

SEQ ID NO: 4540 - RNA, 20 nt, Artificial Sequence
  ELANE RNA Guide
cgcaaucaggguggcgccgc

SEQ ID NO: 4541 - RNA, 20 nt, Artificial Sequence
  ELANE RNA Guide
cgccgcugaaguggccuccg

SEQ ID NO: 4542 - RNA, 20 nt, Artificial Sequence
  ELANE RNA Guide
cgcggaggccacuucagcgg

SEQ ID NO: 4543 - RNA, 20 nt, Artificial Sequence
  ELANE RNA Guide
cgcugaaguggccuccgcgc

SEQ ID NO: 4544 - RNA, 20 nt, Artificial Sequence
  ELANE RNA Guide
cggaggccacuucagcggcg

SEQ ID NO: 4545 - RNA, 20 nt, Artificial Sequence
  ELANE RNA Guide
cugaaguggccuccgcgcag

SEQ ID NO: 4546 - RNA, 20 nt, Artificial Sequence
  ELANE RNA Guide
cugcgcggaggccacuucag

SEQ ID NO: 4547 - RNA, 20 nt, Artificial Sequence
  ELANE RNA Guide
cuucagcggcgccacccuga

SEQ ID NO: 4548 - RNA, 20 nt, Artificial Sequence
  ELANE RNA Guide
gaggccacuucagcggcgcc

SEQ ID NO: 4549 - RNA, 20 nt, Artificial Sequence
  ELANE RNA Guide
gcaaucaggguggcgccgcu

SEQ ID NO: 4550 - RNA, 20 nt, Artificial Sequence
  ELANE RNA Guide
gcagcugcgcggaggccacu

SEQ ID NO: 4551 - RNA, 20 nt, Artificial Sequence
  ELANE RNA Guide
gccacuucagcggcgccacc

SEQ ID NO: 4552 - RNA, 20 nt, Artificial Sequence
  ELANE RNA Guide
gccgcugaaguggccuccgc

SEQ ID NO: 4553 - RNA, 20 nt, Artificial Sequence
  ELANE RNA Guide
gcgcaaucaggguggcgccg

SEQ ID NO: 4554 - RNA, 20 nt, Artificial Sequence
  ELANE RNA Guide
gcgccgcugaaguggccucc

SEQ ID NO: 4555 - RNA, 20 nt, Artificial Sequence
  ELANE RNA Guide
gcgcggaggccacuucagcg

SEQ ID NO: 4556 - RNA, 20 nt, Artificial Sequence
  ELANE RNA Guide
gcggaggccacuucagcggc

SEQ ID NO: 4557 - RNA, 20 nt, Artificial Sequence
  ELANE RNA Guide
gcugaaguggccuccgcgca

SEQ ID NO: 4558 - RNA, 20 nt, Artificial Sequence
  ELANE RNA Guide
gcugcgcggaggccacuuca

SEQ ID NO: 4559 - RNA, 20 nt, Artificial Sequence
  ELANE RNA Guide
ggaggccacuucagcggcgc

SEQ ID NO: 4560 - RNA, 20 nt, Artificial Sequence
  ELANE RNA Guide
ggccacuucagcggcgccac

SEQ ID NO: 4561 - RNA, 20 nt, Artificial Sequence
  ELANE RNA Guide
ggcgcaaucaggguggcgcc

SEQ ID NO: 4562 - RNA, 20 nt, Artificial Sequence
  ELANE RNA Guide
ggcgccgcugaaguggccuc

SEQ ID NO: 4563 - RNA, 20 nt, Artificial Sequence
  ELANE RNA Guide
gggcgcaaucaggguggcgc

SEQ ID NO: 4564 - RNA, 20 nt, Artificial Sequence
  ELANE RNA Guide
ggguggcgccgcugaagugg

SEQ ID NO: 4565 - RNA, 20 nt, Artificial Sequence
  ELANE RNA Guide
gguggcgccgcugaaguggc

SEQ ID NO: 4566 - RNA, 20 nt, Artificial Sequence
  ELANE RNA Guide
guggcgccgcugaaguggcc

SEQ ID NO: 4567 - RNA, 20 nt, Artificial Sequence
  ELANE RNA Guide
ucagcggcgccacccugauu

SEQ ID NO: 4568 - RNA, 20 nt, Artificial Sequence
  ELANE RNA Guide
ucaggguggcgccgcugaag

SEQ ID NO: 4569 - RNA, 20 nt, Artificial Sequence
  ELANE RNA Guide
ugcagcugcgcggaggccac

SEQ ID NO: 4570 - RNA, 20 nt, Artificial Sequence
  ELANE RNA Guide
ugcgcggaggccacuucagc

SEQ ID NO: 4571 - RNA, 20 nt, Artificial Sequence
  ELANE RNA Guide
uggcgccgcugaaguggccu

SEQ ID NO: 4572 - RNA, 20 nt, Artificial Sequence
  ELANE RNA Guide
uucagcggcgccacccugau

SEQ ID NO: 4573 - RNA, 21 nt, Artificial Sequence
  ELANE RNA Guide
aaucaggguggcgccgcugaa

SEQ ID NO: 4574 - RNA, 21 nt, Artificial Sequence
  ELANE RNA Guide
acuucagcggcgccacccuga

SEQ ID NO: 4575 - RNA, 21 nt, Artificial Sequence
  ELANE RNA Guide
agcugcgcggaggccacuuca

SEQ ID NO: 4576 - RNA, 21 nt, Artificial Sequence
  ELANE RNA Guide
aggccacuucagcggcgccac

SEQ ID NO: 4577 - RNA, 21 nt, Artificial Sequence
  ELANE RNA Guide
aggguggcgccgcugaagugg

SEQ ID NO: 4578 - RNA, 21 nt, Artificial Sequence
  ELANE RNA Guide
aucaggguggcgccgcugaag

SEQ ID NO: 4579 - RNA, 21 nt, Artificial Sequence
  ELANE RNA Guide
caaucaggguggcgccgcuga

SEQ ID NO: 4580 - RNA, 21 nt, Artificial Sequence
  ELANE RNA Guide
cacuucagcggcgccacccug

SEQ ID NO: 4581 - RNA, 21 nt, Artificial Sequence
  ELANE RNA Guide
cagcggcgccacccugauugc

SEQ ID NO: 4582 - RNA, 21 nt, Artificial Sequence
  ELANE RNA Guide
cagcugcgcggaggccacuuc

SEQ ID NO: 4583 - RNA, 21 nt, Artificial Sequence
  ELANE RNA Guide
caggguggcgccgcugaagug

SEQ ID NO: 4584 - RNA, 21 nt, Artificial Sequence
  ELANE RNA Guide
ccacuucagcggcgccacccu

SEQ ID NO: 4585 - RNA, 21 nt, Artificial Sequence
  ELANE RNA Guide
ccgcugaaguggccuccgcgc

SEQ ID NO: 4586 - RNA, 21 nt, Artificial Sequence
  ELANE RNA Guide
cgcaaucaggguggcgccgcu

SEQ ID NO: 4587 - RNA, 21 nt, Artificial Sequence
  ELANE RNA Guide
cgccgcugaaguggccuccgc

SEQ ID NO: 4588 - RNA, 21 nt, Artificial Sequence
  ELANE RNA Guide
cgcggaggccacuucagcggc

SEQ ID NO: 4589 - RNA, 21 nt, Artificial Sequence
  ELANE RNA Guide
cgcugaaguggccuccgcgca

SEQ ID NO: 4590 - RNA, 21 nt, Artificial Sequence
  ELANE RNA Guide
cggaggccacuucagcggcgc

SEQ ID NO: 4591 - RNA, 21 nt, Artificial Sequence
  ELANE RNA Guide
cugaaguggccuccgcgcagc

SEQ ID NO: 4592 - RNA, 21 nt, Artificial Sequence
  ELANE RNA Guide
cugcagcugcgcggaggccac

SEQ ID NO: 4593 - RNA, 21 nt, Artificial Sequence
  ELANE RNA Guide
cugcgcggaggccacuucagc

SEQ ID NO: 4594 - RNA, 21 nt, Artificial Sequence
  ELANE RNA Guide
cuucagcggcgccacccugau

SEQ ID NO: 4595 - RNA, 21 nt, Artificial Sequence
  ELANE RNA Guide
gaggccacuucagcggcgcca

SEQ ID NO: 4596 - RNA, 21 nt, Artificial Sequence
  ELANE RNA Guide
gcaaucaggguggcgccgcug

SEQ ID NO: 4597 - RNA, 21 nt, Artificial Sequence
  ELANE RNA Guide
gcagcugcgcggaggccacuu

SEQ ID NO: 4598 - RNA, 21 nt, Artificial Sequence
  ELANE RNA Guide
gccacuucagcggcgccaccc

SEQ ID NO: 4599 - RNA, 21 nt, Artificial Sequence
  ELANE RNA Guide
gccgcugaaguggccuccgcg

SEQ ID NO: 4600 - RNA, 21 nt, Artificial Sequence
  ELANE RNA Guide
gcgcaaucaggguggcgccgc

SEQ ID NO: 4601 - RNA, 21 nt, Artificial Sequence
  ELANE RNA Guide
gcgccgcugaaguggccuccg

SEQ ID NO: 4602 - RNA, 21 nt, Artificial Sequence
  ELANE RNA Guide
gcgcggaggccacuucagcgg

SEQ ID NO: 4603 - RNA, 21 nt, Artificial Sequence
  ELANE RNA Guide
gcggaggccacuucagcggcg

SEQ ID NO: 4604 - RNA, 21 nt, Artificial Sequence
  ELANE RNA Guide
gcugaaguggccuccgcgcag

SEQ ID NO: 4605 - RNA, 21 nt, Artificial Sequence
  ELANE RNA Guide
gcugcgcggaggccacuucag

SEQ ID NO: 4606 - RNA, 21 nt, Artificial Sequence
  ELANE RNA Guide
ggaggccacuucagcggcgcc

SEQ ID NO: 4607 - RNA, 21 nt, Artificial Sequence
  ELANE RNA Guide
ggccacuucagcggcgccacc

SEQ ID NO: 4608 - RNA, 21 nt, Artificial Sequence
  ELANE RNA Guide
ggcgcaaucaggguggcgccg

SEQ ID NO: 4609 - RNA, 21 nt, Artificial Sequence
  ELANE RNA Guide
ggcgccgcugaaguggccucc

SEQ ID NO: 4610 - RNA, 21 nt, Artificial Sequence
  ELANE RNA Guide
gggcgcaaucaggguggcgcc

SEQ ID NO: 4611 - RNA, 21 nt, Artificial Sequence
  ELANE RNA Guide
ggguggcgccgcugaaguggc

SEQ ID NO: 4612 - RNA, 21 nt, Artificial Sequence
  ELANE RNA Guide
gguggcgccgcugaaguggcc

SEQ ID NO: 4613 - RNA, 21 nt, Artificial Sequence
  ELANE RNA Guide
guggcgccgcugaaguggccu

SEQ ID NO: 4614 - RNA, 21 nt, Artificial Sequence
  ELANE RNA Guide
ucagcggcgccacccugauug

SEQ ID NO: 4615 - RNA, 21 nt, Artificial Sequence
  ELANE RNA Guide
ucaggguggcgccgcugaagu

SEQ ID NO: 4616 - RNA, 21 nt, Artificial Sequence
  ELANE RNA Guide
ugcagcugcgcggaggccacu

SEQ ID NO: 4617 - RNA, 21 nt, Artificial Sequence
  ELANE RNA Guide
ugcgcggaggccacuucagcg

SEQ ID NO: 4618 - RNA, 21 nt, Artificial Sequence
  ELANE RNA Guide
uggcgccgcugaaguggccuc

SEQ ID NO: 4619 - RNA, 21 nt, Artificial Sequence
  ELANE RNA Guide
ugggcgcaaucaggguggcgc

SEQ ID NO: 4620 - RNA, 21 nt, Artificial Sequence
  ELANE RNA Guide
uucagcggcgccacccugauu

SEQ ID NO: 4621 - RNA, 22 nt, Artificial Sequence
  ELANE RNA Guide
aaucaggguggcgccgcugaag

SEQ ID NO: 4622 - RNA, 22 nt, Artificial Sequence
  ELANE RNA Guide
acuucagcggcgccacccugau

SEQ ID NO: 4623 - RNA, 22 nt, Artificial Sequence
  ELANE RNA Guide
agcugcgcggaggccacuucag

SEQ ID NO: 4624 - RNA, 22 nt, Artificial Sequence
  ELANE RNA Guide
aggccacuucagcggcgccacc

SEQ ID NO: 4625 - RNA, 22 nt, Artificial Sequence
  ELANE RNA Guide
aggguggcgccgcugaaguggc

SEQ ID NO: 4626 - RNA, 22 nt, Artificial Sequence
  ELANE RNA Guide
aucaggguggcgccgcugaagu

SEQ ID NO: 4627 - RNA, 22 nt, Artificial Sequence
  ELANE RNA Guide
caaucaggguggcgccgcugaa

SEQ ID NO: 4628 - RNA, 22 nt, Artificial Sequence
  ELANE RNA Guide
cacuucagcggcgccacccuga

SEQ ID NO: 4629 - RNA, 22 nt, Artificial Sequence
  ELANE RNA Guide
cagcggcgccacccugauugcg

SEQ ID NO: 4630 - RNA, 22 nt, Artificial Sequence
  ELANE RNA Guide
cagcugcgcggaggccacuuca

SEQ ID NO: 4631 - RNA, 22 nt, Artificial Sequence
  ELANE RNA Guide
caggguggcgccgcugaagugg

SEQ ID NO: 4632 - RNA, 22 nt, Artificial Sequence
  ELANE RNA Guide
ccacuucagcggcgccacccug

SEQ ID NO: 4633 - RNA, 22 nt, Artificial Sequence
  ELANE RNA Guide
ccgcugaaguggccuccgcgca

SEQ ID NO: 4634 - RNA, 22 nt, Artificial Sequence
  ELANE RNA Guide
ccugcagcugcgcggaggccac

SEQ ID NO: 4635 - RNA, 22 nt, Artificial Sequence
  ELANE RNA Guide
cgcaaucaggguggcgccgcug

SEQ ID NO: 4636 - RNA, 22 nt, Artificial Sequence
  ELANE RNA Guide
cgccgcugaaguggccuccgcg

SEQ ID NO: 4637 - RNA, 22 nt, Artificial Sequence
  ELANE RNA Guide
cgcggaggccacuucagcggcg

SEQ ID NO: 4638 - RNA, 22 nt, Artificial Sequence
  ELANE RNA Guide
cgcugaaguggccuccgcgcag

SEQ ID NO: 4639 - RNA, 22 nt, Artificial Sequence
  ELANE RNA Guide
cggaggccacuucagcggcgcc

SEQ ID NO: 4640 - RNA, 22 nt, Artificial Sequence
  ELANE RNA Guide
cugaaguggccuccgcgcagcu

SEQ ID NO: 4641 - RNA, 22 nt, Artificial Sequence
  ELANE RNA Guide
cugcagcugcgcggaggccacu

SEQ ID NO: 4642 - RNA, 22 nt, Artificial Sequence
  ELANE RNA Guide
cugcgcggaggccacuucagcg

SEQ ID NO: 4643 - RNA, 22 nt, Artificial Sequence
  ELANE RNA Guide
cuucagcggcgccacccugauu

SEQ ID NO: 4644 - RNA, 22 nt, Artificial Sequence
  ELANE RNA Guide
gaggccacuucagcggcgccac

SEQ ID NO: 4645 - RNA, 22 nt, Artificial Sequence
  ELANE RNA Guide
gcaaucaggguggcgccgcuga

SEQ ID NO: 4646 - RNA, 22 nt, Artificial Sequence
  ELANE RNA Guide
gcagcugcgcggaggccacuuc

SEQ ID NO: 4647 - RNA, 22 nt, Artificial Sequence
  ELANE RNA Guide
gccacuucagcggcgccacccu

SEQ ID NO: 4648 - RNA, 22 nt, Artificial Sequence
  ELANE RNA Guide
gccgcugaaguggccuccgcgc

SEQ ID NO: 4649 - RNA, 22 nt, Artificial Sequence
  ELANE RNA Guide
gcgcaaucaggguggcgccgcu

SEQ ID NO: 4650 - RNA, 22 nt, Artificial Sequence
  ELANE RNA Guide
gcgccgcugaaguggccuccgc

SEQ ID NO: 4651 - RNA, 22 nt, Artificial Sequence
  ELANE RNA Guide
gcgcggaggccacuucagcggc

SEQ ID NO: 4652 - RNA, 22 nt, Artificial Sequence
  ELANE RNA Guide
gcggaggccacuucagcggcgc

SEQ ID NO: 4653 - RNA, 22 nt, Artificial Sequence
  ELANE RNA Guide
gcugaaguggccuccgcgcagc

SEQ ID NO: 4654 - RNA, 22 nt, Artificial Sequence
  ELANE RNA Guide
gcugcgcggaggccacuucagc

SEQ ID NO: 4655 - RNA, 22 nt, Artificial Sequence
  ELANE RNA Guide
ggaggccacuucagcggcgcca

SEQ ID NO: 4656 - RNA, 22 nt, Artificial Sequence
  ELANE RNA Guide
ggccacuucagcggcgccaccc

SEQ ID NO: 4657 - RNA, 22 nt, Artificial Sequence
  ELANE RNA Guide
ggcgcaaucaggguggcgccgc

SEQ ID NO: 4658 - RNA, 22 nt, Artificial Sequence
  ELANE RNA Guide
ggcgccgcugaaguggccuccg

SEQ ID NO: 4659 - RNA, 22 nt, Artificial Sequence
  ELANE RNA Guide
gggcgcaaucaggguggcgccg

SEQ ID NO: 4660 - RNA, 22 nt, Artificial Sequence
  ELANE RNA Guide
ggguggcgccgcugaaguggcc

SEQ ID NO: 4661 - RNA, 22 nt, Artificial Sequence
  ELANE RNA Guide
gguggcgccgcugaaguggccu

SEQ ID NO: 4662 - RNA, 22 nt, Artificial Sequence
  ELANE RNA Guide
guggcgccgcugaaguggccuc

SEQ ID NO: 4663 - RNA, 22 nt, Artificial Sequence
  ELANE RNA Guide
ucagcggcgccacccugauugc

SEQ ID NO: 4664 - RNA, 22 nt, Artificial Sequence
  ELANE RNA Guide
ucaggguggcgccgcugaagug

SEQ ID NO: 4665 - RNA, 22 nt, Artificial Sequence
  ELANE RNA Guide
ugcagcugcgcggaggccacuu

SEQ ID NO: 4666 - RNA, 22 nt, Artificial Sequence
  ELANE RNA Guide
ugcgcggaggccacuucagcgg

SEQ ID NO: 4667 - RNA, 22 nt, Artificial Sequence
  ELANE RNA Guide
uggcgccgcugaaguggccucc

SEQ ID NO: 4668 - RNA, 22 nt, Artificial Sequence
  ELANE RNA Guide
ugggcgcaaucaggguggcgcc

SEQ ID NO: 4669 - RNA, 22 nt, Artificial Sequence
  ELANE RNA Guide
uucagcggcgccacccugauug

SEQ ID NO: 4670 - RNA, 22 nt, Artificial Sequence
  ELANE RNA Guide
uugggcgcaaucaggguggcgc

SEQ ID NO: 4671 - RNA, 20 nt, Artificial Sequence
  ELANE RNA Guide
aaucaggguggcgccguaga

SEQ ID NO: 4672 - RNA, 20 nt, Artificial Sequence
  ELANE RNA Guide
acuucuacggcgccacccug

SEQ ID NO: 4673 - RNA, 20 nt, Artificial Sequence
  ELANE RNA Guide
aggccacuucuacggcgcca

SEQ ID NO: 4674 - RNA, 20 nt, Artificial Sequence
  ELANE RNA Guide
aggguggcgccguagaagug

SEQ ID NO: 4675 - RNA, 20 nt, Artificial Sequence
  ELANE RNA Guide
aucaggguggcgccguagaa

SEQ ID NO: 4676 - RNA, 20 nt, Artificial Sequence
  ELANE RNA Guide
caaucaggguggcgccguag

SEQ ID NO: 4677 - RNA, 20 nt, Artificial Sequence
  ELANE RNA Guide
cacuucuacggcgccacccu

SEQ ID NO: 4678 - RNA, 20 nt, Artificial Sequence
  ELANE RNA Guide
caggguggcgccguagaagu

SEQ ID NO: 4679 - RNA, 20 nt, Artificial Sequence
  ELANE RNA Guide
ccacuucuacggcgccaccc

SEQ ID NO: 4680 - RNA, 20 nt, Artificial Sequence
  ELANE RNA Guide
ccguagaaguggccuccgcg

SEQ ID NO: 4681 - RNA, 20 nt, Artificial Sequence
  ELANE RNA Guide
cgcaaucaggguggcgccgu

SEQ ID NO: 4682 - RNA, 20 nt, Artificial Sequence
  ELANE RNA Guide
cgccguagaaguggccuccg

SEQ ID NO: 4683 - RNA, 20 nt, Artificial Sequence
  ELANE RNA Guide
cgcggaggccacuucuacgg

SEQ ID NO: 4684 - RNA, 20 nt, Artificial Sequence
  ELANE RNA Guide
cggaggccacuucuacggcg

SEQ ID NO: 4685 - RNA, 20 nt, Artificial Sequence
  ELANE RNA Guide
cguagaaguggccuccgcgc

SEQ ID NO: 4686 - RNA, 20 nt, Artificial Sequence
  ELANE RNA Guide
cuacggcgccacccugauug

SEQ ID NO: 4687 - RNA, 20 nt, Artificial Sequence
  ELANE RNA Guide
cugcgcggaggccacuucua

SEQ ID NO: 4688 - RNA, 20 nt, Artificial Sequence
  ELANE RNA Guide
cuucuacggcgccacccuga

SEQ ID NO: 4689 - RNA, 20 nt, Artificial Sequence
  ELANE RNA Guide
gaggccacuucuacggcgcc

SEQ ID NO: 4690 - RNA, 20 nt, Artificial Sequence
  ELANE RNA Guide
gcaaucaggguggcgccgua

SEQ ID NO: 4691 - RNA, 20 nt, Artificial Sequence
  ELANE RNA Guide
gccacuucuacggcgccacc

SEQ ID NO: 4692 - RNA, 20 nt, Artificial Sequence
  ELANE RNA Guide
gccguagaaguggccuccgc

SEQ ID NO: 4693 - RNA, 20 nt, Artificial Sequence
  ELANE RNA Guide
gcgccguagaaguggccucc

SEQ ID NO: 4694 - RNA, 20 nt, Artificial Sequence
  ELANE RNA Guide
gcgcggaggccacuucuacg

SEQ ID NO: 4695 - RNA, 20 nt, Artificial Sequence
  ELANE RNA Guide
gcggaggccacuucuacggc

SEQ ID NO: 4696 - RNA, 20 nt, Artificial Sequence
  ELANE RNA Guide
gcugcgcggaggccacuucu

SEQ ID NO: 4697 - RNA, 20 nt, Artificial Sequence
  ELANE RNA Guide
ggaggccacuucuacggcgc

SEQ ID NO: 4698 - RNA, 20 nt, Artificial Sequence
  ELANE RNA Guide
ggccacuucuacggcgccac

SEQ ID NO: 4699 - RNA, 20 nt, Artificial Sequence
  ELANE RNA Guide
ggcgccguagaaguggccuc

SEQ ID NO: 4700 - RNA, 20 nt, Artificial Sequence
  ELANE RNA Guide
ggguggcgccguagaagugg

SEQ ID NO: 4701 - RNA, 20 nt, Artificial Sequence
  ELANE RNA Guide
gguggcgccguagaaguggc

SEQ ID NO: 4702 - RNA, 20 nt, Artificial Sequence
  ELANE RNA Guide
guagaaguggccuccgcgca

SEQ ID NO: 4703 - RNA, 20 nt, Artificial Sequence
  ELANE RNA Guide
guggcgccguagaaguggcc

SEQ ID NO: 4704 - RNA, 20 nt, Artificial Sequence
  ELANE RNA Guide
uacggcgccacccugauugc

SEQ ID NO: 4705 - RNA, 20 nt, Artificial Sequence
  ELANE RNA Guide
ucaggguggcgccguagaag

SEQ ID NO: 4706 - RNA, 20 nt, Artificial Sequence
  ELANE RNA Guide
ucuacggcgccacccugauu

SEQ ID NO: 4707 - RNA, 20 nt, Artificial Sequence
  ELANE RNA Guide
ugcgcggaggccacuucuac

SEQ ID NO: 4708 - RNA, 20 nt, Artificial Sequence
  ELANE RNA Guide
uggcgccguagaaguggccu

SEQ ID NO: 4709 - RNA, 20 nt, Artificial Sequence
  ELANE RNA Guide
ugggcgcaaucaggguggcg

SEQ ID NO: 4710 - RNA, 20 nt, Artificial Sequence
  ELANE RNA Guide
uucuacggcgccacccugau

SEQ ID NO: 4711 - RNA, 21 nt, Artificial Sequence
  ELANE RNA Guide
aaucaggguggcgccguagaa

SEQ ID NO: 4712 - RNA, 21 nt, Artificial Sequence
  ELANE RNA Guide
acuucuacggcgccacccuga

SEQ ID NO: 4713 - RNA, 21 nt, Artificial Sequence
  ELANE RNA Guide
agcugcgcggaggccacuucu

SEQ ID NO: 4714 - RNA, 21 nt, Artificial Sequence
  ELANE RNA Guide
aggccacuucuacggcgccac

SEQ ID NO: 4715 - RNA, 21 nt, Artificial Sequence
  ELANE RNA Guide
aggguggcgccguagaagugg

SEQ ID NO: 4716 - RNA, 21 nt, Artificial Sequence
  ELANE RNA Guide
aucaggguggcgccguagaag

SEQ ID NO: 4717 - RNA, 21 nt, Artificial Sequence
  ELANE RNA Guide
caaucaggguggcgccguaga

SEQ ID NO: 4718 - RNA, 21 nt, Artificial Sequence
  ELANE RNA Guide
cacuucuacggcgccacccug

SEQ ID NO: 4719 - RNA, 21 nt, Artificial Sequence
  ELANE RNA Guide
caggguggcgccguagaagug

SEQ ID NO: 4720 - RNA, 21 nt, Artificial Sequence
  ELANE RNA Guide
ccacuucuacggcgccacccu

SEQ ID NO: 4721 - RNA, 21 nt, Artificial Sequence
  ELANE RNA Guide
ccguagaaguggccuccgcgc

SEQ ID NO: 4722 - RNA, 21 nt, Artificial Sequence
  ELANE RNA Guide
cgcaaucaggguggcgccgua

SEQ ID NO: 4723 - RNA, 21 nt, Artificial Sequence
  ELANE RNA Guide
cgccguagaaguggccuccgc

SEQ ID NO: 4724 - RNA, 21 nt, Artificial Sequence
  ELANE RNA Guide
cgcggaggccacuucuacggc

SEQ ID NO: 4725 - RNA, 21 nt, Artificial Sequence
  ELANE RNA Guide
cggaggccacuucuacggcgc

SEQ ID NO: 4726 - RNA, 21 nt, Artificial Sequence
  ELANE RNA Guide
cguagaaguggccuccgcgca

SEQ ID NO: 4727 - RNA, 21 nt, Artificial Sequence
  ELANE RNA Guide
cuacggcgccacccugauugc

SEQ ID NO: 4728 - RNA, 21 nt, Artificial Sequence
  ELANE RNA Guide
cugcgcggaggccacuucuac

SEQ ID NO: 4729 - RNA, 21 nt, Artificial Sequence
  ELANE RNA Guide
cuucuacggcgccacccugau

SEQ ID NO: 4730 - RNA, 21 nt, Artificial Sequence
  ELANE RNA Guide
gaggccacuucuacggcgcca

SEQ ID NO: 4731 - RNA, 21 nt, Artificial Sequence
  ELANE RNA Guide
gcaaucaggguggcgccguag

SEQ ID NO: 4732 - RNA, 21 nt, Artificial Sequence
  ELANE RNA Guide
gccacuucuacggcgccaccc

SEQ ID NO: 4733 - RNA, 21 nt, Artificial Sequence
  ELANE RNA Guide
gccguagaaguggccuccgcg

SEQ ID NO: 4734 - RNA, 21 nt, Artificial Sequence
  ELANE RNA Guide
gcgcaaucaggguggcgccgu

SEQ ID NO: 4735 - RNA, 21 nt, Artificial Sequence
  ELANE RNA Guide
gcgccguagaaguggccuccg

SEQ ID NO: 4736 - RNA, 21 nt, Artificial Sequence
  ELANE RNA Guide
gcgcggaggccacuucuacgg

SEQ ID NO: 4737 - RNA, 21 nt, Artificial Sequence
  ELANE RNA Guide
gcggaggccacuucuacggcg

SEQ ID NO: 4738 - RNA, 21 nt, Artificial Sequence
  ELANE RNA Guide
gcugcgcggaggccacuucua

SEQ ID NO: 4739 - RNA, 21 nt, Artificial Sequence
  ELANE RNA Guide
ggaggccacuucuacggcgcc

SEQ ID NO: 4740 - RNA, 21 nt, Artificial Sequence
  ELANE RNA Guide
ggccacuucuacggcgccacc

SEQ ID NO: 4741 - RNA, 21 nt, Artificial Sequence
  ELANE RNA Guide
ggcgccguagaaguggccucc

SEQ ID NO: 4742 - RNA, 21 nt, Artificial Sequence
  ELANE RNA Guide
ggguggcgccguagaaguggc

SEQ ID NO: 4743 - RNA, 21 nt, Artificial Sequence
  ELANE RNA Guide
gguggcgccguagaaguggcc

SEQ ID NO: 4744 - RNA, 21 nt, Artificial Sequence
  ELANE RNA Guide
guagaaguggccuccgcgcag

SEQ ID NO: 4745 - RNA, 21 nt, Artificial Sequence
  ELANE RNA Guide
guggcgccguagaaguggccu

SEQ ID NO: 4746 - RNA, 21 nt, Artificial Sequence
  ELANE RNA Guide
uacggcgccacccugauugcg

SEQ ID NO: 4747 - RNA, 21 nt, Artificial Sequence
  ELANE RNA Guide
ucaggguggcgccguagaagu

SEQ ID NO: 4748 - RNA, 21 nt, Artificial Sequence
  ELANE RNA Guide
ucuacggcgccacccugauug

SEQ ID NO: 4749 - RNA, 21 nt, Artificial Sequence
  ELANE RNA Guide
ugcgcggaggccacuucuacg

SEQ ID NO: 4750 - RNA, 21 nt, Artificial Sequence
  ELANE RNA Guide
uggcgccguagaaguggccuc

SEQ ID NO: 4751 - RNA, 21 nt, Artificial Sequence
  ELANE RNA Guide
uucuacggcgccacccugauu

SEQ ID NO: 4752 - RNA, 21 nt, Artificial Sequence
  ELANE RNA Guide
uugggcgcaaucaggguggcg

SEQ ID NO: 4753 - RNA, 22 nt, Artificial Sequence
  ELANE RNA Guide
aaucaggguggcgccguagaag

SEQ ID NO: 4754 - RNA, 22 nt, Artificial Sequence
  ELANE RNA Guide
acuucuacggcgccacccugau

SEQ ID NO: 4755 - RNA, 22 nt, Artificial Sequence
  ELANE RNA Guide
agcugcgcggaggccacuucua

SEQ ID NO: 4756 - RNA, 22 nt, Artificial Sequence
  ELANE RNA Guide
aggccacuucuacggcgccacc

SEQ ID NO: 4757 - RNA, 22 nt, Artificial Sequence
  ELANE RNA Guide
aggguggcgccguagaaguggc

SEQ ID NO: 4758 - RNA, 22 nt, Artificial Sequence
  ELANE RNA Guide
aucaggguggcgccguagaagu

SEQ ID NO: 4759 - RNA, 22 nt, Artificial Sequence
  ELANE RNA Guide
caaucaggguggcgccguagaa

SEQ ID NO: 4760 - RNA, 22 nt, Artificial Sequence
  ELANE RNA Guide
cacuucuacggcgccacccuga

SEQ ID NO: 4761 - RNA, 22 nt, Artificial Sequence
  ELANE RNA Guide
cagcugcgcggaggccacuucu

SEQ ID NO: 4762 - RNA, 22 nt, Artificial Sequence
  ELANE RNA Guide
caggguggcgccguagaagugg

SEQ ID NO: 4763 - RNA, 22 nt, Artificial Sequence
  ELANE RNA Guide
ccacuucuacggcgccacccug

SEQ ID NO: 4764 - RNA, 22 nt, Artificial Sequence
  ELANE RNA Guide
ccguagaaguggccuccgcgca

SEQ ID NO: 4765 - RNA, 22 nt, Artificial Sequence
  ELANE RNA Guide
cgcaaucaggguggcgccguag

SEQ ID NO: 4766 - RNA, 22 nt, Artificial Sequence
  ELANE RNA Guide
cgccguagaaguggccuccgcg

SEQ ID NO: 4767 - RNA, 22 nt, Artificial Sequence
  ELANE RNA Guide
cgcggaggccacuucuacggcg

SEQ ID NO: 4768 - RNA, 22 nt, Artificial Sequence
  ELANE RNA Guide
cggaggccacuucuacggcgcc

SEQ ID NO: 4769 - RNA, 22 nt, Artificial Sequence
  ELANE RNA Guide
cguagaaguggccuccgcgcag

SEQ ID NO: 4770 - RNA, 22 nt, Artificial Sequence
  ELANE RNA Guide
cuacggcgccacccugauugcg

SEQ ID NO: 4771 - RNA, 22 nt, Artificial Sequence
  ELANE RNA Guide
cugcgcggaggccacuucuacg

SEQ ID NO: 4772 - RNA, 22 nt, Artificial Sequence
  ELANE RNA Guide
cuucuacggcgccacccugauu

SEQ ID NO: 4773 - RNA, 22 nt, Artificial Sequence
  ELANE RNA Guide
gaggccacuucuacggcgccac

SEQ ID NO: 4774 - RNA, 22 nt, Artificial Sequence
  ELANE RNA Guide
gcaaucaggguggcgccguaga

SEQ ID NO: 4775 - RNA, 22 nt, Artificial Sequence
  ELANE RNA Guide
gccacuucuacggcgccacccu

SEQ ID NO: 4776 - RNA, 22 nt, Artificial Sequence
  ELANE RNA Guide
gccguagaaguggccuccgcgc

SEQ ID NO: 4777 - RNA, 22 nt, Artificial Sequence
  ELANE RNA Guide
gcgcaaucaggguggcgccgua

SEQ ID NO: 4778 - RNA, 22 nt, Artificial Sequence
  ELANE RNA Guide
gcgccguagaaguggccuccgc

SEQ ID NO: 4779 - RNA, 22 nt, Artificial Sequence
  ELANE RNA Guide
gcgcggaggccacuucuacggc

SEQ ID NO: 4780 - RNA, 22 nt, Artificial Sequence
  ELANE RNA Guide
gcggaggccacuucuacggcgc

SEQ ID NO: 4781 - RNA, 22 nt, Artificial Sequence
  ELANE RNA Guide
gcugcgcggaggccacuucuac

SEQ ID NO: 4782 - RNA, 22 nt, Artificial Sequence
  ELANE RNA Guide
ggaggccacuucuacggcgcca

SEQ ID NO: 4783 - RNA, 22 nt, Artificial Sequence
  ELANE RNA Guide
ggccacuucuacggcgccaccc

SEQ ID NO: 4784 - RNA, 22 nt, Artificial Sequence
  ELANE RNA Guide
ggcgcaaucaggguggcgccgu

SEQ ID NO: 4785 - RNA, 22 nt, Artificial Sequence
  ELANE RNA Guide
ggcgccguagaaguggccuccg

SEQ ID NO: 4786 - RNA, 22 nt, Artificial Sequence
  ELANE RNA Guide
ggguggcgccguagaaguggcc

SEQ ID NO: 4787 - RNA, 22 nt, Artificial Sequence
  ELANE RNA Guide
gguggcgccguagaaguggccu

SEQ ID NO: 4788 - RNA, 22 nt, Artificial Sequence
  ELANE RNA Guide
guagaaguggccuccgcgcagc

SEQ ID NO: 4789 - RNA, 22 nt, Artificial Sequence
  ELANE RNA Guide
guggcgccguagaaguggccuc

SEQ ID NO: 4790 - RNA, 22 nt, Artificial Sequence
  ELANE RNA Guide
guugggcgcaaucaggguggcg

SEQ ID NO: 4791 - RNA, 22 nt, Artificial Sequence
  ELANE RNA Guide
uacggcgccacccugauugcgc

SEQ ID NO: 4792 - RNA, 22 nt, Artificial Sequence
  ELANE RNA Guide
ucaggguggcgccguagaagug

SEQ ID NO: 4793 - RNA, 22 nt, Artificial Sequence
  ELANE RNA Guide
ucuacggcgccacccugauugc

SEQ ID NO: 4794 - RNA, 22 nt, Artificial Sequence
  ELANE RNA Guide
ugcgcggaggccacuucuacgg

SEQ ID NO: 4795 - RNA, 22 nt, Artificial Sequence
  ELANE RNA Guide
uggcgccguagaaguggccucc

SEQ ID NO: 4796 - RNA, 22 nt, Artificial Sequence
  ELANE RNA Guide
uucuacggcgccacccugauug

SEQ ID NO: 4797 - RNA, 20 nt, Artificial Sequence
  ELANE RNA Guide
aaucaggguggcgccggaga

SEQ ID NO: 4798 - RNA, 20 nt, Artificial Sequence
  ELANE RNA Guide
acuucuccggcgccacccug

SEQ ID NO: 4799 - RNA, 20 nt, Artificial Sequence
  ELANE RNA Guide
aggccacuucuccggcgcca

SEQ ID NO: 4800 - RNA, 20 nt, Artificial Sequence
  ELANE RNA Guide
aggguggcgccggagaagug

SEQ ID NO: 4801 - RNA, 20 nt, Artificial Sequence
  ELANE RNA Guide
aucaggguggcgccggagaa

SEQ ID NO: 4802 - RNA, 20 nt, Artificial Sequence
  ELANE RNA Guide
caaucaggguggcgccggag

SEQ ID NO: 4803 - RNA, 20 nt, Artificial Sequence
  ELANE RNA Guide
cacuucuccggcgccacccu

SEQ ID NO: 4804 - RNA, 20 nt, Artificial Sequence
  ELANE RNA Guide
caggguggcgccggagaagu

SEQ ID NO: 4805 - RNA, 20 nt, Artificial Sequence
  ELANE RNA Guide
ccacuucuccggcgccaccc

SEQ ID NO: 4806 - RNA, 20 nt, Artificial Sequence
  ELANE RNA Guide
ccggagaaguggccuccgcg

SEQ ID NO: 4807 - RNA, 20 nt, Artificial Sequence
  ELANE RNA Guide
cgcaaucaggguggcgccgg

SEQ ID NO: 4808 - RNA, 20 nt, Artificial Sequence
  ELANE RNA Guide
cgccggagaaguggccuccg

SEQ ID NO: 4809 - RNA, 20 nt, Artificial Sequence
  ELANE RNA Guide
cgcggaggccacuucuccgg

SEQ ID NO: 4810 - RNA, 20 nt, Artificial Sequence
  ELANE RNA Guide
cggagaaguggccuccgcgc

SEQ ID NO: 4811 - RNA, 20 nt, Artificial Sequence
  ELANE RNA Guide
cggaggccacuucuccggcg

SEQ ID NO: 4812 - RNA, 20 nt, Artificial Sequence
  ELANE RNA Guide
cuccggcgccacccugauug

SEQ ID NO: 4813 - RNA, 20 nt, Artificial Sequence
  ELANE RNA Guide
cugcgcggaggccacuucuc

SEQ ID NO: 4814 - RNA, 20 nt, Artificial Sequence
  ELANE RNA Guide
cuucuccggcgccacccuga

SEQ ID NO: 4815 - RNA, 20 nt, Artificial Sequence
  ELANE RNA Guide
gaggccacuucuccggcgcc

SEQ ID NO: 4816 - RNA, 20 nt, Artificial Sequence
  ELANE RNA Guide
gcaaucaggguggcgccgga

SEQ ID NO: 4817 - RNA, 20 nt, Artificial Sequence
  ELANE RNA Guide
gccacuucuccggcgccacc

SEQ ID NO: 4818 - RNA, 20 nt, Artificial Sequence
  ELANE RNA Guide
gccggagaaguggccuccgc

SEQ ID NO: 4819 - RNA, 20 nt, Artificial Sequence
  ELANE RNA Guide
gcgccggagaaguggccucc

SEQ ID NO: 4820 - RNA, 20 nt, Artificial Sequence
  ELANE RNA Guide
gcgcggaggccacuucuccg

SEQ ID NO: 4821 - RNA, 20 nt, Artificial Sequence
  ELANE RNA Guide
gcggaggccacuucuccggc

SEQ ID NO: 4822 - RNA, 20 nt, Artificial Sequence
  ELANE RNA Guide
ggagaaguggccuccgcgca

SEQ ID NO: 4823 - RNA, 20 nt, Artificial Sequence
  ELANE RNA Guide
ggaggccacuucuccggcgc

SEQ ID NO: 4824 - RNA, 20 nt, Artificial Sequence
  ELANE RNA Guide
ggccacuucuccggcgccac

SEQ ID NO: 4825 - RNA, 20 nt, Artificial Sequence
  ELANE RNA Guide
ggcgccggagaaguggccuc

SEQ ID NO: 4826 - RNA, 20 nt, Artificial Sequence
  ELANE RNA Guide
ggguggcgccggagaagugg

SEQ ID NO: 4827 - RNA, 20 nt, Artificial Sequence
  ELANE RNA Guide
gguggcgccggagaaguggc

SEQ ID NO: 4828 - RNA, 20 nt, Artificial Sequence
  ELANE RNA Guide
guggcgccggagaaguggcc

SEQ ID NO: 4829 - RNA, 20 nt, Artificial Sequence
  ELANE RNA Guide
ucaggguggcgccggagaag

SEQ ID NO: 4830 - RNA, 20 nt, Artificial Sequence
  ELANE RNA Guide
uccggcgccacccugauugc

SEQ ID NO: 4831 - RNA, 20 nt, Artificial Sequence
  ELANE RNA Guide
ucuccggcgccacccugauu

SEQ ID NO: 4832 - RNA, 20 nt, Artificial Sequence
  ELANE RNA Guide
ugcgcggaggccacuucucc

SEQ ID NO: 4833 - RNA, 20 nt, Artificial Sequence
  ELANE RNA Guide
uggcgccggagaaguggccu

SEQ ID NO: 4834 - RNA, 20 nt, Artificial Sequence
  ELANE RNA Guide
uucuccggcgccacccugau

SEQ ID NO: 4835 - RNA, 21 nt, Artificial Sequence
  ELANE RNA Guide
aaucaggguggcgccggagaa

SEQ ID NO: 4836 - RNA, 21 nt, Artificial Sequence
  ELANE RNA Guide
acuucuccggcgccacccuga

SEQ ID NO: 4837 - RNA, 21 nt, Artificial Sequence
  ELANE RNA Guide
aggccacuucuccggcgccac

SEQ ID NO: 4838 - RNA, 21 nt, Artificial Sequence
  ELANE RNA Guide
aggguggcgccggagaagugg

SEQ ID NO: 4839 - RNA, 21 nt, Artificial Sequence
  ELANE RNA Guide
aucaggguggcgccggagaag

SEQ ID NO: 4840 - RNA, 21 nt, Artificial Sequence
  ELANE RNA Guide
caaucaggguggcgccggaga

SEQ ID NO: 4841 - RNA, 21 nt, Artificial Sequence
  ELANE RNA Guide
cacuucuccggcgccacccug

SEQ ID NO: 4842 - RNA, 21 nt, Artificial Sequence
  ELANE RNA Guide
caggguggcgccggagaagug

SEQ ID NO: 4843 - RNA, 21 nt, Artificial Sequence
  ELANE RNA Guide
ccacuucuccggcgccacccu

SEQ ID NO: 4844 - RNA, 21 nt, Artificial Sequence
  ELANE RNA Guide
ccggagaaguggccuccgcgc

SEQ ID NO: 4845 - RNA, 21 nt, Artificial Sequence
  ELANE RNA Guide
cgcaaucaggguggcgccgga

SEQ ID NO: 4846 - RNA, 21 nt, Artificial Sequence
  ELANE RNA Guide
cgccggagaaguggccuccgc

SEQ ID NO: 4847 - RNA, 21 nt, Artificial Sequence
  ELANE RNA Guide
cgcggaggccacuucuccggc

SEQ ID NO: 4848 - RNA, 21 nt, Artificial Sequence
  ELANE RNA Guide
cggagaaguggccuccgcgca

SEQ ID NO: 4849 - RNA, 21 nt, Artificial Sequence
  ELANE RNA Guide
cggaggccacuucuccggcgc

SEQ ID NO: 4850 - RNA, 21 nt, Artificial Sequence
  ELANE RNA Guide
cuccggcgccacccugauugc

SEQ ID NO: 4851 - RNA, 21 nt, Artificial Sequence
  ELANE RNA Guide
cugcgcggaggccacuucucc

SEQ ID NO: 4852 - RNA, 21 nt, Artificial Sequence
  ELANE RNA Guide
cuucuccggcgccacccugau

SEQ ID NO: 4853 - RNA, 21 nt, Artificial Sequence
  ELANE RNA Guide
gaggccacuucuccggcgcca

SEQ ID NO: 4854 - RNA, 21 nt, Artificial Sequence
  ELANE RNA Guide
gcaaucaggguggcgccggag

SEQ ID NO: 4855 - RNA, 21 nt, Artificial Sequence
  ELANE RNA Guide
gccacuucuccggcgccaccc

SEQ ID NO: 4856 - RNA, 21 nt, Artificial Sequence
  ELANE RNA Guide
gccggagaaguggccuccgcg

SEQ ID NO: 4857 - RNA, 21 nt, Artificial Sequence
  ELANE RNA Guide
gcgcaaucaggguggcgccgg

SEQ ID NO: 4858 - RNA, 21 nt, Artificial Sequence
  ELANE RNA Guide
gcgccggagaaguggccuccg

SEQ ID NO: 4859 - RNA, 21 nt, Artificial Sequence
  ELANE RNA Guide
gcgcggaggccacuucuccgg

SEQ ID NO: 4860 - RNA, 21 nt, Artificial Sequence
  ELANE RNA Guide
gcggaggccacuucuccggcg

SEQ ID NO: 4861 - RNA, 21 nt, Artificial Sequence
  ELANE RNA Guide
gcugcgcggaggccacuucuc

SEQ ID NO: 4862 - RNA, 21 nt, Artificial Sequence
  ELANE RNA Guide
ggagaaguggccuccgcgcag

SEQ ID NO: 4863 - RNA, 21 nt, Artificial Sequence
  ELANE RNA Guide
ggaggccacuucuccggcgcc

SEQ ID NO: 4864 - RNA, 21 nt, Artificial Sequence
  ELANE RNA Guide
ggccacuucuccggcgccacc

SEQ ID NO: 4865 - RNA, 21 nt, Artificial Sequence
  ELANE RNA Guide
ggcgccggagaaguggccucc

SEQ ID NO: 4866 - RNA, 21 nt, Artificial Sequence
  ELANE RNA Guide
ggguggcgccggagaaguggc

SEQ ID NO: 4867 - RNA, 21 nt, Artificial Sequence
  ELANE RNA Guide
gguggcgccggagaaguggcc

SEQ ID NO: 4868 - RNA, 21 nt, Artificial Sequence
  ELANE RNA Guide
guggcgccggagaaguggccu

SEQ ID NO: 4869 - RNA, 21 nt, Artificial Sequence
  ELANE RNA Guide
ucaggguggcgccggagaagu

SEQ ID NO: 4870 - RNA, 21 nt, Artificial Sequence
  ELANE RNA Guide
uccggcgccacccugauugcg

SEQ ID NO: 4871 - RNA, 21 nt, Artificial Sequence
  ELANE RNA Guide
ucuccggcgccacccugauug

SEQ ID NO: 4872 - RNA, 21 nt, Artificial Sequence
  ELANE RNA Guide
ugcgcggaggccacuucuccg

SEQ ID NO: 4873 - RNA, 21 nt, Artificial Sequence
  ELANE RNA Guide
uggcgccggagaaguggccuc

SEQ ID NO: 4874 - RNA, 21 nt, Artificial Sequence
  ELANE RNA Guide
uucuccggcgccacccugauu

SEQ ID NO: 4875 - RNA, 22 nt, Artificial Sequence
  ELANE RNA Guide
aaucaggguggcgccggagaag

SEQ ID NO: 4876 - RNA, 22 nt, Artificial Sequence
  ELANE RNA Guide
acuucuccggcgccacccugau

SEQ ID NO: 4877 - RNA, 22 nt, Artificial Sequence
  ELANE RNA Guide
agcugcgcggaggccacuucuc

SEQ ID NO: 4878 - RNA, 22 nt, Artificial Sequence
  ELANE RNA Guide
aggccacuucuccggcgccacc

SEQ ID NO: 4879 - RNA, 22 nt, Artificial Sequence
  ELANE RNA Guide
aggguggcgccggagaaguggc

SEQ ID NO: 4880 - RNA, 22 nt, Artificial Sequence
  ELANE RNA Guide
aucaggguggcgccggagaagu

SEQ ID NO: 4881 - RNA, 22 nt, Artificial Sequence
  ELANE RNA Guide
caaucaggguggcgccggagaa

SEQ ID NO: 4882 - RNA, 22 nt, Artificial Sequence
  ELANE RNA Guide
cacuucuccggcgccacccuga

SEQ ID NO: 4883 - RNA, 22 nt, Artificial Sequence
  ELANE RNA Guide
caggguggcgccggagaagugg

SEQ ID NO: 4884 - RNA, 22 nt, Artificial Sequence
  ELANE RNA Guide
ccacuucuccggcgccacccug

SEQ ID NO: 4885 - RNA, 22 nt, Artificial Sequence
  ELANE RNA Guide
ccggagaaguggccuccgcgca

SEQ ID NO: 4886 - RNA, 22 nt, Artificial Sequence
  ELANE RNA Guide
cgcaaucaggguggcgccggag

SEQ ID NO: 4887 - RNA, 22 nt, Artificial Sequence
  ELANE RNA Guide
cgccggagaaguggccuccgcg

SEQ ID NO: 4888 - RNA, 22 nt, Artificial Sequence
  ELANE RNA Guide
cgcggaggccacuucuccggcg

SEQ ID NO: 4889 - RNA, 22 nt, Artificial Sequence
  ELANE RNA Guide
cggagaaguggccuccgcgcag

SEQ ID NO: 4890 - RNA, 22 nt, Artificial Sequence
  ELANE RNA Guide
cggaggccacuucuccggcgcc

SEQ ID NO: 4891 - RNA, 22 nt, Artificial Sequence
  ELANE RNA Guide
cuccggcgccacccugauugcg

SEQ ID NO: 4892 - RNA, 22 nt, Artificial Sequence
  ELANE RNA Guide
cugcgcggaggccacuucuccg

SEQ ID NO: 4893 - RNA, 22 nt, Artificial Sequence
  ELANE RNA Guide
cuucuccggcgccacccugauu

SEQ ID NO: 4894 - RNA, 22 nt, Artificial Sequence
  ELANE RNA Guide
gaggccacuucuccggcgccac

SEQ ID NO: 4895 - RNA, 22 nt, Artificial Sequence
  ELANE RNA Guide
gcaaucaggguggcgccggaga

SEQ ID NO: 4896 - RNA, 22 nt, Artificial Sequence
  ELANE RNA Guide
gccacuucuccggcgccacccu

SEQ ID NO: 4897 - RNA, 22 nt, Artificial Sequence
  ELANE RNA Guide
gccggagaaguggccuccgcgc

SEQ ID NO: 4898 - RNA, 22 nt, Artificial Sequence
  ELANE RNA Guide
gcgcaaucaggguggcgccgga

SEQ ID NO: 4899 - RNA, 22 nt, Artificial Sequence
  ELANE RNA Guide
gcgccggagaaguggccuccgc

SEQ ID NO: 4900 - RNA, 22 nt, Artificial Sequence
  ELANE RNA Guide
gcgcggaggccacuucuccggc

SEQ ID NO: 4901 - RNA, 22 nt, Artificial Sequence
  ELANE RNA Guide
gcggaggccacuucuccggcgc

SEQ ID NO: 4902 - RNA, 22 nt, Artificial Sequence
  ELANE RNA Guide
gcugcgcggaggccacuucucc

SEQ ID NO: 4903 - RNA, 22 nt, Artificial Sequence
  ELANE RNA Guide
ggagaaguggccuccgcgcagc

SEQ ID NO: 4904 - RNA, 22 nt, Artificial Sequence
  ELANE RNA Guide
ggaggccacuucuccggcgcca

SEQ ID NO: 4905 - RNA, 22 nt, Artificial Sequence
  ELANE RNA Guide
ggccacuucuccggcgccaccc

SEQ ID NO: 4906 - RNA, 22 nt, Artificial Sequence
  ELANE RNA Guide
ggcgcaaucaggguggcgccgg

SEQ ID NO: 4907 - RNA, 22 nt, Artificial Sequence
  ELANE RNA Guide
ggcgccggagaaguggccuccg

SEQ ID NO: 4908 - RNA, 22 nt, Artificial Sequence
  ELANE RNA Guide
ggguggcgccggagaaguggcc

SEQ ID NO: 4909 - RNA, 22 nt, Artificial Sequence
  ELANE RNA Guide
gguggcgccggagaaguggccu

SEQ ID NO: 4910 - RNA, 22 nt, Artificial Sequence
  ELANE RNA Guide
guggcgccggagaaguggccuc

SEQ ID NO: 4911 - RNA, 22 nt, Artificial Sequence
  ELANE RNA Guide
ucaggguggcgccggagaagug

SEQ ID NO: 4912 - RNA, 22 nt, Artificial Sequence
  ELANE RNA Guide
uccggcgccacccugauugcgc

SEQ ID NO: 4913 - RNA, 22 nt, Artificial Sequence
  ELANE RNA Guide
ucuccggcgccacccugauugc

SEQ ID NO: 4914 - RNA, 22 nt, Artificial Sequence
  ELANE RNA Guide
ugcgcggaggccacuucuccgg

SEQ ID NO: 4915 - RNA, 22 nt, Artificial Sequence
  ELANE RNA Guide
uggcgccggagaaguggccucc

SEQ ID NO: 4916 - RNA, 22 nt, Artificial Sequence
  ELANE RNA Guide
uucuccggcgccacccugauug

SEQ ID NO: 4917 - RNA, 20 nt, Artificial Sequence
  ELANE RNA Guide
aaucaggguggcgcggcaga

SEQ ID NO: 4918 - RNA, 20 nt, Artificial Sequence
  ELANE RNA Guide
acuucugccgcgccacccug

SEQ ID NO: 4919 - RNA, 20 nt, Artificial Sequence
  ELANE RNA Guide
aggccacuucugccgcgcca

SEQ ID NO: 4920 - RNA, 20 nt, Artificial Sequence
  ELANE RNA Guide
aggguggcgcggcagaagug

SEQ ID NO: 4921 - RNA, 20 nt, Artificial Sequence
  ELANE RNA Guide
aucaggguggcgcggcagaa

SEQ ID NO: 4922 - RNA, 20 nt, Artificial Sequence
  ELANE RNA Guide
caaucaggguggcgcggcag

SEQ ID NO: 4923 - RNA, 20 nt, Artificial Sequence
  ELANE RNA Guide
cacuucugccgcgccacccu

SEQ ID NO: 4924 - RNA, 20 nt, Artificial Sequence
  ELANE RNA Guide
caggguggcgcggcagaagu

SEQ ID NO: 4925 - RNA, 20 nt, Artificial Sequence
  ELANE RNA Guide
ccacuucugccgcgccaccc

SEQ ID NO: 4926 - RNA, 20 nt, Artificial Sequence
  ELANE RNA Guide
ccgcgccacccugauugcgc

SEQ ID NO: 4927 - RNA, 20 nt, Artificial Sequence
  ELANE RNA Guide
cgcaaucaggguggcgcggc

SEQ ID NO: 4928 - RNA, 20 nt, Artificial Sequence
  ELANE RNA Guide
cgcggaggccacuucugccg

SEQ ID NO: 4929 - RNA, 20 nt, Artificial Sequence
  ELANE RNA Guide
cgcggcagaaguggccuccg

SEQ ID NO: 4930 - RNA, 20 nt, Artificial Sequence
  ELANE RNA Guide
cggaggccacuucugccgcg

SEQ ID NO: 4931 - RNA, 20 nt, Artificial Sequence
  ELANE RNA Guide
cggcagaaguggccuccgcg

SEQ ID NO: 4932 - RNA, 20 nt, Artificial Sequence
  ELANE RNA Guide
cugccgcgccacccugauug

SEQ ID NO: 4933 - RNA, 20 nt, Artificial Sequence
  ELANE RNA Guide
cugcgcggaggccacuucug

SEQ ID NO: 4934 - RNA, 20 nt, Artificial Sequence
  ELANE RNA Guide
cuucugccgcgccacccuga

SEQ ID NO: 4935 - RNA, 20 nt, Artificial Sequence
  ELANE RNA Guide
gaggccacuucugccgcgcc

SEQ ID NO: 4936 - RNA, 20 nt, Artificial Sequence
  ELANE RNA Guide
gcaaucaggguggcgcggca

SEQ ID NO: 4937 - RNA, 20 nt, Artificial Sequence
  ELANE RNA Guide
gccacuucugccgcgccacc

SEQ ID NO: 4938 - RNA, 20 nt, Artificial Sequence
  ELANE RNA Guide
gccgcgccacccugauugcg

SEQ ID NO: 4939 - RNA, 20 nt, Artificial Sequence
  ELANE RNA Guide
gcgcaaucaggguggcgcgg

SEQ ID NO: 4940 - RNA, 20 nt, Artificial Sequence
  ELANE RNA Guide
gcgcggaggccacuucugcc

SEQ ID NO: 4941 - RNA, 20 nt, Artificial Sequence
  ELANE RNA Guide
gcgcggcagaaguggccucc

SEQ ID NO: 4942 - RNA, 20 nt, Artificial Sequence
  ELANE RNA Guide
gcggaggccacuucugccgc

SEQ ID NO: 4943 - RNA, 20 nt, Artificial Sequence
  ELANE RNA Guide
gcggcagaaguggccuccgc

SEQ ID NO: 4944 - RNA, 20 nt, Artificial Sequence
  ELANE RNA Guide
ggaggccacuucugccgcgc

SEQ ID NO: 4945 - RNA, 20 nt, Artificial Sequence
  ELANE RNA Guide
ggccacuucugccgcgccac

SEQ ID NO: 4946 - RNA, 20 nt, Artificial Sequence
  ELANE RNA Guide
ggcgcaaucaggguggcgcg

SEQ ID NO: 4947 - RNA, 20 nt, Artificial Sequence
  ELANE RNA Guide
ggcgcggcagaaguggccuc

SEQ ID NO: 4948 - RNA, 20 nt, Artificial Sequence
  ELANE RNA Guide
ggguggcgcggcagaagugg

SEQ ID NO: 4949 - RNA, 20 nt, Artificial Sequence
  ELANE RNA Guide
gguggcgcggcagaaguggc

SEQ ID NO: 4950 - RNA, 20 nt, Artificial Sequence
  ELANE RNA Guide
guggcgcggcagaaguggcc

SEQ ID NO: 4951 - RNA, 20 nt, Artificial Sequence
  ELANE RNA Guide
guugggcgcaaucagggugg

SEQ ID NO: 4952 - RNA, 20 nt, Artificial Sequence
  ELANE RNA Guide
ucaggguggcgcggcagaag

SEQ ID NO: 4953 - RNA, 20 nt, Artificial Sequence
  ELANE RNA Guide
ucugccgcgccacccugauu

SEQ ID NO: 4954 - RNA, 20 nt, Artificial Sequence
  ELANE RNA Guide
ugccgcgccacccugauugc

SEQ ID NO: 4955 - RNA, 20 nt, Artificial Sequence
  ELANE RNA Guide
ugcgcggaggccacuucugc

SEQ ID NO: 4956 - RNA, 20 nt, Artificial Sequence
  ELANE RNA Guide
uggcgcggcagaaguggccu

SEQ ID NO: 4957 - RNA, 20 nt, Artificial Sequence
  ELANE RNA Guide
uucugccgcgccacccugau

SEQ ID NO: 4958 - RNA, 20 nt, Artificial Sequence
  ELANE RNA Guide
uugggcgcaaucaggguggc

SEQ ID NO: 4959 - RNA, 21 nt, Artificial Sequence
  ELANE RNA Guide
aaucaggguggcgcggcagaa

SEQ ID NO: 4960 - RNA, 21 nt, Artificial Sequence
  ELANE RNA Guide
acuucugccgcgccacccuga

SEQ ID NO: 4961 - RNA, 21 nt, Artificial Sequence
  ELANE RNA Guide
aggccacuucugccgcgccac

SEQ ID NO: 4962 - RNA, 21 nt, Artificial Sequence
  ELANE RNA Guide
aggguggcgcggcagaagugg

SEQ ID NO: 4963 - RNA, 21 nt, Artificial Sequence
  ELANE RNA Guide
aguugggcgcaaucagggugg

SEQ ID NO: 4964 - RNA, 21 nt, Artificial Sequence
  ELANE RNA Guide
aucaggguggcgcggcagaag

SEQ ID NO: 4965 - RNA, 21 nt, Artificial Sequence
  ELANE RNA Guide
caaucaggguggcgcggcaga

SEQ ID NO: 4966 - RNA, 21 nt, Artificial Sequence
  ELANE RNA Guide
cacuucugccgcgccacccug

SEQ ID NO: 4967 - RNA, 21 nt, Artificial Sequence
  ELANE RNA Guide
caggguggcgcggcagaagug

SEQ ID NO: 4968 - RNA, 21 nt, Artificial Sequence
  ELANE RNA Guide
ccacuucugccgcgccacccu

SEQ ID NO: 4969 - RNA, 21 nt, Artificial Sequence
  ELANE RNA Guide
ccgcgccacccugauugcgcc

SEQ ID NO: 4970 - RNA, 21 nt, Artificial Sequence
  ELANE RNA Guide
cgcaaucaggguggcgcggca

SEQ ID NO: 4971 - RNA, 21 nt, Artificial Sequence
  ELANE RNA Guide
cgcggaggccacuucugccgc

SEQ ID NO: 4972 - RNA, 21 nt, Artificial Sequence
  ELANE RNA Guide
cgcggcagaaguggccuccgc

SEQ ID NO: 4973 - RNA, 21 nt, Artificial Sequence
  ELANE RNA Guide
cggaggccacuucugccgcgc

SEQ ID NO: 4974 - RNA, 21 nt, Artificial Sequence
  ELANE RNA Guide
cggcagaaguggccuccgcgc

SEQ ID NO: 4975 - RNA, 21 nt, Artificial Sequence
  ELANE RNA Guide
cugccgcgccacccugauugc

SEQ ID NO: 4976 - RNA, 21 nt, Artificial Sequence
  ELANE RNA Guide
cugcgcggaggccacuucugc

SEQ ID NO: 4977 - RNA, 21 nt, Artificial Sequence
  ELANE RNA Guide
cuucugccgcgccacccugau

SEQ ID NO: 4978 - RNA, 21 nt, Artificial Sequence
  ELANE RNA Guide
gaggccacuucugccgcgcca

SEQ ID NO: 4979 - RNA, 21 nt, Artificial Sequence
  ELANE RNA Guide
gcaaucaggguggcgcggcag

SEQ ID NO: 4980 - RNA, 21 nt, Artificial Sequence
  ELANE RNA Guide
gccacuucugccgcgccaccc

SEQ ID NO: 4981 - RNA, 21 nt, Artificial Sequence
  ELANE RNA Guide
gccgcgccacccugauugcgc

SEQ ID NO: 4982 - RNA, 21 nt, Artificial Sequence
  ELANE RNA Guide
gcgcaaucaggguggcgcggc

SEQ ID NO: 4983 - RNA, 21 nt, Artificial Sequence
  ELANE RNA Guide
gcgcggaggccacuucugccg

SEQ ID NO: 4984 - RNA, 21 nt, Artificial Sequence
  ELANE RNA Guide
gcgcggcagaaguggccuccg

SEQ ID NO: 4985 - RNA, 21 nt, Artificial Sequence
  ELANE RNA Guide
gcggaggccacuucugccgcg

SEQ ID NO: 4986 - RNA, 21 nt, Artificial Sequence
  ELANE RNA Guide
gcggcagaaguggccuccgcg

SEQ ID NO: 4987 - RNA, 21 nt, Artificial Sequence
  ELANE RNA Guide
gcugcgcggaggccacuucug

SEQ ID NO: 4988 - RNA, 21 nt, Artificial Sequence
  ELANE RNA Guide
ggaggccacuucugccgcgcc

SEQ ID NO: 4989 - RNA, 21 nt, Artificial Sequence
  ELANE RNA Guide
ggccacuucugccgcgccacc

SEQ ID NO: 4990 - RNA, 21 nt, Artificial Sequence
  ELANE RNA Guide
ggcgcaaucaggguggcgcgg

SEQ ID NO: 4991 - RNA, 21 nt, Artificial Sequence
  ELANE RNA Guide
ggcgcggcagaaguggccucc

SEQ ID NO: 4992 - RNA, 21 nt, Artificial Sequence
  ELANE RNA Guide
gggcgcaaucaggguggcgcg

SEQ ID NO: 4993 - RNA, 21 nt, Artificial Sequence
  ELANE RNA Guide
ggguggcgcggcagaaguggc

SEQ ID NO: 4994 - RNA, 21 nt, Artificial Sequence
  ELANE RNA Guide
gguggcgcggcagaaguggcc

SEQ ID NO: 4995 - RNA, 21 nt, Artificial Sequence
  ELANE RNA Guide
guggcgcggcagaaguggccu

SEQ ID NO: 4996 - RNA, 21 nt, Artificial Sequence
  ELANE RNA Guide
guugggcgcaaucaggguggc

SEQ ID NO: 4997 - RNA, 21 nt, Artificial Sequence
  ELANE RNA Guide
ucaggguggcgcggcagaagu

SEQ ID NO: 4998 - RNA, 21 nt, Artificial Sequence
  ELANE RNA Guide
ucugccgcgccacccugauug

SEQ ID NO: 4999 - RNA, 21 nt, Artificial Sequence
  ELANE RNA Guide
ugccgcgccacccugauugcg

SEQ ID NO: 5000 - RNA, 21 nt, Artificial Sequence
  ELANE RNA Guide
ugcgcggaggccacuucugcc

SEQ ID NO: 5001 - RNA, 21 nt, Artificial Sequence
  ELANE RNA Guide
uggcgcggcagaaguggccuc

SEQ ID NO: 5002 - RNA, 21 nt, Artificial Sequence
  ELANE RNA Guide
uucugccgcgccacccugauu

SEQ ID NO: 5003 - RNA, 22 nt, Artificial Sequence
  ELANE RNA Guide
aaguugggcgcaaucagggugg

SEQ ID NO: 5004 - RNA, 22 nt, Artificial Sequence
  ELANE RNA Guide
aaucaggguggcgcggcagaag

SEQ ID NO: 5005 - RNA, 22 nt, Artificial Sequence
  ELANE RNA Guide
acuucugccgcgccacccugau

SEQ ID NO: 5006 - RNA, 22 nt, Artificial Sequence
  ELANE RNA Guide
agcugcgcggaggccacuucug

SEQ ID NO: 5007 - RNA, 22 nt, Artificial Sequence
  ELANE RNA Guide
aggccacuucugccgcgccacc

SEQ ID NO: 5008 - RNA, 22 nt, Artificial Sequence
  ELANE RNA Guide
aggguggcgcggcagaaguggc

SEQ ID NO: 5009 - RNA, 22 nt, Artificial Sequence
  ELANE RNA Guide
aguugggcgcaaucaggguggc

SEQ ID NO: 5010 - RNA, 22 nt, Artificial Sequence
  ELANE RNA Guide
aucaggguggcgcggcagaagu

SEQ ID NO: 5011 - RNA, 22 nt, Artificial Sequence
  ELANE RNA Guide
caaucaggguggcgcggcagaa

SEQ ID NO: 5012 - RNA, 22 nt, Artificial Sequence
  ELANE RNA Guide
cacuucugccgcgccacccuga

SEQ ID NO: 5013 - RNA, 22 nt, Artificial Sequence
  ELANE RNA Guide
caggguggcgcggcagaagugg

SEQ ID NO: 5014 - RNA, 22 nt, Artificial Sequence
  ELANE RNA Guide
ccacuucugccgcgccacccug

SEQ ID NO: 5015 - RNA, 22 nt, Artificial Sequence
  ELANE RNA Guide
ccgcgccacccugauugcgccc

SEQ ID NO: 5016 - RNA, 22 nt, Artificial Sequence
  ELANE RNA Guide
cgcaaucaggguggcgcggcag

SEQ ID NO: 5017 - RNA, 22 nt, Artificial Sequence
  ELANE RNA Guide
cgcggaggccacuucugccgcg

SEQ ID NO: 5018 - RNA, 22 nt, Artificial Sequence
  ELANE RNA Guide
cgcggcagaaguggccuccgcg

SEQ ID NO: 5019 - RNA, 22 nt, Artificial Sequence
  ELANE RNA Guide
cggaggccacuucugccgcgcc

SEQ ID NO: 5020 - RNA, 22 nt, Artificial Sequence
  ELANE RNA Guide
cggcagaaguggccuccgcgca

SEQ ID NO: 5021 - RNA, 22 nt, Artificial Sequence
  ELANE RNA Guide
cugccgcgccacccugauugcg

SEQ ID NO: 5022 - RNA, 22 nt, Artificial Sequence
  ELANE RNA Guide
cugcgcggaggccacuucugcc

SEQ ID NO: 5023 - RNA, 22 nt, Artificial Sequence
  ELANE RNA Guide
cuucugccgcgccacccugauu

SEQ ID NO: 5024 - RNA, 22 nt, Artificial Sequence
  ELANE RNA Guide
gaggccacuucugccgcgccac

SEQ ID NO: 5025 - RNA, 22 nt, Artificial Sequence
  ELANE RNA Guide
gcaaucaggguggcgcggcaga

SEQ ID NO: 5026 - RNA, 22 nt, Artificial Sequence
  ELANE RNA Guide
gccacuucugccgcgccacccu

SEQ ID NO: 5027 - RNA, 22 nt, Artificial Sequence
  ELANE RNA Guide
gccgcgccacccugauugcgcc

SEQ ID NO: 5028 - RNA, 22 nt, Artificial Sequence
  ELANE RNA Guide
gcgcaaucaggguggcgcggca

SEQ ID NO: 5029 - RNA, 22 nt, Artificial Sequence
  ELANE RNA Guide
gcgcggaggccacuucugccgc

SEQ ID NO: 5030 - RNA, 22 nt, Artificial Sequence
  ELANE RNA Guide
gcgcggcagaaguggccuccgc

SEQ ID NO: 5031 - RNA, 22 nt, Artificial Sequence
  ELANE RNA Guide
gcggaggccacuucugccgcgc

SEQ ID NO: 5032 - RNA, 22 nt, Artificial Sequence
  ELANE RNA Guide
gcggcagaaguggccuccgcgc

SEQ ID NO: 5033 - RNA, 22 nt, Artificial Sequence
  ELANE RNA Guide
gcugcgcggaggccacuucugc

SEQ ID NO: 5034 - RNA, 22 nt, Artificial Sequence
  ELANE RNA Guide
ggaggccacuucugccgcgcca

SEQ ID NO: 5035 - RNA, 22 nt, Artificial Sequence
  ELANE RNA Guide
ggccacuucugccgcgccaccc

SEQ ID NO: 5036 - RNA, 22 nt, Artificial Sequence
  ELANE RNA Guide
ggcgcaaucaggguggcgcggc

SEQ ID NO: 5037 - RNA, 22 nt, Artificial Sequence
  ELANE RNA Guide
ggcgcggcagaaguggccuccg

SEQ ID NO: 5038 - RNA, 22 nt, Artificial Sequence
  ELANE RNA Guide
gggcgcaaucaggguggcgcgg

SEQ ID NO: 5039 - RNA, 22 nt, Artificial Sequence
  ELANE RNA Guide
ggguggcgcggcagaaguggcc

SEQ ID NO: 5040 - RNA, 22 nt, Artificial Sequence
  ELANE RNA Guide
gguggcgcggcagaaguggccu

SEQ ID NO: 5041 - RNA, 22 nt, Artificial Sequence
  ELANE RNA Guide
guggcgcggcagaaguggccuc

SEQ ID NO: 5042 - RNA, 22 nt, Artificial Sequence
  ELANE RNA Guide
ucaggguggcgcggcagaagug

SEQ ID NO: 5043 - RNA, 22 nt, Artificial Sequence
  ELANE RNA Guide
ucugccgcgccacccugauugc

SEQ ID NO: 5044 - RNA, 22 nt, Artificial Sequence
  ELANE RNA Guide
ugccgcgccacccugauugcgc

SEQ ID NO: 5045 - RNA, 22 nt, Artificial Sequence
  ELANE RNA Guide
ugcgcggaggccacuucugccg

SEQ ID NO: 5046 - RNA, 22 nt, Artificial Sequence
  ELANE RNA Guide
uggcgcggcagaaguggccucc

SEQ ID NO: 5047 - RNA, 22 nt, Artificial Sequence
  ELANE RNA Guide
ugggcgcaaucaggguggcgcg

SEQ ID NO: 5048 - RNA, 22 nt, Artificial Sequence
  ELANE RNA Guide
uucugccgcgccacccugauug

SEQ ID NO: 5049 - RNA, 20 nt, Artificial Sequence
  ELANE RNA Guide
aaucaggccgcagaaguggc

SEQ ID NO: 5050 - RNA, 20 nt, Artificial Sequence
  ELANE RNA Guide
aaucaggguggcaaucaggc

SEQ ID NO: 5051 - RNA, 20 nt, Artificial Sequence
  ELANE RNA Guide
acuucugcggccugauugcc

SEQ ID NO: 5052 - RNA, 20 nt, Artificial Sequence
  ELANE RNA Guide
aggccacuucugcggccuga

SEQ ID NO: 5053 - RNA, 20 nt, Artificial Sequence
  ELANE RNA Guide
aggccgcagaaguggccucc

SEQ ID NO: 5054 - RNA, 20 nt, Artificial Sequence
  ELANE RNA Guide
aggguggcaaucaggccgca

SEQ ID NO: 5055 - RNA, 20 nt, Artificial Sequence
  ELANE RNA Guide
aucaggccgcagaaguggcc

SEQ ID NO: 5056 - RNA, 20 nt, Artificial Sequence
  ELANE RNA Guide
aucaggguggcaaucaggcc

SEQ ID NO: 5057 - RNA, 20 nt, Artificial Sequence
  ELANE RNA Guide
caaucaggccgcagaagugg

SEQ ID NO: 5058 - RNA, 20 nt, Artificial Sequence
  ELANE RNA Guide
caaucaggguggcaaucagg

SEQ ID NO: 5059 - RNA, 20 nt, Artificial Sequence
  ELANE RNA Guide
cacuucugcggccugauugc

SEQ ID NO: 5060 - RNA, 20 nt, Artificial Sequence
  ELANE RNA Guide
caggccgcagaaguggccuc

SEQ ID NO: 5061 - RNA, 20 nt, Artificial Sequence
  ELANE RNA Guide
caggguggcaaucaggccgc

SEQ ID NO: 5062 - RNA, 20 nt, Artificial Sequence
  ELANE RNA Guide
ccacuucugcggccugauug

SEQ ID NO: 5063 - RNA, 20 nt, Artificial Sequence
  ELANE RNA Guide
cgcaaucaggguggcaauca

SEQ ID NO: 5064 - RNA, 20 nt, Artificial Sequence
  ELANE RNA Guide
cgcggaggccacuucugcgg

SEQ ID NO: 5065 - RNA, 20 nt, Artificial Sequence
  ELANE RNA Guide
cggaggccacuucugcggcc

SEQ ID NO: 5066 - RNA, 20 nt, Artificial Sequence
  ELANE RNA Guide
cggccugauugccacccuga

SEQ ID NO: 5067 - RNA, 20 nt, Artificial Sequence
  ELANE RNA Guide
cugcggccugauugccaccc

SEQ ID NO: 5068 - RNA, 20 nt, Artificial Sequence
  ELANE RNA Guide
cuucugcggccugauugcca

SEQ ID NO: 5069 - RNA, 20 nt, Artificial Sequence
  ELANE RNA Guide
gaggccacuucugcggccug

SEQ ID NO: 5070 - RNA, 20 nt, Artificial Sequence
  ELANE RNA Guide
gcaaucaggccgcagaagug

SEQ ID NO: 5071 - RNA, 20 nt, Artificial Sequence
  ELANE RNA Guide
gcaaucaggguggcaaucag

SEQ ID NO: 5072 - RNA, 20 nt, Artificial Sequence
  ELANE RNA Guide
gccacuucugcggccugauu

SEQ ID NO: 5073 - RNA, 20 nt, Artificial Sequence
  ELANE RNA Guide
gccugauugccacccugauu

SEQ ID NO: 5074 - RNA, 20 nt, Artificial Sequence
  ELANE RNA Guide
gcgcaaucaggguggcaauc

SEQ ID NO: 5075 - RNA, 20 nt, Artificial Sequence
  ELANE RNA Guide
gcgcggaggccacuucugcg

SEQ ID NO: 5076 - RNA, 20 nt, Artificial Sequence
  ELANE RNA Guide
gcggaggccacuucugcggc

SEQ ID NO: 5077 - RNA, 20 nt, Artificial Sequence
  ELANE RNA Guide
gcggccugauugccacccug

SEQ ID NO: 5078 - RNA, 20 nt, Artificial Sequence
  ELANE RNA Guide
ggaggccacuucugcggccu

SEQ ID NO: 5079 - RNA, 20 nt, Artificial Sequence
  ELANE RNA Guide
ggcaaucaggccgcagaagu

SEQ ID NO: 5080 - RNA, 20 nt, Artificial Sequence
  ELANE RNA Guide
ggccacuucugcggccugau

SEQ ID NO: 5081 - RNA, 20 nt, Artificial Sequence
  ELANE RNA Guide
ggccgcagaaguggccuccg

SEQ ID NO: 5082 - RNA, 20 nt, Artificial Sequence
  ELANE RNA Guide
ggccugauugccacccugau

SEQ ID NO: 5083 - RNA, 20 nt, Artificial Sequence
  ELANE RNA Guide
ggcgcaaucaggguggcaau

SEQ ID NO: 5084 - RNA, 20 nt, Artificial Sequence
  ELANE RNA Guide
ggguggcaaucaggccgcag

SEQ ID NO: 5085 - RNA, 20 nt, Artificial Sequence
  ELANE RNA Guide
gguggcaaucaggccgcaga

SEQ ID NO: 5086 - RNA, 20 nt, Artificial Sequence
  ELANE RNA Guide
guggcaaucaggccgcagaa

SEQ ID NO: 5087 - RNA, 20 nt, Artificial Sequence
  ELANE RNA Guide
ucaggccgcagaaguggccu

SEQ ID NO: 5088 - RNA, 20 nt, Artificial Sequence
  ELANE RNA Guide
ucaggguggcaaucaggccg

SEQ ID NO: 5089 - RNA, 20 nt, Artificial Sequence
  ELANE RNA Guide
ucugcggccugauugccacc

SEQ ID NO: 5090 - RNA, 20 nt, Artificial Sequence
  ELANE RNA Guide
ugcggccugauugccacccu

SEQ ID NO: 5091 - RNA, 20 nt, Artificial Sequence
  ELANE RNA Guide
uggcaaucaggccgcagaag

SEQ ID NO: 5092 - RNA, 20 nt, Artificial Sequence
  ELANE RNA Guide
uucugcggccugauugccac

SEQ ID NO: 5093 - RNA, 21 nt, Artificial Sequence
  ELANE RNA Guide
aaucaggccgcagaaguggcc

SEQ ID NO: 5094 - RNA, 21 nt, Artificial Sequence
  ELANE RNA Guide
aaucaggguggcaaucaggcc

SEQ ID NO: 5095 - RNA, 21 nt, Artificial Sequence
  ELANE RNA Guide
acuucugcggccugauugcca

SEQ ID NO: 5096 - RNA, 21 nt, Artificial Sequence
  ELANE RNA Guide
aggccacuucugcggccugau

SEQ ID NO: 5097 - RNA, 21 nt, Artificial Sequence
  ELANE RNA Guide
aggccgcagaaguggccuccg

SEQ ID NO: 5098 - RNA, 21 nt, Artificial Sequence
  ELANE RNA Guide
aggguggcaaucaggccgcag

SEQ ID NO: 5099 - RNA, 21 nt, Artificial Sequence
  ELANE RNA Guide
aucaggccgcagaaguggccu

SEQ ID NO: 5100 - RNA, 21 nt, Artificial Sequence
  ELANE RNA Guide
aucaggguggcaaucaggccg

SEQ ID NO: 5101 - RNA, 21 nt, Artificial Sequence
  ELANE RNA Guide
caaucaggccgcagaaguggc

SEQ ID NO: 5102 - RNA, 21 nt, Artificial Sequence
  ELANE RNA Guide
caaucaggguggcaaucaggc

SEQ ID NO: 5103 - RNA, 21 nt, Artificial Sequence
  ELANE RNA Guide
cacuucugcggccugauugcc

SEQ ID NO: 5104 - RNA, 21 nt, Artificial Sequence
  ELANE RNA Guide
caggccgcagaaguggccucc

SEQ ID NO: 5105 - RNA, 21 nt, Artificial Sequence
  ELANE RNA Guide
caggguggcaaucaggccgca

SEQ ID NO: 5106 - RNA, 21 nt, Artificial Sequence
  ELANE RNA Guide
ccacuucugcggccugauugc

SEQ ID NO: 5107 - RNA, 21 nt, Artificial Sequence
  ELANE RNA Guide
cgcaaucaggguggcaaucag

SEQ ID NO: 5108 - RNA, 21 nt, Artificial Sequence
  ELANE RNA Guide
cgcggaggccacuucugcggc

SEQ ID NO: 5109 - RNA, 21 nt, Artificial Sequence
  ELANE RNA Guide
cggaggccacuucugcggccu

SEQ ID NO: 5110 - RNA, 21 nt, Artificial Sequence
  ELANE RNA Guide
cggccugauugccacccugau

SEQ ID NO: 5111 - RNA, 21 nt, Artificial Sequence
  ELANE RNA Guide
cugcggccugauugccacccu

SEQ ID NO: 5112 - RNA, 21 nt, Artificial Sequence
  ELANE RNA Guide
cuucugcggccugauugccac

SEQ ID NO: 5113 - RNA, 21 nt, Artificial Sequence
  ELANE RNA Guide
gaggccacuucugcggccuga

SEQ ID NO: 5114 - RNA, 21 nt, Artificial Sequence
  ELANE RNA Guide
gcaaucaggccgcagaagugg

SEQ ID NO: 5115 - RNA, 21 nt, Artificial Sequence
  ELANE RNA Guide
gcaaucaggguggcaaucagg

SEQ ID NO: 5116 - RNA, 21 nt, Artificial Sequence
  ELANE RNA Guide
gccacuucugcggccugauug

SEQ ID NO: 5117 - RNA, 21 nt, Artificial Sequence
  ELANE RNA Guide
gccugauugccacccugauug

SEQ ID NO: 5118 - RNA, 21 nt, Artificial Sequence
  ELANE RNA Guide
gcgcaaucaggguggcaauca

SEQ ID NO: 5119 - RNA, 21 nt, Artificial Sequence
  ELANE RNA Guide
gcgcggaggccacuucugcgg

SEQ ID NO: 5120 - RNA, 21 nt, Artificial Sequence
  ELANE RNA Guide
gcggaggccacuucugcggcc

SEQ ID NO: 5121 - RNA, 21 nt, Artificial Sequence
  ELANE RNA Guide
gcggccugauugccacccuga

SEQ ID NO: 5122 - RNA, 21 nt, Artificial Sequence
  ELANE RNA Guide
ggaggccacuucugcggccug

SEQ ID NO: 5123 - RNA, 21 nt, Artificial Sequence
  ELANE RNA Guide
ggcaaucaggccgcagaagug

SEQ ID NO: 5124 - RNA, 21 nt, Artificial Sequence
  ELANE RNA Guide
ggccacuucugcggccugauu

SEQ ID NO: 5125 - RNA, 21 nt, Artificial Sequence
  ELANE RNA Guide
ggccgcagaaguggccuccgc

SEQ ID NO: 5126 - RNA, 21 nt, Artificial Sequence
  ELANE RNA Guide
ggccugauugccacccugauu

SEQ ID NO: 5127 - RNA, 21 nt, Artificial Sequence
  ELANE RNA Guide
ggcgcaaucaggguggcaauc

SEQ ID NO: 5128 - RNA, 21 nt, Artificial Sequence
  ELANE RNA Guide
gggcgcaaucaggguggcaau

SEQ ID NO: 5129 - RNA, 21 nt, Artificial Sequence
  ELANE RNA Guide
ggguggcaaucaggccgcaga

SEQ ID NO: 5130 - RNA, 21 nt, Artificial Sequence
  ELANE RNA Guide
gguggcaaucaggccgcagaa

SEQ ID NO: 5131 - RNA, 21 nt, Artificial Sequence
  ELANE RNA Guide
guggcaaucaggccgcagaag

SEQ ID NO: 5132 - RNA, 21 nt, Artificial Sequence
  ELANE RNA Guide
ucaggccgcagaaguggccuc

SEQ ID NO: 5133 - RNA, 21 nt, Artificial Sequence
  ELANE RNA Guide
ucaggguggcaaucaggccgc

SEQ ID NO: 5134 - RNA, 21 nt, Artificial Sequence
  ELANE RNA Guide
ucugcggccugauugccaccc

SEQ ID NO: 5135 - RNA, 21 nt, Artificial Sequence
  ELANE RNA Guide
ugcgcggaggccacuucugcg

SEQ ID NO: 5136 - RNA, 21 nt, Artificial Sequence
  ELANE RNA Guide
ugcggccugauugccacccug

SEQ ID NO: 5137 - RNA, 21 nt, Artificial Sequence
  ELANE RNA Guide
uggcaaucaggccgcagaagu

SEQ ID NO: 5138 - RNA, 21 nt, Artificial Sequence
  ELANE RNA Guide
uucugcggccugauugccacc

SEQ ID NO: 5139 - RNA, 22 nt, Artificial Sequence
  ELANE RNA Guide
aaucaggccgcagaaguggccu

SEQ ID NO: 5140 - RNA, 22 nt, Artificial Sequence
  ELANE RNA Guide
aaucaggguggcaaucaggccg

SEQ ID NO: 5141 - RNA, 22 nt, Artificial Sequence
  ELANE RNA Guide
acuucugcggccugauugccac

SEQ ID NO: 5142 - RNA, 22 nt, Artificial Sequence
  ELANE RNA Guide
aggccacuucugcggccugauu

SEQ ID NO: 5143 - RNA, 22 nt, Artificial Sequence
  ELANE RNA Guide
aggccgcagaaguggccuccgc

SEQ ID NO: 5144 - RNA, 22 nt, Artificial Sequence
  ELANE RNA Guide
aggguggcaaucaggccgcaga

SEQ ID NO: 5145 - RNA, 22 nt, Artificial Sequence
  ELANE RNA Guide
aucaggccgcagaaguggccuc

SEQ ID NO: 5146 - RNA, 22 nt, Artificial Sequence
  ELANE RNA Guide
aucaggguggcaaucaggccgc

SEQ ID NO: 5147 - RNA, 22 nt, Artificial Sequence
  ELANE RNA Guide
caaucaggccgcagaaguggcc

SEQ ID NO: 5148 - RNA, 22 nt, Artificial Sequence
  ELANE RNA Guide
caaucaggguggcaaucaggcc

SEQ ID NO: 5149 - RNA, 22 nt, Artificial Sequence
  ELANE RNA Guide
cacuucugcggccugauugcca

SEQ ID NO: 5150 - RNA, 22 nt, Artificial Sequence
  ELANE RNA Guide
caggccgcagaaguggccuccg

SEQ ID NO: 5151 - RNA, 22 nt, Artificial Sequence
  ELANE RNA Guide
caggguggcaaucaggccgcag

SEQ ID NO: 5152 - RNA, 22 nt, Artificial Sequence
  ELANE RNA Guide
ccacuucugcggccugauugcc

SEQ ID NO: 5153 - RNA, 22 nt, Artificial Sequence
  ELANE RNA Guide
cgcaaucaggguggcaaucagg

SEQ ID NO: 5154 - RNA, 22 nt, Artificial Sequence
  ELANE RNA Guide
cgcggaggccacuucugcggcc

SEQ ID NO: 5155 - RNA, 22 nt, Artificial Sequence
  ELANE RNA Guide
cggaggccacuucugcggccug

SEQ ID NO: 5156 - RNA, 22 nt, Artificial Sequence
  ELANE RNA Guide
cggccugauugccacccugauu

SEQ ID NO: 5157 - RNA, 22 nt, Artificial Sequence
  ELANE RNA Guide
cugcgcggaggccacuucugcg

SEQ ID NO: 5158 - RNA, 22 nt, Artificial Sequence
  ELANE RNA Guide
cugcggccugauugccacccug

SEQ ID NO: 5159 - RNA, 22 nt, Artificial Sequence
  ELANE RNA Guide
cuucugcggccugauugccacc

SEQ ID NO: 5160 - RNA, 22 nt, Artificial Sequence
  ELANE RNA Guide
gaggccacuucugcggccugau

SEQ ID NO: 5161 - RNA, 22 nt, Artificial Sequence
  ELANE RNA Guide
gcaaucaggccgcagaaguggc

SEQ ID NO: 5162 - RNA, 22 nt, Artificial Sequence
  ELANE RNA Guide
gcaaucaggguggcaaucaggc

SEQ ID NO: 5163 - RNA, 22 nt, Artificial Sequence
  ELANE RNA Guide
gccacuucugcggccugauugc

SEQ ID NO: 5164 - RNA, 22 nt, Artificial Sequence
  ELANE RNA Guide
gccugauugccacccugauugc

SEQ ID NO: 5165 - RNA, 22 nt, Artificial Sequence
  ELANE RNA Guide
gcgcaaucaggguggcaaucag

SEQ ID NO: 5166 - RNA, 22 nt, Artificial Sequence
  ELANE RNA Guide
gcgcggaggccacuucugcggc

SEQ ID NO: 5167 - RNA, 22 nt, Artificial Sequence
  ELANE RNA Guide
gcggaggccacuucugcggccu

SEQ ID NO: 5168 - RNA, 22 nt, Artificial Sequence
  ELANE RNA Guide
gcggccugauugccacccugau

SEQ ID NO: 5169 - RNA, 22 nt, Artificial Sequence
  ELANE RNA Guide
ggaggccacuucugcggccuga

SEQ ID NO: 5170 - RNA, 22 nt, Artificial Sequence
  ELANE RNA Guide
ggcaaucaggccgcagaagugg

SEQ ID NO: 5171 - RNA, 22 nt, Artificial Sequence
  ELANE RNA Guide
ggccacuucugcggccugauug

SEQ ID NO: 5172 - RNA, 22 nt, Artificial Sequence
  ELANE RNA Guide
ggccgcagaaguggccuccgcg

SEQ ID NO: 5173 - RNA, 22 nt, Artificial Sequence
  ELANE RNA Guide
ggccugauugccacccugauug

SEQ ID NO: 5174 - RNA, 22 nt, Artificial Sequence
  ELANE RNA Guide
ggcgcaaucaggguggcaauca

SEQ ID NO: 5175 - RNA, 22 nt, Artificial Sequence
  ELANE RNA Guide
gggcgcaaucaggguggcaauc

SEQ ID NO: 5176 - RNA, 22 nt, Artificial Sequence
  ELANE RNA Guide
ggguggcaaucaggccgcagaa

SEQ ID NO: 5177 - RNA, 22 nt, Artificial Sequence
  ELANE RNA Guide
gguggcaaucaggccgcagaag

SEQ ID NO: 5178 - RNA, 22 nt, Artificial Sequence
  ELANE RNA Guide
guggcaaucaggccgcagaagu

SEQ ID NO: 5179 - RNA, 22 nt, Artificial Sequence
  ELANE RNA Guide
ucaggccgcagaaguggccucc

SEQ ID NO: 5180 - RNA, 22 nt, Artificial Sequence
  ELANE RNA Guide
ucaggguggcaaucaggccgca

SEQ ID NO: 5181 - RNA, 22 nt, Artificial Sequence
  ELANE RNA Guide
ucugcggccugauugccacccu

SEQ ID NO: 5182 - RNA, 22 nt, Artificial Sequence
  ELANE RNA Guide
ugcgcggaggccacuucugcgg

SEQ ID NO: 5183 - RNA, 22 nt, Artificial Sequence
  ELANE RNA Guide
ugcggccugauugccacccuga

SEQ ID NO: 5184 - RNA, 22 nt, Artificial Sequence
  ELANE RNA Guide
uggcaaucaggccgcagaagug

SEQ ID NO: 5185 - RNA, 22 nt, Artificial Sequence
  ELANE RNA Guide
ugggcgcaaucaggguggcaau

SEQ ID NO: 5186 - RNA, 22 nt, Artificial Sequence
  ELANE RNA Guide
uucugcggccugauugccaccc

SEQ ID NO: 5187 - RNA, 20 nt, Artificial Sequence
  ELANE RNA Guide
aaguugggcgcaaucagggu

SEQ ID NO: 5188 - RNA, 20 nt, Artificial Sequence
  ELANE RNA Guide
aaucaggguggugccgcaga

SEQ ID NO: 5189 - RNA, 20 nt, Artificial Sequence
  ELANE RNA Guide
acuucugcggcaccacccug

SEQ ID NO: 5190 - RNA, 20 nt, Artificial Sequence
  ELANE RNA Guide
aggccacuucugcggcacca

SEQ ID NO: 5191 - RNA, 20 nt, Artificial Sequence
  ELANE RNA Guide
aggguggugccgcagaagug

SEQ ID NO: 5192 - RNA, 20 nt, Artificial Sequence
  ELANE RNA Guide
aguugggcgcaaucagggug

SEQ ID NO: 5193 - RNA, 20 nt, Artificial Sequence
  ELANE RNA Guide
aucaggguggugccgcagaa

SEQ ID NO: 5194 - RNA, 20 nt, Artificial Sequence
  ELANE RNA Guide
caaucaggguggugccgcag

SEQ ID NO: 5195 - RNA, 20 nt, Artificial Sequence
  ELANE RNA Guide
caccacccugauugcgccca

SEQ ID NO: 5196 - RNA, 20 nt, Artificial Sequence
  ELANE RNA Guide
cacuucugcggcaccacccu

SEQ ID NO: 5197 - RNA, 20 nt, Artificial Sequence
  ELANE RNA Guide
caggguggugccgcagaagu

SEQ ID NO: 5198 - RNA, 20 nt, Artificial Sequence
  ELANE RNA Guide
ccacuucugcggcaccaccc

SEQ ID NO: 5199 - RNA, 20 nt, Artificial Sequence
  ELANE RNA Guide
cgcaaucaggguggugccgc

SEQ ID NO: 5200 - RNA, 20 nt, Artificial Sequence
  ELANE RNA Guide
cggaggccacuucugcggca

SEQ ID NO: 5201 - RNA, 20 nt, Artificial Sequence
  ELANE RNA Guide
cggcaccacccugauugcgc

SEQ ID NO: 5202 - RNA, 20 nt, Artificial Sequence
  ELANE RNA Guide
cugcggcaccacccugauug

SEQ ID NO: 5203 - RNA, 20 nt, Artificial Sequence
  ELANE RNA Guide
cuucugcggcaccacccuga

SEQ ID NO: 5204 - RNA, 20 nt, Artificial Sequence
  ELANE RNA Guide
gaaguugggcgcaaucaggg

SEQ ID NO: 5205 - RNA, 20 nt, Artificial Sequence
  ELANE RNA Guide
gaggccacuucugcggcacc

SEQ ID NO: 5206 - RNA, 20 nt, Artificial Sequence
  ELANE RNA Guide
gcaaucaggguggugccgca

SEQ ID NO: 5207 - RNA, 20 nt, Artificial Sequence
  ELANE RNA Guide
gcaccacccugauugcgccc

SEQ ID NO: 5208 - RNA, 20 nt, Artificial Sequence
  ELANE RNA Guide
gccacuucugcggcaccacc

SEQ ID NO: 5209 - RNA, 20 nt, Artificial Sequence
  ELANE RNA Guide
gcgcaaucaggguggugccg

SEQ ID NO: 5210 - RNA, 20 nt, Artificial Sequence
  ELANE RNA Guide
gcggcaccacccugauugcg

SEQ ID NO: 5211 - RNA, 20 nt, Artificial Sequence
  ELANE RNA Guide
ggaggccacuucugcggcac

SEQ ID NO: 5212 - RNA, 20 nt, Artificial Sequence
  ELANE RNA Guide
ggcaccacccugauugcgcc

SEQ ID NO: 5213 - RNA, 20 nt, Artificial Sequence
  ELANE RNA Guide
ggccacuucugcggcaccac

SEQ ID NO: 5214 - RNA, 20 nt, Artificial Sequence
  ELANE RNA Guide
ggcgcaaucaggguggugcc

SEQ ID NO: 5215 - RNA, 20 nt, Artificial Sequence
  ELANE RNA Guide
gggcgcaaucaggguggugc

SEQ ID NO: 5216 - RNA, 20 nt, Artificial Sequence
  ELANE RNA Guide
ggguggugccgcagaagugg

SEQ ID NO: 5217 - RNA, 20 nt, Artificial Sequence
  ELANE RNA Guide
ggugccgcagaaguggccuc

SEQ ID NO: 5218 - RNA, 20 nt, Artificial Sequence
  ELANE RNA Guide
gguggugccgcagaaguggc

SEQ ID NO: 5219 - RNA, 20 nt, Artificial Sequence
  ELANE RNA Guide
gugccgcagaaguggccucc

SEQ ID NO: 5220 - RNA, 20 nt, Artificial Sequence
  ELANE RNA Guide
guggugccgcagaaguggcc

SEQ ID NO: 5221 - RNA, 20 nt, Artificial Sequence
  ELANE RNA Guide
ucaggguggugccgcagaag

SEQ ID NO: 5222 - RNA, 20 nt, Artificial Sequence
  ELANE RNA Guide
ucugcggcaccacccugauu

SEQ ID NO: 5223 - RNA, 20 nt, Artificial Sequence
  ELANE RNA Guide
ugcggcaccacccugauugc

SEQ ID NO: 5224 - RNA, 20 nt, Artificial Sequence
  ELANE RNA Guide
ugggcgcaaucaggguggug

SEQ ID NO: 5225 - RNA, 20 nt, Artificial Sequence
  ELANE RNA Guide
uggugccgcagaaguggccu

SEQ ID NO: 5226 - RNA, 20 nt, Artificial Sequence
  ELANE RNA Guide
uucugcggcaccacccugau

SEQ ID NO: 5227 - RNA, 20 nt, Artificial Sequence
  ELANE RNA Guide
uugggcgcaaucaggguggu

SEQ ID NO: 5228 - RNA, 21 nt, Artificial Sequence
  ELANE RNA Guide
aaguugggcgcaaucagggug

SEQ ID NO: 5229 - RNA, 21 nt, Artificial Sequence
  ELANE RNA Guide
aaucaggguggugccgcagaa

SEQ ID NO: 5230 - RNA, 21 nt, Artificial Sequence
  ELANE RNA Guide
acuucugcggcaccacccuga

SEQ ID NO: 5231 - RNA, 21 nt, Artificial Sequence
  ELANE RNA Guide
aggccacuucugcggcaccac

SEQ ID NO: 5232 - RNA, 21 nt, Artificial Sequence
  ELANE RNA Guide
aggguggugccgcagaagugg

SEQ ID NO: 5233 - RNA, 21 nt, Artificial Sequence
  ELANE RNA Guide
aucaggguggugccgcagaag

SEQ ID NO: 5234 - RNA, 21 nt, Artificial Sequence
  ELANE RNA Guide
caaucaggguggugccgcaga

SEQ ID NO: 5235 - RNA, 21 nt, Artificial Sequence
  ELANE RNA Guide
caccacccugauugcgcccaa

SEQ ID NO: 5236 - RNA, 21 nt, Artificial Sequence
  ELANE RNA Guide
cacuucugcggcaccacccug

SEQ ID NO: 5237 - RNA, 21 nt, Artificial Sequence
  ELANE RNA Guide
caggguggugccgcagaagug

SEQ ID NO: 5238 - RNA, 21 nt, Artificial Sequence
  ELANE RNA Guide
ccacuucugcggcaccacccu

SEQ ID NO: 5239 - RNA, 21 nt, Artificial Sequence
  ELANE RNA Guide
cgaaguugggcgcaaucaggg

SEQ ID NO: 5240 - RNA, 21 nt, Artificial Sequence
  ELANE RNA Guide
cgcaaucaggguggugccgca

SEQ ID NO: 5241 - RNA, 21 nt, Artificial Sequence
  ELANE RNA Guide
cggaggccacuucugcggcac

SEQ ID NO: 5242 - RNA, 21 nt, Artificial Sequence
  ELANE RNA Guide
cggcaccacccugauugcgcc

SEQ ID NO: 5243 - RNA, 21 nt, Artificial Sequence
  ELANE RNA Guide
cugcggcaccacccugauugc

SEQ ID NO: 5244 - RNA, 21 nt, Artificial Sequence
  ELANE RNA Guide
cuucugcggcaccacccugau

SEQ ID NO: 5245 - RNA, 21 nt, Artificial Sequence
  ELANE RNA Guide
gaaguugggcgcaaucagggu

SEQ ID NO: 5246 - RNA, 21 nt, Artificial Sequence
  ELANE RNA Guide
gaggccacuucugcggcacca

SEQ ID NO: 5247 - RNA, 21 nt, Artificial Sequence
  ELANE RNA Guide
gcaaucaggguggugccgcag

SEQ ID NO: 5248 - RNA, 21 nt, Artificial Sequence
  ELANE RNA Guide
gcaccacccugauugcgccca

SEQ ID NO: 5249 - RNA, 21 nt, Artificial Sequence
  ELANE RNA Guide
gccacuucugcggcaccaccc

SEQ ID NO: 5250 - RNA, 21 nt, Artificial Sequence
  ELANE RNA Guide
gcgcaaucaggguggugccgc

SEQ ID NO: 5251 - RNA, 21 nt, Artificial Sequence
  ELANE RNA Guide
gcggaggccacuucugcggca

SEQ ID NO: 5252 - RNA, 21 nt, Artificial Sequence
  ELANE RNA Guide
gcggcaccacccugauugcgc

SEQ ID NO: 5253 - RNA, 21 nt, Artificial Sequence
  ELANE RNA Guide
ggaggccacuucugcggcacc

SEQ ID NO: 5254 - RNA, 21 nt, Artificial Sequence
  ELANE RNA Guide
ggcaccacccugauugcgccc

SEQ ID NO: 5255 - RNA, 21 nt, Artificial Sequence
  ELANE RNA Guide
ggccacuucugcggcaccacc

SEQ ID NO: 5256 - RNA, 21 nt, Artificial Sequence
  ELANE RNA Guide
ggcgcaaucaggguggugccg

SEQ ID NO: 5257 - RNA, 21 nt, Artificial Sequence
  ELANE RNA Guide
gggcgcaaucaggguggugcc

SEQ ID NO: 5258 - RNA, 21 nt, Artificial Sequence
  ELANE RNA Guide
ggguggugccgcagaaguggc

SEQ ID NO: 5259 - RNA, 21 nt, Artificial Sequence
  ELANE RNA Guide
ggugccgcagaaguggccucc

SEQ ID NO: 5260 - RNA, 21 nt, Artificial Sequence
  ELANE RNA Guide
gguggugccgcagaaguggcc

SEQ ID NO: 5261 - RNA, 21 nt, Artificial Sequence
  ELANE RNA Guide
gugccgcagaaguggccuccg

SEQ ID NO: 5262 - RNA, 21 nt, Artificial Sequence
  ELANE RNA Guide
guggugccgcagaaguggccu

SEQ ID NO: 5263 - RNA, 21 nt, Artificial Sequence
  ELANE RNA Guide
guugggcgcaaucaggguggu

SEQ ID NO: 5264 - RNA, 21 nt, Artificial Sequence
  ELANE RNA Guide
ucaggguggugccgcagaagu

SEQ ID NO: 5265 - RNA, 21 nt, Artificial Sequence
  ELANE RNA Guide
ucugcggcaccacccugauug

SEQ ID NO: 5266 - RNA, 21 nt, Artificial Sequence
  ELANE RNA Guide
ugcggcaccacccugauugcg

SEQ ID NO: 5267 - RNA, 21 nt, Artificial Sequence
  ELANE RNA Guide
ugggcgcaaucaggguggugc

SEQ ID NO: 5268 - RNA, 21 nt, Artificial Sequence
  ELANE RNA Guide
uggugccgcagaaguggccuc

SEQ ID NO: 5269 - RNA, 21 nt, Artificial Sequence
  ELANE RNA Guide
uucugcggcaccacccugauu

SEQ ID NO: 5270 - RNA, 21 nt, Artificial Sequence
  ELANE RNA Guide
uugggcgcaaucaggguggug

SEQ ID NO: 5271 - RNA, 22 nt, Artificial Sequence
  ELANE RNA Guide
aaucaggguggugccgcagaag

SEQ ID NO: 5272 - RNA, 22 nt, Artificial Sequence
  ELANE RNA Guide
acgaaguugggcgcaaucaggg

SEQ ID NO: 5273 - RNA, 22 nt, Artificial Sequence
  ELANE RNA Guide
acuucugcggcaccacccugau

SEQ ID NO: 5274 - RNA, 22 nt, Artificial Sequence
  ELANE RNA Guide
aggccacuucugcggcaccacc

SEQ ID NO: 5275 - RNA, 22 nt, Artificial Sequence
  ELANE RNA Guide
aggguggugccgcagaaguggc

SEQ ID NO: 5276 - RNA, 22 nt, Artificial Sequence
  ELANE RNA Guide
aguugggcgcaaucaggguggu

SEQ ID NO: 5277 - RNA, 22 nt, Artificial Sequence
  ELANE RNA Guide
aucaggguggugccgcagaagu

SEQ ID NO: 5278 - RNA, 22 nt, Artificial Sequence
  ELANE RNA Guide
caaucaggguggugccgcagaa

SEQ ID NO: 5279 - RNA, 22 nt, Artificial Sequence
  ELANE RNA Guide
caccacccugauugcgcccaac

SEQ ID NO: 5280 - RNA, 22 nt, Artificial Sequence
  ELANE RNA Guide
cacuucugcggcaccacccuga

SEQ ID NO: 5281 - RNA, 22 nt, Artificial Sequence
  ELANE RNA Guide
caggguggugccgcagaagugg

SEQ ID NO: 5282 - RNA, 22 nt, Artificial Sequence
  ELANE RNA Guide
ccacuucugcggcaccacccug

SEQ ID NO: 5283 - RNA, 22 nt, Artificial Sequence
  ELANE RNA Guide
cgaaguugggcgcaaucagggu

SEQ ID NO: 5284 - RNA, 22 nt, Artificial Sequence
  ELANE RNA Guide
cgcaaucaggguggugccgcag

SEQ ID NO: 5285 - RNA, 22 nt, Artificial Sequence
  ELANE RNA Guide
cgcggaggccacuucugcggca

SEQ ID NO: 5286 - RNA, 22 nt, Artificial Sequence
  ELANE RNA Guide
cggaggccacuucugcggcacc

SEQ ID NO: 5287 - RNA, 22 nt, Artificial Sequence
  ELANE RNA Guide
cggcaccacccugauugcgccc

SEQ ID NO: 5288 - RNA, 22 nt, Artificial Sequence
  ELANE RNA Guide
cugcggcaccacccugauugcg

SEQ ID NO: 5289 - RNA, 22 nt, Artificial Sequence
  ELANE RNA Guide
cuucugcggcaccacccugauu

SEQ ID NO: 5290 - RNA, 22 nt, Artificial Sequence
  ELANE RNA Guide
gaaguugggcgcaaucagggug

SEQ ID NO: 5291 - RNA, 22 nt, Artificial Sequence
  ELANE RNA Guide
gaggccacuucugcggcaccac

SEQ ID NO: 5292 - RNA, 22 nt, Artificial Sequence
  ELANE RNA Guide
gcaaucaggguggugccgcaga

SEQ ID NO: 5293 - RNA, 22 nt, Artificial Sequence
  ELANE RNA Guide
gcaccacccugauugcgcccaa

SEQ ID NO: 5294 - RNA, 22 nt, Artificial Sequence
  ELANE RNA Guide
gccacuucugcggcaccacccu

SEQ ID NO: 5295 - RNA, 22 nt, Artificial Sequence
  ELANE RNA Guide
gcgcaaucaggguggugccgca

SEQ ID NO: 5296 - RNA, 22 nt, Artificial Sequence
  ELANE RNA Guide
gcggaggccacuucugcggcac

SEQ ID NO: 5297 - RNA, 22 nt, Artificial Sequence
  ELANE RNA Guide
gcggcaccacccugauugcgcc

SEQ ID NO: 5298 - RNA, 22 nt, Artificial Sequence
  ELANE RNA Guide
ggaggccacuucugcggcacca

SEQ ID NO: 5299 - RNA, 22 nt, Artificial Sequence
  ELANE RNA Guide
ggcaccacccugauugcgccca

SEQ ID NO: 5300 - RNA, 22 nt, Artificial Sequence
  ELANE RNA Guide
ggccacuucugcggcaccaccc

SEQ ID NO: 5301 - RNA, 22 nt, Artificial Sequence
  ELANE RNA Guide
ggcgcaaucaggguggugccgc

SEQ ID NO: 5302 - RNA, 22 nt, Artificial Sequence
  ELANE RNA Guide
gggcgcaaucaggguggugccg

SEQ ID NO: 5303 - RNA, 22 nt, Artificial Sequence
  ELANE RNA Guide
ggguggugccgcagaaguggcc

SEQ ID NO: 5304 - RNA, 22 nt, Artificial Sequence
  ELANE RNA Guide
ggugccgcagaaguggccuccg

SEQ ID NO: 5305 - RNA, 22 nt, Artificial Sequence
  ELANE RNA Guide
gguggugccgcagaaguggccu

SEQ ID NO: 5306 - RNA, 22 nt, Artificial Sequence
  ELANE RNA Guide
gugccgcagaaguggccuccgc

SEQ ID NO: 5307 - RNA, 22 nt, Artificial Sequence
  ELANE RNA Guide
guggugccgcagaaguggccuc

SEQ ID NO: 5308 - RNA, 22 nt, Artificial Sequence
  ELANE RNA Guide
guugggcgcaaucaggguggug

SEQ ID NO: 5309 - RNA, 22 nt, Artificial Sequence
  ELANE RNA Guide
ucaggguggugccgcagaagug

SEQ ID NO: 5310 - RNA, 22 nt, Artificial Sequence
  ELANE RNA Guide
ucugcggcaccacccugauugc

SEQ ID NO: 5311 - RNA, 22 nt, Artificial Sequence
  ELANE RNA Guide
ugcggcaccacccugauugcgc

SEQ ID NO: 5312 - RNA, 22 nt, Artificial Sequence
  ELANE RNA Guide
ugggcgcaaucaggguggugcc

SEQ ID NO: 5313 - RNA, 22 nt, Artificial Sequence
  ELANE RNA Guide
uggugccgcagaaguggccucc

SEQ ID NO: 5314 - RNA, 22 nt, Artificial Sequence
  ELANE RNA Guide
uucugcggcaccacccugauug

SEQ ID NO: 5315 - RNA, 22 nt, Artificial Sequence
  ELANE RNA Guide
uugggcgcaaucaggguggugc

SEQ ID NO: 5316 - RNA, 20 nt, Artificial Sequence
  ELANE RNA Guide
aaucaggguggagccgcaga

SEQ ID NO: 5317 - RNA, 20 nt, Artificial Sequence
  ELANE RNA Guide
acuucugcggcuccacccug

SEQ ID NO: 5318 - RNA, 20 nt, Artificial Sequence
  ELANE RNA Guide
aggccacuucugcggcucca

SEQ ID NO: 5319 - RNA, 20 nt, Artificial Sequence
  ELANE RNA Guide
aggguggagccgcagaagug

SEQ ID NO: 5320 - RNA, 20 nt, Artificial Sequence
  ELANE RNA Guide
aucaggguggagccgcagaa

SEQ ID NO: 5321 - RNA, 20 nt, Artificial Sequence
  ELANE RNA Guide
caaucaggguggagccgcag

SEQ ID NO: 5322 - RNA, 20 nt, Artificial Sequence
  ELANE RNA Guide
cacuucugcggcuccacccu

SEQ ID NO: 5323 - RNA, 20 nt, Artificial Sequence
  ELANE RNA Guide
caggguggagccgcagaagu

SEQ ID NO: 5324 - RNA, 20 nt, Artificial Sequence
  ELANE RNA Guide
ccacuucugcggcuccaccc

SEQ ID NO: 5325 - RNA, 20 nt, Artificial Sequence
  ELANE RNA Guide
cgcaaucaggguggagccgc

SEQ ID NO: 5326 - RNA, 20 nt, Artificial Sequence
  ELANE RNA Guide
cggaggccacuucugcggcu

SEQ ID NO: 5327 - RNA, 20 nt, Artificial Sequence
  ELANE RNA Guide
cggcuccacccugauugcgc

SEQ ID NO: 5328 - RNA, 20 nt, Artificial Sequence
  ELANE RNA Guide
cuccacccugauugcgccca

SEQ ID NO: 5329 - RNA, 20 nt, Artificial Sequence
  ELANE RNA Guide
cugcggcuccacccugauug

SEQ ID NO: 5330 - RNA, 20 nt, Artificial Sequence
  ELANE RNA Guide
cuucugcggcuccacccuga

SEQ ID NO: 5331 - RNA, 20 nt, Artificial Sequence
  ELANE RNA Guide
gagccgcagaaguggccucc

SEQ ID NO: 5332 - RNA, 20 nt, Artificial Sequence
  ELANE RNA Guide
gaggccacuucugcggcucc

SEQ ID NO: 5333 - RNA, 20 nt, Artificial Sequence
  ELANE RNA Guide
gcaaucaggguggagccgca

SEQ ID NO: 5334 - RNA, 20 nt, Artificial Sequence
  ELANE RNA Guide
gccacuucugcggcuccacc

SEQ ID NO: 5335 - RNA, 20 nt, Artificial Sequence
  ELANE RNA Guide
gcgcaaucaggguggagccg

SEQ ID NO: 5336 - RNA, 20 nt, Artificial Sequence
  ELANE RNA Guide
gcggcuccacccugauugcg

SEQ ID NO: 5337 - RNA, 20 nt, Artificial Sequence
  ELANE RNA Guide
gcuccacccugauugcgccc

SEQ ID NO: 5338 - RNA, 20 nt, Artificial Sequence
  ELANE RNA Guide
ggagccgcagaaguggccuc

SEQ ID NO: 5339 - RNA, 20 nt, Artificial Sequence
  ELANE RNA Guide
ggaggccacuucugcggcuc

SEQ ID NO: 5340 - RNA, 20 nt, Artificial Sequence
  ELANE RNA Guide
ggccacuucugcggcuccac

SEQ ID NO: 5341 - RNA, 20 nt, Artificial Sequence
  ELANE RNA Guide
ggcgcaaucaggguggagcc

SEQ ID NO: 5342 - RNA, 20 nt, Artificial Sequence
  ELANE RNA Guide
ggcuccacccugauugcgcc

SEQ ID NO: 5343 - RNA, 20 nt, Artificial Sequence
  ELANE RNA Guide
gggcgcaaucaggguggagc

SEQ ID NO: 5344 - RNA, 20 nt, Artificial Sequence
  ELANE RNA Guide
ggguggagccgcagaagugg

SEQ ID NO: 5345 - RNA, 20 nt, Artificial Sequence
  ELANE RNA Guide
gguggagccgcagaaguggc

SEQ ID NO: 5346 - RNA, 20 nt, Artificial Sequence
  ELANE RNA Guide
guggagccgcagaaguggcc

SEQ ID NO: 5347 - RNA, 20 nt, Artificial Sequence
  ELANE RNA Guide
ucaggguggagccgcagaag

SEQ ID NO: 5348 - RNA, 20 nt, Artificial Sequence
  ELANE RNA Guide
ucugcggcuccacccugauu

SEQ ID NO: 5349 - RNA, 20 nt, Artificial Sequence
  ELANE RNA Guide
ugcggcuccacccugauugc

SEQ ID NO: 5350 - RNA, 20 nt, Artificial Sequence
  ELANE RNA Guide
uggagccgcagaaguggccu

SEQ ID NO: 5351 - RNA, 20 nt, Artificial Sequence
  ELANE RNA Guide
ugggcgcaaucaggguggag

SEQ ID NO: 5352 - RNA, 20 nt, Artificial Sequence
  ELANE RNA Guide
uucugcggcuccacccugau

SEQ ID NO: 5353 - RNA, 20 nt, Artificial Sequence
  ELANE RNA Guide
uugggcgcaaucagggugga

SEQ ID NO: 5354 - RNA, 21 nt, Artificial Sequence
  ELANE RNA Guide
aaucaggguggagccgcagaa

SEQ ID NO: 5355 - RNA, 21 nt, Artificial Sequence
  ELANE RNA Guide
acuucugcggcuccacccuga

SEQ ID NO: 5356 - RNA, 21 nt, Artificial Sequence
  ELANE RNA Guide
aggccacuucugcggcuccac

SEQ ID NO: 5357 - RNA, 21 nt, Artificial Sequence
  ELANE RNA Guide
aggguggagccgcagaagugg

SEQ ID NO: 5358 - RNA, 21 nt, Artificial Sequence
  ELANE RNA Guide
aucaggguggagccgcagaag

SEQ ID NO: 5359 - RNA, 21 nt, Artificial Sequence
  ELANE RNA Guide
caaucaggguggagccgcaga

SEQ ID NO: 5360 - RNA, 21 nt, Artificial Sequence
  ELANE RNA Guide
cacuucugcggcuccacccug

SEQ ID NO: 5361 - RNA, 21 nt, Artificial Sequence
  ELANE RNA Guide
caggguggagccgcagaagug

SEQ ID NO: 5362 - RNA, 21 nt, Artificial Sequence
  ELANE RNA Guide
ccacuucugcggcuccacccu

SEQ ID NO: 5363 - RNA, 21 nt, Artificial Sequence
  ELANE RNA Guide
cgcaaucaggguggagccgca

SEQ ID NO: 5364 - RNA, 21 nt, Artificial Sequence
  ELANE RNA Guide
cggaggccacuucugcggcuc

SEQ ID NO: 5365 - RNA, 21 nt, Artificial Sequence
  ELANE RNA Guide
cggcuccacccugauugcgcc

SEQ ID NO: 5366 - RNA, 21 nt, Artificial Sequence
  ELANE RNA Guide
cuccacccugauugcgcccaa

SEQ ID NO: 5367 - RNA, 21 nt, Artificial Sequence
  ELANE RNA Guide
cugcggcuccacccugauugc

SEQ ID NO: 5368 - RNA, 21 nt, Artificial Sequence
  ELANE RNA Guide
cuucugcggcuccacccugau

SEQ ID NO: 5369 - RNA, 21 nt, Artificial Sequence
  ELANE RNA Guide
gagccgcagaaguggccuccg

SEQ ID NO: 5370 - RNA, 21 nt, Artificial Sequence
  ELANE RNA Guide
gaggccacuucugcggcucca

SEQ ID NO: 5371 - RNA, 21 nt, Artificial Sequence
  ELANE RNA Guide
gcaaucaggguggagccgcag

SEQ ID NO: 5372 - RNA, 21 nt, Artificial Sequence
  ELANE RNA Guide
gccacuucugcggcuccaccc

SEQ ID NO: 5373 - RNA, 21 nt, Artificial Sequence
  ELANE RNA Guide
gcgcaaucaggguggagccgc

SEQ ID NO: 5374 - RNA, 21 nt, Artificial Sequence
  ELANE RNA Guide
gcggaggccacuucugcggcu

SEQ ID NO: 5375 - RNA, 21 nt, Artificial Sequence
  ELANE RNA Guide
gcggcuccacccugauugcgc

SEQ ID NO: 5376 - RNA, 21 nt, Artificial Sequence
  ELANE RNA Guide
gcuccacccugauugcgccca

SEQ ID NO: 5377 - RNA, 21 nt, Artificial Sequence
  ELANE RNA Guide
ggagccgcagaaguggccucc

SEQ ID NO: 5378 - RNA, 21 nt, Artificial Sequence
  ELANE RNA Guide
ggaggccacuucugcggcucc

SEQ ID NO: 5379 - RNA, 21 nt, Artificial Sequence
  ELANE RNA Guide
ggccacuucugcggcuccacc

SEQ ID NO: 5380 - RNA, 21 nt, Artificial Sequence
  ELANE RNA Guide
ggcgcaaucaggguggagccg

SEQ ID NO: 5381 - RNA, 21 nt, Artificial Sequence
  ELANE RNA Guide
ggcuccacccugauugcgccc

SEQ ID NO: 5382 - RNA, 21 nt, Artificial Sequence
  ELANE RNA Guide
gggcgcaaucaggguggagcc

SEQ ID NO: 5383 - RNA, 21 nt, Artificial Sequence
  ELANE RNA Guide
ggguggagccgcagaaguggc

SEQ ID NO: 5384 - RNA, 21 nt, Artificial Sequence
  ELANE RNA Guide
gguggagccgcagaaguggcc

SEQ ID NO: 5385 - RNA, 21 nt, Artificial Sequence
  ELANE RNA Guide
guggagccgcagaaguggccu

SEQ ID NO: 5386 - RNA, 21 nt, Artificial Sequence
  ELANE RNA Guide
guugggcgcaaucagggugga

SEQ ID NO: 5387 - RNA, 21 nt, Artificial Sequence
  ELANE RNA Guide
ucaggguggagccgcagaagu

SEQ ID NO: 5388 - RNA, 21 nt, Artificial Sequence
  ELANE RNA Guide
ucugcggcuccacccugauug

SEQ ID NO: 5389 - RNA, 21 nt, Artificial Sequence
  ELANE RNA Guide
ugcggcuccacccugauugcg

SEQ ID NO: 5390 - RNA, 21 nt, Artificial Sequence
  ELANE RNA Guide
uggagccgcagaaguggccuc

SEQ ID NO: 5391 - RNA, 21 nt, Artificial Sequence
  ELANE RNA Guide
ugggcgcaaucaggguggagc

SEQ ID NO: 5392 - RNA, 21 nt, Artificial Sequence
  ELANE RNA Guide
uucugcggcuccacccugauu

SEQ ID NO: 5393 - RNA, 21 nt, Artificial Sequence
  ELANE RNA Guide
uugggcgcaaucaggguggag

SEQ ID NO: 5394 - RNA, 22 nt, Artificial Sequence
  ELANE RNA Guide
aaucaggguggagccgcagaag

SEQ ID NO: 5395 - RNA, 22 nt, Artificial Sequence
  ELANE RNA Guide
acuucugcggcuccacccugau

SEQ ID NO: 5396 - RNA, 22 nt, Artificial Sequence
  ELANE RNA Guide
aggccacuucugcggcuccacc

SEQ ID NO: 5397 - RNA, 22 nt, Artificial Sequence
  ELANE RNA Guide
aggguggagccgcagaaguggc

SEQ ID NO: 5398 - RNA, 22 nt, Artificial Sequence
  ELANE RNA Guide
aguugggcgcaaucagggugga

SEQ ID NO: 5399 - RNA, 22 nt, Artificial Sequence
  ELANE RNA Guide
aucaggguggagccgcagaagu

SEQ ID NO: 5400 - RNA, 22 nt, Artificial Sequence
  ELANE RNA Guide
caaucaggguggagccgcagaa

SEQ ID NO: 5401 - RNA, 22 nt, Artificial Sequence
  ELANE RNA Guide
cacuucugcggcuccacccuga

SEQ ID NO: 5402 - RNA, 22 nt, Artificial Sequence
  ELANE RNA Guide
caggguggagccgcagaagugg

SEQ ID NO: 5403 - RNA, 22 nt, Artificial Sequence
  ELANE RNA Guide
ccacuucugcggcuccacccug

SEQ ID NO: 5404 - RNA, 22 nt, Artificial Sequence
  ELANE RNA Guide
cgcaaucaggguggagccgcag

SEQ ID NO: 5405 - RNA, 22 nt, Artificial Sequence
  ELANE RNA Guide
cgcggaggccacuucugcggcu

SEQ ID NO: 5406 - RNA, 22 nt, Artificial Sequence
  ELANE RNA Guide
cggaggccacuucugcggcucc

SEQ ID NO: 5407 - RNA, 22 nt, Artificial Sequence
  ELANE RNA Guide
cggcuccacccugauugcgccc

SEQ ID NO: 5408 - RNA, 22 nt, Artificial Sequence
  ELANE RNA Guide
cuccacccugauugcgcccaac

SEQ ID NO: 5409 - RNA, 22 nt, Artificial Sequence
  ELANE RNA Guide
cugcggcuccacccugauugcg

SEQ ID NO: 5410 - RNA, 22 nt, Artificial Sequence
  ELANE RNA Guide
cuucugcggcuccacccugauu

SEQ ID NO: 5411 - RNA, 22 nt, Artificial Sequence
  ELANE RNA Guide
gagccgcagaaguggccuccgc

SEQ ID NO: 5412 - RNA, 22 nt, Artificial Sequence
  ELANE RNA Guide
gaggccacuucugcggcuccac

SEQ ID NO: 5413 - RNA, 22 nt, Artificial Sequence
  ELANE RNA Guide
gcaaucaggguggagccgcaga

SEQ ID NO: 5414 - RNA, 22 nt, Artificial Sequence
  ELANE RNA Guide
gccacuucugcggcuccacccu

SEQ ID NO: 5415 - RNA, 22 nt, Artificial Sequence
  ELANE RNA Guide
gcgcaaucaggguggagccgca

SEQ ID NO: 5416 - RNA, 22 nt, Artificial Sequence
  ELANE RNA Guide
gcggaggccacuucugcggcuc

SEQ ID NO: 5417 - RNA, 22 nt, Artificial Sequence
  ELANE RNA Guide
gcggcuccacccugauugcgcc

SEQ ID NO: 5418 - RNA, 22 nt, Artificial Sequence
  ELANE RNA Guide
gcuccacccugauugcgcccaa

SEQ ID NO: 5419 - RNA, 22 nt, Artificial Sequence
  ELANE RNA Guide
ggagccgcagaaguggccuccg

SEQ ID NO: 5420 - RNA, 22 nt, Artificial Sequence
  ELANE RNA Guide
ggaggccacuucugcggcucca

SEQ ID NO: 5421 - RNA, 22 nt, Artificial Sequence
  ELANE RNA Guide
ggccacuucugcggcuccaccc

SEQ ID NO: 5422 - RNA, 22 nt, Artificial Sequence
  ELANE RNA Guide
ggcgcaaucaggguggagccgc

SEQ ID NO: 5423 - RNA, 22 nt, Artificial Sequence
  ELANE RNA Guide
ggcuccacccugauugcgccca

SEQ ID NO: 5424 - RNA, 22 nt, Artificial Sequence
  ELANE RNA Guide
gggcgcaaucaggguggagccg

SEQ ID NO: 5425 - RNA, 22 nt, Artificial Sequence
  ELANE RNA Guide
ggguggagccgcagaaguggcc

SEQ ID NO: 5426 - RNA, 22 nt, Artificial Sequence
  ELANE RNA Guide
gguggagccgcagaaguggccu

SEQ ID NO: 5427 - RNA, 22 nt, Artificial Sequence
  ELANE RNA Guide
guggagccgcagaaguggccuc

SEQ ID NO: 5428 - RNA, 22 nt, Artificial Sequence
  ELANE RNA Guide
guugggcgcaaucaggguggag

SEQ ID NO: 5429 - RNA, 22 nt, Artificial Sequence
  ELANE RNA Guide
ucaggguggagccgcagaagug

SEQ ID NO: 5430 - RNA, 22 nt, Artificial Sequence
  ELANE RNA Guide
ucugcggcuccacccugauugc

SEQ ID NO: 5431 - RNA, 22 nt, Artificial Sequence
  ELANE RNA Guide
ugcggcuccacccugauugcgc

SEQ ID NO: 5432 - RNA, 22 nt, Artificial Sequence
  ELANE RNA Guide
uggagccgcagaaguggccucc

SEQ ID NO: 5433 - RNA, 22 nt, Artificial Sequence
  ELANE RNA Guide
ugggcgcaaucaggguggagcc

SEQ ID NO: 5434 - RNA, 22 nt, Artificial Sequence
  ELANE RNA Guide
uucugcggcuccacccugauug

SEQ ID NO: 5435 - RNA, 22 nt, Artificial Sequence
  ELANE RNA Guide
uugggcgcaaucaggguggagc

SEQ ID NO: 5436 - RNA, 20 nt, Artificial Sequence
  ELANE RNA Guide
aaucagggugacgccgcaga

SEQ ID NO: 5437 - RNA, 20 nt, Artificial Sequence
  ELANE RNA Guide
acuucugcggcgucacccug

SEQ ID NO: 5438 - RNA, 20 nt, Artificial Sequence
  ELANE RNA Guide
aggccacuucugcggcguca

SEQ ID NO: 5439 - RNA, 20 nt, Artificial Sequence
  ELANE RNA Guide
agggugacgccgcagaagug

SEQ ID NO: 5440 - RNA, 20 nt, Artificial Sequence
  ELANE RNA Guide
aucagggugacgccgcagaa

SEQ ID NO: 5441 - RNA, 20 nt, Artificial Sequence
  ELANE RNA Guide
caaucagggugacgccgcag

SEQ ID NO: 5442 - RNA, 20 nt, Artificial Sequence
  ELANE RNA Guide
cacuucugcggcgucacccu

SEQ ID NO: 5443 - RNA, 20 nt, Artificial Sequence
  ELANE RNA Guide
cagggugacgccgcagaagu

SEQ ID NO: 5444 - RNA, 20 nt, Artificial Sequence
  ELANE RNA Guide
ccacuucugcggcgucaccc

SEQ ID NO: 5445 - RNA, 20 nt, Artificial Sequence
  ELANE RNA Guide
cgaaguugggcgcaaucagg

SEQ ID NO: 5446 - RNA, 20 nt, Artificial Sequence
  ELANE RNA Guide
cgcaaucagggugacgccgc

SEQ ID NO: 5447 - RNA, 20 nt, Artificial Sequence
  ELANE RNA Guide
cggaggccacuucugcggcg

SEQ ID NO: 5448 - RNA, 20 nt, Artificial Sequence
  ELANE RNA Guide
cggcgucacccugauugcgc

SEQ ID NO: 5449 - RNA, 20 nt, Artificial Sequence
  ELANE RNA Guide
cgucacccugauugcgccca

SEQ ID NO: 5450 - RNA, 20 nt, Artificial Sequence
  ELANE RNA Guide
cugcggcgucacccugauug

SEQ ID NO: 5451 - RNA, 20 nt, Artificial Sequence
  ELANE RNA Guide
cuucugcggcgucacccuga

SEQ ID NO: 5452 - RNA, 20 nt, Artificial Sequence
  ELANE RNA Guide
gacgccgcagaaguggccuc

SEQ ID NO: 5453 - RNA, 20 nt, Artificial Sequence
  ELANE RNA Guide
gaggccacuucugcggcguc

SEQ ID NO: 5454 - RNA, 20 nt, Artificial Sequence
  ELANE RNA Guide
gcaaucagggugacgccgca

SEQ ID NO: 5455 - RNA, 20 nt, Artificial Sequence
  ELANE RNA Guide
gccacuucugcggcgucacc

SEQ ID NO: 5456 - RNA, 20 nt, Artificial Sequence
  ELANE RNA Guide
gcgcaaucagggugacgccg

SEQ ID NO: 5457 - RNA, 20 nt, Artificial Sequence
  ELANE RNA Guide
gcggcgucacccugauugcg

SEQ ID NO: 5458 - RNA, 20 nt, Artificial Sequence
  ELANE RNA Guide
gcgucacccugauugcgccc

SEQ ID NO: 5459 - RNA, 20 nt, Artificial Sequence
  ELANE RNA Guide
ggaggccacuucugcggcgu

SEQ ID NO: 5460 - RNA, 20 nt, Artificial Sequence
  ELANE RNA Guide
ggccacuucugcggcgucac

SEQ ID NO: 5461 - RNA, 20 nt, Artificial Sequence
  ELANE RNA Guide
ggcgcaaucagggugacgcc

SEQ ID NO: 5462 - RNA, 20 nt, Artificial Sequence
  ELANE RNA Guide
ggcgucacccugauugcgcc

SEQ ID NO: 5463 - RNA, 20 nt, Artificial Sequence
  ELANE RNA Guide
gggcgcaaucagggugacgc

SEQ ID NO: 5464 - RNA, 20 nt, Artificial Sequence
  ELANE RNA Guide
gggugacgccgcagaagugg

SEQ ID NO: 5465 - RNA, 20 nt, Artificial Sequence
  ELANE RNA Guide
ggugacgccgcagaaguggc

SEQ ID NO: 5466 - RNA, 20 nt, Artificial Sequence
  ELANE RNA Guide
gucacccugauugcgcccaa

SEQ ID NO: 5467 - RNA, 20 nt, Artificial Sequence
  ELANE RNA Guide
gugacgccgcagaaguggcc

SEQ ID NO: 5468 - RNA, 20 nt, Artificial Sequence
  ELANE RNA Guide
guugggcgcaaucaggguga

SEQ ID NO: 5469 - RNA, 20 nt, Artificial Sequence
  ELANE RNA Guide
ucagggugacgccgcagaag

SEQ ID NO: 5470 - RNA, 20 nt, Artificial Sequence
  ELANE RNA Guide
ucugcggcgucacccugauu

SEQ ID NO: 5471 - RNA, 20 nt, Artificial Sequence
  ELANE RNA Guide
ugacgccgcagaaguggccu

SEQ ID NO: 5472 - RNA, 20 nt, Artificial Sequence
  ELANE RNA Guide
ugcggcgucacccugauugc

SEQ ID NO: 5473 - RNA, 20 nt, Artificial Sequence
  ELANE RNA Guide
ugggcgcaaucagggugacg

SEQ ID NO: 5474 - RNA, 20 nt, Artificial Sequence
  ELANE RNA Guide
uucugcggcgucacccugau

SEQ ID NO: 5475 - RNA, 20 nt, Artificial Sequence
  ELANE RNA Guide
uugggcgcaaucagggugac

SEQ ID NO: 5476 - RNA, 21 nt, Artificial Sequence
  ELANE RNA Guide
aaucagggugacgccgcagaa

SEQ ID NO: 5477 - RNA, 21 nt, Artificial Sequence
  ELANE RNA Guide
acgaaguugggcgcaaucagg

SEQ ID NO: 5478 - RNA, 21 nt, Artificial Sequence
  ELANE RNA Guide
acuucugcggcgucacccuga

SEQ ID NO: 5479 - RNA, 21 nt, Artificial Sequence
  ELANE RNA Guide
aggccacuucugcggcgucac

SEQ ID NO: 5480 - RNA, 21 nt, Artificial Sequence
  ELANE RNA Guide
agggugacgccgcagaagugg

SEQ ID NO: 5481 - RNA, 21 nt, Artificial Sequence
  ELANE RNA Guide
aguugggcgcaaucaggguga

SEQ ID NO: 5482 - RNA, 21 nt, Artificial Sequence
  ELANE RNA Guide
aucagggugacgccgcagaag

SEQ ID NO: 5483 - RNA, 21 nt, Artificial Sequence
  ELANE RNA Guide
caaucagggugacgccgcaga

SEQ ID NO: 5484 - RNA, 21 nt, Artificial Sequence
  ELANE RNA Guide
cacuucugcggcgucacccug

SEQ ID NO: 5485 - RNA, 21 nt, Artificial Sequence
  ELANE RNA Guide
cagggugacgccgcagaagug

SEQ ID NO: 5486 - RNA, 21 nt, Artificial Sequence
  ELANE RNA Guide
ccacuucugcggcgucacccu

SEQ ID NO: 5487 - RNA, 21 nt, Artificial Sequence
  ELANE RNA Guide
cgcaaucagggugacgccgca

SEQ ID NO: 5488 - RNA, 21 nt, Artificial Sequence
  ELANE RNA Guide
cggaggccacuucugcggcgu

SEQ ID NO: 5489 - RNA, 21 nt, Artificial Sequence
  ELANE RNA Guide
cggcgucacccugauugcgcc

SEQ ID NO: 5490 - RNA, 21 nt, Artificial Sequence
  ELANE RNA Guide
cgucacccugauugcgcccaa

SEQ ID NO: 5491 - RNA, 21 nt, Artificial Sequence
  ELANE RNA Guide
cugcggcgucacccugauugc

SEQ ID NO: 5492 - RNA, 21 nt, Artificial Sequence
  ELANE RNA Guide
cuucugcggcgucacccugau

SEQ ID NO: 5493 - RNA, 21 nt, Artificial Sequence
  ELANE RNA Guide
gacgccgcagaaguggccucc

SEQ ID NO: 5494 - RNA, 21 nt, Artificial Sequence
  ELANE RNA Guide
gaggccacuucugcggcguca

SEQ ID NO: 5495 - RNA, 21 nt, Artificial Sequence
  ELANE RNA Guide
gcaaucagggugacgccgcag

SEQ ID NO: 5496 - RNA, 21 nt, Artificial Sequence
  ELANE RNA Guide
gccacuucugcggcgucaccc

SEQ ID NO: 5497 - RNA, 21 nt, Artificial Sequence
  ELANE RNA Guide
gcgcaaucagggugacgccgc

SEQ ID NO: 5498 - RNA, 21 nt, Artificial Sequence
  ELANE RNA Guide
gcggaggccacuucugcggcg

SEQ ID NO: 5499 - RNA, 21 nt, Artificial Sequence
  ELANE RNA Guide
gcggcgucacccugauugcgc

SEQ ID NO: 5500 - RNA, 21 nt, Artificial Sequence
  ELANE RNA Guide
gcgucacccugauugcgccca

SEQ ID NO: 5501 - RNA, 21 nt, Artificial Sequence
  ELANE RNA Guide
ggaggccacuucugcggcguc

SEQ ID NO: 5502 - RNA, 21 nt, Artificial Sequence
  ELANE RNA Guide
ggccacuucugcggcgucacc

SEQ ID NO: 5503 - RNA, 21 nt, Artificial Sequence
  ELANE RNA Guide
ggcgcaaucagggugacgccg

SEQ ID NO: 5504 - RNA, 21 nt, Artificial Sequence
  ELANE RNA Guide
ggcgucacccugauugcgccc

SEQ ID NO: 5505 - RNA, 21 nt, Artificial Sequence
  ELANE RNA Guide
gggcgcaaucagggugacgcc

SEQ ID NO: 5506 - RNA, 21 nt, Artificial Sequence
  ELANE RNA Guide
gggugacgccgcagaaguggc

SEQ ID NO: 5507 - RNA, 21 nt, Artificial Sequence
  ELANE RNA Guide
ggugacgccgcagaaguggcc

SEQ ID NO: 5508 - RNA, 21 nt, Artificial Sequence
  ELANE RNA Guide
gucacccugauugcgcccaac

SEQ ID NO: 5509 - RNA, 21 nt, Artificial Sequence
  ELANE RNA Guide
gugacgccgcagaaguggccu

SEQ ID NO: 5510 - RNA, 21 nt, Artificial Sequence
  ELANE RNA Guide
guugggcgcaaucagggugac

SEQ ID NO: 5511 - RNA, 21 nt, Artificial Sequence
  ELANE RNA Guide
ucagggugacgccgcagaagu

SEQ ID NO: 5512 - RNA, 21 nt, Artificial Sequence
  ELANE RNA Guide
ucugcggcgucacccugauug

SEQ ID NO: 5513 - RNA, 21 nt, Artificial Sequence
  ELANE RNA Guide
ugacgccgcagaaguggccuc

SEQ ID NO: 5514 - RNA, 21 nt, Artificial Sequence
  ELANE RNA Guide
ugcggcgucacccugauugcg

SEQ ID NO: 5515 - RNA, 21 nt, Artificial Sequence
  ELANE RNA Guide
ugggcgcaaucagggugacgc

SEQ ID NO: 5516 - RNA, 21 nt, Artificial Sequence
  ELANE RNA Guide
uucugcggcgucacccugauu

SEQ ID NO: 5517 - RNA, 21 nt, Artificial Sequence
  ELANE RNA Guide
uugggcgcaaucagggugacg

SEQ ID NO: 5518 - RNA, 22 nt, Artificial Sequence
  ELANE RNA Guide
aaguugggcgcaaucaggguga

SEQ ID NO: 5519 - RNA, 22 nt, Artificial Sequence
  ELANE RNA Guide
aaucagggugacgccgcagaag

SEQ ID NO: 5520 - RNA, 22 nt, Artificial Sequence
  ELANE RNA Guide
acuucugcggcgucacccugau

SEQ ID NO: 5521 - RNA, 22 nt, Artificial Sequence
  ELANE RNA Guide
aggccacuucugcggcgucacc

SEQ ID NO: 5522 - RNA, 22 nt, Artificial Sequence
  ELANE RNA Guide
agggugacgccgcagaaguggc

SEQ ID NO: 5523 - RNA, 22 nt, Artificial Sequence
  ELANE RNA Guide
aguugggcgcaaucagggugac

SEQ ID NO: 5524 - RNA, 22 nt, Artificial Sequence
  ELANE RNA Guide
aucagggugacgccgcagaagu

SEQ ID NO: 5525 - RNA, 22 nt, Artificial Sequence
  ELANE RNA Guide
caaucagggugacgccgcagaa

SEQ ID NO: 5526 - RNA, 22 nt, Artificial Sequence
  ELANE RNA Guide
cacuucugcggcgucacccuga

SEQ ID NO: 5527 - RNA, 22 nt, Artificial Sequence
  ELANE RNA Guide
cagggugacgccgcagaagugg

SEQ ID NO: 5528 - RNA, 22 nt, Artificial Sequence
  ELANE RNA Guide
ccacuucugcggcgucacccug

SEQ ID NO: 5529 - RNA, 22 nt, Artificial Sequence
  ELANE RNA Guide
cgcaaucagggugacgccgcag

SEQ ID NO: 5530 - RNA, 22 nt, Artificial Sequence
  ELANE RNA Guide
cgcggaggccacuucugcggcg

SEQ ID NO: 5531 - RNA, 22 nt, Artificial Sequence
  ELANE RNA Guide
cggaggccacuucugcggcguc

SEQ ID NO: 5532 - RNA, 22 nt, Artificial Sequence
  ELANE RNA Guide
cggcgucacccugauugcgccc

SEQ ID NO: 5533 - RNA, 22 nt, Artificial Sequence
  ELANE RNA Guide
cgucacccugauugcgcccaac

SEQ ID NO: 5534 - RNA, 22 nt, Artificial Sequence
  ELANE RNA Guide
cugcggcgucacccugauugcg

SEQ ID NO: 5535 - RNA, 22 nt, Artificial Sequence
  ELANE RNA Guide
cuucugcggcgucacccugauu

SEQ ID NO: 5536 - RNA, 22 nt, Artificial Sequence
  ELANE RNA Guide
gacgaaguugggcgcaaucagg

SEQ ID NO: 5537 - RNA, 22 nt, Artificial Sequence
  ELANE RNA Guide
gacgccgcagaaguggccuccg

SEQ ID NO: 5538 - RNA, 22 nt, Artificial Sequence
  ELANE RNA Guide
gaggccacuucugcggcgucac

SEQ ID NO: 5539 - RNA, 22 nt, Artificial Sequence
  ELANE RNA Guide
gcaaucagggugacgccgcaga

SEQ ID NO: 5540 - RNA, 22 nt, Artificial Sequence
  ELANE RNA Guide
gccacuucugcggcgucacccu

SEQ ID NO: 5541 - RNA, 22 nt, Artificial Sequence
  ELANE RNA Guide
gcgcaaucagggugacgccgca

SEQ ID NO: 5542 - RNA, 22 nt, Artificial Sequence
  ELANE RNA Guide
gcggaggccacuucugcggcgu

SEQ ID NO: 5543 - RNA, 22 nt, Artificial Sequence
  ELANE RNA Guide
gcggcgucacccugauugcgcc

SEQ ID NO: 5544 - RNA, 22 nt, Artificial Sequence
  ELANE RNA Guide
gcgucacccugauugcgcccaa

SEQ ID NO: 5545 - RNA, 22 nt, Artificial Sequence
  ELANE RNA Guide
ggaggccacuucugcggcguca

SEQ ID NO: 5546 - RNA, 22 nt, Artificial Sequence
  ELANE RNA Guide
ggccacuucugcggcgucaccc

SEQ ID NO: 5547 - RNA, 22 nt, Artificial Sequence
  ELANE RNA Guide
ggcgcaaucagggugacgccgc

SEQ ID NO: 5548 - RNA, 22 nt, Artificial Sequence
  ELANE RNA Guide
ggcgucacccugauugcgccca

SEQ ID NO: 5549 - RNA, 22 nt, Artificial Sequence
  ELANE RNA Guide
gggcgcaaucagggugacgccg

SEQ ID NO: 5550 - RNA, 22 nt, Artificial Sequence
  ELANE RNA Guide
gggugacgccgcagaaguggcc

SEQ ID NO: 5551 - RNA, 22 nt, Artificial Sequence
  ELANE RNA Guide
ggugacgccgcagaaguggccu

SEQ ID NO: 5552 - RNA, 22 nt, Artificial Sequence
  ELANE RNA Guide
gucacccugauugcgcccaacu

SEQ ID NO: 5553 - RNA, 22 nt, Artificial Sequence
  ELANE RNA Guide
gugacgccgcagaaguggccuc

SEQ ID NO: 5554 - RNA, 22 nt, Artificial Sequence
  ELANE RNA Guide
guugggcgcaaucagggugacg

SEQ ID NO: 5555 - RNA, 22 nt, Artificial Sequence
  ELANE RNA Guide
ucagggugacgccgcagaagug

SEQ ID NO: 5556 - RNA, 22 nt, Artificial Sequence
  ELANE RNA Guide
ucugcggcgucacccugauugc

SEQ ID NO: 5557 - RNA, 22 nt, Artificial Sequence
  ELANE RNA Guide
ugacgccgcagaaguggccucc

SEQ ID NO: 5558 - RNA, 22 nt, Artificial Sequence
  ELANE RNA Guide
ugcggcgucacccugauugcgc

SEQ ID NO: 5559 - RNA, 22 nt, Artificial Sequence
  ELANE RNA Guide
ugggcgcaaucagggugacgcc

SEQ ID NO: 5560 - RNA, 22 nt, Artificial Sequence
  ELANE RNA Guide
uucugcggcgucacccugauug

SEQ ID NO: 5561 - RNA, 22 nt, Artificial Sequence
  ELANE RNA Guide
uugggcgcaaucagggugacgc

SEQ ID NO: 5562 - RNA, 20 nt, Artificial Sequence
  ELANE RNA Guide
aaguugggcgcaaucagggg

SEQ ID NO: 5563 - RNA, 20 nt, Artificial Sequence
  ELANE RNA Guide
aaucaggggggcgccgcaga

SEQ ID NO: 5564 - RNA, 20 nt, Artificial Sequence
  ELANE RNA Guide
acgaaguugggcgcaaucag

SEQ ID NO: 5565 - RNA, 20 nt, Artificial Sequence
  ELANE RNA Guide
acuucugcggcgccccccug

SEQ ID NO: 5566 - RNA, 20 nt, Artificial Sequence
  ELANE RNA Guide
aggccacuucugcggcgccc

SEQ ID NO: 5567 - RNA, 20 nt, Artificial Sequence
  ELANE RNA Guide
aggggggcgccgcagaagug

SEQ ID NO: 5568 - RNA, 20 nt, Artificial Sequence
  ELANE RNA Guide
aguugggcgcaaucaggggg

SEQ ID NO: 5569 - RNA, 20 nt, Artificial Sequence
  ELANE RNA Guide
aucaggggggcgccgcagaa

SEQ ID NO: 5570 - RNA, 20 nt, Artificial Sequence
  ELANE RNA Guide
caaucaggggggcgccgcag

SEQ ID NO: 5571 - RNA, 20 nt, Artificial Sequence
  ELANE RNA Guide
cacuucugcggcgccccccu

SEQ ID NO: 5572 - RNA, 20 nt, Artificial Sequence
  ELANE RNA Guide
caggggggcgccgcagaagu

SEQ ID NO: 5573 - RNA, 20 nt, Artificial Sequence
  ELANE RNA Guide
ccacuucugcggcgcccccc

SEQ ID NO: 5574 - RNA, 20 nt, Artificial Sequence
  ELANE RNA Guide
ccccccugauugcgcccaac

SEQ ID NO: 5575 - RNA, 20 nt, Artificial Sequence
  ELANE RNA Guide
cccccugauugcgcccaacu

SEQ ID NO: 5576 - RNA, 20 nt, Artificial Sequence
  ELANE RNA Guide
cgcaaucaggggggcgccgc

SEQ ID NO: 5577 - RNA, 20 nt, Artificial Sequence
  ELANE RNA Guide
cgccccccugauugcgccca

SEQ ID NO: 5578 - RNA, 20 nt, Artificial Sequence
  ELANE RNA Guide
cggcgccccccugauugcgc

SEQ ID NO: 5579 - RNA, 20 nt, Artificial Sequence
  ELANE RNA Guide
cugcggcgccccccugauug

SEQ ID NO: 5580 - RNA, 20 nt, Artificial Sequence
  ELANE RNA Guide
cuucugcggcgccccccuga

SEQ ID NO: 5581 - RNA, 20 nt, Artificial Sequence
  ELANE RNA Guide
gacgaaguugggcgcaauca

SEQ ID NO: 5582 - RNA, 20 nt, Artificial Sequence
  ELANE RNA Guide
gaggccacuucugcggcgcc

SEQ ID NO: 5583 - RNA, 20 nt, Artificial Sequence
  ELANE RNA Guide
gcaaucaggggggcgccgca

SEQ ID NO: 5584 - RNA, 20 nt, Artificial Sequence
  ELANE RNA Guide
gccacuucugcggcgccccc

SEQ ID NO: 5585 - RNA, 20 nt, Artificial Sequence
  ELANE RNA Guide
gccccccugauugcgcccaa

SEQ ID NO: 5586 - RNA, 20 nt, Artificial Sequence
  ELANE RNA Guide
gcgcaaucaggggggcgccg

SEQ ID NO: 5587 - RNA, 20 nt, Artificial Sequence
  ELANE RNA Guide
gcgccccccugauugcgccc

SEQ ID NO: 5588 - RNA, 20 nt, Artificial Sequence
  ELANE RNA Guide
gcggcgccccccugauugcg

SEQ ID NO: 5589 - RNA, 20 nt, Artificial Sequence
  ELANE RNA Guide
ggaggccacuucugcggcgc

SEQ ID NO: 5590 - RNA, 20 nt, Artificial Sequence
  ELANE RNA Guide
ggccacuucugcggcgcccc

SEQ ID NO: 5591 - RNA, 20 nt, Artificial Sequence
  ELANE RNA Guide
ggcgcaaucaggggggcgcc

SEQ ID NO: 5592 - RNA, 20 nt, Artificial Sequence
  ELANE RNA Guide
ggcgccccccugauugcgcc

SEQ ID NO: 5593 - RNA, 20 nt, Artificial Sequence
  ELANE RNA Guide
gggcgcaaucaggggggcgc

SEQ ID NO: 5594 - RNA, 20 nt, Artificial Sequence
  ELANE RNA Guide
ggggcgccgcagaaguggcc

SEQ ID NO: 5595 - RNA, 20 nt, Artificial Sequence
  ELANE RNA Guide
gggggcgccgcagaaguggc

SEQ ID NO: 5596 - RNA, 20 nt, Artificial Sequence
  ELANE RNA Guide
ggggggcgccgcagaagugg

SEQ ID NO: 5597 - RNA, 20 nt, Artificial Sequence
  ELANE RNA Guide
guugggcgcaaucagggggg

SEQ ID NO: 5598 - RNA, 20 nt, Artificial Sequence
  ELANE RNA Guide
ucaggggggcgccgcagaag

SEQ ID NO: 5599 - RNA, 20 nt, Artificial Sequence
  ELANE RNA Guide
ucugcggcgccccccugauu

SEQ ID NO: 5600 - RNA, 20 nt, Artificial Sequence
  ELANE RNA Guide
ugcggcgccccccugauugc

SEQ ID NO: 5601 - RNA, 20 nt, Artificial Sequence
  ELANE RNA Guide
ugggcgcaaucaggggggcg

SEQ ID NO: 5602 - RNA, 20 nt, Artificial Sequence
  ELANE RNA Guide
uucugcggcgccccccugau

SEQ ID NO: 5603 - RNA, 20 nt, Artificial Sequence
  ELANE RNA Guide
uugggcgcaaucaggggggc

SEQ ID NO: 5604 - RNA, 21 nt, Artificial Sequence
  ELANE RNA Guide
aaguugggcgcaaucaggggg

SEQ ID NO: 5605 - RNA, 21 nt, Artificial Sequence
  ELANE RNA Guide
aaucaggggggcgccgcagaa

SEQ ID NO: 5606 - RNA, 21 nt, Artificial Sequence
  ELANE RNA Guide
acuucugcggcgccccccuga

SEQ ID NO: 5607 - RNA, 21 nt, Artificial Sequence
  ELANE RNA Guide
aggccacuucugcggcgcccc

SEQ ID NO: 5608 - RNA, 21 nt, Artificial Sequence
  ELANE RNA Guide
aggggggcgccgcagaagugg

SEQ ID NO: 5609 - RNA, 21 nt, Artificial Sequence
  ELANE RNA Guide
aguugggcgcaaucagggggg

SEQ ID NO: 5610 - RNA, 21 nt, Artificial Sequence
  ELANE RNA Guide
aucaggggggcgccgcagaag

SEQ ID NO: 5611 - RNA, 21 nt, Artificial Sequence
  ELANE RNA Guide
caaucaggggggcgccgcaga

SEQ ID NO: 5612 - RNA, 21 nt, Artificial Sequence
  ELANE RNA Guide
cacuucugcggcgccccccug

SEQ ID NO: 5613 - RNA, 21 nt, Artificial Sequence
  ELANE RNA Guide
caggggggcgccgcagaagug

SEQ ID NO: 5614 - RNA, 21 nt, Artificial Sequence
  ELANE RNA Guide
ccacuucugcggcgccccccu

SEQ ID NO: 5615 - RNA, 21 nt, Artificial Sequence
  ELANE RNA Guide
ccccccugauugcgcccaacu

SEQ ID NO: 5616 - RNA, 21 nt, Artificial Sequence
  ELANE RNA Guide
cccccugauugcgcccaacuu

SEQ ID NO: 5617 - RNA, 21 nt, Artificial Sequence
  ELANE RNA Guide
cgcaaucaggggggcgccgca

SEQ ID NO: 5618 - RNA, 21 nt, Artificial Sequence
  ELANE RNA Guide
cgccccccugauugcgcccaa

SEQ ID NO: 5619 - RNA, 21 nt, Artificial Sequence
  ELANE RNA Guide
cggaggccacuucugcggcgc

SEQ ID NO: 5620 - RNA, 21 nt, Artificial Sequence
  ELANE RNA Guide
cugcggcgccccccugauugc

SEQ ID NO: 5621 - RNA, 21 nt, Artificial Sequence
  ELANE RNA Guide
cuucugcggcgccccccugau

SEQ ID NO: 5622 - RNA, 21 nt, Artificial Sequence
  ELANE RNA Guide
gaaguugggcgcaaucagggg

SEQ ID NO: 5623 - RNA, 21 nt, Artificial Sequence
  ELANE RNA Guide
gacgaaguugggcgcaaucag

SEQ ID NO: 5624 - RNA, 21 nt, Artificial Sequence
  ELANE RNA Guide
gaggccacuucugcggcgccc

SEQ ID NO: 5625 - RNA, 21 nt, Artificial Sequence
  ELANE RNA Guide
gcaaucaggggggcgccgcag

SEQ ID NO: 5626 - RNA, 21 nt, Artificial Sequence
  ELANE RNA Guide
gccccccugauugcgcccaac

SEQ ID NO: 5627 - RNA, 21 nt, Artificial Sequence
  ELANE RNA Guide
gcgccccccugauugcgccca

SEQ ID NO: 5628 - RNA, 21 nt, Artificial Sequence
  ELANE RNA Guide
ggaggccacuucugcggcgcc

SEQ ID NO: 5629 - RNA, 21 nt, Artificial Sequence
  ELANE RNA Guide
ggggcgccgcagaaguggccu

SEQ ID NO: 5630 - RNA, 21 nt, Artificial Sequence
  ELANE RNA Guide
guugggcgcaaucaggggggc

SEQ ID NO: 5631 - RNA, 21 nt, Artificial Sequence
  ELANE RNA Guide
ucaggggggcgccgcagaagu

SEQ ID NO: 5632 - RNA, 21 nt, Artificial Sequence
  ELANE RNA Guide
ucugcggcgccccccugauug

SEQ ID NO: 5633 - RNA, 21 nt, Artificial Sequence
  ELANE RNA Guide
ugacgaaguugggcgcaauca

SEQ ID NO: 5634 - RNA, 21 nt, Artificial Sequence
  ELANE RNA Guide
ugcggcgccccccugauugcg

SEQ ID NO: 5635 - RNA, 21 nt, Artificial Sequence
  ELANE RNA Guide
ugggcgcaaucaggggggcgc

SEQ ID NO: 5636 - RNA, 21 nt, Artificial Sequence
  ELANE RNA Guide
uucugcggcgccccccugauu

SEQ ID NO: 5637 - RNA, 21 nt, Artificial Sequence
  ELANE RNA Guide
uugggcgcaaucaggggggcg

SEQ ID NO: 5638 - RNA, 22 nt, Artificial Sequence
  ELANE RNA Guide
aaguugggcgcaaucagggggg

SEQ ID NO: 5639 - RNA, 22 nt, Artificial Sequence
  ELANE RNA Guide
aaucaggggggcgccgcagaag

SEQ ID NO: 5640 - RNA, 22 nt, Artificial Sequence
  ELANE RNA Guide
acuucugcggcgccccccugau

SEQ ID NO: 5641 - RNA, 22 nt, Artificial Sequence
  ELANE RNA Guide
aggccacuucugcggcgccccc

SEQ ID NO: 5642 - RNA, 22 nt, Artificial Sequence
  ELANE RNA Guide
aggggggcgccgcagaaguggc

SEQ ID NO: 5643 - RNA, 22 nt, Artificial Sequence
  ELANE RNA Guide
aguugggcgcaaucaggggggc

SEQ ID NO: 5644 - RNA, 22 nt, Artificial Sequence
  ELANE RNA Guide
aucaggggggcgccgcagaagu

SEQ ID NO: 5645 - RNA, 22 nt, Artificial Sequence
  ELANE RNA Guide
augacgaaguugggcgcaauca

SEQ ID NO: 5646 - RNA, 22 nt, Artificial Sequence
  ELANE RNA Guide
caaucaggggggcgccgcagaa

SEQ ID NO: 5647 - RNA, 22 nt, Artificial Sequence
  ELANE RNA Guide
cacuucugcggcgccccccuga

SEQ ID NO: 5648 - RNA, 22 nt, Artificial Sequence
  ELANE RNA Guide
caggggggcgccgcagaagugg

SEQ ID NO: 5649 - RNA, 22 nt, Artificial Sequence
  ELANE RNA Guide
ccacuucugcggcgccccccug

SEQ ID NO: 5650 - RNA, 22 nt, Artificial Sequence
  ELANE RNA Guide
ccccccugauugcgcccaacuu

SEQ ID NO: 5651 - RNA, 22 nt, Artificial Sequence
  ELANE RNA Guide
cccccugauugcgcccaacuuc

SEQ ID NO: 5652 - RNA, 22 nt, Artificial Sequence
  ELANE RNA Guide
cgaaguugggcgcaaucagggg

SEQ ID NO: 5653 - RNA, 22 nt, Artificial Sequence
  ELANE RNA Guide
cgcaaucaggggggcgccgcag

SEQ ID NO: 5654 - RNA, 22 nt, Artificial Sequence
  ELANE RNA Guide
cgccccccugauugcgcccaac

SEQ ID NO: 5655 - RNA, 22 nt, Artificial Sequence
  ELANE RNA Guide
cggaggccacuucugcggcgcc

SEQ ID NO: 5656 - RNA, 22 nt, Artificial Sequence
  ELANE RNA Guide
cugcggcgccccccugauugcg

SEQ ID NO: 5657 - RNA, 22 nt, Artificial Sequence
  ELANE RNA Guide
cuucugcggcgccccccugauu

SEQ ID NO: 5658 - RNA, 22 nt, Artificial Sequence
  ELANE RNA Guide
gaaguugggcgcaaucaggggg

SEQ ID NO: 5659 - RNA, 22 nt, Artificial Sequence
  ELANE RNA Guide
gaggccacuucugcggcgcccc

SEQ ID NO: 5660 - RNA, 22 nt, Artificial Sequence
  ELANE RNA Guide
gcaaucaggggggcgccgcaga

SEQ ID NO: 5661 - RNA, 22 nt, Artificial Sequence
  ELANE RNA Guide
gccacuucugcggcgccccccu

SEQ ID NO: 5662 - RNA, 22 nt, Artificial Sequence
  ELANE RNA Guide
gccccccugauugcgcccaacu

SEQ ID NO: 5663 - RNA, 22 nt, Artificial Sequence
  ELANE RNA Guide
gcgcaaucaggggggcgccgca

SEQ ID NO: 5664 - RNA, 22 nt, Artificial Sequence
  ELANE RNA Guide
gcgccccccugauugcgcccaa

SEQ ID NO: 5665 - RNA, 22 nt, Artificial Sequence
  ELANE RNA Guide
gcggaggccacuucugcggcgc

SEQ ID NO: 5666 - RNA, 22 nt, Artificial Sequence
  ELANE RNA Guide
ggaggccacuucugcggcgccc

SEQ ID NO: 5667 - RNA, 22 nt, Artificial Sequence
  ELANE RNA Guide
ggcgccccccugauugcgccca

SEQ ID NO: 5668 - RNA, 22 nt, Artificial Sequence
  ELANE RNA Guide
ggggcgccgcagaaguggccuc

SEQ ID NO: 5669 - RNA, 22 nt, Artificial Sequence
  ELANE RNA Guide
gggggcgccgcagaaguggccu

SEQ ID NO: 5670 - RNA, 22 nt, Artificial Sequence
  ELANE RNA Guide
guugggcgcaaucaggggggcg

SEQ ID NO: 5671 - RNA, 22 nt, Artificial Sequence
  ELANE RNA Guide
ucaggggggcgccgcagaagug

SEQ ID NO: 5672 - RNA, 22 nt, Artificial Sequence
  ELANE RNA Guide
ucugcggcgccccccugauugc

SEQ ID NO: 5673 - RNA, 22 nt, Artificial Sequence
  ELANE RNA Guide
ugacgaaguugggcgcaaucag

SEQ ID NO: 5674 - RNA, 22 nt, Artificial Sequence
  ELANE RNA Guide
ugcggcgccccccugauugcgc

SEQ ID NO: 5675 - RNA, 22 nt, Artificial Sequence
  ELANE RNA Guide
ugggcgcaaucaggggggcgcc

SEQ ID NO: 5676 - RNA, 22 nt, Artificial Sequence
  ELANE RNA Guide
uucugcggcgccccccugauug

SEQ ID NO: 5677 - RNA, 22 nt, Artificial Sequence
  ELANE RNA Guide
uugggcgcaaucaggggggcgc

SEQ ID NO: 5678 - RNA, 20 nt, Artificial Sequence
  ELANE RNA Guide
aaguugggcgcaaucggggu

SEQ ID NO: 5679 - RNA, 20 nt, Artificial Sequence
  ELANE RNA Guide
aaucgggguggcgccgcaga

SEQ ID NO: 5680 - RNA, 20 nt, Artificial Sequence
  ELANE RNA Guide
acaugacgaaguugggcgca

SEQ ID NO: 5681 - RNA, 20 nt, Artificial Sequence
  ELANE RNA Guide
accccgauugcgcccaacuu

SEQ ID NO: 5682 - RNA, 20 nt, Artificial Sequence
  ELANE RNA Guide
acgaaguugggcgcaaucgg

SEQ ID NO: 5683 - RNA, 20 nt, Artificial Sequence
  ELANE RNA Guide
acuucugcggcgccaccccg

SEQ ID NO: 5684 - RNA, 20 nt, Artificial Sequence
  ELANE RNA Guide
aggccacuucugcggcgcca

SEQ ID NO: 5685 - RNA, 20 nt, Artificial Sequence
  ELANE RNA Guide
aguugggcgcaaucggggug

SEQ ID NO: 5686 - RNA, 20 nt, Artificial Sequence
  ELANE RNA Guide
aucgggguggcgccgcagaa

SEQ ID NO: 5687 - RNA, 20 nt, Artificial Sequence
  ELANE RNA Guide
augacgaaguugggcgcaau

SEQ ID NO: 5688 - RNA, 20 nt, Artificial Sequence
  ELANE RNA Guide
caaucgggguggcgccgcag

SEQ ID NO: 5689 - RNA, 20 nt, Artificial Sequence
  ELANE RNA Guide
caccccgauugcgcccaacu

SEQ ID NO: 5690 - RNA, 20 nt, Artificial Sequence
  ELANE RNA Guide
cacuucugcggcgccacccc

SEQ ID NO: 5691 - RNA, 20 nt, Artificial Sequence
  ELANE RNA Guide
caugacgaaguugggcgcaa

SEQ ID NO: 5692 - RNA, 20 nt, Artificial Sequence
  ELANE RNA Guide
ccaccccgauugcgcccaac

SEQ ID NO: 5693 - RNA, 20 nt, Artificial Sequence
  ELANE RNA Guide
ccacuucugcggcgccaccc

SEQ ID NO: 5694 - RNA, 20 nt, Artificial Sequence
  ELANE RNA Guide
ccccgauugcgcccaacuuc

SEQ ID NO: 5695 - RNA, 20 nt, Artificial Sequence
  ELANE RNA Guide
cccgauugcgcccaacuucg

SEQ ID NO: 5696 - RNA, 20 nt, Artificial Sequence
  ELANE RNA Guide
ccgauugcgcccaacuucgu

SEQ ID NO: 5697 - RNA, 20 nt, Artificial Sequence
  ELANE RNA Guide
cgaaguugggcgcaaucggg

SEQ ID NO: 5698 - RNA, 20 nt, Artificial Sequence
  ELANE RNA Guide
cgcaaucgggguggcgccgc

SEQ ID NO: 5699 - RNA, 20 nt, Artificial Sequence
  ELANE RNA Guide
cgccaccccgauugcgccca

SEQ ID NO: 5700 - RNA, 20 nt, Artificial Sequence
  ELANE RNA Guide
cggcgccaccccgauugcgc

SEQ ID NO: 5701 - RNA, 20 nt, Artificial Sequence
  ELANE RNA Guide
cgggguggcgccgcagaagu

SEQ ID NO: 5702 - RNA, 20 nt, Artificial Sequence
  ELANE RNA Guide
cugcggcgccaccccgauug

SEQ ID NO: 5703 - RNA, 20 nt, Artificial Sequence
  ELANE RNA Guide
cuucugcggcgccaccccga

SEQ ID NO: 5704 - RNA, 20 nt, Artificial Sequence
  ELANE RNA Guide
gaaguugggcgcaaucgggg

SEQ ID NO: 5705 - RNA, 20 nt, Artificial Sequence
  ELANE RNA Guide
gacgaaguugggcgcaaucg

SEQ ID NO: 5706 - RNA, 20 nt, Artificial Sequence
  ELANE RNA Guide
gcaaucgggguggcgccgca

SEQ ID NO: 5707 - RNA, 20 nt, Artificial Sequence
  ELANE RNA Guide
gccaccccgauugcgcccaa

SEQ ID NO: 5708 - RNA, 20 nt, Artificial Sequence
  ELANE RNA Guide
gccacuucugcggcgccacc

SEQ ID NO: 5709 - RNA, 20 nt, Artificial Sequence
  ELANE RNA Guide
gcgcaaucgggguggcgccg

SEQ ID NO: 5710 - RNA, 20 nt, Artificial Sequence
  ELANE RNA Guide
gcgccaccccgauugcgccc

SEQ ID NO: 5711 - RNA, 20 nt, Artificial Sequence
  ELANE RNA Guide
gcggcgccaccccgauugcg

SEQ ID NO: 5712 - RNA, 20 nt, Artificial Sequence
  ELANE RNA Guide
ggccacuucugcggcgccac

SEQ ID NO: 5713 - RNA, 20 nt, Artificial Sequence
  ELANE RNA Guide
ggcgcaaucgggguggcgcc

SEQ ID NO: 5714 - RNA, 20 nt, Artificial Sequence
  ELANE RNA Guide
ggcgccaccccgauugcgcc

SEQ ID NO: 5715 - RNA, 20 nt, Artificial Sequence
  ELANE RNA Guide
gggcgcaaucgggguggcgc

SEQ ID NO: 5716 - RNA, 20 nt, Artificial Sequence
  ELANE RNA Guide
guugggcgcaaucggggugg

SEQ ID NO: 5717 - RNA, 20 nt, Artificial Sequence
  ELANE RNA Guide
ucgggguggcgccgcagaag

SEQ ID NO: 5718 - RNA, 20 nt, Artificial Sequence
  ELANE RNA Guide
ucugcggcgccaccccgauu

SEQ ID NO: 5719 - RNA, 20 nt, Artificial Sequence
  ELANE RNA Guide
ugacgaaguugggcgcaauc

SEQ ID NO: 5720 - RNA, 20 nt, Artificial Sequence
  ELANE RNA Guide
ugcggcgccaccccgauugc

SEQ ID NO: 5721 - RNA, 20 nt, Artificial Sequence
  ELANE RNA Guide
ugggcgcaaucgggguggcg

SEQ ID NO: 5722 - RNA, 20 nt, Artificial Sequence
  ELANE RNA Guide
uucugcggcgccaccccgau

SEQ ID NO: 5723 - RNA, 20 nt, Artificial Sequence
  ELANE RNA Guide
uugggcgcaaucgggguggc

SEQ ID NO: 5724 - RNA, 21 nt, Artificial Sequence
  ELANE RNA Guide
aaguugggcgcaaucggggug

SEQ ID NO: 5725 - RNA, 21 nt, Artificial Sequence
  ELANE RNA Guide
aaucgggguggcgccgcagaa

SEQ ID NO: 5726 - RNA, 21 nt, Artificial Sequence
  ELANE RNA Guide
acaugacgaaguugggcgcaa

SEQ ID NO: 5727 - RNA, 21 nt, Artificial Sequence
  ELANE RNA Guide
accccgauugcgcccaacuuc

SEQ ID NO: 5728 - RNA, 21 nt, Artificial Sequence
  ELANE RNA Guide
acgaaguugggcgcaaucggg

SEQ ID NO: 5729 - RNA, 21 nt, Artificial Sequence
  ELANE RNA Guide
acuucugcggcgccaccccga

SEQ ID NO: 5730 - RNA, 21 nt, Artificial Sequence
  ELANE RNA Guide
aggccacuucugcggcgccac

SEQ ID NO: 5731 - RNA, 21 nt, Artificial Sequence
  ELANE RNA Guide
aguugggcgcaaucggggugg

SEQ ID NO: 5732 - RNA, 21 nt, Artificial Sequence
  ELANE RNA Guide
aucgggguggcgccgcagaag

SEQ ID NO: 5733 - RNA, 21 nt, Artificial Sequence
  ELANE RNA Guide
augacgaaguugggcgcaauc

SEQ ID NO: 5734 - RNA, 21 nt, Artificial Sequence
  ELANE RNA Guide
caaucgggguggcgccgcaga

SEQ ID NO: 5735 - RNA, 21 nt, Artificial Sequence
  ELANE RNA Guide
caccccgauugcgcccaacuu

SEQ ID NO: 5736 - RNA, 21 nt, Artificial Sequence
  ELANE RNA Guide
cacuucugcggcgccaccccg

SEQ ID NO: 5737 - RNA, 21 nt, Artificial Sequence
  ELANE RNA Guide
caugacgaaguugggcgcaau

SEQ ID NO: 5738 - RNA, 21 nt, Artificial Sequence
  ELANE RNA Guide
ccaccccgauugcgcccaacu

SEQ ID NO: 5739 - RNA, 21 nt, Artificial Sequence
  ELANE RNA Guide
ccacuucugcggcgccacccc

SEQ ID NO: 5740 - RNA, 21 nt, Artificial Sequence
  ELANE RNA Guide
ccccgauugcgcccaacuucg

SEQ ID NO: 5741 - RNA, 21 nt, Artificial Sequence
  ELANE RNA Guide
cccgauugcgcccaacuucgu

SEQ ID NO: 5742 - RNA, 21 nt, Artificial Sequence
  ELANE RNA Guide
ccgauugcgcccaacuucguc

SEQ ID NO: 5743 - RNA, 21 nt, Artificial Sequence
  ELANE RNA Guide
cgaaguugggcgcaaucgggg

SEQ ID NO: 5744 - RNA, 21 nt, Artificial Sequence
  ELANE RNA Guide
cgcaaucgggguggcgccgca

SEQ ID NO: 5745 - RNA, 21 nt, Artificial Sequence
  ELANE RNA Guide
cgccaccccgauugcgcccaa

SEQ ID NO: 5746 - RNA, 21 nt, Artificial Sequence
  ELANE RNA Guide
cgggguggcgccgcagaagug

SEQ ID NO: 5747 - RNA, 21 nt, Artificial Sequence
  ELANE RNA Guide
cugcggcgccaccccgauugc

SEQ ID NO: 5748 - RNA, 21 nt, Artificial Sequence
  ELANE RNA Guide
cuucugcggcgccaccccgau

SEQ ID NO: 5749 - RNA, 21 nt, Artificial Sequence
  ELANE RNA Guide
gaaguugggcgcaaucggggu

SEQ ID NO: 5750 - RNA, 21 nt, Artificial Sequence
  ELANE RNA Guide
gacaugacgaaguugggcgca

SEQ ID NO: 5751 - RNA, 21 nt, Artificial Sequence
  ELANE RNA Guide
gacgaaguugggcgcaaucgg

SEQ ID NO: 5752 - RNA, 21 nt, Artificial Sequence
  ELANE RNA Guide
gaggccacuucugcggcgcca

SEQ ID NO: 5753 - RNA, 21 nt, Artificial Sequence
  ELANE RNA Guide
gcaaucgggguggcgccgcag

SEQ ID NO: 5754 - RNA, 21 nt, Artificial Sequence
  ELANE RNA Guide
gccaccccgauugcgcccaac

SEQ ID NO: 5755 - RNA, 21 nt, Artificial Sequence
  ELANE RNA Guide
gccacuucugcggcgccaccc

SEQ ID NO: 5756 - RNA, 21 nt, Artificial Sequence
  ELANE RNA Guide
gcgccaccccgauugcgccca

SEQ ID NO: 5757 - RNA, 21 nt, Artificial Sequence
  ELANE RNA Guide
ggccacuucugcggcgccacc

SEQ ID NO: 5758 - RNA, 21 nt, Artificial Sequence
  ELANE RNA Guide
guugggcgcaaucgggguggc

SEQ ID NO: 5759 - RNA, 21 nt, Artificial Sequence
  ELANE RNA Guide
ucgggguggcgccgcagaagu

SEQ ID NO: 5760 - RNA, 21 nt, Artificial Sequence
  ELANE RNA Guide
ucugcggcgccaccccgauug

SEQ ID NO: 5761 - RNA, 21 nt, Artificial Sequence
  ELANE RNA Guide
ugacgaaguugggcgcaaucg

SEQ ID NO: 5762 - RNA, 21 nt, Artificial Sequence
  ELANE RNA Guide
ugcggcgccaccccgauugcg

SEQ ID NO: 5763 - RNA, 21 nt, Artificial Sequence
  ELANE RNA Guide
ugggcgcaaucgggguggcgc

SEQ ID NO: 5764 - RNA, 21 nt, Artificial Sequence
  ELANE RNA Guide
uucugcggcgccaccccgauu

SEQ ID NO: 5765 - RNA, 21 nt, Artificial Sequence
  ELANE RNA Guide
uugggcgcaaucgggguggcg

SEQ ID NO: 5766 - RNA, 22 nt, Artificial Sequence
  ELANE RNA Guide
aaguugggcgcaaucggggugg

SEQ ID NO: 5767 - RNA, 22 nt, Artificial Sequence
  ELANE RNA Guide
aaucgggguggcgccgcagaag

SEQ ID NO: 5768 - RNA, 22 nt, Artificial Sequence
  ELANE RNA Guide
acaugacgaaguugggcgcaau

SEQ ID NO: 5769 - RNA, 22 nt, Artificial Sequence
  ELANE RNA Guide
accccgauugcgcccaacuucg

SEQ ID NO: 5770 - RNA, 22 nt, Artificial Sequence
  ELANE RNA Guide
acgaaguugggcgcaaucgggg

SEQ ID NO: 5771 - RNA, 22 nt, Artificial Sequence
  ELANE RNA Guide
acuucugcggcgccaccccgau

SEQ ID NO: 5772 - RNA, 22 nt, Artificial Sequence
  ELANE RNA Guide
aggccacuucugcggcgccacc

SEQ ID NO: 5773 - RNA, 22 nt, Artificial Sequence
  ELANE RNA Guide
aguugggcgcaaucgggguggc

SEQ ID NO: 5774 - RNA, 22 nt, Artificial Sequence
  ELANE RNA Guide
aucgggguggcgccgcagaagu

SEQ ID NO: 5775 - RNA, 22 nt, Artificial Sequence
  ELANE RNA Guide
augacgaaguugggcgcaaucg

SEQ ID NO: 5776 - RNA, 22 nt, Artificial Sequence
  ELANE RNA Guide
caaucgggguggcgccgcagaa

SEQ ID NO: 5777 - RNA, 22 nt, Artificial Sequence
  ELANE RNA Guide
caccccgauugcgcccaacuuc

SEQ ID NO: 5778 - RNA, 22 nt, Artificial Sequence
  ELANE RNA Guide
cacuucugcggcgccaccccga

SEQ ID NO: 5779 - RNA, 22 nt, Artificial Sequence
  ELANE RNA Guide
caugacgaaguugggcgcaauc

SEQ ID NO: 5780 - RNA, 22 nt, Artificial Sequence
  ELANE RNA Guide
ccaccccgauugcgcccaacuu

SEQ ID NO: 5781 - RNA, 22 nt, Artificial Sequence
  ELANE RNA Guide
ccacuucugcggcgccaccccg

SEQ ID NO: 5782 - RNA, 22 nt, Artificial Sequence
  ELANE RNA Guide
ccccgauugcgcccaacuucgu

SEQ ID NO: 5783 - RNA, 22 nt, Artificial Sequence
  ELANE RNA Guide
cccgauugcgcccaacuucguc

SEQ ID NO: 5784 - RNA, 22 nt, Artificial Sequence
  ELANE RNA Guide
ccgauugcgcccaacuucguca

SEQ ID NO: 5785 - RNA, 22 nt, Artificial Sequence
  ELANE RNA Guide
cgaaguugggcgcaaucggggu

SEQ ID NO: 5786 - RNA, 22 nt, Artificial Sequence
  ELANE RNA Guide
cgacaugacgaaguugggcgca

SEQ ID NO: 5787 - RNA, 22 nt, Artificial Sequence
  ELANE RNA Guide
cgcaaucgggguggcgccgcag

SEQ ID NO: 5788 - RNA, 22 nt, Artificial Sequence
  ELANE RNA Guide
cgccaccccgauugcgcccaac

SEQ ID NO: 5789 - RNA, 22 nt, Artificial Sequence
  ELANE RNA Guide
cgggguggcgccgcagaagugg

SEQ ID NO: 5790 - RNA, 22 nt, Artificial Sequence
  ELANE RNA Guide
cugcggcgccaccccgauugcg

SEQ ID NO: 5791 - RNA, 22 nt, Artificial Sequence
  ELANE RNA Guide
cuucugcggcgccaccccgauu

SEQ ID NO: 5792 - RNA, 22 nt, Artificial Sequence
  ELANE RNA Guide
gaaguugggcgcaaucggggug

SEQ ID NO: 5793 - RNA, 22 nt, Artificial Sequence
  ELANE RNA Guide
gacaugacgaaguugggcgcaa

SEQ ID NO: 5794 - RNA, 22 nt, Artificial Sequence
  ELANE RNA Guide
gacgaaguugggcgcaaucggg

SEQ ID NO: 5795 - RNA, 22 nt, Artificial Sequence
  ELANE RNA Guide
gaggccacuucugcggcgccac

SEQ ID NO: 5796 - RNA, 22 nt, Artificial Sequence
  ELANE RNA Guide
gcaaucgggguggcgccgcaga

SEQ ID NO: 5797 - RNA, 22 nt, Artificial Sequence
  ELANE RNA Guide
gccaccccgauugcgcccaacu

SEQ ID NO: 5798 - RNA, 22 nt, Artificial Sequence
  ELANE RNA Guide
gccacuucugcggcgccacccc

SEQ ID NO: 5799 - RNA, 22 nt, Artificial Sequence
  ELANE RNA Guide
gcgcaaucgggguggcgccgca

SEQ ID NO: 5800 - RNA, 22 nt, Artificial Sequence
  ELANE RNA Guide
gcgccaccccgauugcgcccaa

SEQ ID NO: 5801 - RNA, 22 nt, Artificial Sequence
  ELANE RNA Guide
ggaggccacuucugcggcgcca

SEQ ID NO: 5802 - RNA, 22 nt, Artificial Sequence
  ELANE RNA Guide
ggccacuucugcggcgccaccc

SEQ ID NO: 5803 - RNA, 22 nt, Artificial Sequence
  ELANE RNA Guide
ggcgccaccccgauugcgccca

SEQ ID NO: 5804 - RNA, 22 nt, Artificial Sequence
  ELANE RNA Guide
guugggcgcaaucgggguggcg

SEQ ID NO: 5805 - RNA, 22 nt, Artificial Sequence
  ELANE RNA Guide
ucgggguggcgccgcagaagug

SEQ ID NO: 5806 - RNA, 22 nt, Artificial Sequence
  ELANE RNA Guide
ucugcggcgccaccccgauugc

SEQ ID NO: 5807 - RNA, 22 nt, Artificial Sequence
  ELANE RNA Guide
ugacgaaguugggcgcaaucgg

SEQ ID NO: 5808 - RNA, 22 nt, Artificial Sequence
  ELANE RNA Guide
ugcggcgccaccccgauugcgc

SEQ ID NO: 5809 - RNA, 22 nt, Artificial Sequence
  ELANE RNA Guide
ugggcgcaaucgggguggcgcc

SEQ ID NO: 5810 - RNA, 22 nt, Artificial Sequence
  ELANE RNA Guide
uucugcggcgccaccccgauug

SEQ ID NO: 5811 - RNA, 22 nt, Artificial Sequence
  ELANE RNA Guide
uugggcgcaaucgggguggcgc

SEQ ID NO: 5812 - RNA, 20 nt, Artificial Sequence
  ELANE RNA Guide
aaguugggcgcaauccgggu

SEQ ID NO: 5813 - RNA, 20 nt, Artificial Sequence
  ELANE RNA Guide
aauccggguggcgccgcaga

SEQ ID NO: 5814 - RNA, 20 nt, Artificial Sequence
  ELANE RNA Guide
acccggauugcgcccaacuu

SEQ ID NO: 5815 - RNA, 20 nt, Artificial Sequence
  ELANE RNA Guide
acgaaguugggcgcaauccg

SEQ ID NO: 5816 - RNA, 20 nt, Artificial Sequence
  ELANE RNA Guide
acuucugcggcgccacccgg

SEQ ID NO: 5817 - RNA, 20 nt, Artificial Sequence
  ELANE RNA Guide
aguugggcgcaauccgggug

SEQ ID NO: 5818 - RNA, 20 nt, Artificial Sequence
  ELANE RNA Guide
auccggguggcgccgcagaa

SEQ ID NO: 5819 - RNA, 20 nt, Artificial Sequence
  ELANE RNA Guide
caauccggguggcgccgcag

SEQ ID NO: 5820 - RNA, 20 nt, Artificial Sequence
  ELANE RNA Guide
cacccggauugcgcccaacu

SEQ ID NO: 5821 - RNA, 20 nt, Artificial Sequence
  ELANE RNA Guide
cacuucugcggcgccacccg

SEQ ID NO: 5822 - RNA, 20 nt, Artificial Sequence
  ELANE RNA Guide
ccacccggauugcgcccaac

SEQ ID NO: 5823 - RNA, 20 nt, Artificial Sequence
  ELANE RNA Guide
cccggauugcgcccaacuuc

SEQ ID NO: 5824 - RNA, 20 nt, Artificial Sequence
  ELANE RNA Guide
ccggauugcgcccaacuucg

SEQ ID NO: 5825 - RNA, 20 nt, Artificial Sequence
  ELANE RNA Guide
ccggguggcgccgcagaagu

SEQ ID NO: 5826 - RNA, 20 nt, Artificial Sequence
  ELANE RNA Guide
cgaaguugggcgcaauccgg

SEQ ID NO: 5827 - RNA, 20 nt, Artificial Sequence
  ELANE RNA Guide
cgcaauccggguggcgccgc

SEQ ID NO: 5828 - RNA, 20 nt, Artificial Sequence
  ELANE RNA Guide
cgccacccggauugcgccca

SEQ ID NO: 5829 - RNA, 20 nt, Artificial Sequence
  ELANE RNA Guide
cggauugcgcccaacuucgu

SEQ ID NO: 5830 - RNA, 20 nt, Artificial Sequence
  ELANE RNA Guide
cggcgccacccggauugcgc

SEQ ID NO: 5831 - RNA, 20 nt, Artificial Sequence
  ELANE RNA Guide
cugcggcgccacccggauug

SEQ ID NO: 5832 - RNA, 20 nt, Artificial Sequence
  ELANE RNA Guide
cuucugcggcgccacccgga

SEQ ID NO: 5833 - RNA, 20 nt, Artificial Sequence
  ELANE RNA Guide
gaaguugggcgcaauccggg

SEQ ID NO: 5834 - RNA, 20 nt, Artificial Sequence
  ELANE RNA Guide
gacgaaguugggcgcaaucc

SEQ ID NO: 5835 - RNA, 20 nt, Artificial Sequence
  ELANE RNA Guide
gcaauccggguggcgccgca

SEQ ID NO: 5836 - RNA, 20 nt, Artificial Sequence
  ELANE RNA Guide
gccacccggauugcgcccaa

SEQ ID NO: 5837 - RNA, 20 nt, Artificial Sequence
  ELANE RNA Guide
gcgcaauccggguggcgccg

SEQ ID NO: 5838 - RNA, 20 nt, Artificial Sequence
  ELANE RNA Guide
gcgccacccggauugcgccc

SEQ ID NO: 5839 - RNA, 20 nt, Artificial Sequence
  ELANE RNA Guide
gcggcgccacccggauugcg

SEQ ID NO: 5840 - RNA, 20 nt, Artificial Sequence
  ELANE RNA Guide
ggcgcaauccggguggcgcc

SEQ ID NO: 5841 - RNA, 20 nt, Artificial Sequence
  ELANE RNA Guide
ggcgccacccggauugcgcc

SEQ ID NO: 5842 - RNA, 20 nt, Artificial Sequence
  ELANE RNA Guide
gggcgcaauccggguggcgc

SEQ ID NO: 5843 - RNA, 20 nt, Artificial Sequence
  ELANE RNA Guide
guugggcgcaauccgggugg

SEQ ID NO: 5844 - RNA, 20 nt, Artificial Sequence
  ELANE RNA Guide
uccggguggcgccgcagaag

SEQ ID NO: 5845 - RNA, 20 nt, Artificial Sequence
  ELANE RNA Guide
ucugcggcgccacccggauu

SEQ ID NO: 5846 - RNA, 20 nt, Artificial Sequence
  ELANE RNA Guide
ugcggcgccacccggauugc

SEQ ID NO: 5847 - RNA, 20 nt, Artificial Sequence
  ELANE RNA Guide
ugggcgcaauccggguggcg

SEQ ID NO: 5848 - RNA, 20 nt, Artificial Sequence
  ELANE RNA Guide
uucugcggcgccacccggau

SEQ ID NO: 5849 - RNA, 20 nt, Artificial Sequence
  ELANE RNA Guide
uugggcgcaauccggguggc

SEQ ID NO: 5850 - RNA, 21 nt, Artificial Sequence
  ELANE RNA Guide
aaguugggcgcaauccgggug

SEQ ID NO: 5851 - RNA, 21 nt, Artificial Sequence
  ELANE RNA Guide
aauccggguggcgccgcagaa

SEQ ID NO: 5852 - RNA, 21 nt, Artificial Sequence
  ELANE RNA Guide
acccggauugcgcccaacuuc

SEQ ID NO: 5853 - RNA, 21 nt, Artificial Sequence
  ELANE RNA Guide
acgaaguugggcgcaauccgg

SEQ ID NO: 5854 - RNA, 21 nt, Artificial Sequence
  ELANE RNA Guide
acuucugcggcgccacccgga

SEQ ID NO: 5855 - RNA, 21 nt, Artificial Sequence
  ELANE RNA Guide
aguugggcgcaauccgggugg

SEQ ID NO: 5856 - RNA, 21 nt, Artificial Sequence
  ELANE RNA Guide
auccggguggcgccgcagaag

SEQ ID NO: 5857 - RNA, 21 nt, Artificial Sequence
  ELANE RNA Guide
caauccggguggcgccgcaga

SEQ ID NO: 5858 - RNA, 21 nt, Artificial Sequence
  ELANE RNA Guide
cacccggauugcgcccaacuu

SEQ ID NO: 5859 - RNA, 21 nt, Artificial Sequence
  ELANE RNA Guide
cacuucugcggcgccacccgg

SEQ ID NO: 5860 - RNA, 21 nt, Artificial Sequence
  ELANE RNA Guide
ccacccggauugcgcccaacu

SEQ ID NO: 5861 - RNA, 21 nt, Artificial Sequence
  ELANE RNA Guide
ccacuucugcggcgccacccg

SEQ ID NO: 5862 - RNA, 21 nt, Artificial Sequence
  ELANE RNA Guide
cccggauugcgcccaacuucg

SEQ ID NO: 5863 - RNA, 21 nt, Artificial Sequence
  ELANE RNA Guide
ccggauugcgcccaacuucgu

SEQ ID NO: 5864 - RNA, 21 nt, Artificial Sequence
  ELANE RNA Guide
ccggguggcgccgcagaagug

SEQ ID NO: 5865 - RNA, 21 nt, Artificial Sequence
  ELANE RNA Guide
cgaaguugggcgcaauccggg

SEQ ID NO: 5866 - RNA, 21 nt, Artificial Sequence
  ELANE RNA Guide
cgcaauccggguggcgccgca

SEQ ID NO: 5867 - RNA, 21 nt, Artificial Sequence
  ELANE RNA Guide
cgccacccggauugcgcccaa

SEQ ID NO: 5868 - RNA, 21 nt, Artificial Sequence
  ELANE RNA Guide
cggauugcgcccaacuucguc

SEQ ID NO: 5869 - RNA, 21 nt, Artificial Sequence
  ELANE RNA Guide
cugcggcgccacccggauugc

SEQ ID NO: 5870 - RNA, 21 nt, Artificial Sequence
  ELANE RNA Guide
cuucugcggcgccacccggau

SEQ ID NO: 5871 - RNA, 21 nt, Artificial Sequence
  ELANE RNA Guide
gaaguugggcgcaauccgggu

SEQ ID NO: 5872 - RNA, 21 nt, Artificial Sequence
  ELANE RNA Guide
gacgaaguugggcgcaauccg

SEQ ID NO: 5873 - RNA, 21 nt, Artificial Sequence
  ELANE RNA Guide
gcaauccggguggcgccgcag

SEQ ID NO: 5874 - RNA, 21 nt, Artificial Sequence
  ELANE RNA Guide
gccacccggauugcgcccaac

SEQ ID NO: 5875 - RNA, 21 nt, Artificial Sequence
  ELANE RNA Guide
gcgccacccggauugcgccca

SEQ ID NO: 5876 - RNA, 21 nt, Artificial Sequence
  ELANE RNA Guide
guugggcgcaauccggguggc

SEQ ID NO: 5877 - RNA, 21 nt, Artificial Sequence
  ELANE RNA Guide
uccggguggcgccgcagaagu

SEQ ID NO: 5878 - RNA, 21 nt, Artificial Sequence
  ELANE RNA Guide
ucugcggcgccacccggauug

SEQ ID NO: 5879 - RNA, 21 nt, Artificial Sequence
  ELANE RNA Guide
ugacgaaguugggcgcaaucc

SEQ ID NO: 5880 - RNA, 21 nt, Artificial Sequence
  ELANE RNA Guide
ugcggcgccacccggauugcg

SEQ ID NO: 5881 - RNA, 21 nt, Artificial Sequence
  ELANE RNA Guide
ugggcgcaauccggguggcgc

SEQ ID NO: 5882 - RNA, 21 nt, Artificial Sequence
  ELANE RNA Guide
uucugcggcgccacccggauu

SEQ ID NO: 5883 - RNA, 21 nt, Artificial Sequence
  ELANE RNA Guide
uugggcgcaauccggguggcg

SEQ ID NO: 5884 - RNA, 22 nt, Artificial Sequence
  ELANE RNA Guide
aaguugggcgcaauccgggugg

SEQ ID NO: 5885 - RNA, 22 nt, Artificial Sequence
  ELANE RNA Guide
aauccggguggcgccgcagaag

SEQ ID NO: 5886 - RNA, 22 nt, Artificial Sequence
  ELANE RNA Guide
acccggauugcgcccaacuucg

SEQ ID NO: 5887 - RNA, 22 nt, Artificial Sequence
  ELANE RNA Guide
acgaaguugggcgcaauccggg

SEQ ID NO: 5888 - RNA, 22 nt, Artificial Sequence
  ELANE RNA Guide
acuucugcggcgccacccggau

SEQ ID NO: 5889 - RNA, 22 nt, Artificial Sequence
  ELANE RNA Guide
aguugggcgcaauccggguggc

SEQ ID NO: 5890 - RNA, 22 nt, Artificial Sequence
  ELANE RNA Guide
auccggguggcgccgcagaagu

SEQ ID NO: 5891 - RNA, 22 nt, Artificial Sequence
  ELANE RNA Guide
augacgaaguugggcgcaaucc

SEQ ID NO: 5892 - RNA, 22 nt, Artificial Sequence
  ELANE RNA Guide
caauccggguggcgccgcagaa

SEQ ID NO: 5893 - RNA, 22 nt, Artificial Sequence
  ELANE RNA Guide
cacccggauugcgcccaacuuc

SEQ ID NO: 5894 - RNA, 22 nt, Artificial Sequence
  ELANE RNA Guide
cacuucugcggcgccacccgga

SEQ ID NO: 5895 - RNA, 22 nt, Artificial Sequence
  ELANE RNA Guide
ccacccggauugcgcccaacuu

SEQ ID NO: 5896 - RNA, 22 nt, Artificial Sequence
  ELANE RNA Guide
ccacuucugcggcgccacccgg

SEQ ID NO: 5897 - RNA, 22 nt, Artificial Sequence
  ELANE RNA Guide
cccggauugcgcccaacuucgu

SEQ ID NO: 5898 - RNA, 22 nt, Artificial Sequence
  ELANE RNA Guide
ccggauugcgcccaacuucguc

SEQ ID NO: 5899 - RNA, 22 nt, Artificial Sequence
  ELANE RNA Guide
ccggguggcgccgcagaagugg

SEQ ID NO: 5900 - RNA, 22 nt, Artificial Sequence
  ELANE RNA Guide
cgaaguugggcgcaauccgggu

SEQ ID NO: 5901 - RNA, 22 nt, Artificial Sequence
  ELANE RNA Guide
cgcaauccggguggcgccgcag

SEQ ID NO: 5902 - RNA, 22 nt, Artificial Sequence
  ELANE RNA Guide
cgccacccggauugcgcccaac

SEQ ID NO: 5903 - RNA, 22 nt, Artificial Sequence
  ELANE RNA Guide
cggauugcgcccaacuucguca

SEQ ID NO: 5904 - RNA, 22 nt, Artificial Sequence
  ELANE RNA Guide
cugcggcgccacccggauugcg

SEQ ID NO: 5905 - RNA, 22 nt, Artificial Sequence
  ELANE RNA Guide
cuucugcggcgccacccggauu

SEQ ID NO: 5906 - RNA, 22 nt, Artificial Sequence
  ELANE RNA Guide
gaaguugggcgcaauccgggug

SEQ ID NO: 5907 - RNA, 22 nt, Artificial Sequence
  ELANE RNA Guide
gacgaaguugggcgcaauccgg

SEQ ID NO: 5908 - RNA, 22 nt, Artificial Sequence
  ELANE RNA Guide
gcaauccggguggcgccgcaga

SEQ ID NO: 5909 - RNA, 22 nt, Artificial Sequence
  ELANE RNA Guide
gccacccggauugcgcccaacu

SEQ ID NO: 5910 - RNA, 22 nt, Artificial Sequence
  ELANE RNA Guide
gccacuucugcggcgccacccg

SEQ ID NO: 5911 - RNA, 22 nt, Artificial Sequence
  ELANE RNA Guide
gcgcaauccggguggcgccgca

SEQ ID NO: 5912 - RNA, 22 nt, Artificial Sequence
  ELANE RNA Guide
gcgccacccggauugcgcccaa

SEQ ID NO: 5913 - RNA, 22 nt, Artificial Sequence
  ELANE RNA Guide
ggcgccacccggauugcgccca

SEQ ID NO: 5914 - RNA, 22 nt, Artificial Sequence
  ELANE RNA Guide
guugggcgcaauccggguggcg

SEQ ID NO: 5915 - RNA, 22 nt, Artificial Sequence
  ELANE RNA Guide
uccggguggcgccgcagaagug

SEQ ID NO: 5916 - RNA, 22 nt, Artificial Sequence
  ELANE RNA Guide
ucugcggcgccacccggauugc

SEQ ID NO: 5917 - RNA, 22 nt, Artificial Sequence
  ELANE RNA Guide
ugacgaaguugggcgcaauccg

SEQ ID NO: 5918 - RNA, 22 nt, Artificial Sequence
  ELANE RNA Guide
ugcggcgccacccggauugcgc

SEQ ID NO: 5919 - RNA, 22 nt, Artificial Sequence
  ELANE RNA Guide
ugggcgcaauccggguggcgcc

SEQ ID NO: 5920 - RNA, 22 nt, Artificial Sequence
  ELANE RNA Guide
uucugcggcgccacccggauug

SEQ ID NO: 5921 - RNA, 22 nt, Artificial Sequence
  ELANE RNA Guide
uugggcgcaauccggguggcgc

SEQ ID NO: 5922 - RNA, 20 nt, Artificial Sequence
  ELANE RNA Guide
aaguugggccucaggguggc

SEQ ID NO: 5923 - RNA, 20 nt, Artificial Sequence
  ELANE RNA Guide
acaugacgaaguugggccuc

SEQ ID NO: 5924 - RNA, 20 nt, Artificial Sequence
  ELANE RNA Guide
acccugaggcccaacuucgu

SEQ ID NO: 5925 - RNA, 20 nt, Artificial Sequence
  ELANE RNA Guide
acgaaguugggccucagggu

SEQ ID NO: 5926 - RNA, 20 nt, Artificial Sequence
  ELANE RNA Guide
acuucugcggcgccacccug

SEQ ID NO: 5927 - RNA, 20 nt, Artificial Sequence
  ELANE RNA Guide
aguugggccucaggguggcg

SEQ ID NO: 5928 - RNA, 20 nt, Artificial Sequence
  ELANE RNA Guide
augacgaaguugggccucag

SEQ ID NO: 5929 - RNA, 20 nt, Artificial Sequence
  ELANE RNA Guide
cacccugaggcccaacuucg

SEQ ID NO: 5930 - RNA, 20 nt, Artificial Sequence
  ELANE RNA Guide
cacuucugcggcgccacccu

SEQ ID NO: 5931 - RNA, 20 nt, Artificial Sequence
  ELANE RNA Guide
caugacgaaguugggccuca

SEQ ID NO: 5932 - RNA, 20 nt, Artificial Sequence
  ELANE RNA Guide
ccacccugaggcccaacuuc

SEQ ID NO: 5933 - RNA, 20 nt, Artificial Sequence
  ELANE RNA Guide
cccugaggcccaacuucguc

SEQ ID NO: 5934 - RNA, 20 nt, Artificial Sequence
  ELANE RNA Guide
ccgacaugacgaaguugggc

SEQ ID NO: 5935 - RNA, 20 nt, Artificial Sequence
  ELANE RNA Guide
ccucaggguggcgccgcaga

SEQ ID NO: 5936 - RNA, 20 nt, Artificial Sequence
  ELANE RNA Guide
ccugaggcccaacuucguca

SEQ ID NO: 5937 - RNA, 20 nt, Artificial Sequence
  ELANE RNA Guide
cgaaguugggccucagggug

SEQ ID NO: 5938 - RNA, 20 nt, Artificial Sequence
  ELANE RNA Guide
cgacaugacgaaguugggcc

SEQ ID NO: 5939 - RNA, 20 nt, Artificial Sequence
  ELANE RNA Guide
cgccacccugaggcccaacu

SEQ ID NO: 5940 - RNA, 20 nt, Artificial Sequence
  ELANE RNA Guide
cggcgccacccugaggccca

SEQ ID NO: 5941 - RNA, 20 nt, Artificial Sequence
  ELANE RNA Guide
cucaggguggcgccgcagaa

SEQ ID NO: 5942 - RNA, 20 nt, Artificial Sequence
  ELANE RNA Guide
cugaggcccaacuucgucau

SEQ ID NO: 5943 - RNA, 20 nt, Artificial Sequence
  ELANE RNA Guide
cugcggcgccacccugaggc

SEQ ID NO: 5944 - RNA, 20 nt, Artificial Sequence
  ELANE RNA Guide
cuucugcggcgccacccuga

SEQ ID NO: 5945 - RNA, 20 nt, Artificial Sequence
  ELANE RNA Guide
gaaguugggccucagggugg

SEQ ID NO: 5946 - RNA, 20 nt, Artificial Sequence
  ELANE RNA Guide
gacaugacgaaguugggccu

SEQ ID NO: 5947 - RNA, 20 nt, Artificial Sequence
  ELANE RNA Guide
gacgaaguugggccucaggg

SEQ ID NO: 5948 - RNA, 20 nt, Artificial Sequence
  ELANE RNA Guide
gaggcccaacuucgucaugu

SEQ ID NO: 5949 - RNA, 20 nt, Artificial Sequence
  ELANE RNA Guide
gccacccugaggcccaacuu

SEQ ID NO: 5950 - RNA, 20 nt, Artificial Sequence
  ELANE RNA Guide
gccgacaugacgaaguuggg

SEQ ID NO: 5951 - RNA, 20 nt, Artificial Sequence
  ELANE RNA Guide
gccucaggguggcgccgcag

SEQ ID NO: 5952 - RNA, 20 nt, Artificial Sequence
  ELANE RNA Guide
gcgccacccugaggcccaac

SEQ ID NO: 5953 - RNA, 20 nt, Artificial Sequence
  ELANE RNA Guide
ggccgacaugacgaaguugg

SEQ ID NO: 5954 - RNA, 20 nt, Artificial Sequence
  ELANE RNA Guide
ggccucaggguggcgccgca

SEQ ID NO: 5955 - RNA, 20 nt, Artificial Sequence
  ELANE RNA Guide
ggcgccacccugaggcccaa

SEQ ID NO: 5956 - RNA, 20 nt, Artificial Sequence
  ELANE RNA Guide
guugggccucaggguggcgc

SEQ ID NO: 5957 - RNA, 20 nt, Artificial Sequence
  ELANE RNA Guide
ucugcggcgccacccugagg

SEQ ID NO: 5958 - RNA, 20 nt, Artificial Sequence
  ELANE RNA Guide
ugacgaaguugggccucagg

SEQ ID NO: 5959 - RNA, 20 nt, Artificial Sequence
  ELANE RNA Guide
ugaggcccaacuucgucaug

SEQ ID NO: 5960 - RNA, 20 nt, Artificial Sequence
  ELANE RNA Guide
ugcggcgccacccugaggcc

SEQ ID NO: 5961 - RNA, 20 nt, Artificial Sequence
  ELANE RNA Guide
ugggccucaggguggcgccg

SEQ ID NO: 5962 - RNA, 20 nt, Artificial Sequence
  ELANE RNA Guide
uucugcggcgccacccugag

SEQ ID NO: 5963 - RNA, 20 nt, Artificial Sequence
  ELANE RNA Guide
uugggccucaggguggcgcc

SEQ ID NO: 5964 - RNA, 21 nt, Artificial Sequence
  ELANE RNA Guide
aaguugggccucaggguggcg

SEQ ID NO: 5965 - RNA, 21 nt, Artificial Sequence
  ELANE RNA Guide
acaugacgaaguugggccuca

SEQ ID NO: 5966 - RNA, 21 nt, Artificial Sequence
  ELANE RNA Guide
acccugaggcccaacuucguc

SEQ ID NO: 5967 - RNA, 21 nt, Artificial Sequence
  ELANE RNA Guide
acgaaguugggccucagggug

SEQ ID NO: 5968 - RNA, 21 nt, Artificial Sequence
  ELANE RNA Guide
acuucugcggcgccacccuga

SEQ ID NO: 5969 - RNA, 21 nt, Artificial Sequence
  ELANE RNA Guide
aguugggccucaggguggcgc

SEQ ID NO: 5970 - RNA, 21 nt, Artificial Sequence
  ELANE RNA Guide
augacgaaguugggccucagg

SEQ ID NO: 5971 - RNA, 21 nt, Artificial Sequence
  ELANE RNA Guide
cacccugaggcccaacuucgu

SEQ ID NO: 5972 - RNA, 21 nt, Artificial Sequence
  ELANE RNA Guide
cacuucugcggcgccacccug

SEQ ID NO: 5973 - RNA, 21 nt, Artificial Sequence
  ELANE RNA Guide
caugacgaaguugggccucag

SEQ ID NO: 5974 - RNA, 21 nt, Artificial Sequence
  ELANE RNA Guide
ccacccugaggcccaacuucg

SEQ ID NO: 5975 - RNA, 21 nt, Artificial Sequence
  ELANE RNA Guide
ccacuucugcggcgccacccu

SEQ ID NO: 5976 - RNA, 21 nt, Artificial Sequence
  ELANE RNA Guide
cccugaggcccaacuucguca

SEQ ID NO: 5977 - RNA, 21 nt, Artificial Sequence
  ELANE RNA Guide
ccgacaugacgaaguugggcc

SEQ ID NO: 5978 - RNA, 21 nt, Artificial Sequence
  ELANE RNA Guide
ccucaggguggcgccgcagaa

SEQ ID NO: 5979 - RNA, 21 nt, Artificial Sequence
  ELANE RNA Guide
ccugaggcccaacuucgucau

SEQ ID NO: 5980 - RNA, 21 nt, Artificial Sequence
  ELANE RNA Guide
cgaaguugggccucagggugg

SEQ ID NO: 5981 - RNA, 21 nt, Artificial Sequence
  ELANE RNA Guide
cgacaugacgaaguugggccu

SEQ ID NO: 5982 - RNA, 21 nt, Artificial Sequence
  ELANE RNA Guide
cgccacccugaggcccaacuu

SEQ ID NO: 5983 - RNA, 21 nt, Artificial Sequence
  ELANE RNA Guide
cggccgacaugacgaaguugg

SEQ ID NO: 5984 - RNA, 21 nt, Artificial Sequence
  ELANE RNA Guide
cggcgccacccugaggcccaa

SEQ ID NO: 5985 - RNA, 21 nt, Artificial Sequence
  ELANE RNA Guide
cucaggguggcgccgcagaag

SEQ ID NO: 5986 - RNA, 21 nt, Artificial Sequence
  ELANE RNA Guide
cugaggcccaacuucgucaug

SEQ ID NO: 5987 - RNA, 21 nt, Artificial Sequence
  ELANE RNA Guide
cuucugcggcgccacccugag

SEQ ID NO: 5988 - RNA, 21 nt, Artificial Sequence
  ELANE RNA Guide
gaaguugggccucaggguggc

SEQ ID NO: 5989 - RNA, 21 nt, Artificial Sequence
  ELANE RNA Guide
gacaugacgaaguugggccuc

SEQ ID NO: 5990 - RNA, 21 nt, Artificial Sequence
  ELANE RNA Guide
gacgaaguugggccucagggu

SEQ ID NO: 5991 - RNA, 21 nt, Artificial Sequence
  ELANE RNA Guide
gaggcccaacuucgucauguc

SEQ ID NO: 5992 - RNA, 21 nt, Artificial Sequence
  ELANE RNA Guide
gccacccugaggcccaacuuc

SEQ ID NO: 5993 - RNA, 21 nt, Artificial Sequence
  ELANE RNA Guide
gccgacaugacgaaguugggc

SEQ ID NO: 5994 - RNA, 21 nt, Artificial Sequence
  ELANE RNA Guide
gccucaggguggcgccgcaga

SEQ ID NO: 5995 - RNA, 21 nt, Artificial Sequence
  ELANE RNA Guide
gcgccacccugaggcccaacu

SEQ ID NO: 5996 - RNA, 21 nt, Artificial Sequence
  ELANE RNA Guide
ggccgacaugacgaaguuggg

SEQ ID NO: 5997 - RNA, 21 nt, Artificial Sequence
  ELANE RNA Guide
ggcgccacccugaggcccaac

SEQ ID NO: 5998 - RNA, 21 nt, Artificial Sequence
  ELANE RNA Guide
guugggccucaggguggcgcc

SEQ ID NO: 5999 - RNA, 21 nt, Artificial Sequence
  ELANE RNA Guide
ucugcggcgccacccugaggc

SEQ ID NO: 6000 - RNA, 21 nt, Artificial Sequence
  ELANE RNA Guide
ugacgaaguugggccucaggg

SEQ ID NO: 6001 - RNA, 21 nt, Artificial Sequence
  ELANE RNA Guide
ugaggcccaacuucgucaugu

SEQ ID NO: 6002 - RNA, 21 nt, Artificial Sequence
  ELANE RNA Guide
uucugcggcgccacccugagg

SEQ ID NO: 6003 - RNA, 21 nt, Artificial Sequence
  ELANE RNA Guide
uugggccucaggguggcgccg

SEQ ID NO: 6004 - RNA, 22 nt, Artificial Sequence
  ELANE RNA Guide
aaguugggccucaggguggcgc

SEQ ID NO: 6005 - RNA, 22 nt, Artificial Sequence
  ELANE RNA Guide
acaugacgaaguugggccucag

SEQ ID NO: 6006 - RNA, 22 nt, Artificial Sequence
  ELANE RNA Guide
acccugaggcccaacuucguca

SEQ ID NO: 6007 - RNA, 22 nt, Artificial Sequence
  ELANE RNA Guide
acgaaguugggccucagggugg

SEQ ID NO: 6008 - RNA, 22 nt, Artificial Sequence
  ELANE RNA Guide
acuucugcggcgccacccugag

SEQ ID NO: 6009 - RNA, 22 nt, Artificial Sequence
  ELANE RNA Guide
aguugggccucaggguggcgcc

SEQ ID NO: 6010 - RNA, 22 nt, Artificial Sequence
  ELANE RNA Guide
augacgaaguugggccucaggg

SEQ ID NO: 6011 - RNA, 22 nt, Artificial Sequence
  ELANE RNA Guide
cacccugaggcccaacuucguc

SEQ ID NO: 6012 - RNA, 22 nt, Artificial Sequence
  ELANE RNA Guide
cacuucugcggcgccacccuga

SEQ ID NO: 6013 - RNA, 22 nt, Artificial Sequence
  ELANE RNA Guide
caugacgaaguugggccucagg

SEQ ID NO: 6014 - RNA, 22 nt, Artificial Sequence
  ELANE RNA Guide
ccacccugaggcccaacuucgu

SEQ ID NO: 6015 - RNA, 22 nt, Artificial Sequence
  ELANE RNA Guide
ccacuucugcggcgccacccug

SEQ ID NO: 6016 - RNA, 22 nt, Artificial Sequence
  ELANE RNA Guide
cccugaggcccaacuucgucau

SEQ ID NO: 6017 - RNA, 22 nt, Artificial Sequence
  ELANE RNA Guide
ccgacaugacgaaguugggccu

SEQ ID NO: 6018 - RNA, 22 nt, Artificial Sequence
  ELANE RNA Guide
ccucaggguggcgccgcagaag

SEQ ID NO: 6019 - RNA, 22 nt, Artificial Sequence
  ELANE RNA Guide
ccugaggcccaacuucgucaug

SEQ ID NO: 6020 - RNA, 22 nt, Artificial Sequence
  ELANE RNA Guide
cgaaguugggccucaggguggc

SEQ ID NO: 6021 - RNA, 22 nt, Artificial Sequence
  ELANE RNA Guide
cgacaugacgaaguugggccuc

SEQ ID NO: 6022 - RNA, 22 nt, Artificial Sequence
  ELANE RNA Guide
cgccacccugaggcccaacuuc

SEQ ID NO: 6023 - RNA, 22 nt, Artificial Sequence
  ELANE RNA Guide
cggccgacaugacgaaguuggg

SEQ ID NO: 6024 - RNA, 22 nt, Artificial Sequence
  ELANE RNA Guide
cggcgccacccugaggcccaac

SEQ ID NO: 6025 - RNA, 22 nt, Artificial Sequence
  ELANE RNA Guide
cucaggguggcgccgcagaagu

SEQ ID NO: 6026 - RNA, 22 nt, Artificial Sequence
  ELANE RNA Guide
cugaggcccaacuucgucaugu

SEQ ID NO: 6027 - RNA, 22 nt, Artificial Sequence
  ELANE RNA Guide
cuucugcggcgccacccugagg

SEQ ID NO: 6028 - RNA, 22 nt, Artificial Sequence
  ELANE RNA Guide
gaaguugggccucaggguggcg

SEQ ID NO: 6029 - RNA, 22 nt, Artificial Sequence
  ELANE RNA Guide
gacaugacgaaguugggccuca

SEQ ID NO: 6030 - RNA, 22 nt, Artificial Sequence
  ELANE RNA Guide
gacgaaguugggccucagggug

SEQ ID NO: 6031 - RNA, 22 nt, Artificial Sequence
  ELANE RNA Guide
gaggcccaacuucgucaugucg

SEQ ID NO: 6032 - RNA, 22 nt, Artificial Sequence
  ELANE RNA Guide
gccacccugaggcccaacuucg

SEQ ID NO: 6033 - RNA, 22 nt, Artificial Sequence
  ELANE RNA Guide
gccacuucugcggcgccacccu

SEQ ID NO: 6034 - RNA, 22 nt, Artificial Sequence
  ELANE RNA Guide
gccgacaugacgaaguugggcc

SEQ ID NO: 6035 - RNA, 22 nt, Artificial Sequence
  ELANE RNA Guide
gccucaggguggcgccgcagaa

SEQ ID NO: 6036 - RNA, 22 nt, Artificial Sequence
  ELANE RNA Guide
gcgccacccugaggcccaacuu

SEQ ID NO: 6037 - RNA, 22 nt, Artificial Sequence
  ELANE RNA Guide
gcggccgacaugacgaaguugg

SEQ ID NO: 6038 - RNA, 22 nt, Artificial Sequence
  ELANE RNA Guide
gcggcgccacccugaggcccaa

SEQ ID NO: 6039 - RNA, 22 nt, Artificial Sequence
  ELANE RNA Guide
ggccgacaugacgaaguugggc

SEQ ID NO: 6040 - RNA, 22 nt, Artificial Sequence
  ELANE RNA Guide
ggccucaggguggcgccgcaga

SEQ ID NO: 6041 - RNA, 22 nt, Artificial Sequence
  ELANE RNA Guide
ggcgccacccugaggcccaacu

SEQ ID NO: 6042 - RNA, 22 nt, Artificial Sequence
  ELANE RNA Guide
guugggccucaggguggcgccg

SEQ ID NO: 6043 - RNA, 22 nt, Artificial Sequence
  ELANE RNA Guide
ucugcggcgccacccugaggcc

SEQ ID NO: 6044 - RNA, 22 nt, Artificial Sequence
  ELANE RNA Guide
ugacgaaguugggccucagggu

SEQ ID NO: 6045 - RNA, 22 nt, Artificial Sequence
  ELANE RNA Guide
ugaggcccaacuucgucauguc

SEQ ID NO: 6046 - RNA, 22 nt, Artificial Sequence
  ELANE RNA Guide
ugcggcgccacccugaggccca

SEQ ID NO: 6047 - RNA, 22 nt, Artificial Sequence
  ELANE RNA Guide
ugggccucaggguggcgccgca

SEQ ID NO: 6048 - RNA, 22 nt, Artificial Sequence
  ELANE RNA Guide
uucugcggcgccacccugaggc

SEQ ID NO: 6049 - RNA, 22 nt, Artificial Sequence
  ELANE RNA Guide
uugggccucaggguggcgccgc

SEQ ID NO: 6050 - RNA, 20 nt, Artificial Sequence
  ELANE RNA Guide
aaguugggcgcagucagggu

SEQ ID NO: 6051 - RNA, 20 nt, Artificial Sequence
  ELANE RNA Guide
acccugacugcgcccaacuu

SEQ ID NO: 6052 - RNA, 20 nt, Artificial Sequence
  ELANE RNA Guide
acgaaguugggcgcagucag

SEQ ID NO: 6053 - RNA, 20 nt, Artificial Sequence
  ELANE RNA Guide
acugcgcccaacuucgucau

SEQ ID NO: 6054 - RNA, 20 nt, Artificial Sequence
  ELANE RNA Guide
agucaggguggcgccgcaga

SEQ ID NO: 6055 - RNA, 20 nt, Artificial Sequence
  ELANE RNA Guide
aguugggcgcagucagggug

SEQ ID NO: 6056 - RNA, 20 nt, Artificial Sequence
  ELANE RNA Guide
augacgaaguugggcgcagu

SEQ ID NO: 6057 - RNA, 20 nt, Artificial Sequence
  ELANE RNA Guide
cacccugacugcgcccaacu

SEQ ID NO: 6058 - RNA, 20 nt, Artificial Sequence
  ELANE RNA Guide
cagucaggguggcgccgcag

SEQ ID NO: 6059 - RNA, 20 nt, Artificial Sequence
  ELANE RNA Guide
caugacgaaguugggcgcag

SEQ ID NO: 6060 - RNA, 20 nt, Artificial Sequence
  ELANE RNA Guide
ccacccugacugcgcccaac

SEQ ID NO: 6061 - RNA, 20 nt, Artificial Sequence
  ELANE RNA Guide
cccugacugcgcccaacuuc

SEQ ID NO: 6062 - RNA, 20 nt, Artificial Sequence
  ELANE RNA Guide
ccugacugcgcccaacuucg

SEQ ID NO: 6063 - RNA, 20 nt, Artificial Sequence
  ELANE RNA Guide
cgaaguugggcgcagucagg

SEQ ID NO: 6064 - RNA, 20 nt, Artificial Sequence
  ELANE RNA Guide
cgacaugacgaaguugggcg

SEQ ID NO: 6065 - RNA, 20 nt, Artificial Sequence
  ELANE RNA Guide
cgcagucaggguggcgccgc

SEQ ID NO: 6066 - RNA, 20 nt, Artificial Sequence
  ELANE RNA Guide
cgccacccugacugcgccca

SEQ ID NO: 6067 - RNA, 20 nt, Artificial Sequence
  ELANE RNA Guide
cggcgccacccugacugcgc

SEQ ID NO: 6068 - RNA, 20 nt, Artificial Sequence
  ELANE RNA Guide
cugacugcgcccaacuucgu

SEQ ID NO: 6069 - RNA, 20 nt, Artificial Sequence
  ELANE RNA Guide
cugcggcgccacccugacug

SEQ ID NO: 6070 - RNA, 20 nt, Artificial Sequence
  ELANE RNA Guide
gaaguugggcgcagucaggg

SEQ ID NO: 6071 - RNA, 20 nt, Artificial Sequence
  ELANE RNA Guide
gacaugacgaaguugggcgc

SEQ ID NO: 6072 - RNA, 20 nt, Artificial Sequence
  ELANE RNA Guide
gacgaaguugggcgcaguca

SEQ ID NO: 6073 - RNA, 20 nt, Artificial Sequence
  ELANE RNA Guide
gacugcgcccaacuucguca

SEQ ID NO: 6074 - RNA, 20 nt, Artificial Sequence
  ELANE RNA Guide
gcagucaggguggcgccgca

SEQ ID NO: 6075 - RNA, 20 nt, Artificial Sequence
  ELANE RNA Guide
gccacccugacugcgcccaa

SEQ ID NO: 6076 - RNA, 20 nt, Artificial Sequence
  ELANE RNA Guide
gcgcagucaggguggcgccg

SEQ ID NO: 6077 - RNA, 20 nt, Artificial Sequence
  ELANE RNA Guide
gcgccacccugacugcgccc

SEQ ID NO: 6078 - RNA, 20 nt, Artificial Sequence
  ELANE RNA Guide
gcggcgccacccugacugcg

SEQ ID NO: 6079 - RNA, 20 nt, Artificial Sequence
  ELANE RNA Guide
ggcgcagucaggguggcgcc

SEQ ID NO: 6080 - RNA, 20 nt, Artificial Sequence
  ELANE RNA Guide
ggcgccacccugacugcgcc

SEQ ID NO: 6081 - RNA, 20 nt, Artificial Sequence
  ELANE RNA Guide
gggcgcagucaggguggcgc

SEQ ID NO: 6082 - RNA, 20 nt, Artificial Sequence
  ELANE RNA Guide
guugggcgcagucagggugg

SEQ ID NO: 6083 - RNA, 20 nt, Artificial Sequence
  ELANE RNA Guide
ucugcggcgccacccugacu

SEQ ID NO: 6084 - RNA, 20 nt, Artificial Sequence
  ELANE RNA Guide
ugacgaaguugggcgcaguc

SEQ ID NO: 6085 - RNA, 20 nt, Artificial Sequence
  ELANE RNA Guide
ugacugcgcccaacuucguc

SEQ ID NO: 6086 - RNA, 20 nt, Artificial Sequence
  ELANE RNA Guide
ugcggcgccacccugacugc

SEQ ID NO: 6087 - RNA, 20 nt, Artificial Sequence
  ELANE RNA Guide
ugggcgcagucaggguggcg

SEQ ID NO: 6088 - RNA, 20 nt, Artificial Sequence
  ELANE RNA Guide
uucugcggcgccacccugac

SEQ ID NO: 6089 - RNA, 20 nt, Artificial Sequence
  ELANE RNA Guide
uugggcgcagucaggguggc

SEQ ID NO: 6090 - RNA, 21 nt, Artificial Sequence
  ELANE RNA Guide
aaguugggcgcagucagggug

SEQ ID NO: 6091 - RNA, 21 nt, Artificial Sequence
  ELANE RNA Guide
acaugacgaaguugggcgcag

SEQ ID NO: 6092 - RNA, 21 nt, Artificial Sequence
  ELANE RNA Guide
acccugacugcgcccaacuuc

SEQ ID NO: 6093 - RNA, 21 nt, Artificial Sequence
  ELANE RNA Guide
acgaaguugggcgcagucagg

SEQ ID NO: 6094 - RNA, 21 nt, Artificial Sequence
  ELANE RNA Guide
acugcgcccaacuucgucaug

SEQ ID NO: 6095 - RNA, 21 nt, Artificial Sequence
  ELANE RNA Guide
agucaggguggcgccgcagaa

SEQ ID NO: 6096 - RNA, 21 nt, Artificial Sequence
  ELANE RNA Guide
aguugggcgcagucagggugg

SEQ ID NO: 6097 - RNA, 21 nt, Artificial Sequence
  ELANE RNA Guide
augacgaaguugggcgcaguc

SEQ ID NO: 6098 - RNA, 21 nt, Artificial Sequence
  ELANE RNA Guide
cacccugacugcgcccaacuu

SEQ ID NO: 6099 - RNA, 21 nt, Artificial Sequence
  ELANE RNA Guide
cagucaggguggcgccgcaga

SEQ ID NO: 6100 - RNA, 21 nt, Artificial Sequence
  ELANE RNA Guide
caugacgaaguugggcgcagu

SEQ ID NO: 6101 - RNA, 21 nt, Artificial Sequence
  ELANE RNA Guide
ccacccugacugcgcccaacu

SEQ ID NO: 6102 - RNA, 21 nt, Artificial Sequence
  ELANE RNA Guide
cccugacugcgcccaacuucg

SEQ ID NO: 6103 - RNA, 21 nt, Artificial Sequence
  ELANE RNA Guide
ccgacaugacgaaguugggcg

SEQ ID NO: 6104 - RNA, 21 nt, Artificial Sequence
  ELANE RNA Guide
ccugacugcgcccaacuucgu

SEQ ID NO: 6105 - RNA, 21 nt, Artificial Sequence
  ELANE RNA Guide
cgaaguugggcgcagucaggg

SEQ ID NO: 6106 - RNA, 21 nt, Artificial Sequence
  ELANE RNA Guide
cgacaugacgaaguugggcgc

SEQ ID NO: 6107 - RNA, 21 nt, Artificial Sequence
  ELANE RNA Guide
cgcagucaggguggcgccgca

SEQ ID NO: 6108 - RNA, 21 nt, Artificial Sequence
  ELANE RNA Guide
cgccacccugacugcgcccaa

SEQ ID NO: 6109 - RNA, 21 nt, Artificial Sequence
  ELANE RNA Guide
cugacugcgcccaacuucguc

SEQ ID NO: 6110 - RNA, 21 nt, Artificial Sequence
  ELANE RNA Guide
cugcggcgccacccugacugc

SEQ ID NO: 6111 - RNA, 21 nt, Artificial Sequence
  ELANE RNA Guide
cuucugcggcgccacccugac

SEQ ID NO: 6112 - RNA, 21 nt, Artificial Sequence
  ELANE RNA Guide
gaaguugggcgcagucagggu

SEQ ID NO: 6113 - RNA, 21 nt, Artificial Sequence
  ELANE RNA Guide
gacgaaguugggcgcagucag

SEQ ID NO: 6114 - RNA, 21 nt, Artificial Sequence
  ELANE RNA Guide
gacugcgcccaacuucgucau

SEQ ID NO: 6115 - RNA, 21 nt, Artificial Sequence
  ELANE RNA Guide
gcagucaggguggcgccgcag

SEQ ID NO: 6116 - RNA, 21 nt, Artificial Sequence
  ELANE RNA Guide
gccacccugacugcgcccaac

SEQ ID NO: 6117 - RNA, 21 nt, Artificial Sequence
  ELANE RNA Guide
gcgccacccugacugcgccca

SEQ ID NO: 6118 - RNA, 21 nt, Artificial Sequence
  ELANE RNA Guide
guugggcgcagucaggguggc

SEQ ID NO: 6119 - RNA, 21 nt, Artificial Sequence
  ELANE RNA Guide
ucugcggcgccacccugacug

SEQ ID NO: 6120 - RNA, 21 nt, Artificial Sequence
  ELANE RNA Guide
ugacgaaguugggcgcaguca

SEQ ID NO: 6121 - RNA, 21 nt, Artificial Sequence
  ELANE RNA Guide
ugacugcgcccaacuucguca

SEQ ID NO: 6122 - RNA, 21 nt, Artificial Sequence
  ELANE RNA Guide
ugcggcgccacccugacugcg

SEQ ID NO: 6123 - RNA, 21 nt, Artificial Sequence
  ELANE RNA Guide
ugggcgcagucaggguggcgc

SEQ ID NO: 6124 - RNA, 21 nt, Artificial Sequence
  ELANE RNA Guide
uucugcggcgccacccugacu

SEQ ID NO: 6125 - RNA, 21 nt, Artificial Sequence
  ELANE RNA Guide
uugggcgcagucaggguggcg

SEQ ID NO: 6126 - RNA, 22 nt, Artificial Sequence
  ELANE RNA Guide
aaguugggcgcagucagggugg

SEQ ID NO: 6127 - RNA, 22 nt, Artificial Sequence
  ELANE RNA Guide
acaugacgaaguugggcgcagu

SEQ ID NO: 6128 - RNA, 22 nt, Artificial Sequence
  ELANE RNA Guide
acccugacugcgcccaacuucg

SEQ ID NO: 6129 - RNA, 22 nt, Artificial Sequence
  ELANE RNA Guide
acgaaguugggcgcagucaggg

SEQ ID NO: 6130 - RNA, 22 nt, Artificial Sequence
  ELANE RNA Guide
acugcgcccaacuucgucaugu

SEQ ID NO: 6131 - RNA, 22 nt, Artificial Sequence
  ELANE RNA Guide
acuucugcggcgccacccugac

SEQ ID NO: 6132 - RNA, 22 nt, Artificial Sequence
  ELANE RNA Guide
agucaggguggcgccgcagaag

SEQ ID NO: 6133 - RNA, 22 nt, Artificial Sequence
  ELANE RNA Guide
aguugggcgcagucaggguggc

SEQ ID NO: 6134 - RNA, 22 nt, Artificial Sequence
  ELANE RNA Guide
augacgaaguugggcgcaguca

SEQ ID NO: 6135 - RNA, 22 nt, Artificial Sequence
  ELANE RNA Guide
cacccugacugcgcccaacuuc

SEQ ID NO: 6136 - RNA, 22 nt, Artificial Sequence
  ELANE RNA Guide
cagucaggguggcgccgcagaa

SEQ ID NO: 6137 - RNA, 22 nt, Artificial Sequence
  ELANE RNA Guide
caugacgaaguugggcgcaguc

SEQ ID NO: 6138 - RNA, 22 nt, Artificial Sequence
  ELANE RNA Guide
ccacccugacugcgcccaacuu

SEQ ID NO: 6139 - RNA, 22 nt, Artificial Sequence
  ELANE RNA Guide
cccugacugcgcccaacuucgu

SEQ ID NO: 6140 - RNA, 22 nt, Artificial Sequence
  ELANE RNA Guide
ccgacaugacgaaguugggcgc

SEQ ID NO: 6141 - RNA, 22 nt, Artificial Sequence
  ELANE RNA Guide
ccugacugcgcccaacuucguc

SEQ ID NO: 6142 - RNA, 22 nt, Artificial Sequence
  ELANE RNA Guide
cgaaguugggcgcagucagggu

SEQ ID NO: 6143 - RNA, 22 nt, Artificial Sequence
  ELANE RNA Guide
cgcagucaggguggcgccgcag

SEQ ID NO: 6144 - RNA, 22 nt, Artificial Sequence
  ELANE RNA Guide
cgccacccugacugcgcccaac

SEQ ID NO: 6145 - RNA, 22 nt, Artificial Sequence
  ELANE RNA Guide
cugacugcgcccaacuucguca

SEQ ID NO: 6146 - RNA, 22 nt, Artificial Sequence
  ELANE RNA Guide
cugcggcgccacccugacugcg

SEQ ID NO: 6147 - RNA, 22 nt, Artificial Sequence
  ELANE RNA Guide
cuucugcggcgccacccugacu

SEQ ID NO: 6148 - RNA, 22 nt, Artificial Sequence
  ELANE RNA Guide
gaaguugggcgcagucagggug

SEQ ID NO: 6149 - RNA, 22 nt, Artificial Sequence
  ELANE RNA Guide
gacaugacgaaguugggcgcag

SEQ ID NO: 6150 - RNA, 22 nt, Artificial Sequence
  ELANE RNA Guide
gacgaaguugggcgcagucagg

SEQ ID NO: 6151 - RNA, 22 nt, Artificial Sequence
  ELANE RNA Guide
gacugcgcccaacuucgucaug

SEQ ID NO: 6152 - RNA, 22 nt, Artificial Sequence
  ELANE RNA Guide
gcagucaggguggcgccgcaga

SEQ ID NO: 6153 - RNA, 22 nt, Artificial Sequence
  ELANE RNA Guide
gccacccugacugcgcccaacu

SEQ ID NO: 6154 - RNA, 22 nt, Artificial Sequence
  ELANE RNA Guide
gccgacaugacgaaguugggcg

SEQ ID NO: 6155 - RNA, 22 nt, Artificial Sequence
  ELANE RNA Guide
gcgcagucaggguggcgccgca

SEQ ID NO: 6156 - RNA, 22 nt, Artificial Sequence
  ELANE RNA Guide
gcgccacccugacugcgcccaa

SEQ ID NO: 6157 - RNA, 22 nt, Artificial Sequence
  ELANE RNA Guide
ggcgccacccugacugcgccca

SEQ ID NO: 6158 - RNA, 22 nt, Artificial Sequence
  ELANE RNA Guide
guugggcgcagucaggguggcg

SEQ ID NO: 6159 - RNA, 22 nt, Artificial Sequence
  ELANE RNA Guide
ucugcggcgccacccugacugc

SEQ ID NO: 6160 - RNA, 22 nt, Artificial Sequence
  ELANE RNA Guide
ugacgaaguugggcgcagucag

SEQ ID NO: 6161 - RNA, 22 nt, Artificial Sequence
  ELANE RNA Guide
ugacugcgcccaacuucgucau

SEQ ID NO: 6162 - RNA, 22 nt, Artificial Sequence
  ELANE RNA Guide
ugcggcgccacccugacugcgc

SEQ ID NO: 6163 - RNA, 22 nt, Artificial Sequence
  ELANE RNA Guide
ugggcgcagucaggguggcgcc

SEQ ID NO: 6164 - RNA, 22 nt, Artificial Sequence
  ELANE RNA Guide
uucugcggcgccacccugacug

SEQ ID NO: 6165 - RNA, 22 nt, Artificial Sequence
  ELANE RNA Guide
uugggcgcagucaggguggcgc

SEQ ID NO: 6166 - RNA, 20 nt, Artificial Sequence
  ELANE RNA Guide
acacauucgccacgcagugc

SEQ ID NO: 6167 - RNA, 20 nt, Artificial Sequence
  ELANE RNA Guide
acauucgccacgcagugcgc

SEQ ID NO: 6168 - RNA, 20 nt, Artificial Sequence
  ELANE RNA Guide
acccugauugcgcacugcgu

SEQ ID NO: 6169 - RNA, 20 nt, Artificial Sequence
  ELANE RNA Guide
acgcagugcgcaaucagggu

SEQ ID NO: 6170 - RNA, 20 nt, Artificial Sequence
  ELANE RNA Guide
agugcgcaaucaggguggcg

SEQ ID NO: 6171 - RNA, 20 nt, Artificial Sequence
  ELANE RNA Guide
auucgccacgcagugcgcaa

SEQ ID NO: 6172 - RNA, 20 nt, Artificial Sequence
  ELANE RNA Guide
auugcgcacugcguggcgaa

SEQ ID NO: 6173 - RNA, 20 nt, Artificial Sequence
  ELANE RNA Guide
cacacauucgccacgcagug

SEQ ID NO: 6174 - RNA, 20 nt, Artificial Sequence
  ELANE RNA Guide
cacauucgccacgcagugcg

SEQ ID NO: 6175 - RNA, 20 nt, Artificial Sequence
  ELANE RNA Guide
cacccugauugcgcacugcg

SEQ ID NO: 6176 - RNA, 20 nt, Artificial Sequence
  ELANE RNA Guide
cacgcagugcgcaaucaggg

SEQ ID NO: 6177 - RNA, 20 nt, Artificial Sequence
  ELANE RNA Guide
cagugcgcaaucaggguggc

SEQ ID NO: 6178 - RNA, 20 nt, Artificial Sequence
  ELANE RNA Guide
cauucgccacgcagugcgca

SEQ ID NO: 6179 - RNA, 20 nt, Artificial Sequence
  ELANE RNA Guide
ccacccugauugcgcacugc

SEQ ID NO: 6180 - RNA, 20 nt, Artificial Sequence
  ELANE RNA Guide
ccacgcagugcgcaaucagg

SEQ ID NO: 6181 - RNA, 20 nt, Artificial Sequence
  ELANE RNA Guide
cccugauugcgcacugcgug

SEQ ID NO: 6182 - RNA, 20 nt, Artificial Sequence
  ELANE RNA Guide
ccugauugcgcacugcgugg

SEQ ID NO: 6183 - RNA, 20 nt, Artificial Sequence
  ELANE RNA Guide
cgcagugcgcaaucagggug

SEQ ID NO: 6184 - RNA, 20 nt, Artificial Sequence
  ELANE RNA Guide
cgccacccugauugcgcacu

SEQ ID NO: 6185 - RNA, 20 nt, Artificial Sequence
  ELANE RNA Guide
cgccacgcagugcgcaauca

SEQ ID NO: 6186 - RNA, 20 nt, Artificial Sequence
  ELANE RNA Guide
cggcgccacccugauugcgc

SEQ ID NO: 6187 - RNA, 20 nt, Artificial Sequence
  ELANE RNA Guide
cugauugcgcacugcguggc

SEQ ID NO: 6188 - RNA, 20 nt, Artificial Sequence
  ELANE RNA Guide
cugcggcgccacccugauug

SEQ ID NO: 6189 - RNA, 20 nt, Artificial Sequence
  ELANE RNA Guide
gauugcgcacugcguggcga

SEQ ID NO: 6190 - RNA, 20 nt, Artificial Sequence
  ELANE RNA Guide
gcagugcgcaaucagggugg

SEQ ID NO: 6191 - RNA, 20 nt, Artificial Sequence
  ELANE RNA Guide
gccacccugauugcgcacug

SEQ ID NO: 6192 - RNA, 20 nt, Artificial Sequence
  ELANE RNA Guide
gccacgcagugcgcaaucag

SEQ ID NO: 6193 - RNA, 20 nt, Artificial Sequence
  ELANE RNA Guide
gcgccacccugauugcgcac

SEQ ID NO: 6194 - RNA, 20 nt, Artificial Sequence
  ELANE RNA Guide
gcggcgccacccugauugcg

SEQ ID NO: 6195 - RNA, 20 nt, Artificial Sequence
  ELANE RNA Guide
ggcgccacccugauugcgca

SEQ ID NO: 6196 - RNA, 20 nt, Artificial Sequence
  ELANE RNA Guide
gugcgcaaucaggguggcgc

SEQ ID NO: 6197 - RNA, 20 nt, Artificial Sequence
  ELANE RNA Guide
ucgccacgcagugcgcaauc

SEQ ID NO: 6198 - RNA, 20 nt, Artificial Sequence
  ELANE RNA Guide
ugauugcgcacugcguggcg

SEQ ID NO: 6199 - RNA, 20 nt, Artificial Sequence
  ELANE RNA Guide
ugcgcaaucaggguggcgcc

SEQ ID NO: 6200 - RNA, 20 nt, Artificial Sequence
  ELANE RNA Guide
ugcggcgccacccugauugc

SEQ ID NO: 6201 - RNA, 20 nt, Artificial Sequence
  ELANE RNA Guide
uucgccacgcagugcgcaau

SEQ ID NO: 6202 - RNA, 20 nt, Artificial Sequence
  ELANE RNA Guide
uugcgcacugcguggcgaau

SEQ ID NO: 6203 - RNA, 21 nt, Artificial Sequence
  ELANE RNA Guide
acacauucgccacgcagugcg

SEQ ID NO: 6204 - RNA, 21 nt, Artificial Sequence
  ELANE RNA Guide
acauucgccacgcagugcgca

SEQ ID NO: 6205 - RNA, 21 nt, Artificial Sequence
  ELANE RNA Guide
acccugauugcgcacugcgug

SEQ ID NO: 6206 - RNA, 21 nt, Artificial Sequence
  ELANE RNA Guide
acgcagugcgcaaucagggug

SEQ ID NO: 6207 - RNA, 21 nt, Artificial Sequence
  ELANE RNA Guide
agugcgcaaucaggguggcgc

SEQ ID NO: 6208 - RNA, 21 nt, Artificial Sequence
  ELANE RNA Guide
auucgccacgcagugcgcaau

SEQ ID NO: 6209 - RNA, 21 nt, Artificial Sequence
  ELANE RNA Guide
auugcgcacugcguggcgaau

SEQ ID NO: 6210 - RNA, 21 nt, Artificial Sequence
  ELANE RNA Guide
cacacauucgccacgcagugc

SEQ ID NO: 6211 - RNA, 21 nt, Artificial Sequence
  ELANE RNA Guide
cacauucgccacgcagugcgc

SEQ ID NO: 6212 - RNA, 21 nt, Artificial Sequence
  ELANE RNA Guide
cacccugauugcgcacugcgu

SEQ ID NO: 6213 - RNA, 21 nt, Artificial Sequence
  ELANE RNA Guide
cacgcagugcgcaaucagggu

SEQ ID NO: 6214 - RNA, 21 nt, Artificial Sequence
  ELANE RNA Guide
cagugcgcaaucaggguggcg

SEQ ID NO: 6215 - RNA, 21 nt, Artificial Sequence
  ELANE RNA Guide
cauucgccacgcagugcgcaa

SEQ ID NO: 6216 - RNA, 21 nt, Artificial Sequence
  ELANE RNA Guide
ccacccugauugcgcacugcg

SEQ ID NO: 6217 - RNA, 21 nt, Artificial Sequence
  ELANE RNA Guide
ccacgcagugcgcaaucaggg

SEQ ID NO: 6218 - RNA, 21 nt, Artificial Sequence
  ELANE RNA Guide
cccugauugcgcacugcgugg

SEQ ID NO: 6219 - RNA, 21 nt, Artificial Sequence
  ELANE RNA Guide
ccugauugcgcacugcguggc

SEQ ID NO: 6220 - RNA, 21 nt, Artificial Sequence
  ELANE RNA Guide
cgcagugcgcaaucagggugg

SEQ ID NO: 6221 - RNA, 21 nt, Artificial Sequence
  ELANE RNA Guide
cgccacccugauugcgcacug

SEQ ID NO: 6222 - RNA, 21 nt, Artificial Sequence
  ELANE RNA Guide
cgccacgcagugcgcaaucag

SEQ ID NO: 6223 - RNA, 21 nt, Artificial Sequence
  ELANE RNA Guide
cggcgccacccugauugcgca

SEQ ID NO: 6224 - RNA, 21 nt, Artificial Sequence
  ELANE RNA Guide
cugauugcgcacugcguggcg

SEQ ID NO: 6225 - RNA, 21 nt, Artificial Sequence
  ELANE RNA Guide
cugcggcgccacccugauugc

SEQ ID NO: 6226 - RNA, 21 nt, Artificial Sequence
  ELANE RNA Guide
gauugcgcacugcguggcgaa

SEQ ID NO: 6227 - RNA, 21 nt, Artificial Sequence
  ELANE RNA Guide
gcagugcgcaaucaggguggc

SEQ ID NO: 6228 - RNA, 21 nt, Artificial Sequence
  ELANE RNA Guide
gccacccugauugcgcacugc

SEQ ID NO: 6229 - RNA, 21 nt, Artificial Sequence
  ELANE RNA Guide
gccacgcagugcgcaaucagg

SEQ ID NO: 6230 - RNA, 21 nt, Artificial Sequence
  ELANE RNA Guide
gcgccacccugauugcgcacu

SEQ ID NO: 6231 - RNA, 21 nt, Artificial Sequence
  ELANE RNA Guide
gcggcgccacccugauugcgc

SEQ ID NO: 6232 - RNA, 21 nt, Artificial Sequence
  ELANE RNA Guide
ggcgccacccugauugcgcac

SEQ ID NO: 6233 - RNA, 21 nt, Artificial Sequence
  ELANE RNA Guide
gugcgcaaucaggguggcgcc

SEQ ID NO: 6234 - RNA, 21 nt, Artificial Sequence
  ELANE RNA Guide
ucacacauucgccacgcagug

SEQ ID NO: 6235 - RNA, 21 nt, Artificial Sequence
  ELANE RNA Guide
ucgccacgcagugcgcaauca

SEQ ID NO: 6236 - RNA, 21 nt, Artificial Sequence
  ELANE RNA Guide
ucugcggcgccacccugauug

SEQ ID NO: 6237 - RNA, 21 nt, Artificial Sequence
  ELANE RNA Guide
ugauugcgcacugcguggcga

SEQ ID NO: 6238 - RNA, 21 nt, Artificial Sequence
  ELANE RNA Guide
ugcgcaaucaggguggcgccg

SEQ ID NO: 6239 - RNA, 21 nt, Artificial Sequence
  ELANE RNA Guide
ugcggcgccacccugauugcg

SEQ ID NO: 6240 - RNA, 21 nt, Artificial Sequence
  ELANE RNA Guide
uucgccacgcagugcgcaauc

SEQ ID NO: 6241 - RNA, 21 nt, Artificial Sequence
  ELANE RNA Guide
uugcgcacugcguggcgaaug

SEQ ID NO: 6242 - RNA, 22 nt, Artificial Sequence
  ELANE RNA Guide
acacauucgccacgcagugcgc

SEQ ID NO: 6243 - RNA, 22 nt, Artificial Sequence
  ELANE RNA Guide
acauucgccacgcagugcgcaa

SEQ ID NO: 6244 - RNA, 22 nt, Artificial Sequence
  ELANE RNA Guide
acccugauugcgcacugcgugg

SEQ ID NO: 6245 - RNA, 22 nt, Artificial Sequence
  ELANE RNA Guide
acgcagugcgcaaucagggugg

SEQ ID NO: 6246 - RNA, 22 nt, Artificial Sequence
  ELANE RNA Guide
agugcgcaaucaggguggcgcc

SEQ ID NO: 6247 - RNA, 22 nt, Artificial Sequence
  ELANE RNA Guide
auucgccacgcagugcgcaauc

SEQ ID NO: 6248 - RNA, 22 nt, Artificial Sequence
  ELANE RNA Guide
auugcgcacugcguggcgaaug

SEQ ID NO: 6249 - RNA, 22 nt, Artificial Sequence
  ELANE RNA Guide
cacacauucgccacgcagugcg

SEQ ID NO: 6250 - RNA, 22 nt, Artificial Sequence
  ELANE RNA Guide
cacauucgccacgcagugcgca

SEQ ID NO: 6251 - RNA, 22 nt, Artificial Sequence
  ELANE RNA Guide
cacccugauugcgcacugcgug

SEQ ID NO: 6252 - RNA, 22 nt, Artificial Sequence
  ELANE RNA Guide
cacgcagugcgcaaucagggug

SEQ ID NO: 6253 - RNA, 22 nt, Artificial Sequence
  ELANE RNA Guide
cagugcgcaaucaggguggcgc

SEQ ID NO: 6254 - RNA, 22 nt, Artificial Sequence
  ELANE RNA Guide
cauucgccacgcagugcgcaau

SEQ ID NO: 6255 - RNA, 22 nt, Artificial Sequence
  ELANE RNA Guide
ccacccugauugcgcacugcgu

SEQ ID NO: 6256 - RNA, 22 nt, Artificial Sequence
  ELANE RNA Guide
ccacgcagugcgcaaucagggu

SEQ ID NO: 6257 - RNA, 22 nt, Artificial Sequence
  ELANE RNA Guide
cccugauugcgcacugcguggc

SEQ ID NO: 6258 - RNA, 22 nt, Artificial Sequence
  ELANE RNA Guide
ccugauugcgcacugcguggcg

SEQ ID NO: 6259 - RNA, 22 nt, Artificial Sequence
  ELANE RNA Guide
cgcagugcgcaaucaggguggc

SEQ ID NO: 6260 - RNA, 22 nt, Artificial Sequence
  ELANE RNA Guide
cgccacccugauugcgcacugc

SEQ ID NO: 6261 - RNA, 22 nt, Artificial Sequence
  ELANE RNA Guide
cgccacgcagugcgcaaucagg

SEQ ID NO: 6262 - RNA, 22 nt, Artificial Sequence
  ELANE RNA Guide
cggcgccacccugauugcgcac

SEQ ID NO: 6263 - RNA, 22 nt, Artificial Sequence
  ELANE RNA Guide
cucacacauucgccacgcagug

SEQ ID NO: 6264 - RNA, 22 nt, Artificial Sequence
  ELANE RNA Guide
cugauugcgcacugcguggcga

SEQ ID NO: 6265 - RNA, 22 nt, Artificial Sequence
  ELANE RNA Guide
cugcggcgccacccugauugcg

SEQ ID NO: 6266 - RNA, 22 nt, Artificial Sequence
  ELANE RNA Guide
gauugcgcacugcguggcgaau

SEQ ID NO: 6267 - RNA, 22 nt, Artificial Sequence
  ELANE RNA Guide
gcagugcgcaaucaggguggcg

SEQ ID NO: 6268 - RNA, 22 nt, Artificial Sequence
  ELANE RNA Guide
gccacccugauugcgcacugcg

SEQ ID NO: 6269 - RNA, 22 nt, Artificial Sequence
  ELANE RNA Guide
gccacgcagugcgcaaucaggg

SEQ ID NO: 6270 - RNA, 22 nt, Artificial Sequence
  ELANE RNA Guide
gcgccacccugauugcgcacug

SEQ ID NO: 6271 - RNA, 22 nt, Artificial Sequence
  ELANE RNA Guide
gcggcgccacccugauugcgca

SEQ ID NO: 6272 - RNA, 22 nt, Artificial Sequence
  ELANE RNA Guide
ggcgccacccugauugcgcacu

SEQ ID NO: 6273 - RNA, 22 nt, Artificial Sequence
  ELANE RNA Guide
gugcgcaaucaggguggcgccg

SEQ ID NO: 6274 - RNA, 22 nt, Artificial Sequence
  ELANE RNA Guide
ucacacauucgccacgcagugc

SEQ ID NO: 6275 - RNA, 22 nt, Artificial Sequence
  ELANE RNA Guide
ucgccacgcagugcgcaaucag

SEQ ID NO: 6276 - RNA, 22 nt, Artificial Sequence
  ELANE RNA Guide
ucugcggcgccacccugauugc

SEQ ID NO: 6277 - RNA, 22 nt, Artificial Sequence
  ELANE RNA Guide
ugauugcgcacugcguggcgaa

SEQ ID NO: 6278 - RNA, 22 nt, Artificial Sequence
  ELANE RNA Guide
ugcgcaaucaggguggcgccgc

SEQ ID NO: 6279 - RNA, 22 nt, Artificial Sequence
  ELANE RNA Guide
ugcggcgccacccugauugcgc

SEQ ID NO: 6280 - RNA, 22 nt, Artificial Sequence
  ELANE RNA Guide
uucgccacgcagugcgcaauca

SEQ ID NO: 6281 - RNA, 22 nt, Artificial Sequence
  ELANE RNA Guide
uucugcggcgccacccugauug

SEQ ID NO: 6282 - RNA, 22 nt, Artificial Sequence
  ELANE RNA Guide
uugcgcacugcguggcgaaugu

SEQ ID NO: 6283 - RNA, 20 nt, Artificial Sequence
  ELANE RNA Guide
aaguugggcgccaucagggu

SEQ ID NO: 6284 - RNA, 20 nt, Artificial Sequence
  ELANE RNA Guide
acaugacgaaguugggcgcc

SEQ ID NO: 6285 - RNA, 20 nt, Artificial Sequence
  ELANE RNA Guide
acccugauggcgcccaacuu

SEQ ID NO: 6286 - RNA, 20 nt, Artificial Sequence
  ELANE RNA Guide
acgaaguugggcgccaucag

SEQ ID NO: 6287 - RNA, 20 nt, Artificial Sequence
  ELANE RNA Guide
aguugggcgccaucagggug

SEQ ID NO: 6288 - RNA, 20 nt, Artificial Sequence
  ELANE RNA Guide
augacgaaguugggcgccau

SEQ ID NO: 6289 - RNA, 20 nt, Artificial Sequence
  ELANE RNA Guide
auggcgcccaacuucgucau

SEQ ID NO: 6290 - RNA, 20 nt, Artificial Sequence
  ELANE RNA Guide
cacccugauggcgcccaacu

SEQ ID NO: 6291 - RNA, 20 nt, Artificial Sequence
  ELANE RNA Guide
caugacgaaguugggcgcca

SEQ ID NO: 6292 - RNA, 20 nt, Artificial Sequence
  ELANE RNA Guide
ccacccugauggcgcccaac

SEQ ID NO: 6293 - RNA, 20 nt, Artificial Sequence
  ELANE RNA Guide
ccaucaggguggcgccgcag

SEQ ID NO: 6294 - RNA, 20 nt, Artificial Sequence
  ELANE RNA Guide
cccugauggcgcccaacuuc

SEQ ID NO: 6295 - RNA, 20 nt, Artificial Sequence
  ELANE RNA Guide
ccugauggcgcccaacuucg

SEQ ID NO: 6296 - RNA, 20 nt, Artificial Sequence
  ELANE RNA Guide
cgaaguugggcgccaucagg

SEQ ID NO: 6297 - RNA, 20 nt, Artificial Sequence
  ELANE RNA Guide
cgccacccugauggcgccca

SEQ ID NO: 6298 - RNA, 20 nt, Artificial Sequence
  ELANE RNA Guide
cgccaucaggguggcgccgc

SEQ ID NO: 6299 - RNA, 20 nt, Artificial Sequence
  ELANE RNA Guide
cggcgccacccugauggcgc

SEQ ID NO: 6300 - RNA, 20 nt, Artificial Sequence
  ELANE RNA Guide
cugauggcgcccaacuucgu

SEQ ID NO: 6301 - RNA, 20 nt, Artificial Sequence
  ELANE RNA Guide
cugcggcgccacccugaugg

SEQ ID NO: 6302 - RNA, 20 nt, Artificial Sequence
  ELANE RNA Guide
gaaguugggcgccaucaggg

SEQ ID NO: 6303 - RNA, 20 nt, Artificial Sequence
  ELANE RNA Guide
gacgaaguugggcgccauca

SEQ ID NO: 6304 - RNA, 20 nt, Artificial Sequence
  ELANE RNA Guide
gauggcgcccaacuucguca

SEQ ID NO: 6305 - RNA, 20 nt, Artificial Sequence
  ELANE RNA Guide
gccacccugauggcgcccaa

SEQ ID NO: 6306 - RNA, 20 nt, Artificial Sequence
  ELANE RNA Guide
gccaucaggguggcgccgca

SEQ ID NO: 6307 - RNA, 20 nt, Artificial Sequence
  ELANE RNA Guide
gcgccacccugauggcgccc

SEQ ID NO: 6308 - RNA, 20 nt, Artificial Sequence
  ELANE RNA Guide
gcgccaucaggguggcgccg

SEQ ID NO: 6309 - RNA, 20 nt, Artificial Sequence
  ELANE RNA Guide
gcggcgccacccugauggcg

SEQ ID NO: 6310 - RNA, 20 nt, Artificial Sequence
  ELANE RNA Guide
ggcgccacccugauggcgcc

SEQ ID NO: 6311 - RNA, 20 nt, Artificial Sequence
  ELANE RNA Guide
ggcgccaucaggguggcgcc

SEQ ID NO: 6312 - RNA, 20 nt, Artificial Sequence
  ELANE RNA Guide
gggcgccaucaggguggcgc

SEQ ID NO: 6313 - RNA, 20 nt, Artificial Sequence
  ELANE RNA Guide
guugggcgccaucagggugg

SEQ ID NO: 6314 - RNA, 20 nt, Artificial Sequence
  ELANE RNA Guide
ucugcggcgccacccugaug

SEQ ID NO: 6315 - RNA, 20 nt, Artificial Sequence
  ELANE RNA Guide
ugacgaaguugggcgccauc

SEQ ID NO: 6316 - RNA, 20 nt, Artificial Sequence
  ELANE RNA Guide
ugauggcgcccaacuucguc

SEQ ID NO: 6317 - RNA, 20 nt, Artificial Sequence
  ELANE RNA Guide
ugcggcgccacccugauggc

SEQ ID NO: 6318 - RNA, 20 nt, Artificial Sequence
  ELANE RNA Guide
uggcgcccaacuucgucaug

SEQ ID NO: 6319 - RNA, 20 nt, Artificial Sequence
  ELANE RNA Guide
ugggcgccaucaggguggcg

SEQ ID NO: 6320 - RNA, 20 nt, Artificial Sequence
  ELANE RNA Guide
uucugcggcgccacccugau

SEQ ID NO: 6321 - RNA, 20 nt, Artificial Sequence
  ELANE RNA Guide
uugggcgccaucaggguggc

SEQ ID NO: 6322 - RNA, 21 nt, Artificial Sequence
  ELANE RNA Guide
aaguugggcgccaucagggug

SEQ ID NO: 6323 - RNA, 21 nt, Artificial Sequence
  ELANE RNA Guide
acaugacgaaguugggcgcca

SEQ ID NO: 6324 - RNA, 21 nt, Artificial Sequence
  ELANE RNA Guide
acccugauggcgcccaacuuc

SEQ ID NO: 6325 - RNA, 21 nt, Artificial Sequence
  ELANE RNA Guide
acgaaguugggcgccaucagg

SEQ ID NO: 6326 - RNA, 21 nt, Artificial Sequence
  ELANE RNA Guide
aguugggcgccaucagggugg

SEQ ID NO: 6327 - RNA, 21 nt, Artificial Sequence
  ELANE RNA Guide
augacgaaguugggcgccauc

SEQ ID NO: 6328 - RNA, 21 nt, Artificial Sequence
  ELANE RNA Guide
auggcgcccaacuucgucaug

SEQ ID NO: 6329 - RNA, 21 nt, Artificial Sequence
  ELANE RNA Guide
cacccugauggcgcccaacuu

SEQ ID NO: 6330 - RNA, 21 nt, Artificial Sequence
  ELANE RNA Guide
caugacgaaguugggcgccau

SEQ ID NO: 6331 - RNA, 21 nt, Artificial Sequence
  ELANE RNA Guide
ccacccugauggcgcccaacu

SEQ ID NO: 6332 - RNA, 21 nt, Artificial Sequence
  ELANE RNA Guide
ccaucaggguggcgccgcaga

SEQ ID NO: 6333 - RNA, 21 nt, Artificial Sequence
  ELANE RNA Guide
cccugauggcgcccaacuucg

SEQ ID NO: 6334 - RNA, 21 nt, Artificial Sequence
  ELANE RNA Guide
ccugauggcgcccaacuucgu

SEQ ID NO: 6335 - RNA, 21 nt, Artificial Sequence
  ELANE RNA Guide
cgaaguugggcgccaucaggg

SEQ ID NO: 6336 - RNA, 21 nt, Artificial Sequence
  ELANE RNA Guide
cgccacccugauggcgcccaa

SEQ ID NO: 6337 - RNA, 21 nt, Artificial Sequence
  ELANE RNA Guide
cgccaucaggguggcgccgca

SEQ ID NO: 6338 - RNA, 21 nt, Artificial Sequence
  ELANE RNA Guide
cugauggcgcccaacuucguc

SEQ ID NO: 6339 - RNA, 21 nt, Artificial Sequence
  ELANE RNA Guide
cugcggcgccacccugauggc

SEQ ID NO: 6340 - RNA, 21 nt, Artificial Sequence
  ELANE RNA Guide
cuucugcggcgccacccugau

SEQ ID NO: 6341 - RNA, 21 nt, Artificial Sequence
  ELANE RNA Guide
gaaguugggcgccaucagggu

SEQ ID NO: 6342 - RNA, 21 nt, Artificial Sequence
  ELANE RNA Guide
gacaugacgaaguugggcgcc

SEQ ID NO: 6343 - RNA, 21 nt, Artificial Sequence
  ELANE RNA Guide
gacgaaguugggcgccaucag

SEQ ID NO: 6344 - RNA, 21 nt, Artificial Sequence
  ELANE RNA Guide
gauggcgcccaacuucgucau

SEQ ID NO: 6345 - RNA, 21 nt, Artificial Sequence
  ELANE RNA Guide
gccacccugauggcgcccaac

SEQ ID NO: 6346 - RNA, 21 nt, Artificial Sequence
  ELANE RNA Guide
gccaucaggguggcgccgcag

SEQ ID NO: 6347 - RNA, 21 nt, Artificial Sequence
  ELANE RNA Guide
gcgccacccugauggcgccca

SEQ ID NO: 6348 - RNA, 21 nt, Artificial Sequence
  ELANE RNA Guide
guugggcgccaucaggguggc

SEQ ID NO: 6349 - RNA, 21 nt, Artificial Sequence
  ELANE RNA Guide
ucugcggcgccacccugaugg

SEQ ID NO: 6350 - RNA, 21 nt, Artificial Sequence
  ELANE RNA Guide
ugacgaaguugggcgccauca

SEQ ID NO: 6351 - RNA, 21 nt, Artificial Sequence
  ELANE RNA Guide
ugauggcgcccaacuucguca

SEQ ID NO: 6352 - RNA, 21 nt, Artificial Sequence
  ELANE RNA Guide
ugcggcgccacccugauggcg

SEQ ID NO: 6353 - RNA, 21 nt, Artificial Sequence
  ELANE RNA Guide
uggcgcccaacuucgucaugu

SEQ ID NO: 6354 - RNA, 21 nt, Artificial Sequence
  ELANE RNA Guide
ugggcgccaucaggguggcgc

SEQ ID NO: 6355 - RNA, 21 nt, Artificial Sequence
  ELANE RNA Guide
uucugcggcgccacccugaug

SEQ ID NO: 6356 - RNA, 21 nt, Artificial Sequence
  ELANE RNA Guide
uugggcgccaucaggguggcg

SEQ ID NO: 6357 - RNA, 22 nt, Artificial Sequence
  ELANE RNA Guide
aaguugggcgccaucagggugg

SEQ ID NO: 6358 - RNA, 22 nt, Artificial Sequence
  ELANE RNA Guide
acaugacgaaguugggcgccau

SEQ ID NO: 6359 - RNA, 22 nt, Artificial Sequence
  ELANE RNA Guide
acccugauggcgcccaacuucg

SEQ ID NO: 6360 - RNA, 22 nt, Artificial Sequence
  ELANE RNA Guide
acgaaguugggcgccaucaggg

SEQ ID NO: 6361 - RNA, 22 nt, Artificial Sequence
  ELANE RNA Guide
acuucugcggcgccacccugau

SEQ ID NO: 6362 - RNA, 22 nt, Artificial Sequence
  ELANE RNA Guide
aguugggcgccaucaggguggc

SEQ ID NO: 6363 - RNA, 22 nt, Artificial Sequence
  ELANE RNA Guide
augacgaaguugggcgccauca

SEQ ID NO: 6364 - RNA, 22 nt, Artificial Sequence
  ELANE RNA Guide
auggcgcccaacuucgucaugu

SEQ ID NO: 6365 - RNA, 22 nt, Artificial Sequence
  ELANE RNA Guide
cacccugauggcgcccaacuuc

SEQ ID NO: 6366 - RNA, 22 nt, Artificial Sequence
  ELANE RNA Guide
caugacgaaguugggcgccauc

SEQ ID NO: 6367 - RNA, 22 nt, Artificial Sequence
  ELANE RNA Guide
ccacccugauggcgcccaacuu

SEQ ID NO: 6368 - RNA, 22 nt, Artificial Sequence
  ELANE RNA Guide
ccaucaggguggcgccgcagaa

SEQ ID NO: 6369 - RNA, 22 nt, Artificial Sequence
  ELANE RNA Guide
cccugauggcgcccaacuucgu

SEQ ID NO: 6370 - RNA, 22 nt, Artificial Sequence
  ELANE RNA Guide
ccugauggcgcccaacuucguc

SEQ ID NO: 6371 - RNA, 22 nt, Artificial Sequence
  ELANE RNA Guide
cgaaguugggcgccaucagggu

SEQ ID NO: 6372 - RNA, 22 nt, Artificial Sequence
  ELANE RNA Guide
cgacaugacgaaguugggcgcc

SEQ ID NO: 6373 - RNA, 22 nt, Artificial Sequence
  ELANE RNA Guide
cgccacccugauggcgcccaac

SEQ ID NO: 6374 - RNA, 22 nt, Artificial Sequence
  ELANE RNA Guide
cgccaucaggguggcgccgcag

SEQ ID NO: 6375 - RNA, 22 nt, Artificial Sequence
  ELANE RNA Guide
cugauggcgcccaacuucguca

SEQ ID NO: 6376 - RNA, 22 nt, Artificial Sequence
  ELANE RNA Guide
cugcggcgccacccugauggcg

SEQ ID NO: 6377 - RNA, 22 nt, Artificial Sequence
  ELANE RNA Guide
cuucugcggcgccacccugaug

SEQ ID NO: 6378 - RNA, 22 nt, Artificial Sequence
  ELANE RNA Guide
gaaguugggcgccaucagggug

SEQ ID NO: 6379 - RNA, 22 nt, Artificial Sequence
  ELANE RNA Guide
gacaugacgaaguugggcgcca

SEQ ID NO: 6380 - RNA, 22 nt, Artificial Sequence
  ELANE RNA Guide
gacgaaguugggcgccaucagg

SEQ ID NO: 6381 - RNA, 22 nt, Artificial Sequence
  ELANE RNA Guide
gauggcgcccaacuucgucaug

SEQ ID NO: 6382 - RNA, 22 nt, Artificial Sequence
  ELANE RNA Guide
gccacccugauggcgcccaacu

SEQ ID NO: 6383 - RNA, 22 nt, Artificial Sequence
  ELANE RNA Guide
gccaucaggguggcgccgcaga

SEQ ID NO: 6384 - RNA, 22 nt, Artificial Sequence
  ELANE RNA Guide
gcgccacccugauggcgcccaa

SEQ ID NO: 6385 - RNA, 22 nt, Artificial Sequence
  ELANE RNA Guide
gcgccaucaggguggcgccgca

SEQ ID NO: 6386 - RNA, 22 nt, Artificial Sequence
  ELANE RNA Guide
ggcgccacccugauggcgccca

SEQ ID NO: 6387 - RNA, 22 nt, Artificial Sequence
  ELANE RNA Guide
guugggcgccaucaggguggcg

SEQ ID NO: 6388 - RNA, 22 nt, Artificial Sequence
  ELANE RNA Guide
ucugcggcgccacccugauggc

SEQ ID NO: 6389 - RNA, 22 nt, Artificial Sequence
  ELANE RNA Guide
ugacgaaguugggcgccaucag

SEQ ID NO: 6390 - RNA, 22 nt, Artificial Sequence
  ELANE RNA Guide
ugauggcgcccaacuucgucau

SEQ ID NO: 6391 - RNA, 22 nt, Artificial Sequence
  ELANE RNA Guide
ugcggcgccacccugauggcgc

SEQ ID NO: 6392 - RNA, 22 nt, Artificial Sequence
  ELANE RNA Guide
uggcgcccaacuucgucauguc

SEQ ID NO: 6393 - RNA, 22 nt, Artificial Sequence
  ELANE RNA Guide
ugggcgccaucaggguggcgcc

SEQ ID NO: 6394 - RNA, 22 nt, Artificial Sequence
  ELANE RNA Guide
uucugcggcgccacccugaugg

SEQ ID NO: 6395 - RNA, 22 nt, Artificial Sequence
  ELANE RNA Guide
uugggcgccaucaggguggcgc

SEQ ID NO: 6396 - RNA, 20 nt, Artificial Sequence
  ELANE RNA Guide
aaguugggcccaaucagggu

SEQ ID NO: 6397 - RNA, 20 nt, Artificial Sequence
  ELANE RNA Guide
acaugacgaaguugggccca

SEQ ID NO: 6398 - RNA, 20 nt, Artificial Sequence
  ELANE RNA Guide
acccugauugggcccaacuu

SEQ ID NO: 6399 - RNA, 20 nt, Artificial Sequence
  ELANE RNA Guide
acgaaguugggcccaaucag

SEQ ID NO: 6400 - RNA, 20 nt, Artificial Sequence
  ELANE RNA Guide
aguugggcccaaucagggug

SEQ ID NO: 6401 - RNA, 20 nt, Artificial Sequence
  ELANE RNA Guide
augacgaaguugggcccaau

SEQ ID NO: 6402 - RNA, 20 nt, Artificial Sequence
  ELANE RNA Guide
auugggcccaacuucgucau

SEQ ID NO: 6403 - RNA, 20 nt, Artificial Sequence
  ELANE RNA Guide
cacccugauugggcccaacu

SEQ ID NO: 6404 - RNA, 20 nt, Artificial Sequence
  ELANE RNA Guide
caugacgaaguugggcccaa

SEQ ID NO: 6405 - RNA, 20 nt, Artificial Sequence
  ELANE RNA Guide
ccacccugauugggcccaac

SEQ ID NO: 6406 - RNA, 20 nt, Artificial Sequence
  ELANE RNA Guide
cccaaucaggguggcgccgc

SEQ ID NO: 6407 - RNA, 20 nt, Artificial Sequence
  ELANE RNA Guide
cccugauugggcccaacuuc

SEQ ID NO: 6408 - RNA, 20 nt, Artificial Sequence
  ELANE RNA Guide
ccugauugggcccaacuucg

SEQ ID NO: 6409 - RNA, 20 nt, Artificial Sequence
  ELANE RNA Guide
cgaaguugggcccaaucagg

SEQ ID NO: 6410 - RNA, 20 nt, Artificial Sequence
  ELANE RNA Guide
cgccacccugauugggccca

SEQ ID NO: 6411 - RNA, 20 nt, Artificial Sequence
  ELANE RNA Guide
cggccgacaugacgaaguug

SEQ ID NO: 6412 - RNA, 20 nt, Artificial Sequence
  ELANE RNA Guide
cggcgccacccugauugggc

SEQ ID NO: 6413 - RNA, 20 nt, Artificial Sequence
  ELANE RNA Guide
cugauugggcccaacuucgu

SEQ ID NO: 6414 - RNA, 20 nt, Artificial Sequence
  ELANE RNA Guide
gaaguugggcccaaucaggg

SEQ ID NO: 6415 - RNA, 20 nt, Artificial Sequence
  ELANE RNA Guide
gacaugacgaaguugggccc

SEQ ID NO: 6416 - RNA, 20 nt, Artificial Sequence
  ELANE RNA Guide
gacgaaguugggcccaauca

SEQ ID NO: 6417 - RNA, 20 nt, Artificial Sequence
  ELANE RNA Guide
gauugggcccaacuucguca

SEQ ID NO: 6418 - RNA, 20 nt, Artificial Sequence
  ELANE RNA Guide
gccacccugauugggcccaa

SEQ ID NO: 6419 - RNA, 20 nt, Artificial Sequence
  ELANE RNA Guide
gcccaaucaggguggcgccg

SEQ ID NO: 6420 - RNA, 20 nt, Artificial Sequence
  ELANE RNA Guide
gcgccacccugauugggccc

SEQ ID NO: 6421 - RNA, 20 nt, Artificial Sequence
  ELANE RNA Guide
gcggcgccacccugauuggg

SEQ ID NO: 6422 - RNA, 20 nt, Artificial Sequence
  ELANE RNA Guide
ggcccaaucaggguggcgcc

SEQ ID NO: 6423 - RNA, 20 nt, Artificial Sequence
  ELANE RNA Guide
ggcgccacccugauugggcc

SEQ ID NO: 6424 - RNA, 20 nt, Artificial Sequence
  ELANE RNA Guide
gggcccaacuucgucauguc

SEQ ID NO: 6425 - RNA, 20 nt, Artificial Sequence
  ELANE RNA Guide
gggcccaaucaggguggcgc

SEQ ID NO: 6426 - RNA, 20 nt, Artificial Sequence
  ELANE RNA Guide
guugggcccaaucagggugg

SEQ ID NO: 6427 - RNA, 20 nt, Artificial Sequence
  ELANE RNA Guide
ucugcggcgccacccugauu

SEQ ID NO: 6428 - RNA, 20 nt, Artificial Sequence
  ELANE RNA Guide
ugacgaaguugggcccaauc

SEQ ID NO: 6429 - RNA, 20 nt, Artificial Sequence
  ELANE RNA Guide
ugauugggcccaacuucguc

SEQ ID NO: 6430 - RNA, 20 nt, Artificial Sequence
  ELANE RNA Guide
ugcggcgccacccugauugg

SEQ ID NO: 6431 - RNA, 20 nt, Artificial Sequence
  ELANE RNA Guide
ugggcccaacuucgucaugu

SEQ ID NO: 6432 - RNA, 20 nt, Artificial Sequence
  ELANE RNA Guide
ugggcccaaucaggguggcg

SEQ ID NO: 6433 - RNA, 20 nt, Artificial Sequence
  ELANE RNA Guide
uugggcccaacuucgucaug

SEQ ID NO: 6434 - RNA, 20 nt, Artificial Sequence
  ELANE RNA Guide
uugggcccaaucaggguggc

SEQ ID NO: 6435 - RNA, 21 nt, Artificial Sequence
  ELANE RNA Guide
aaguugggcccaaucagggug

SEQ ID NO: 6436 - RNA, 21 nt, Artificial Sequence
  ELANE RNA Guide
acaugacgaaguugggcccaa

SEQ ID NO: 6437 - RNA, 21 nt, Artificial Sequence
  ELANE RNA Guide
acccugauugggcccaacuuc

SEQ ID NO: 6438 - RNA, 21 nt, Artificial Sequence
  ELANE RNA Guide
acgaaguugggcccaaucagg

SEQ ID NO: 6439 - RNA, 21 nt, Artificial Sequence
  ELANE RNA Guide
aguugggcccaaucagggugg

SEQ ID NO: 6440 - RNA, 21 nt, Artificial Sequence
  ELANE RNA Guide
augacgaaguugggcccaauc

SEQ ID NO: 6441 - RNA, 21 nt, Artificial Sequence
  ELANE RNA Guide
auugggcccaacuucgucaug

SEQ ID NO: 6442 - RNA, 21 nt, Artificial Sequence
  ELANE RNA Guide
cacccugauugggcccaacuu

SEQ ID NO: 6443 - RNA, 21 nt, Artificial Sequence
  ELANE RNA Guide
caugacgaaguugggcccaau

SEQ ID NO: 6444 - RNA, 21 nt, Artificial Sequence
  ELANE RNA Guide
ccacccugauugggcccaacu

SEQ ID NO: 6445 - RNA, 21 nt, Artificial Sequence
  ELANE RNA Guide
cccaaucaggguggcgccgca

SEQ ID NO: 6446 - RNA, 21 nt, Artificial Sequence
  ELANE RNA Guide
cccugauugggcccaacuucg

SEQ ID NO: 6447 - RNA, 21 nt, Artificial Sequence
  ELANE RNA Guide
ccugauugggcccaacuucgu

SEQ ID NO: 6448 - RNA, 21 nt, Artificial Sequence
  ELANE RNA Guide
cgaaguugggcccaaucaggg

SEQ ID NO: 6449 - RNA, 21 nt, Artificial Sequence
  ELANE RNA Guide
cgacaugacgaaguugggccc

SEQ ID NO: 6450 - RNA, 21 nt, Artificial Sequence
  ELANE RNA Guide
cgccacccugauugggcccaa

SEQ ID NO: 6451 - RNA, 21 nt, Artificial Sequence
  ELANE RNA Guide
cggcgccacccugauugggcc

SEQ ID NO: 6452 - RNA, 21 nt, Artificial Sequence
  ELANE RNA Guide
cugauugggcccaacuucguc

SEQ ID NO: 6453 - RNA, 21 nt, Artificial Sequence
  ELANE RNA Guide
cugcggcgccacccugauugg

SEQ ID NO: 6454 - RNA, 21 nt, Artificial Sequence
  ELANE RNA Guide
gaaguugggcccaaucagggu

SEQ ID NO: 6455 - RNA, 21 nt, Artificial Sequence
  ELANE RNA Guide
gacaugacgaaguugggccca

SEQ ID NO: 6456 - RNA, 21 nt, Artificial Sequence
  ELANE RNA Guide
gacgaaguugggcccaaucag

SEQ ID NO: 6457 - RNA, 21 nt, Artificial Sequence
  ELANE RNA Guide
gauugggcccaacuucgucau

SEQ ID NO: 6458 - RNA, 21 nt, Artificial Sequence
  ELANE RNA Guide
gccacccugauugggcccaac

SEQ ID NO: 6459 - RNA, 21 nt, Artificial Sequence
  ELANE RNA Guide
gcccaaucaggguggcgccgc

SEQ ID NO: 6460 - RNA, 21 nt, Artificial Sequence
  ELANE RNA Guide
gcgccacccugauugggccca

SEQ ID NO: 6461 - RNA, 21 nt, Artificial Sequence
  ELANE RNA Guide
gcggccgacaugacgaaguug

SEQ ID NO: 6462 - RNA, 21 nt, Artificial Sequence
  ELANE RNA Guide
gcggcgccacccugauugggc

SEQ ID NO: 6463 - RNA, 21 nt, Artificial Sequence
  ELANE RNA Guide
ggcccaaucaggguggcgccg

SEQ ID NO: 6464 - RNA, 21 nt, Artificial Sequence
  ELANE RNA Guide
ggcgccacccugauugggccc

SEQ ID NO: 6465 - RNA, 21 nt, Artificial Sequence
  ELANE RNA Guide
gggcccaacuucgucaugucg

SEQ ID NO: 6466 - RNA, 21 nt, Artificial Sequence
  ELANE RNA Guide
gggcccaaucaggguggcgcc

SEQ ID NO: 6467 - RNA, 21 nt, Artificial Sequence
  ELANE RNA Guide
guugggcccaaucaggguggc

SEQ ID NO: 6468 - RNA, 21 nt, Artificial Sequence
  ELANE RNA Guide
ugacgaaguugggcccaauca

SEQ ID NO: 6469 - RNA, 21 nt, Artificial Sequence
  ELANE RNA Guide
ugauugggcccaacuucguca

SEQ ID NO: 6470 - RNA, 21 nt, Artificial Sequence
  ELANE RNA Guide
ugcggcgccacccugauuggg

SEQ ID NO: 6471 - RNA, 21 nt, Artificial Sequence
  ELANE RNA Guide
ugggcccaacuucgucauguc

SEQ ID NO: 6472 - RNA, 21 nt, Artificial Sequence
  ELANE RNA Guide
ugggcccaaucaggguggcgc

SEQ ID NO: 6473 - RNA, 21 nt, Artificial Sequence
  ELANE RNA Guide
uucugcggcgccacccugauu

SEQ ID NO: 6474 - RNA, 21 nt, Artificial Sequence
  ELANE RNA Guide
uugggcccaacuucgucaugu

SEQ ID NO: 6475 - RNA, 21 nt, Artificial Sequence
  ELANE RNA Guide
uugggcccaaucaggguggcg

SEQ ID NO: 6476 - RNA, 22 nt, Artificial Sequence
  ELANE RNA Guide
aaguugggcccaaucagggugg

SEQ ID NO: 6477 - RNA, 22 nt, Artificial Sequence
  ELANE RNA Guide
acaugacgaaguugggcccaau

SEQ ID NO: 6478 - RNA, 22 nt, Artificial Sequence
  ELANE RNA Guide
acccugauugggcccaacuucg

SEQ ID NO: 6479 - RNA, 22 nt, Artificial Sequence
  ELANE RNA Guide
acgaaguugggcccaaucaggg

SEQ ID NO: 6480 - RNA, 22 nt, Artificial Sequence
  ELANE RNA Guide
aguugggcccaaucaggguggc

SEQ ID NO: 6481 - RNA, 22 nt, Artificial Sequence
  ELANE RNA Guide
augacgaaguugggcccaauca

SEQ ID NO: 6482 - RNA, 22 nt, Artificial Sequence
  ELANE RNA Guide
auugggcccaacuucgucaugu

SEQ ID NO: 6483 - RNA, 22 nt, Artificial Sequence
  ELANE RNA Guide
cacccugauugggcccaacuuc

SEQ ID NO: 6484 - RNA, 22 nt, Artificial Sequence
  ELANE RNA Guide
caugacgaaguugggcccaauc

SEQ ID NO: 6485 - RNA, 22 nt, Artificial Sequence
  ELANE RNA Guide
ccacccugauugggcccaacuu

SEQ ID NO: 6486 - RNA, 22 nt, Artificial Sequence
  ELANE RNA Guide
cccaaucaggguggcgccgcag

SEQ ID NO: 6487 - RNA, 22 nt, Artificial Sequence
  ELANE RNA Guide
cccugauugggcccaacuucgu

SEQ ID NO: 6488 - RNA, 22 nt, Artificial Sequence
  ELANE RNA Guide
ccgacaugacgaaguugggccc

SEQ ID NO: 6489 - RNA, 22 nt, Artificial Sequence
  ELANE RNA Guide
ccugauugggcccaacuucguc

SEQ ID NO: 6490 - RNA, 22 nt, Artificial Sequence
  ELANE RNA Guide
cgaaguugggcccaaucagggu

SEQ ID NO: 6491 - RNA, 22 nt, Artificial Sequence
  ELANE RNA Guide
cgacaugacgaaguugggccca

SEQ ID NO: 6492 - RNA, 22 nt, Artificial Sequence
  ELANE RNA Guide
cgccacccugauugggcccaac

SEQ ID NO: 6493 - RNA, 22 nt, Artificial Sequence
  ELANE RNA Guide
cgcggccgacaugacgaaguug

SEQ ID NO: 6494 - RNA, 22 nt, Artificial Sequence
  ELANE RNA Guide
cggcgccacccugauugggccc

SEQ ID NO: 6495 - RNA, 22 nt, Artificial Sequence
  ELANE RNA Guide
cugauugggcccaacuucguca

SEQ ID NO: 6496 - RNA, 22 nt, Artificial Sequence
  ELANE RNA Guide
cugcggcgccacccugauuggg

SEQ ID NO: 6497 - RNA, 22 nt, Artificial Sequence
  ELANE RNA Guide
cuucugcggcgccacccugauu

SEQ ID NO: 6498 - RNA, 22 nt, Artificial Sequence
  ELANE RNA Guide
gaaguugggcccaaucagggug

SEQ ID NO: 6499 - RNA, 22 nt, Artificial Sequence
  ELANE RNA Guide
gacaugacgaaguugggcccaa

SEQ ID NO: 6500 - RNA, 22 nt, Artificial Sequence
  ELANE RNA Guide
gacgaaguugggcccaaucagg

SEQ ID NO: 6501 - RNA, 22 nt, Artificial Sequence
  ELANE RNA Guide
gauugggcccaacuucgucaug

SEQ ID NO: 6502 - RNA, 22 nt, Artificial Sequence
  ELANE RNA Guide
gccacccugauugggcccaacu

SEQ ID NO: 6503 - RNA, 22 nt, Artificial Sequence
  ELANE RNA Guide
gcccaaucaggguggcgccgca

SEQ ID NO: 6504 - RNA, 22 nt, Artificial Sequence
  ELANE RNA Guide
gcgccacccugauugggcccaa

SEQ ID NO: 6505 - RNA, 22 nt, Artificial Sequence
  ELANE RNA Guide
gcggcgccacccugauugggcc

SEQ ID NO: 6506 - RNA, 22 nt, Artificial Sequence
  ELANE RNA Guide
ggcccaaucaggguggcgccgc

SEQ ID NO: 6507 - RNA, 22 nt, Artificial Sequence
  ELANE RNA Guide
ggcgccacccugauugggccca

SEQ ID NO: 6508 - RNA, 22 nt, Artificial Sequence
  ELANE RNA Guide
gggcccaacuucgucaugucgg

SEQ ID NO: 6509 - RNA, 22 nt, Artificial Sequence
  ELANE RNA Guide
gggcccaaucaggguggcgccg

SEQ ID NO: 6510 - RNA, 22 nt, Artificial Sequence
  ELANE RNA Guide
guugggcccaaucaggguggcg

SEQ ID NO: 6511 - RNA, 22 nt, Artificial Sequence
  ELANE RNA Guide
ucugcggcgccacccugauugg

SEQ ID NO: 6512 - RNA, 22 nt, Artificial Sequence
  ELANE RNA Guide
ugacgaaguugggcccaaucag

SEQ ID NO: 6513 - RNA, 22 nt, Artificial Sequence
  ELANE RNA Guide
ugauugggcccaacuucgucau

SEQ ID NO: 6514 - RNA, 22 nt, Artificial Sequence
  ELANE RNA Guide
ugcggcgccacccugauugggc

SEQ ID NO: 6515 - RNA, 22 nt, Artificial Sequence
  ELANE RNA Guide
ugggcccaacuucgucaugucg

SEQ ID NO: 6516 - RNA, 22 nt, Artificial Sequence
  ELANE RNA Guide
ugggcccaaucaggguggcgcc

SEQ ID NO: 6517 - RNA, 22 nt, Artificial Sequence
  ELANE RNA Guide
uugggcccaacuucgucauguc

SEQ ID NO: 6518 - RNA, 22 nt, Artificial Sequence
  ELANE RNA Guide
uugggcccaaucaggguggcgc

SEQ ID NO: 6519 - RNA, 20 nt, Artificial Sequence
  ELANE RNA Guide
aaguugggcacaaucagggu

SEQ ID NO: 6520 - RNA, 20 nt, Artificial Sequence
  ELANE RNA Guide
acaugacgaaguugggcaca

SEQ ID NO: 6521 - RNA, 20 nt, Artificial Sequence
  ELANE RNA Guide
acccugauugugcccaacuu

SEQ ID NO: 6522 - RNA, 20 nt, Artificial Sequence
  ELANE RNA Guide
acgaaguugggcacaaucag

SEQ ID NO: 6523 - RNA, 20 nt, Artificial Sequence
  ELANE RNA Guide
aguugggcacaaucagggug

SEQ ID NO: 6524 - RNA, 20 nt, Artificial Sequence
  ELANE RNA Guide
augacgaaguugggcacaau

SEQ ID NO: 6525 - RNA, 20 nt, Artificial Sequence
  ELANE RNA Guide
auugugcccaacuucgucau

SEQ ID NO: 6526 - RNA, 20 nt, Artificial Sequence
  ELANE RNA Guide
cacaaucaggguggcgccgc

SEQ ID NO: 6527 - RNA, 20 nt, Artificial Sequence
  ELANE RNA Guide
cacccugauugugcccaacu

SEQ ID NO: 6528 - RNA, 20 nt, Artificial Sequence
  ELANE RNA Guide
caugacgaaguugggcacaa

SEQ ID NO: 6529 - RNA, 20 nt, Artificial Sequence
  ELANE RNA Guide
ccacccugauugugcccaac

SEQ ID NO: 6530 - RNA, 20 nt, Artificial Sequence
  ELANE RNA Guide
cccugauugugcccaacuuc

SEQ ID NO: 6531 - RNA, 20 nt, Artificial Sequence
  ELANE RNA Guide
ccugauugugcccaacuucg

SEQ ID NO: 6532 - RNA, 20 nt, Artificial Sequence
  ELANE RNA Guide
cgaaguugggcacaaucagg

SEQ ID NO: 6533 - RNA, 20 nt, Artificial Sequence
  ELANE RNA Guide
cgacaugacgaaguugggca

SEQ ID NO: 6534 - RNA, 20 nt, Artificial Sequence
  ELANE RNA Guide
cgccacccugauugugccca

SEQ ID NO: 6535 - RNA, 20 nt, Artificial Sequence
  ELANE RNA Guide
cggcgccacccugauugugc

SEQ ID NO: 6536 - RNA, 20 nt, Artificial Sequence
  ELANE RNA Guide
cugauugugcccaacuucgu

SEQ ID NO: 6537 - RNA, 20 nt, Artificial Sequence
  ELANE RNA Guide
gaaguugggcacaaucaggg

SEQ ID NO: 6538 - RNA, 20 nt, Artificial Sequence
  ELANE RNA Guide
gacaugacgaaguugggcac

SEQ ID NO: 6539 - RNA, 20 nt, Artificial Sequence
  ELANE RNA Guide
gacgaaguugggcacaauca

SEQ ID NO: 6540 - RNA, 20 nt, Artificial Sequence
  ELANE RNA Guide
gauugugcccaacuucguca

SEQ ID NO: 6541 - RNA, 20 nt, Artificial Sequence
  ELANE RNA Guide
gcacaaucaggguggcgccg

SEQ ID NO: 6542 - RNA, 20 nt, Artificial Sequence
  ELANE RNA Guide
gccacccugauugugcccaa

SEQ ID NO: 6543 - RNA, 20 nt, Artificial Sequence
  ELANE RNA Guide
gcgccacccugauugugccc

SEQ ID NO: 6544 - RNA, 20 nt, Artificial Sequence
  ELANE RNA Guide
gcggcgccacccugauugug

SEQ ID NO: 6545 - RNA, 20 nt, Artificial Sequence
  ELANE RNA Guide
ggcacaaucaggguggcgcc

SEQ ID NO: 6546 - RNA, 20 nt, Artificial Sequence
  ELANE RNA Guide
ggcgccacccugauugugcc

SEQ ID NO: 6547 - RNA, 20 nt, Artificial Sequence
  ELANE RNA Guide
gggcacaaucaggguggcgc

SEQ ID NO: 6548 - RNA, 20 nt, Artificial Sequence
  ELANE RNA Guide
gugcccaacuucgucauguc

SEQ ID NO: 6549 - RNA, 20 nt, Artificial Sequence
  ELANE RNA Guide
guugggcacaaucagggugg

SEQ ID NO: 6550 - RNA, 20 nt, Artificial Sequence
  ELANE RNA Guide
ugacgaaguugggcacaauc

SEQ ID NO: 6551 - RNA, 20 nt, Artificial Sequence
  ELANE RNA Guide
ugauugugcccaacuucguc

SEQ ID NO: 6552 - RNA, 20 nt, Artificial Sequence
  ELANE RNA Guide
ugcggcgccacccugauugu

SEQ ID NO: 6553 - RNA, 20 nt, Artificial Sequence
  ELANE RNA Guide
ugggcacaaucaggguggcg

SEQ ID NO: 6554 - RNA, 20 nt, Artificial Sequence
  ELANE RNA Guide
ugugcccaacuucgucaugu

SEQ ID NO: 6555 - RNA, 20 nt, Artificial Sequence
  ELANE RNA Guide
uugggcacaaucaggguggc

SEQ ID NO: 6556 - RNA, 20 nt, Artificial Sequence
  ELANE RNA Guide
uugugcccaacuucgucaug

SEQ ID NO: 6557 - RNA, 21 nt, Artificial Sequence
  ELANE RNA Guide
aaguugggcacaaucagggug

SEQ ID NO: 6558 - RNA, 21 nt, Artificial Sequence
  ELANE RNA Guide
acaugacgaaguugggcacaa

SEQ ID NO: 6559 - RNA, 21 nt, Artificial Sequence
  ELANE RNA Guide
acccugauugugcccaacuuc

SEQ ID NO: 6560 - RNA, 21 nt, Artificial Sequence
  ELANE RNA Guide
acgaaguugggcacaaucagg

SEQ ID NO: 6561 - RNA, 21 nt, Artificial Sequence
  ELANE RNA Guide
aguugggcacaaucagggugg

SEQ ID NO: 6562 - RNA, 21 nt, Artificial Sequence
  ELANE RNA Guide
augacgaaguugggcacaauc

SEQ ID NO: 6563 - RNA, 21 nt, Artificial Sequence
  ELANE RNA Guide
auugugcccaacuucgucaug

SEQ ID NO: 6564 - RNA, 21 nt, Artificial Sequence
  ELANE RNA Guide
cacaaucaggguggcgccgca

SEQ ID NO: 6565 - RNA, 21 nt, Artificial Sequence
  ELANE RNA Guide
cacccugauugugcccaacuu

SEQ ID NO: 6566 - RNA, 21 nt, Artificial Sequence
  ELANE RNA Guide
caugacgaaguugggcacaau

SEQ ID NO: 6567 - RNA, 21 nt, Artificial Sequence
  ELANE RNA Guide
ccacccugauugugcccaacu

SEQ ID NO: 6568 - RNA, 21 nt, Artificial Sequence
  ELANE RNA Guide
cccugauugugcccaacuucg

SEQ ID NO: 6569 - RNA, 21 nt, Artificial Sequence
  ELANE RNA Guide
ccgacaugacgaaguugggca

SEQ ID NO: 6570 - RNA, 21 nt, Artificial Sequence
  ELANE RNA Guide
ccugauugugcccaacuucgu

SEQ ID NO: 6571 - RNA, 21 nt, Artificial Sequence
  ELANE RNA Guide
cgaaguugggcacaaucaggg

SEQ ID NO: 6572 - RNA, 21 nt, Artificial Sequence
  ELANE RNA Guide
cgacaugacgaaguugggcac

SEQ ID NO: 6573 - RNA, 21 nt, Artificial Sequence
  ELANE RNA Guide
cgccacccugauugugcccaa

SEQ ID NO: 6574 - RNA, 21 nt, Artificial Sequence
  ELANE RNA Guide
cggcgccacccugauugugcc

SEQ ID NO: 6575 - RNA, 21 nt, Artificial Sequence
  ELANE RNA Guide
cugauugugcccaacuucguc

SEQ ID NO: 6576 - RNA, 21 nt, Artificial Sequence
  ELANE RNA Guide
cugcggcgccacccugauugu

SEQ ID NO: 6577 - RNA, 21 nt, Artificial Sequence
  ELANE RNA Guide
gaaguugggcacaaucagggu

SEQ ID NO: 6578 - RNA, 21 nt, Artificial Sequence
  ELANE RNA Guide
gacaugacgaaguugggcaca

SEQ ID NO: 6579 - RNA, 21 nt, Artificial Sequence
  ELANE RNA Guide
gacgaaguugggcacaaucag

SEQ ID NO: 6580 - RNA, 21 nt, Artificial Sequence
  ELANE RNA Guide
gauugugcccaacuucgucau

SEQ ID NO: 6581 - RNA, 21 nt, Artificial Sequence
  ELANE RNA Guide
gcacaaucaggguggcgccgc

SEQ ID NO: 6582 - RNA, 21 nt, Artificial Sequence
  ELANE RNA Guide
gccacccugauugugcccaac

SEQ ID NO: 6583 - RNA, 21 nt, Artificial Sequence
  ELANE RNA Guide
gcgccacccugauugugccca

SEQ ID NO: 6584 - RNA, 21 nt, Artificial Sequence
  ELANE RNA Guide
gcggcgccacccugauugugc

SEQ ID NO: 6585 - RNA, 21 nt, Artificial Sequence
  ELANE RNA Guide
ggcacaaucaggguggcgccg

SEQ ID NO: 6586 - RNA, 21 nt, Artificial Sequence
  ELANE RNA Guide
ggcgccacccugauugugccc

SEQ ID NO: 6587 - RNA, 21 nt, Artificial Sequence
  ELANE RNA Guide
gggcacaaucaggguggcgcc

SEQ ID NO: 6588 - RNA, 21 nt, Artificial Sequence
  ELANE RNA Guide
gugcccaacuucgucaugucg

SEQ ID NO: 6589 - RNA, 21 nt, Artificial Sequence
  ELANE RNA Guide
guugggcacaaucaggguggc

SEQ ID NO: 6590 - RNA, 21 nt, Artificial Sequence
  ELANE RNA Guide
ugacgaaguugggcacaauca

SEQ ID NO: 6591 - RNA, 21 nt, Artificial Sequence
  ELANE RNA Guide
ugauugugcccaacuucguca

SEQ ID NO: 6592 - RNA, 21 nt, Artificial Sequence
  ELANE RNA Guide
ugcggcgccacccugauugug

SEQ ID NO: 6593 - RNA, 21 nt, Artificial Sequence
  ELANE RNA Guide
ugggcacaaucaggguggcgc

SEQ ID NO: 6594 - RNA, 21 nt, Artificial Sequence
  ELANE RNA Guide
ugugcccaacuucgucauguc

SEQ ID NO: 6595 - RNA, 21 nt, Artificial Sequence
  ELANE RNA Guide
uugggcacaaucaggguggcg

SEQ ID NO: 6596 - RNA, 21 nt, Artificial Sequence
  ELANE RNA Guide
uugugcccaacuucgucaugu

SEQ ID NO: 6597 - RNA, 22 nt, Artificial Sequence
  ELANE RNA Guide
aaguugggcacaaucagggugg

SEQ ID NO: 6598 - RNA, 22 nt, Artificial Sequence
  ELANE RNA Guide
acaugacgaaguugggcacaau

SEQ ID NO: 6599 - RNA, 22 nt, Artificial Sequence
  ELANE RNA Guide
acccugauugugcccaacuucg

SEQ ID NO: 6600 - RNA, 22 nt, Artificial Sequence
  ELANE RNA Guide
acgaaguugggcacaaucaggg

SEQ ID NO: 6601 - RNA, 22 nt, Artificial Sequence
  ELANE RNA Guide
aguugggcacaaucaggguggc

SEQ ID NO: 6602 - RNA, 22 nt, Artificial Sequence
  ELANE RNA Guide
augacgaaguugggcacaauca

SEQ ID NO: 6603 - RNA, 22 nt, Artificial Sequence
  ELANE RNA Guide
auugugcccaacuucgucaugu

SEQ ID NO: 6604 - RNA, 22 nt, Artificial Sequence
  ELANE RNA Guide
cacaaucaggguggcgccgcag

SEQ ID NO: 6605 - RNA, 22 nt, Artificial Sequence
  ELANE RNA Guide
cacccugauugugcccaacuuc

SEQ ID NO: 6606 - RNA, 22 nt, Artificial Sequence
  ELANE RNA Guide
caugacgaaguugggcacaauc

SEQ ID NO: 6607 - RNA, 22 nt, Artificial Sequence
  ELANE RNA Guide
ccacccugauugugcccaacuu

SEQ ID NO: 6608 - RNA, 22 nt, Artificial Sequence
  ELANE RNA Guide
cccugauugugcccaacuucgu

SEQ ID NO: 6609 - RNA, 22 nt, Artificial Sequence
  ELANE RNA Guide
ccgacaugacgaaguugggcac

SEQ ID NO: 6610 - RNA, 22 nt, Artificial Sequence
  ELANE RNA Guide
ccugauugugcccaacuucguc

SEQ ID NO: 6611 - RNA, 22 nt, Artificial Sequence
  ELANE RNA Guide
cgaaguugggcacaaucagggu

SEQ ID NO: 6612 - RNA, 22 nt, Artificial Sequence
  ELANE RNA Guide
cgacaugacgaaguugggcaca

SEQ ID NO: 6613 - RNA, 22 nt, Artificial Sequence
  ELANE RNA Guide
cgccacccugauugugcccaac

SEQ ID NO: 6614 - RNA, 22 nt, Artificial Sequence
  ELANE RNA Guide
cggcgccacccugauugugccc

SEQ ID NO: 6615 - RNA, 22 nt, Artificial Sequence
  ELANE RNA Guide
cugauugugcccaacuucguca

SEQ ID NO: 6616 - RNA, 22 nt, Artificial Sequence
  ELANE RNA Guide
cugcggcgccacccugauugug

SEQ ID NO: 6617 - RNA, 22 nt, Artificial Sequence
  ELANE RNA Guide
gaaguugggcacaaucagggug

SEQ ID NO: 6618 - RNA, 22 nt, Artificial Sequence
  ELANE RNA Guide
gacaugacgaaguugggcacaa

SEQ ID NO: 6619 - RNA, 22 nt, Artificial Sequence
  ELANE RNA Guide
gacgaaguugggcacaaucagg

SEQ ID NO: 6620 - RNA, 22 nt, Artificial Sequence
  ELANE RNA Guide
gauugugcccaacuucgucaug

SEQ ID NO: 6621 - RNA, 22 nt, Artificial Sequence
  ELANE RNA Guide
gcacaaucaggguggcgccgca

SEQ ID NO: 6622 - RNA, 22 nt, Artificial Sequence
  ELANE RNA Guide
gccacccugauugugcccaacu

SEQ ID NO: 6623 - RNA, 22 nt, Artificial Sequence
  ELANE RNA Guide
gccgacaugacgaaguugggca

SEQ ID NO: 6624 - RNA, 22 nt, Artificial Sequence
  ELANE RNA Guide
gcgccacccugauugugcccaa

SEQ ID NO: 6625 - RNA, 22 nt, Artificial Sequence
  ELANE RNA Guide
gcggcgccacccugauugugcc

SEQ ID NO: 6626 - RNA, 22 nt, Artificial Sequence
  ELANE RNA Guide
ggcacaaucaggguggcgccgc

SEQ ID NO: 6627 - RNA, 22 nt, Artificial Sequence
  ELANE RNA Guide
ggcgccacccugauugugccca

SEQ ID NO: 6628 - RNA, 22 nt, Artificial Sequence
  ELANE RNA Guide
gggcacaaucaggguggcgccg

SEQ ID NO: 6629 - RNA, 22 nt, Artificial Sequence
  ELANE RNA Guide
gugcccaacuucgucaugucgg

SEQ ID NO: 6630 - RNA, 22 nt, Artificial Sequence
  ELANE RNA Guide
guugggcacaaucaggguggcg

SEQ ID NO: 6631 - RNA, 22 nt, Artificial Sequence
  ELANE RNA Guide
ucugcggcgccacccugauugu

SEQ ID NO: 6632 - RNA, 22 nt, Artificial Sequence
  ELANE RNA Guide
ugacgaaguugggcacaaucag

SEQ ID NO: 6633 - RNA, 22 nt, Artificial Sequence
  ELANE RNA Guide
ugauugugcccaacuucgucau

SEQ ID NO: 6634 - RNA, 22 nt, Artificial Sequence
  ELANE RNA Guide
ugcggcgccacccugauugugc

SEQ ID NO: 6635 - RNA, 22 nt, Artificial Sequence
  ELANE RNA Guide
ugggcacaaucaggguggcgcc

SEQ ID NO: 6636 - RNA, 22 nt, Artificial Sequence
  ELANE RNA Guide
ugugcccaacuucgucaugucg

SEQ ID NO: 6637 - RNA, 22 nt, Artificial Sequence
  ELANE RNA Guide
uugggcacaaucaggguggcgc

SEQ ID NO: 6638 - RNA, 22 nt, Artificial Sequence
  ELANE RNA Guide
uugugcccaacuucgucauguc

SEQ ID NO: 6639 - RNA, 20 nt, Artificial Sequence
  ELANE RNA Guide
aacuucaugucggccgcgca

SEQ ID NO: 6640 - RNA, 20 nt, Artificial Sequence
  ELANE RNA Guide
acaugaaguugggcgcaauc

SEQ ID NO: 6641 - RNA, 20 nt, Artificial Sequence
  ELANE RNA Guide
acccugauugcgcccaacuu

SEQ ID NO: 6642 - RNA, 20 nt, Artificial Sequence
  ELANE RNA Guide
acgcagugcgcggccgacau

SEQ ID NO: 6643 - RNA, 20 nt, Artificial Sequence
  ELANE RNA Guide
acuucaugucggccgcgcac

SEQ ID NO: 6644 - RNA, 20 nt, Artificial Sequence
  ELANE RNA Guide
agugcgcggccgacaugaag

SEQ ID NO: 6645 - RNA, 20 nt, Artificial Sequence
  ELANE RNA Guide
augaaguugggcgcaaucag

SEQ ID NO: 6646 - RNA, 20 nt, Artificial Sequence
  ELANE RNA Guide
auugcgcccaacuucauguc

SEQ ID NO: 6647 - RNA, 20 nt, Artificial Sequence
  ELANE RNA Guide
caacuucaugucggccgcgc

SEQ ID NO: 6648 - RNA, 20 nt, Artificial Sequence
  ELANE RNA Guide
cacccugauugcgcccaacu

SEQ ID NO: 6649 - RNA, 20 nt, Artificial Sequence
  ELANE RNA Guide
cacgcagugcgcggccgaca

SEQ ID NO: 6650 - RNA, 20 nt, Artificial Sequence
  ELANE RNA Guide
cagugcgcggccgacaugaa

SEQ ID NO: 6651 - RNA, 20 nt, Artificial Sequence
  ELANE RNA Guide
caugaaguugggcgcaauca

SEQ ID NO: 6652 - RNA, 20 nt, Artificial Sequence
  ELANE RNA Guide
ccaacuucaugucggccgcg

SEQ ID NO: 6653 - RNA, 20 nt, Artificial Sequence
  ELANE RNA Guide
ccacccugauugcgcccaac

SEQ ID NO: 6654 - RNA, 20 nt, Artificial Sequence
  ELANE RNA Guide
cccaacuucaugucggccgc

SEQ ID NO: 6655 - RNA, 20 nt, Artificial Sequence
  ELANE RNA Guide
cccugauugcgcccaacuuc

SEQ ID NO: 6656 - RNA, 20 nt, Artificial Sequence
  ELANE RNA Guide
ccgacaugaaguugggcgca

SEQ ID NO: 6657 - RNA, 20 nt, Artificial Sequence
  ELANE RNA Guide
ccugauugcgcccaacuuca

SEQ ID NO: 6658 - RNA, 20 nt, Artificial Sequence
  ELANE RNA Guide
cgacaugaaguugggcgcaa

SEQ ID NO: 6659 - RNA, 20 nt, Artificial Sequence
  ELANE RNA Guide
cgcagugcgcggccgacaug

SEQ ID NO: 6660 - RNA, 20 nt, Artificial Sequence
  ELANE RNA Guide
cgcccaacuucaugucggcc

SEQ ID NO: 6661 - RNA, 20 nt, Artificial Sequence
  ELANE RNA Guide
cgcggccgacaugaaguugg

SEQ ID NO: 6662 - RNA, 20 nt, Artificial Sequence
  ELANE RNA Guide
cggccgacaugaaguugggc

SEQ ID NO: 6663 - RNA, 20 nt, Artificial Sequence
  ELANE RNA Guide
cugauugcgcccaacuucau

SEQ ID NO: 6664 - RNA, 20 nt, Artificial Sequence
  ELANE RNA Guide
cuucaugucggccgcgcacu

SEQ ID NO: 6665 - RNA, 20 nt, Artificial Sequence
  ELANE RNA Guide
gacaugaaguugggcgcaau

SEQ ID NO: 6666 - RNA, 20 nt, Artificial Sequence
  ELANE RNA Guide
gauugcgcccaacuucaugu

SEQ ID NO: 6667 - RNA, 20 nt, Artificial Sequence
  ELANE RNA Guide
gcagugcgcggccgacauga

SEQ ID NO: 6668 - RNA, 20 nt, Artificial Sequence
  ELANE RNA Guide
gcccaacuucaugucggccg

SEQ ID NO: 6669 - RNA, 20 nt, Artificial Sequence
  ELANE RNA Guide
gccgacaugaaguugggcgc

SEQ ID NO: 6670 - RNA, 20 nt, Artificial Sequence
  ELANE RNA Guide
gcgcccaacuucaugucggc

SEQ ID NO: 6671 - RNA, 20 nt, Artificial Sequence
  ELANE RNA Guide
gcgcggccgacaugaaguug

SEQ ID NO: 6672 - RNA, 20 nt, Artificial Sequence
  ELANE RNA Guide
gcggccgacaugaaguuggg

SEQ ID NO: 6673 - RNA, 20 nt, Artificial Sequence
  ELANE RNA Guide
ggccgacaugaaguugggcg

SEQ ID NO: 6674 - RNA, 20 nt, Artificial Sequence
  ELANE RNA Guide
gugcgcggccgacaugaagu

SEQ ID NO: 6675 - RNA, 20 nt, Artificial Sequence
  ELANE RNA Guide
ugaaguugggcgcaaucagg

SEQ ID NO: 6676 - RNA, 20 nt, Artificial Sequence
  ELANE RNA Guide
ugauugcgcccaacuucaug

SEQ ID NO: 6677 - RNA, 20 nt, Artificial Sequence
  ELANE RNA Guide
ugcgcccaacuucaugucgg

SEQ ID NO: 6678 - RNA, 20 nt, Artificial Sequence
  ELANE RNA Guide
ugcgcggccgacaugaaguu

SEQ ID NO: 6679 - RNA, 20 nt, Artificial Sequence
  ELANE RNA Guide
uugcgcccaacuucaugucg

SEQ ID NO: 6680 - RNA, 21 nt, Artificial Sequence
  ELANE RNA Guide
aacuucaugucggccgcgcac

SEQ ID NO: 6681 - RNA, 21 nt, Artificial Sequence
  ELANE RNA Guide
acaugaaguugggcgcaauca

SEQ ID NO: 6682 - RNA, 21 nt, Artificial Sequence
  ELANE RNA Guide
acccugauugcgcccaacuuc

SEQ ID NO: 6683 - RNA, 21 nt, Artificial Sequence
  ELANE RNA Guide
acgcagugcgcggccgacaug

SEQ ID NO: 6684 - RNA, 21 nt, Artificial Sequence
  ELANE RNA Guide
acuucaugucggccgcgcacu

SEQ ID NO: 6685 - RNA, 21 nt, Artificial Sequence
  ELANE RNA Guide
agugcgcggccgacaugaagu

SEQ ID NO: 6686 - RNA, 21 nt, Artificial Sequence
  ELANE RNA Guide
augaaguugggcgcaaucagg

SEQ ID NO: 6687 - RNA, 21 nt, Artificial Sequence
  ELANE RNA Guide
auugcgcccaacuucaugucg

SEQ ID NO: 6688 - RNA, 21 nt, Artificial Sequence
  ELANE RNA Guide
caacuucaugucggccgcgca

SEQ ID NO: 6689 - RNA, 21 nt, Artificial Sequence
  ELANE RNA Guide
cacccugauugcgcccaacuu

SEQ ID NO: 6690 - RNA, 21 nt, Artificial Sequence
  ELANE RNA Guide
cacgcagugcgcggccgacau

SEQ ID NO: 6691 - RNA, 21 nt, Artificial Sequence
  ELANE RNA Guide
cagugcgcggccgacaugaag

SEQ ID NO: 6692 - RNA, 21 nt, Artificial Sequence
  ELANE RNA Guide
caugaaguugggcgcaaucag

SEQ ID NO: 6693 - RNA, 21 nt, Artificial Sequence
  ELANE RNA Guide
ccaacuucaugucggccgcgc

SEQ ID NO: 6694 - RNA, 21 nt, Artificial Sequence
  ELANE RNA Guide
ccacccugauugcgcccaacu

SEQ ID NO: 6695 - RNA, 21 nt, Artificial Sequence
  ELANE RNA Guide
ccacgcagugcgcggccgaca

SEQ ID NO: 6696 - RNA, 21 nt, Artificial Sequence
  ELANE RNA Guide
cccaacuucaugucggccgcg

SEQ ID NO: 6697 - RNA, 21 nt, Artificial Sequence
  ELANE RNA Guide
cccugauugcgcccaacuuca

SEQ ID NO: 6698 - RNA, 21 nt, Artificial Sequence
  ELANE RNA Guide
ccgacaugaaguugggcgcaa

SEQ ID NO: 6699 - RNA, 21 nt, Artificial Sequence
  ELANE RNA Guide
ccugauugcgcccaacuucau

SEQ ID NO: 6700 - RNA, 21 nt, Artificial Sequence
  ELANE RNA Guide
cgacaugaaguugggcgcaau

SEQ ID NO: 6701 - RNA, 21 nt, Artificial Sequence
  ELANE RNA Guide
cgcagugcgcggccgacauga

SEQ ID NO: 6702 - RNA, 21 nt, Artificial Sequence
  ELANE RNA Guide
cgcccaacuucaugucggccg

SEQ ID NO: 6703 - RNA, 21 nt, Artificial Sequence
  ELANE RNA Guide
cgcggccgacaugaaguuggg

SEQ ID NO: 6704 - RNA, 21 nt, Artificial Sequence
  ELANE RNA Guide
cggccgacaugaaguugggcg

SEQ ID NO: 6705 - RNA, 21 nt, Artificial Sequence
  ELANE RNA Guide
cugauugcgcccaacuucaug

SEQ ID NO: 6706 - RNA, 21 nt, Artificial Sequence
  ELANE RNA Guide
cuucaugucggccgcgcacug

SEQ ID NO: 6707 - RNA, 21 nt, Artificial Sequence
  ELANE RNA Guide
gacaugaaguugggcgcaauc

SEQ ID NO: 6708 - RNA, 21 nt, Artificial Sequence
  ELANE RNA Guide
gauugcgcccaacuucauguc

SEQ ID NO: 6709 - RNA, 21 nt, Artificial Sequence
  ELANE RNA Guide
gcagugcgcggccgacaugaa

SEQ ID NO: 6710 - RNA, 21 nt, Artificial Sequence
  ELANE RNA Guide
gccacccugauugcgcccaac

SEQ ID NO: 6711 - RNA, 21 nt, Artificial Sequence
  ELANE RNA Guide
gcccaacuucaugucggccgc

SEQ ID NO: 6712 - RNA, 21 nt, Artificial Sequence
  ELANE RNA Guide
gccgacaugaaguugggcgca

SEQ ID NO: 6713 - RNA, 21 nt, Artificial Sequence
  ELANE RNA Guide
gcgcccaacuucaugucggcc

SEQ ID NO: 6714 - RNA, 21 nt, Artificial Sequence
  ELANE RNA Guide
gcgcggccgacaugaaguugg

SEQ ID NO: 6715 - RNA, 21 nt, Artificial Sequence
  ELANE RNA Guide
gcggccgacaugaaguugggc

SEQ ID NO: 6716 - RNA, 21 nt, Artificial Sequence
  ELANE RNA Guide
ggccgacaugaaguugggcgc

SEQ ID NO: 6717 - RNA, 21 nt, Artificial Sequence
  ELANE RNA Guide
gugcgcggccgacaugaaguu

SEQ ID NO: 6718 - RNA, 21 nt, Artificial Sequence
  ELANE RNA Guide
ugaaguugggcgcaaucaggg

SEQ ID NO: 6719 - RNA, 21 nt, Artificial Sequence
  ELANE RNA Guide
ugauugcgcccaacuucaugu

SEQ ID NO: 6720 - RNA, 21 nt, Artificial Sequence
  ELANE RNA Guide
ugcgcccaacuucaugucggc

SEQ ID NO: 6721 - RNA, 21 nt, Artificial Sequence
  ELANE RNA Guide
ugcgcggccgacaugaaguug

SEQ ID NO: 6722 - RNA, 21 nt, Artificial Sequence
  ELANE RNA Guide
uugcgcccaacuucaugucgg

SEQ ID NO: 6723 - RNA, 22 nt, Artificial Sequence
  ELANE RNA Guide
aacuucaugucggccgcgcacu

SEQ ID NO: 6724 - RNA, 22 nt, Artificial Sequence
  ELANE RNA Guide
acaugaaguugggcgcaaucag

SEQ ID NO: 6725 - RNA, 22 nt, Artificial Sequence
  ELANE RNA Guide
acccugauugcgcccaacuuca

SEQ ID NO: 6726 - RNA, 22 nt, Artificial Sequence
  ELANE RNA Guide
acgcagugcgcggccgacauga

SEQ ID NO: 6727 - RNA, 22 nt, Artificial Sequence
  ELANE RNA Guide
acuucaugucggccgcgcacug

SEQ ID NO: 6728 - RNA, 22 nt, Artificial Sequence
  ELANE RNA Guide
agugcgcggccgacaugaaguu

SEQ ID NO: 6729 - RNA, 22 nt, Artificial Sequence
  ELANE RNA Guide
augaaguugggcgcaaucaggg

SEQ ID NO: 6730 - RNA, 22 nt, Artificial Sequence
  ELANE RNA Guide
auugcgcccaacuucaugucgg

SEQ ID NO: 6731 - RNA, 22 nt, Artificial Sequence
  ELANE RNA Guide
caacuucaugucggccgcgcac

SEQ ID NO: 6732 - RNA, 22 nt, Artificial Sequence
  ELANE RNA Guide
cacccugauugcgcccaacuuc

SEQ ID NO: 6733 - RNA, 22 nt, Artificial Sequence
  ELANE RNA Guide
cacgcagugcgcggccgacaug

SEQ ID NO: 6734 - RNA, 22 nt, Artificial Sequence
  ELANE RNA Guide
cagugcgcggccgacaugaagu

SEQ ID NO: 6735 - RNA, 22 nt, Artificial Sequence
  ELANE RNA Guide
caugaaguugggcgcaaucagg

SEQ ID NO: 6736 - RNA, 22 nt, Artificial Sequence
  ELANE RNA Guide
ccaacuucaugucggccgcgca

SEQ ID NO: 6737 - RNA, 22 nt, Artificial Sequence
  ELANE RNA Guide
ccacccugauugcgcccaacuu

SEQ ID NO: 6738 - RNA, 22 nt, Artificial Sequence
  ELANE RNA Guide
ccacgcagugcgcggccgacau

SEQ ID NO: 6739 - RNA, 22 nt, Artificial Sequence
  ELANE RNA Guide
cccaacuucaugucggccgcgc

SEQ ID NO: 6740 - RNA, 22 nt, Artificial Sequence
  ELANE RNA Guide
cccugauugcgcccaacuucau

SEQ ID NO: 6741 - RNA, 22 nt, Artificial Sequence
  ELANE RNA Guide
ccgacaugaaguugggcgcaau

SEQ ID NO: 6742 - RNA, 22 nt, Artificial Sequence
  ELANE RNA Guide
ccugauugcgcccaacuucaug

SEQ ID NO: 6743 - RNA, 22 nt, Artificial Sequence
  ELANE RNA Guide
cgacaugaaguugggcgcaauc

SEQ ID NO: 6744 - RNA, 22 nt, Artificial Sequence
  ELANE RNA Guide
cgcagugcgcggccgacaugaa

SEQ ID NO: 6745 - RNA, 22 nt, Artificial Sequence
  ELANE RNA Guide
cgccacccugauugcgcccaac

SEQ ID NO: 6746 - RNA, 22 nt, Artificial Sequence
  ELANE RNA Guide
cgcccaacuucaugucggccgc

SEQ ID NO: 6747 - RNA, 22 nt, Artificial Sequence
  ELANE RNA Guide
cgcggccgacaugaaguugggc

SEQ ID NO: 6748 - RNA, 22 nt, Artificial Sequence
  ELANE RNA Guide
cggccgacaugaaguugggcgc

SEQ ID NO: 6749 - RNA, 22 nt, Artificial Sequence
  ELANE RNA Guide
cugauugcgcccaacuucaugu

SEQ ID NO: 6750 - RNA, 22 nt, Artificial Sequence
  ELANE RNA Guide
cuucaugucggccgcgcacugc

SEQ ID NO: 6751 - RNA, 22 nt, Artificial Sequence
  ELANE RNA Guide
gacaugaaguugggcgcaauca

SEQ ID NO: 6752 - RNA, 22 nt, Artificial Sequence
  ELANE RNA Guide
gauugcgcccaacuucaugucg

SEQ ID NO: 6753 - RNA, 22 nt, Artificial Sequence
  ELANE RNA Guide
gcagugcgcggccgacaugaag

SEQ ID NO: 6754 - RNA, 22 nt, Artificial Sequence
  ELANE RNA Guide
gccacccugauugcgcccaacu

SEQ ID NO: 6755 - RNA, 22 nt, Artificial Sequence
  ELANE RNA Guide
gccacgcagugcgcggccgaca

SEQ ID NO: 6756 - RNA, 22 nt, Artificial Sequence
  ELANE RNA Guide
gcccaacuucaugucggccgcg

SEQ ID NO: 6757 - RNA, 22 nt, Artificial Sequence
  ELANE RNA Guide
gccgacaugaaguugggcgcaa

SEQ ID NO: 6758 - RNA, 22 nt, Artificial Sequence
  ELANE RNA Guide
gcgcccaacuucaugucggccg

SEQ ID NO: 6759 - RNA, 22 nt, Artificial Sequence
  ELANE RNA Guide
gcgcggccgacaugaaguuggg

SEQ ID NO: 6760 - RNA, 22 nt, Artificial Sequence
  ELANE RNA Guide
gcggccgacaugaaguugggcg

SEQ ID NO: 6761 - RNA, 22 nt, Artificial Sequence
  ELANE RNA Guide
ggccgacaugaaguugggcgca

SEQ ID NO: 6762 - RNA, 22 nt, Artificial Sequence
  ELANE RNA Guide
gugcgcggccgacaugaaguug

SEQ ID NO: 6763 - RNA, 22 nt, Artificial Sequence
  ELANE RNA Guide
ugaaguugggcgcaaucagggu

SEQ ID NO: 6764 - RNA, 22 nt, Artificial Sequence
  ELANE RNA Guide
ugauugcgcccaacuucauguc

SEQ ID NO: 6765 - RNA, 22 nt, Artificial Sequence
  ELANE RNA Guide
ugcgcccaacuucaugucggcc

SEQ ID NO: 6766 - RNA, 22 nt, Artificial Sequence
  ELANE RNA Guide
ugcgcggccgacaugaaguugg

SEQ ID NO: 6767 - RNA, 22 nt, Artificial Sequence
  ELANE RNA Guide
uugcgcccaacuucaugucggc

SEQ ID NO: 6768 - RNA, 20 nt, Artificial Sequence
  ELANE RNA Guide
aacuucuucaugucggccgc

SEQ ID NO: 6769 - RNA, 20 nt, Artificial Sequence
  ELANE RNA Guide
aagaaguugggcgcaaucag

SEQ ID NO: 6770 - RNA, 20 nt, Artificial Sequence
  ELANE RNA Guide
acaugaagaaguugggcgca

SEQ ID NO: 6771 - RNA, 20 nt, Artificial Sequence
  ELANE RNA Guide
acuucuucaugucggccgcg

SEQ ID NO: 6772 - RNA, 20 nt, Artificial Sequence
  ELANE RNA Guide
augaagaaguugggcgcaau

SEQ ID NO: 6773 - RNA, 20 nt, Artificial Sequence
  ELANE RNA Guide
auugcgcccaacuucuucau

SEQ ID NO: 6774 - RNA, 20 nt, Artificial Sequence
  ELANE RNA Guide
caacuucuucaugucggccg

SEQ ID NO: 6775 - RNA, 20 nt, Artificial Sequence
  ELANE RNA Guide
caugaagaaguugggcgcaa

SEQ ID NO: 6776 - RNA, 20 nt, Artificial Sequence
  ELANE RNA Guide
ccaacuucuucaugucggcc

SEQ ID NO: 6777 - RNA, 20 nt, Artificial Sequence
  ELANE RNA Guide
cccaacuucuucaugucggc

SEQ ID NO: 6778 - RNA, 20 nt, Artificial Sequence
  ELANE RNA Guide
ccgacaugaagaaguugggc

SEQ ID NO: 6779 - RNA, 20 nt, Artificial Sequence
  ELANE RNA Guide
ccugauugcgcccaacuucu

SEQ ID NO: 6780 - RNA, 20 nt, Artificial Sequence
  ELANE RNA Guide
cgacaugaagaaguugggcg

SEQ ID NO: 6781 - RNA, 20 nt, Artificial Sequence
  ELANE RNA Guide
cgcccaacuucuucaugucg

SEQ ID NO: 6782 - RNA, 20 nt, Artificial Sequence
  ELANE RNA Guide
cgcggccgacaugaagaagu

SEQ ID NO: 6783 - RNA, 20 nt, Artificial Sequence
  ELANE RNA Guide
cggccgacaugaagaaguug

SEQ ID NO: 6784 - RNA, 20 nt, Artificial Sequence
  ELANE RNA Guide
cugauugcgcccaacuucuu

SEQ ID NO: 6785 - RNA, 20 nt, Artificial Sequence
  ELANE RNA Guide
cuucuucaugucggccgcgc

SEQ ID NO: 6786 - RNA, 20 nt, Artificial Sequence
  ELANE RNA Guide
gaagaaguugggcgcaauca

SEQ ID NO: 6787 - RNA, 20 nt, Artificial Sequence
  ELANE RNA Guide
gacaugaagaaguugggcgc

SEQ ID NO: 6788 - RNA, 20 nt, Artificial Sequence
  ELANE RNA Guide
gauugcgcccaacuucuuca

SEQ ID NO: 6789 - RNA, 20 nt, Artificial Sequence
  ELANE RNA Guide
gcccaacuucuucaugucgg

SEQ ID NO: 6790 - RNA, 20 nt, Artificial Sequence
  ELANE RNA Guide
gccgacaugaagaaguuggg

SEQ ID NO: 6791 - RNA, 20 nt, Artificial Sequence
  ELANE RNA Guide
gcgcccaacuucuucauguc

SEQ ID NO: 6792 - RNA, 20 nt, Artificial Sequence
  ELANE RNA Guide
gcgcggccgacaugaagaag

SEQ ID NO: 6793 - RNA, 20 nt, Artificial Sequence
  ELANE RNA Guide
gcggccgacaugaagaaguu

SEQ ID NO: 6794 - RNA, 20 nt, Artificial Sequence
  ELANE RNA Guide
ggccgacaugaagaaguugg

SEQ ID NO: 6795 - RNA, 20 nt, Artificial Sequence
  ELANE RNA Guide
gugcgcggccgacaugaaga

SEQ ID NO: 6796 - RNA, 20 nt, Artificial Sequence
  ELANE RNA Guide
ucuucaugucggccgcgcac

SEQ ID NO: 6797 - RNA, 20 nt, Artificial Sequence
  ELANE RNA Guide
ugaagaaguugggcgcaauc

SEQ ID NO: 6798 - RNA, 20 nt, Artificial Sequence
  ELANE RNA Guide
ugauugcgcccaacuucuuc

SEQ ID NO: 6799 - RNA, 20 nt, Artificial Sequence
  ELANE RNA Guide
ugcgcccaacuucuucaugu

SEQ ID NO: 6800 - RNA, 20 nt, Artificial Sequence
  ELANE RNA Guide
ugcgcggccgacaugaagaa

SEQ ID NO: 6801 - RNA, 20 nt, Artificial Sequence
  ELANE RNA Guide
uucuucaugucggccgcgca

SEQ ID NO: 6802 - RNA, 20 nt, Artificial Sequence
  ELANE RNA Guide
uugcgcccaacuucuucaug

SEQ ID NO: 6803 - RNA, 21 nt, Artificial Sequence
  ELANE RNA Guide
aacuucuucaugucggccgcg

SEQ ID NO: 6804 - RNA, 21 nt, Artificial Sequence
  ELANE RNA Guide
aagaaguugggcgcaaucagg

SEQ ID NO: 6805 - RNA, 21 nt, Artificial Sequence
  ELANE RNA Guide
acaugaagaaguugggcgcaa

SEQ ID NO: 6806 - RNA, 21 nt, Artificial Sequence
  ELANE RNA Guide
acuucuucaugucggccgcgc

SEQ ID NO: 6807 - RNA, 21 nt, Artificial Sequence
  ELANE RNA Guide
agugcgcggccgacaugaaga

SEQ ID NO: 6808 - RNA, 21 nt, Artificial Sequence
  ELANE RNA Guide
augaagaaguugggcgcaauc

SEQ ID NO: 6809 - RNA, 21 nt, Artificial Sequence
  ELANE RNA Guide
auugcgcccaacuucuucaug

SEQ ID NO: 6810 - RNA, 21 nt, Artificial Sequence
  ELANE RNA Guide
caacuucuucaugucggccgc

SEQ ID NO: 6811 - RNA, 21 nt, Artificial Sequence
  ELANE RNA Guide
caugaagaaguugggcgcaau

SEQ ID NO: 6812 - RNA, 21 nt, Artificial Sequence
  ELANE RNA Guide
ccaacuucuucaugucggccg

SEQ ID NO: 6813 - RNA, 21 nt, Artificial Sequence
  ELANE RNA Guide
cccaacuucuucaugucggcc

SEQ ID NO: 6814 - RNA, 21 nt, Artificial Sequence
  ELANE RNA Guide
cccugauugcgcccaacuucu

SEQ ID NO: 6815 - RNA, 21 nt, Artificial Sequence
  ELANE RNA Guide
ccgacaugaagaaguugggcg

SEQ ID NO: 6816 - RNA, 21 nt, Artificial Sequence
  ELANE RNA Guide
ccugauugcgcccaacuucuu

SEQ ID NO: 6817 - RNA, 21 nt, Artificial Sequence
  ELANE RNA Guide
cgacaugaagaaguugggcgc

SEQ ID NO: 6818 - RNA, 21 nt, Artificial Sequence
  ELANE RNA Guide
cgcccaacuucuucaugucgg

SEQ ID NO: 6819 - RNA, 21 nt, Artificial Sequence
  ELANE RNA Guide
cgcggccgacaugaagaaguu

SEQ ID NO: 6820 - RNA, 21 nt, Artificial Sequence
  ELANE RNA Guide
cggccgacaugaagaaguugg

SEQ ID NO: 6821 - RNA, 21 nt, Artificial Sequence
  ELANE RNA Guide
cugauugcgcccaacuucuuc

SEQ ID NO: 6822 - RNA, 21 nt, Artificial Sequence
  ELANE RNA Guide
cuucuucaugucggccgcgca

SEQ ID NO: 6823 - RNA, 21 nt, Artificial Sequence
  ELANE RNA Guide
gaagaaguugggcgcaaucag

SEQ ID NO: 6824 - RNA, 21 nt, Artificial Sequence
  ELANE RNA Guide
gacaugaagaaguugggcgca

SEQ ID NO: 6825 - RNA, 21 nt, Artificial Sequence
  ELANE RNA Guide
gauugcgcccaacuucuucau

SEQ ID NO: 6826 - RNA, 21 nt, Artificial Sequence
  ELANE RNA Guide
gcccaacuucuucaugucggc

SEQ ID NO: 6827 - RNA, 21 nt, Artificial Sequence
  ELANE RNA Guide
gccgacaugaagaaguugggc

SEQ ID NO: 6828 - RNA, 21 nt, Artificial Sequence
  ELANE RNA Guide
gcgcccaacuucuucaugucg

SEQ ID NO: 6829 - RNA, 21 nt, Artificial Sequence
  ELANE RNA Guide
gcgcggccgacaugaagaagu

SEQ ID NO: 6830 - RNA, 21 nt, Artificial Sequence
  ELANE RNA Guide
gcggccgacaugaagaaguug

SEQ ID NO: 6831 - RNA, 21 nt, Artificial Sequence
  ELANE RNA Guide
ggccgacaugaagaaguuggg

SEQ ID NO: 6832 - RNA, 21 nt, Artificial Sequence
  ELANE RNA Guide
gugcgcggccgacaugaagaa

SEQ ID NO: 6833 - RNA, 21 nt, Artificial Sequence
  ELANE RNA Guide
ucuucaugucggccgcgcacu

SEQ ID NO: 6834 - RNA, 21 nt, Artificial Sequence
  ELANE RNA Guide
ugaagaaguugggcgcaauca

SEQ ID NO: 6835 - RNA, 21 nt, Artificial Sequence
  ELANE RNA Guide
ugauugcgcccaacuucuuca

SEQ ID NO: 6836 - RNA, 21 nt, Artificial Sequence
  ELANE RNA Guide
ugcgcccaacuucuucauguc

SEQ ID NO: 6837 - RNA, 21 nt, Artificial Sequence
  ELANE RNA Guide
ugcgcggccgacaugaagaag

SEQ ID NO: 6838 - RNA, 21 nt, Artificial Sequence
  ELANE RNA Guide
uucuucaugucggccgcgcac

SEQ ID NO: 6839 - RNA, 21 nt, Artificial Sequence
  ELANE RNA Guide
uugcgcccaacuucuucaugu

SEQ ID NO: 6840 - RNA, 22 nt, Artificial Sequence
  ELANE RNA Guide
aacuucuucaugucggccgcgc

SEQ ID NO: 6841 - RNA, 22 nt, Artificial Sequence
  ELANE RNA Guide
aagaaguugggcgcaaucaggg

SEQ ID NO: 6842 - RNA, 22 nt, Artificial Sequence
  ELANE RNA Guide
acaugaagaaguugggcgcaau

SEQ ID NO: 6843 - RNA, 22 nt, Artificial Sequence
  ELANE RNA Guide
acccugauugcgcccaacuucu

SEQ ID NO: 6844 - RNA, 22 nt, Artificial Sequence
  ELANE RNA Guide
acuucuucaugucggccgcgca

SEQ ID NO: 6845 - RNA, 22 nt, Artificial Sequence
  ELANE RNA Guide
agugcgcggccgacaugaagaa

SEQ ID NO: 6846 - RNA, 22 nt, Artificial Sequence
  ELANE RNA Guide
augaagaaguugggcgcaauca

SEQ ID NO: 6847 - RNA, 22 nt, Artificial Sequence
  ELANE RNA Guide
auugcgcccaacuucuucaugu

SEQ ID NO: 6848 - RNA, 22 nt, Artificial Sequence
  ELANE RNA Guide
caacuucuucaugucggccgcg

SEQ ID NO: 6849 - RNA, 22 nt, Artificial Sequence
  ELANE RNA Guide
cagugcgcggccgacaugaaga

SEQ ID NO: 6850 - RNA, 22 nt, Artificial Sequence
  ELANE RNA Guide
caugaagaaguugggcgcaauc

SEQ ID NO: 6851 - RNA, 22 nt, Artificial Sequence
  ELANE RNA Guide
ccaacuucuucaugucggccgc

SEQ ID NO: 6852 - RNA, 22 nt, Artificial Sequence
  ELANE RNA Guide
cccaacuucuucaugucggccg

SEQ ID NO: 6853 - RNA, 22 nt, Artificial Sequence
  ELANE RNA Guide
cccugauugcgcccaacuucuu

SEQ ID NO: 6854 - RNA, 22 nt, Artificial Sequence
  ELANE RNA Guide
ccgacaugaagaaguugggcgc

SEQ ID NO: 6855 - RNA, 22 nt, Artificial Sequence
  ELANE RNA Guide
ccugauugcgcccaacuucuuc

SEQ ID NO: 6856 - RNA, 22 nt, Artificial Sequence
  ELANE RNA Guide
cgacaugaagaaguugggcgca

SEQ ID NO: 6857 - RNA, 22 nt, Artificial Sequence
  ELANE RNA Guide
cgcccaacuucuucaugucggc

SEQ ID NO: 6858 - RNA, 22 nt, Artificial Sequence
  ELANE RNA Guide
cgcggccgacaugaagaaguug

SEQ ID NO: 6859 - RNA, 22 nt, Artificial Sequence
  ELANE RNA Guide
cggccgacaugaagaaguuggg

SEQ ID NO: 6860 - RNA, 22 nt, Artificial Sequence
  ELANE RNA Guide
cugauugcgcccaacuucuuca

SEQ ID NO: 6861 - RNA, 22 nt, Artificial Sequence
  ELANE RNA Guide
cuucuucaugucggccgcgcac

SEQ ID NO: 6862 - RNA, 22 nt, Artificial Sequence
  ELANE RNA Guide
gaagaaguugggcgcaaucagg

SEQ ID NO: 6863 - RNA, 22 nt, Artificial Sequence
  ELANE RNA Guide
gacaugaagaaguugggcgcaa

SEQ ID NO: 6864 - RNA, 22 nt, Artificial Sequence
  ELANE RNA Guide
gauugcgcccaacuucuucaug

SEQ ID NO: 6865 - RNA, 22 nt, Artificial Sequence
  ELANE RNA Guide
gcccaacuucuucaugucggcc

SEQ ID NO: 6866 - RNA, 22 nt, Artificial Sequence
  ELANE RNA Guide
gccgacaugaagaaguugggcg

SEQ ID NO: 6867 - RNA, 22 nt, Artificial Sequence
  ELANE RNA Guide
gcgcccaacuucuucaugucgg

SEQ ID NO: 6868 - RNA, 22 nt, Artificial Sequence
  ELANE RNA Guide
gcgcggccgacaugaagaaguu

SEQ ID NO: 6869 - RNA, 22 nt, Artificial Sequence
  ELANE RNA Guide
gcggccgacaugaagaaguugg

SEQ ID NO: 6870 - RNA, 22 nt, Artificial Sequence
  ELANE RNA Guide
ggccgacaugaagaaguugggc

SEQ ID NO: 6871 - RNA, 22 nt, Artificial Sequence
  ELANE RNA Guide
gugcgcggccgacaugaagaag

SEQ ID NO: 6872 - RNA, 22 nt, Artificial Sequence
  ELANE RNA Guide
ucuucaugucggccgcgcacug

SEQ ID NO: 6873 - RNA, 22 nt, Artificial Sequence
  ELANE RNA Guide
ugaagaaguugggcgcaaucag

SEQ ID NO: 6874 - RNA, 22 nt, Artificial Sequence
  ELANE RNA Guide
ugauugcgcccaacuucuucau

SEQ ID NO: 6875 - RNA, 22 nt, Artificial Sequence
  ELANE RNA Guide
ugcgcccaacuucuucaugucg

SEQ ID NO: 6876 - RNA, 22 nt, Artificial Sequence
  ELANE RNA Guide
ugcgcggccgacaugaagaagu

SEQ ID NO: 6877 - RNA, 22 nt, Artificial Sequence
  ELANE RNA Guide
uucuucaugucggccgcgcacu

SEQ ID NO: 6878 - RNA, 22 nt, Artificial Sequence
  ELANE RNA Guide
uugcgcccaacuucuucauguc

SEQ ID NO: 6879 - RNA, 20 nt, Artificial Sequence
  ELANE RNA Guide
aacuucguaugcguggcgaa

SEQ ID NO: 6880 - RNA, 20 nt, Artificial Sequence
  ELANE RNA Guide
acacauucgccacgcauacg

SEQ ID NO: 6881 - RNA, 20 nt, Artificial Sequence
  ELANE RNA Guide
acauucgccacgcauacgaa

SEQ ID NO: 6882 - RNA, 20 nt, Artificial Sequence
  ELANE RNA Guide
acgcauacgaaguugggcgc

SEQ ID NO: 6883 - RNA, 20 nt, Artificial Sequence
  ELANE RNA Guide
acucacacauucgccacgca

SEQ ID NO: 6884 - RNA, 20 nt, Artificial Sequence
  ELANE RNA Guide
acuucguaugcguggcgaau

SEQ ID NO: 6885 - RNA, 20 nt, Artificial Sequence
  ELANE RNA Guide
auacgaaguugggcgcaauc

SEQ ID NO: 6886 - RNA, 20 nt, Artificial Sequence
  ELANE RNA Guide
auucgccacgcauacgaagu

SEQ ID NO: 6887 - RNA, 20 nt, Artificial Sequence
  ELANE RNA Guide
auugcgcccaacuucguaug

SEQ ID NO: 6888 - RNA, 20 nt, Artificial Sequence
  ELANE RNA Guide
caacuucguaugcguggcga

SEQ ID NO: 6889 - RNA, 20 nt, Artificial Sequence
  ELANE RNA Guide
cacacauucgccacgcauac

SEQ ID NO: 6890 - RNA, 20 nt, Artificial Sequence
  ELANE RNA Guide
cacauucgccacgcauacga

SEQ ID NO: 6891 - RNA, 20 nt, Artificial Sequence
  ELANE RNA Guide
cacgcauacgaaguugggcg

SEQ ID NO: 6892 - RNA, 20 nt, Artificial Sequence
  ELANE RNA Guide
cauacgaaguugggcgcaau

SEQ ID NO: 6893 - RNA, 20 nt, Artificial Sequence
  ELANE RNA Guide
cauucgccacgcauacgaag

SEQ ID NO: 6894 - RNA, 20 nt, Artificial Sequence
  ELANE RNA Guide
ccaacuucguaugcguggcg

SEQ ID NO: 6895 - RNA, 20 nt, Artificial Sequence
  ELANE RNA Guide
ccacgcauacgaaguugggc

SEQ ID NO: 6896 - RNA, 20 nt, Artificial Sequence
  ELANE RNA Guide
cccaacuucguaugcguggc

SEQ ID NO: 6897 - RNA, 20 nt, Artificial Sequence
  ELANE RNA Guide
ccugauugcgcccaacuucg

SEQ ID NO: 6898 - RNA, 20 nt, Artificial Sequence
  ELANE RNA Guide
cgcauacgaaguugggcgca

SEQ ID NO: 6899 - RNA, 20 nt, Artificial Sequence
  ELANE RNA Guide
cgccacgcauacgaaguugg

SEQ ID NO: 6900 - RNA, 20 nt, Artificial Sequence
  ELANE RNA Guide
cgcccaacuucguaugcgug

SEQ ID NO: 6901 - RNA, 20 nt, Artificial Sequence
  ELANE RNA Guide
cguaugcguggcgaaugugu

SEQ ID NO: 6902 - RNA, 20 nt, Artificial Sequence
  ELANE RNA Guide
cuacucacacauucgccacg

SEQ ID NO: 6903 - RNA, 20 nt, Artificial Sequence
  ELANE RNA Guide
cucacacauucgccacgcau

SEQ ID NO: 6904 - RNA, 20 nt, Artificial Sequence
  ELANE RNA Guide
cugauugcgcccaacuucgu

SEQ ID NO: 6905 - RNA, 20 nt, Artificial Sequence
  ELANE RNA Guide
cuucguaugcguggcgaaug

SEQ ID NO: 6906 - RNA, 20 nt, Artificial Sequence
  ELANE RNA Guide
gauugcgcccaacuucguau

SEQ ID NO: 6907 - RNA, 20 nt, Artificial Sequence
  ELANE RNA Guide
gcauacgaaguugggcgcaa

SEQ ID NO: 6908 - RNA, 20 nt, Artificial Sequence
  ELANE RNA Guide
gccacgcauacgaaguuggg

SEQ ID NO: 6909 - RNA, 20 nt, Artificial Sequence
  ELANE RNA Guide
gcccaacuucguaugcgugg

SEQ ID NO: 6910 - RNA, 20 nt, Artificial Sequence
  ELANE RNA Guide
gcgcccaacuucguaugcgu

SEQ ID NO: 6911 - RNA, 20 nt, Artificial Sequence
  ELANE RNA Guide
guaugcguggcgaaugugug

SEQ ID NO: 6912 - RNA, 20 nt, Artificial Sequence
  ELANE RNA Guide
uacgaaguugggcgcaauca

SEQ ID NO: 6913 - RNA, 20 nt, Artificial Sequence
  ELANE RNA Guide
uacucacacauucgccacgc

SEQ ID NO: 6914 - RNA, 20 nt, Artificial Sequence
  ELANE RNA Guide
ucacacauucgccacgcaua

SEQ ID NO: 6915 - RNA, 20 nt, Artificial Sequence
  ELANE RNA Guide
ucgccacgcauacgaaguug

SEQ ID NO: 6916 - RNA, 20 nt, Artificial Sequence
  ELANE RNA Guide
ucguaugcguggcgaaugug

SEQ ID NO: 6917 - RNA, 20 nt, Artificial Sequence
  ELANE RNA Guide
ugauugcgcccaacuucgua

SEQ ID NO: 6918 - RNA, 20 nt, Artificial Sequence
  ELANE RNA Guide
ugcgcccaacuucguaugcg

SEQ ID NO: 6919 - RNA, 20 nt, Artificial Sequence
  ELANE RNA Guide
uucgccacgcauacgaaguu

SEQ ID NO: 6920 - RNA, 20 nt, Artificial Sequence
  ELANE RNA Guide
uucguaugcguggcgaaugu

SEQ ID NO: 6921 - RNA, 20 nt, Artificial Sequence
  ELANE RNA Guide
uugcgcccaacuucguaugc

SEQ ID NO: 6922 - RNA, 21 nt, Artificial Sequence
  ELANE RNA Guide
aacuucguaugcguggcgaau

SEQ ID NO: 6923 - RNA, 21 nt, Artificial Sequence
  ELANE RNA Guide
acacauucgccacgcauacga

SEQ ID NO: 6924 - RNA, 21 nt, Artificial Sequence
  ELANE RNA Guide
acauucgccacgcauacgaag

SEQ ID NO: 6925 - RNA, 21 nt, Artificial Sequence
  ELANE RNA Guide
acgcauacgaaguugggcgca

SEQ ID NO: 6926 - RNA, 21 nt, Artificial Sequence
  ELANE RNA Guide
acucacacauucgccacgcau

SEQ ID NO: 6927 - RNA, 21 nt, Artificial Sequence
  ELANE RNA Guide
acuucguaugcguggcgaaug

SEQ ID NO: 6928 - RNA, 21 nt, Artificial Sequence
  ELANE RNA Guide
auacgaaguugggcgcaauca

SEQ ID NO: 6929 - RNA, 21 nt, Artificial Sequence
  ELANE RNA Guide
auucgccacgcauacgaaguu

SEQ ID NO: 6930 - RNA, 21 nt, Artificial Sequence
  ELANE RNA Guide
auugcgcccaacuucguaugc

SEQ ID NO: 6931 - RNA, 21 nt, Artificial Sequence
  ELANE RNA Guide
caacuucguaugcguggcgaa

SEQ ID NO: 6932 - RNA, 21 nt, Artificial Sequence
  ELANE RNA Guide
cacacauucgccacgcauacg

SEQ ID NO: 6933 - RNA, 21 nt, Artificial Sequence
  ELANE RNA Guide
cacauucgccacgcauacgaa

SEQ ID NO: 6934 - RNA, 21 nt, Artificial Sequence
  ELANE RNA Guide
cacgcauacgaaguugggcgc

SEQ ID NO: 6935 - RNA, 21 nt, Artificial Sequence
  ELANE RNA Guide
cauacgaaguugggcgcaauc

SEQ ID NO: 6936 - RNA, 21 nt, Artificial Sequence
  ELANE RNA Guide
cauucgccacgcauacgaagu

SEQ ID NO: 6937 - RNA, 21 nt, Artificial Sequence
  ELANE RNA Guide
ccaacuucguaugcguggcga

SEQ ID NO: 6938 - RNA, 21 nt, Artificial Sequence
  ELANE RNA Guide
ccacgcauacgaaguugggcg

SEQ ID NO: 6939 - RNA, 21 nt, Artificial Sequence
  ELANE RNA Guide
cccaacuucguaugcguggcg

SEQ ID NO: 6940 - RNA, 21 nt, Artificial Sequence
  ELANE RNA Guide
cccugauugcgcccaacuucg

SEQ ID NO: 6941 - RNA, 21 nt, Artificial Sequence
  ELANE RNA Guide
ccugauugcgcccaacuucgu

SEQ ID NO: 6942 - RNA, 21 nt, Artificial Sequence
  ELANE RNA Guide
cgcauacgaaguugggcgcaa

SEQ ID NO: 6943 - RNA, 21 nt, Artificial Sequence
  ELANE RNA Guide
cgccacgcauacgaaguuggg

SEQ ID NO: 6944 - RNA, 21 nt, Artificial Sequence
  ELANE RNA Guide
cgcccaacuucguaugcgugg

SEQ ID NO: 6945 - RNA, 21 nt, Artificial Sequence
  ELANE RNA Guide
cguaugcguggcgaaugugug

SEQ ID NO: 6946 - RNA, 21 nt, Artificial Sequence
  ELANE RNA Guide
cuacucacacauucgccacgc

SEQ ID NO: 6947 - RNA, 21 nt, Artificial Sequence
  ELANE RNA Guide
cucacacauucgccacgcaua

SEQ ID NO: 6948 - RNA, 21 nt, Artificial Sequence
  ELANE RNA Guide
cugauugcgcccaacuucgua

SEQ ID NO: 6949 - RNA, 21 nt, Artificial Sequence
  ELANE RNA Guide
cuucguaugcguggcgaaugu

SEQ ID NO: 6950 - RNA, 21 nt, Artificial Sequence
  ELANE RNA Guide
gauugcgcccaacuucguaug

SEQ ID NO: 6951 - RNA, 21 nt, Artificial Sequence
  ELANE RNA Guide
gcauacgaaguugggcgcaau

SEQ ID NO: 6952 - RNA, 21 nt, Artificial Sequence
  ELANE RNA Guide
gccacgcauacgaaguugggc

SEQ ID NO: 6953 - RNA, 21 nt, Artificial Sequence
  ELANE RNA Guide
gcccaacuucguaugcguggc

SEQ ID NO: 6954 - RNA, 21 nt, Artificial Sequence
  ELANE RNA Guide
gcgcccaacuucguaugcgug

SEQ ID NO: 6955 - RNA, 21 nt, Artificial Sequence
  ELANE RNA Guide
gcuacucacacauucgccacg

SEQ ID NO: 6956 - RNA, 21 nt, Artificial Sequence
  ELANE RNA Guide
guaugcguggcgaauguguga

SEQ ID NO: 6957 - RNA, 21 nt, Artificial Sequence
  ELANE RNA Guide
uacgaaguugggcgcaaucag

SEQ ID NO: 6958 - RNA, 21 nt, Artificial Sequence
  ELANE RNA Guide
uacucacacauucgccacgca

SEQ ID NO: 6959 - RNA, 21 nt, Artificial Sequence
  ELANE RNA Guide
ucacacauucgccacgcauac

SEQ ID NO: 6960 - RNA, 21 nt, Artificial Sequence
  ELANE RNA Guide
ucgccacgcauacgaaguugg

SEQ ID NO: 6961 - RNA, 21 nt, Artificial Sequence
  ELANE RNA Guide
ucguaugcguggcgaaugugu

SEQ ID NO: 6962 - RNA, 21 nt, Artificial Sequence
  ELANE RNA Guide
ugauugcgcccaacuucguau

SEQ ID NO: 6963 - RNA, 21 nt, Artificial Sequence
  ELANE RNA Guide
ugcgcccaacuucguaugcgu

SEQ ID NO: 6964 - RNA, 21 nt, Artificial Sequence
  ELANE RNA Guide
uucgccacgcauacgaaguug

SEQ ID NO: 6965 - RNA, 21 nt, Artificial Sequence
  ELANE RNA Guide
uucguaugcguggcgaaugug

SEQ ID NO: 6966 - RNA, 21 nt, Artificial Sequence
  ELANE RNA Guide
uugcgcccaacuucguaugcg

SEQ ID NO: 6967 - RNA, 22 nt, Artificial Sequence
  ELANE RNA Guide
aacuucguaugcguggcgaaug

SEQ ID NO: 6968 - RNA, 22 nt, Artificial Sequence
  ELANE RNA Guide
acacauucgccacgcauacgaa

SEQ ID NO: 6969 - RNA, 22 nt, Artificial Sequence
  ELANE RNA Guide
acauucgccacgcauacgaagu

SEQ ID NO: 6970 - RNA, 22 nt, Artificial Sequence
  ELANE RNA Guide
acccugauugcgcccaacuucg

SEQ ID NO: 6971 - RNA, 22 nt, Artificial Sequence
  ELANE RNA Guide
acgcauacgaaguugggcgcaa

SEQ ID NO: 6972 - RNA, 22 nt, Artificial Sequence
  ELANE RNA Guide
acucacacauucgccacgcaua

SEQ ID NO: 6973 - RNA, 22 nt, Artificial Sequence
  ELANE RNA Guide
acuucguaugcguggcgaaugu

SEQ ID NO: 6974 - RNA, 22 nt, Artificial Sequence
  ELANE RNA Guide
auacgaaguugggcgcaaucag

SEQ ID NO: 6975 - RNA, 22 nt, Artificial Sequence
  ELANE RNA Guide
auucgccacgcauacgaaguug

SEQ ID NO: 6976 - RNA, 22 nt, Artificial Sequence
  ELANE RNA Guide
auugcgcccaacuucguaugcg

SEQ ID NO: 6977 - RNA, 22 nt, Artificial Sequence
  ELANE RNA Guide
caacuucguaugcguggcgaau

SEQ ID NO: 6978 - RNA, 22 nt, Artificial Sequence
  ELANE RNA Guide
cacacauucgccacgcauacga

SEQ ID NO: 6979 - RNA, 22 nt, Artificial Sequence
  ELANE RNA Guide
cacauucgccacgcauacgaag

SEQ ID NO: 6980 - RNA, 22 nt, Artificial Sequence
  ELANE RNA Guide
cacgcauacgaaguugggcgca

SEQ ID NO: 6981 - RNA, 22 nt, Artificial Sequence
  ELANE RNA Guide
cauacgaaguugggcgcaauca

SEQ ID NO: 6982 - RNA, 22 nt, Artificial Sequence
  ELANE RNA Guide
cauucgccacgcauacgaaguu

SEQ ID NO: 6983 - RNA, 22 nt, Artificial Sequence
  ELANE RNA Guide
ccaacuucguaugcguggcgaa

SEQ ID NO: 6984 - RNA, 22 nt, Artificial Sequence
  ELANE RNA Guide
ccacgcauacgaaguugggcgc

SEQ ID NO: 6985 - RNA, 22 nt, Artificial Sequence
  ELANE RNA Guide
cccaacuucguaugcguggcga

SEQ ID NO: 6986 - RNA, 22 nt, Artificial Sequence
  ELANE RNA Guide
cccugauugcgcccaacuucgu

SEQ ID NO: 6987 - RNA, 22 nt, Artificial Sequence
  ELANE RNA Guide
ccugauugcgcccaacuucgua

SEQ ID NO: 6988 - RNA, 22 nt, Artificial Sequence
  ELANE RNA Guide
cgcauacgaaguugggcgcaau

SEQ ID NO: 6989 - RNA, 22 nt, Artificial Sequence
  ELANE RNA Guide
cgccacgcauacgaaguugggc

SEQ ID NO: 6990 - RNA, 22 nt, Artificial Sequence
  ELANE RNA Guide
cgcccaacuucguaugcguggc

SEQ ID NO: 6991 - RNA, 22 nt, Artificial Sequence
  ELANE RNA Guide
cguaugcguggcgaauguguga

SEQ ID NO: 6992 - RNA, 22 nt, Artificial Sequence
  ELANE RNA Guide
cuacucacacauucgccacgca

SEQ ID NO: 6993 - RNA, 22 nt, Artificial Sequence
  ELANE RNA Guide
cucacacauucgccacgcauac

SEQ ID NO: 6994 - RNA, 22 nt, Artificial Sequence
  ELANE RNA Guide
cugauugcgcccaacuucguau

SEQ ID NO: 6995 - RNA, 22 nt, Artificial Sequence
  ELANE RNA Guide
cuucguaugcguggcgaaugug

SEQ ID NO: 6996 - RNA, 22 nt, Artificial Sequence
  ELANE RNA Guide
gauugcgcccaacuucguaugc

SEQ ID NO: 6997 - RNA, 22 nt, Artificial Sequence
  ELANE RNA Guide
gcauacgaaguugggcgcaauc

SEQ ID NO: 6998 - RNA, 22 nt, Artificial Sequence
  ELANE RNA Guide
gccacgcauacgaaguugggcg

SEQ ID NO: 6999 - RNA, 22 nt, Artificial Sequence
  ELANE RNA Guide
gcccaacuucguaugcguggcg

SEQ ID NO: 7000 - RNA, 22 nt, Artificial Sequence
  ELANE RNA Guide
gcgcccaacuucguaugcgugg

SEQ ID NO: 7001 - RNA, 22 nt, Artificial Sequence
  ELANE RNA Guide
gcuacucacacauucgccacgc

SEQ ID NO: 7002 - RNA, 22 nt, Artificial Sequence
  ELANE RNA Guide
ggcuacucacacauucgccacg

SEQ ID NO: 7003 - RNA, 22 nt, Artificial Sequence
  ELANE RNA Guide
guaugcguggcgaaugugugag

SEQ ID NO: 7004 - RNA, 22 nt, Artificial Sequence
  ELANE RNA Guide
uacgaaguugggcgcaaucagg

SEQ ID NO: 7005 - RNA, 22 nt, Artificial Sequence
  ELANE RNA Guide
uacucacacauucgccacgcau

SEQ ID NO: 7006 - RNA, 22 nt, Artificial Sequence
  ELANE RNA Guide
ucacacauucgccacgcauacg

SEQ ID NO: 7007 - RNA, 22 nt, Artificial Sequence
  ELANE RNA Guide
ucgccacgcauacgaaguuggg

SEQ ID NO: 7008 - RNA, 22 nt, Artificial Sequence
  ELANE RNA Guide
ucguaugcguggcgaaugugug

SEQ ID NO: 7009 - RNA, 22 nt, Artificial Sequence
  ELANE RNA Guide
ugauugcgcccaacuucguaug

SEQ ID NO: 7010 - RNA, 22 nt, Artificial Sequence
  ELANE RNA Guide
ugcgcccaacuucguaugcgug

SEQ ID NO: 7011 - RNA, 22 nt, Artificial Sequence
  ELANE RNA Guide
uucgccacgcauacgaaguugg

SEQ ID NO: 7012 - RNA, 22 nt, Artificial Sequence
  ELANE RNA Guide
uucguaugcguggcgaaugugu

SEQ ID NO: 7013 - RNA, 22 nt, Artificial Sequence
  ELANE RNA Guide
uugcgcccaacuucguaugcgu

SEQ ID NO: 7014 - RNA, 20 nt, Artificial Sequence
  ELANE RNA Guide
aacuucgacaugucggccgc

SEQ ID NO: 7015 - RNA, 20 nt, Artificial Sequence
  ELANE RNA Guide
acaugucgaaguugggcgca

SEQ ID NO: 7016 - RNA, 20 nt, Artificial Sequence
  ELANE RNA Guide
acuucgacaugucggccgcg

SEQ ID NO: 7017 - RNA, 20 nt, Artificial Sequence
  ELANE RNA Guide
agugcgcggccgacaugucg

SEQ ID NO: 7018 - RNA, 20 nt, Artificial Sequence
  ELANE RNA Guide
augucgaaguugggcgcaau

SEQ ID NO: 7019 - RNA, 20 nt, Artificial Sequence
  ELANE RNA Guide
auugcgcccaacuucgacau

SEQ ID NO: 7020 - RNA, 20 nt, Artificial Sequence
  ELANE RNA Guide
caacuucgacaugucggccg

SEQ ID NO: 7021 - RNA, 20 nt, Artificial Sequence
  ELANE RNA Guide
cagugcgcggccgacauguc

SEQ ID NO: 7022 - RNA, 20 nt, Artificial Sequence
  ELANE RNA Guide
caugucgaaguugggcgcaa

SEQ ID NO: 7023 - RNA, 20 nt, Artificial Sequence
  ELANE RNA Guide
ccaacuucgacaugucggcc

SEQ ID NO: 7024 - RNA, 20 nt, Artificial Sequence
  ELANE RNA Guide
ccacgcagugcgcggccgac

SEQ ID NO: 7025 - RNA, 20 nt, Artificial Sequence
  ELANE RNA Guide
cccaacuucgacaugucggc

SEQ ID NO: 7026 - RNA, 20 nt, Artificial Sequence
  ELANE RNA Guide
ccgacaugucgaaguugggc

SEQ ID NO: 7027 - RNA, 20 nt, Artificial Sequence
  ELANE RNA Guide
cgacaugucgaaguugggcg

SEQ ID NO: 7028 - RNA, 20 nt, Artificial Sequence
  ELANE RNA Guide
cgacaugucggccgcgcacu

SEQ ID NO: 7029 - RNA, 20 nt, Artificial Sequence
  ELANE RNA Guide
cgcccaacuucgacaugucg

SEQ ID NO: 7030 - RNA, 20 nt, Artificial Sequence
  ELANE RNA Guide
cgcggccgacaugucgaagu

SEQ ID NO: 7031 - RNA, 20 nt, Artificial Sequence
  ELANE RNA Guide
cggccgacaugucgaaguug

SEQ ID NO: 7032 - RNA, 20 nt, Artificial Sequence
  ELANE RNA Guide
cugauugcgcccaacuucga

SEQ ID NO: 7033 - RNA, 20 nt, Artificial Sequence
  ELANE RNA Guide
cuucgacaugucggccgcgc

SEQ ID NO: 7034 - RNA, 20 nt, Artificial Sequence
  ELANE RNA Guide
gacaugucgaaguugggcgc

SEQ ID NO: 7035 - RNA, 20 nt, Artificial Sequence
  ELANE RNA Guide
gacaugucggccgcgcacug

SEQ ID NO: 7036 - RNA, 20 nt, Artificial Sequence
  ELANE RNA Guide
gauugcgcccaacuucgaca

SEQ ID NO: 7037 - RNA, 20 nt, Artificial Sequence
  ELANE RNA Guide
gcagugcgcggccgacaugu

SEQ ID NO: 7038 - RNA, 20 nt, Artificial Sequence
  ELANE RNA Guide
gcccaacuucgacaugucgg

SEQ ID NO: 7039 - RNA, 20 nt, Artificial Sequence
  ELANE RNA Guide
gccgacaugucgaaguuggg

SEQ ID NO: 7040 - RNA, 20 nt, Artificial Sequence
  ELANE RNA Guide
gcgcccaacuucgacauguc

SEQ ID NO: 7041 - RNA, 20 nt, Artificial Sequence
  ELANE RNA Guide
gcgcggccgacaugucgaag

SEQ ID NO: 7042 - RNA, 20 nt, Artificial Sequence
  ELANE RNA Guide
gcggccgacaugucgaaguu

SEQ ID NO: 7043 - RNA, 20 nt, Artificial Sequence
  ELANE RNA Guide
ggccgacaugucgaaguugg

SEQ ID NO: 7044 - RNA, 20 nt, Artificial Sequence
  ELANE RNA Guide
gucgaaguugggcgcaauca

SEQ ID NO: 7045 - RNA, 20 nt, Artificial Sequence
  ELANE RNA Guide
gugcgcggccgacaugucga

SEQ ID NO: 7046 - RNA, 20 nt, Artificial Sequence
  ELANE RNA Guide
ucgacaugucggccgcgcac

SEQ ID NO: 7047 - RNA, 20 nt, Artificial Sequence
  ELANE RNA Guide
ugauugcgcccaacuucgac

SEQ ID NO: 7048 - RNA, 20 nt, Artificial Sequence
  ELANE RNA Guide
ugcgcccaacuucgacaugu

SEQ ID NO: 7049 - RNA, 20 nt, Artificial Sequence
  ELANE RNA Guide
ugcgcggccgacaugucgaa

SEQ ID NO: 7050 - RNA, 20 nt, Artificial Sequence
  ELANE RNA Guide
ugucgaaguugggcgcaauc

SEQ ID NO: 7051 - RNA, 20 nt, Artificial Sequence
  ELANE RNA Guide
uucgacaugucggccgcgca

SEQ ID NO: 7052 - RNA, 20 nt, Artificial Sequence
  ELANE RNA Guide
uugcgcccaacuucgacaug

SEQ ID NO: 7053 - RNA, 21 nt, Artificial Sequence
  ELANE RNA Guide
aacuucgacaugucggccgcg

SEQ ID NO: 7054 - RNA, 21 nt, Artificial Sequence
  ELANE RNA Guide
acaugucgaaguugggcgcaa

SEQ ID NO: 7055 - RNA, 21 nt, Artificial Sequence
  ELANE RNA Guide
acuucgacaugucggccgcgc

SEQ ID NO: 7056 - RNA, 21 nt, Artificial Sequence
  ELANE RNA Guide
agugcgcggccgacaugucga

SEQ ID NO: 7057 - RNA, 21 nt, Artificial Sequence
  ELANE RNA Guide
augucgaaguugggcgcaauc

SEQ ID NO: 7058 - RNA, 21 nt, Artificial Sequence
  ELANE RNA Guide
auugcgcccaacuucgacaug

SEQ ID NO: 7059 - RNA, 21 nt, Artificial Sequence
  ELANE RNA Guide
caacuucgacaugucggccgc

SEQ ID NO: 7060 - RNA, 21 nt, Artificial Sequence
  ELANE RNA Guide
cagugcgcggccgacaugucg

SEQ ID NO: 7061 - RNA, 21 nt, Artificial Sequence
  ELANE RNA Guide
caugucgaaguugggcgcaau

SEQ ID NO: 7062 - RNA, 21 nt, Artificial Sequence
  ELANE RNA Guide
ccaacuucgacaugucggccg

SEQ ID NO: 7063 - RNA, 21 nt, Artificial Sequence
  ELANE RNA Guide
cccaacuucgacaugucggcc

SEQ ID NO: 7064 - RNA, 21 nt, Artificial Sequence
  ELANE RNA Guide
ccgacaugucgaaguugggcg

SEQ ID NO: 7065 - RNA, 21 nt, Artificial Sequence
  ELANE RNA Guide
ccugauugcgcccaacuucga

SEQ ID NO: 7066 - RNA, 21 nt, Artificial Sequence
  ELANE RNA Guide
cgacaugucgaaguugggcgc

SEQ ID NO: 7067 - RNA, 21 nt, Artificial Sequence
  ELANE RNA Guide
cgacaugucggccgcgcacug

SEQ ID NO: 7068 - RNA, 21 nt, Artificial Sequence
  ELANE RNA Guide
cgcagugcgcggccgacaugu

SEQ ID NO: 7069 - RNA, 21 nt, Artificial Sequence
  ELANE RNA Guide
cgcccaacuucgacaugucgg

SEQ ID NO: 7070 - RNA, 21 nt, Artificial Sequence
  ELANE RNA Guide
cgcggccgacaugucgaaguu

SEQ ID NO: 7071 - RNA, 21 nt, Artificial Sequence
  ELANE RNA Guide
cggccgacaugucgaaguugg

SEQ ID NO: 7072 - RNA, 21 nt, Artificial Sequence
  ELANE RNA Guide
cugauugcgcccaacuucgac

SEQ ID NO: 7073 - RNA, 21 nt, Artificial Sequence
  ELANE RNA Guide
cuucgacaugucggccgcgca

SEQ ID NO: 7074 - RNA, 21 nt, Artificial Sequence
  ELANE RNA Guide
gacaugucgaaguugggcgca

SEQ ID NO: 7075 - RNA, 21 nt, Artificial Sequence
  ELANE RNA Guide
gacaugucggccgcgcacugc

SEQ ID NO: 7076 - RNA, 21 nt, Artificial Sequence
  ELANE RNA Guide
gauugcgcccaacuucgacau

SEQ ID NO: 7077 - RNA, 21 nt, Artificial Sequence
  ELANE RNA Guide
gcagugcgcggccgacauguc

SEQ ID NO: 7078 - RNA, 21 nt, Artificial Sequence
  ELANE RNA Guide
gcccaacuucgacaugucggc

SEQ ID NO: 7079 - RNA, 21 nt, Artificial Sequence
  ELANE RNA Guide
gccgacaugucgaaguugggc

SEQ ID NO: 7080 - RNA, 21 nt, Artificial Sequence
  ELANE RNA Guide
gcgcccaacuucgacaugucg

SEQ ID NO: 7081 - RNA, 21 nt, Artificial Sequence
  ELANE RNA Guide
gcgcggccgacaugucgaagu

SEQ ID NO: 7082 - RNA, 21 nt, Artificial Sequence
  ELANE RNA Guide
gcggccgacaugucgaaguug

SEQ ID NO: 7083 - RNA, 21 nt, Artificial Sequence
  ELANE RNA Guide
ggccgacaugucgaaguuggg

SEQ ID NO: 7084 - RNA, 21 nt, Artificial Sequence
  ELANE RNA Guide
gucgaaguugggcgcaaucag

SEQ ID NO: 7085 - RNA, 21 nt, Artificial Sequence
  ELANE RNA Guide
gugcgcggccgacaugucgaa

SEQ ID NO: 7086 - RNA, 21 nt, Artificial Sequence
  ELANE RNA Guide
ucgacaugucggccgcgcacu

SEQ ID NO: 7087 - RNA, 21 nt, Artificial Sequence
  ELANE RNA Guide
ugauugcgcccaacuucgaca

SEQ ID NO: 7088 - RNA, 21 nt, Artificial Sequence
  ELANE RNA Guide
ugcgcccaacuucgacauguc

SEQ ID NO: 7089 - RNA, 21 nt, Artificial Sequence
  ELANE RNA Guide
ugcgcggccgacaugucgaag

SEQ ID NO: 7090 - RNA, 21 nt, Artificial Sequence
  ELANE RNA Guide
ugucgaaguugggcgcaauca

SEQ ID NO: 7091 - RNA, 21 nt, Artificial Sequence
  ELANE RNA Guide
uucgacaugucggccgcgcac

SEQ ID NO: 7092 - RNA, 21 nt, Artificial Sequence
  ELANE RNA Guide
uugcgcccaacuucgacaugu

SEQ ID NO: 7093 - RNA, 22 nt, Artificial Sequence
  ELANE RNA Guide
aacuucgacaugucggccgcgc

SEQ ID NO: 7094 - RNA, 22 nt, Artificial Sequence
  ELANE RNA Guide
acaugucgaaguugggcgcaau

SEQ ID NO: 7095 - RNA, 22 nt, Artificial Sequence
  ELANE RNA Guide
acgcagugcgcggccgacaugu

SEQ ID NO: 7096 - RNA, 22 nt, Artificial Sequence
  ELANE RNA Guide
acuucgacaugucggccgcgca

SEQ ID NO: 7097 - RNA, 22 nt, Artificial Sequence
  ELANE RNA Guide
agugcgcggccgacaugucgaa

SEQ ID NO: 7098 - RNA, 22 nt, Artificial Sequence
  ELANE RNA Guide
augucgaaguugggcgcaauca

SEQ ID NO: 7099 - RNA, 22 nt, Artificial Sequence
  ELANE RNA Guide
auugcgcccaacuucgacaugu

SEQ ID NO: 7100 - RNA, 22 nt, Artificial Sequence
  ELANE RNA Guide
caacuucgacaugucggccgcg

SEQ ID NO: 7101 - RNA, 22 nt, Artificial Sequence
  ELANE RNA Guide
cagugcgcggccgacaugucga

SEQ ID NO: 7102 - RNA, 22 nt, Artificial Sequence
  ELANE RNA Guide
caugucgaaguugggcgcaauc

SEQ ID NO: 7103 - RNA, 22 nt, Artificial Sequence
  ELANE RNA Guide
ccaacuucgacaugucggccgc

SEQ ID NO: 7104 - RNA, 22 nt, Artificial Sequence
  ELANE RNA Guide
cccaacuucgacaugucggccg

SEQ ID NO: 7105 - RNA, 22 nt, Artificial Sequence
  ELANE RNA Guide
cccugauugcgcccaacuucga

SEQ ID NO: 7106 - RNA, 22 nt, Artificial Sequence
  ELANE RNA Guide
ccgacaugucgaaguugggcgc

SEQ ID NO: 7107 - RNA, 22 nt, Artificial Sequence
  ELANE RNA Guide
ccugauugcgcccaacuucgac

SEQ ID NO: 7108 - RNA, 22 nt, Artificial Sequence
  ELANE RNA Guide
cgacaugucgaaguugggcgca

SEQ ID NO: 7109 - RNA, 22 nt, Artificial Sequence
  ELANE RNA Guide
cgacaugucggccgcgcacugc

SEQ ID NO: 7110 - RNA, 22 nt, Artificial Sequence
  ELANE RNA Guide
cgcagugcgcggccgacauguc

SEQ ID NO: 7111 - RNA, 22 nt, Artificial Sequence
  ELANE RNA Guide
cgcccaacuucgacaugucggc

SEQ ID NO: 7112 - RNA, 22 nt, Artificial Sequence
  ELANE RNA Guide
cgcggccgacaugucgaaguug

SEQ ID NO: 7113 - RNA, 22 nt, Artificial Sequence
  ELANE RNA Guide
cggccgacaugucgaaguuggg

SEQ ID NO: 7114 - RNA, 22 nt, Artificial Sequence
  ELANE RNA Guide
cugauugcgcccaacuucgaca

SEQ ID NO: 7115 - RNA, 22 nt, Artificial Sequence
  ELANE RNA Guide
cuucgacaugucggccgcgcac

SEQ ID NO: 7116 - RNA, 22 nt, Artificial Sequence
  ELANE RNA Guide
gacaugucgaaguugggcgcaa

SEQ ID NO: 7117 - RNA, 22 nt, Artificial Sequence
  ELANE RNA Guide
gacaugucggccgcgcacugcg

SEQ ID NO: 7118 - RNA, 22 nt, Artificial Sequence
  ELANE RNA Guide
gauugcgcccaacuucgacaug

SEQ ID NO: 7119 - RNA, 22 nt, Artificial Sequence
  ELANE RNA Guide
gcagugcgcggccgacaugucg

SEQ ID NO: 7120 - RNA, 22 nt, Artificial Sequence
  ELANE RNA Guide
gcccaacuucgacaugucggcc

SEQ ID NO: 7121 - RNA, 22 nt, Artificial Sequence
  ELANE RNA Guide
gccgacaugucgaaguugggcg

SEQ ID NO: 7122 - RNA, 22 nt, Artificial Sequence
  ELANE RNA Guide
gcgcccaacuucgacaugucgg

SEQ ID NO: 7123 - RNA, 22 nt, Artificial Sequence
  ELANE RNA Guide
gcgcggccgacaugucgaaguu

SEQ ID NO: 7124 - RNA, 22 nt, Artificial Sequence
  ELANE RNA Guide
gcggccgacaugucgaaguugg

SEQ ID NO: 7125 - RNA, 22 nt, Artificial Sequence
  ELANE RNA Guide
ggccgacaugucgaaguugggc

SEQ ID NO: 7126 - RNA, 22 nt, Artificial Sequence
  ELANE RNA Guide
gucgaaguugggcgcaaucagg

SEQ ID NO: 7127 - RNA, 22 nt, Artificial Sequence
  ELANE RNA Guide
gugcgcggccgacaugucgaag

SEQ ID NO: 7128 - RNA, 22 nt, Artificial Sequence
  ELANE RNA Guide
ucgacaugucggccgcgcacug

SEQ ID NO: 7129 - RNA, 22 nt, Artificial Sequence
  ELANE RNA Guide
ugauugcgcccaacuucgacau

SEQ ID NO: 7130 - RNA, 22 nt, Artificial Sequence
  ELANE RNA Guide
ugcgcccaacuucgacaugucg

SEQ ID NO: 7131 - RNA, 22 nt, Artificial Sequence
  ELANE RNA Guide
ugcgcggccgacaugucgaagu

SEQ ID NO: 7132 - RNA, 22 nt, Artificial Sequence
  ELANE RNA Guide
ugucgaaguugggcgcaaucag

SEQ ID NO: 7133 - RNA, 22 nt, Artificial Sequence
  ELANE RNA Guide
uucgacaugucggccgcgcacu

SEQ ID NO: 7134 - RNA, 22 nt, Artificial Sequence
  ELANE RNA Guide
uugcgcccaacuucgacauguc

SEQ ID NO: 7135 - RNA, 20 nt, Artificial Sequence
  ELANE RNA Guide
aacuucgucaggucggccgc

SEQ ID NO: 7136 - RNA, 20 nt, Artificial Sequence
  ELANE RNA Guide
accugacgaaguugggcgca

SEQ ID NO: 7137 - RNA, 20 nt, Artificial Sequence
  ELANE RNA Guide
acgcagugcgcggccgaccu

SEQ ID NO: 7138 - RNA, 20 nt, Artificial Sequence
  ELANE RNA Guide
acuucgucaggucggccgcg

SEQ ID NO: 7139 - RNA, 20 nt, Artificial Sequence
  ELANE RNA Guide
aggucggccgcgcacugcgu

SEQ ID NO: 7140 - RNA, 20 nt, Artificial Sequence
  ELANE RNA Guide
agugcgcggccgaccugacg

SEQ ID NO: 7141 - RNA, 20 nt, Artificial Sequence
  ELANE RNA Guide
auugcgcccaacuucgucag

SEQ ID NO: 7142 - RNA, 20 nt, Artificial Sequence
  ELANE RNA Guide
caacuucgucaggucggccg

SEQ ID NO: 7143 - RNA, 20 nt, Artificial Sequence
  ELANE RNA Guide
cacgcagugcgcggccgacc

SEQ ID NO: 7144 - RNA, 20 nt, Artificial Sequence
  ELANE RNA Guide
caggucggccgcgcacugcg

SEQ ID NO: 7145 - RNA, 20 nt, Artificial Sequence
  ELANE RNA Guide
cagugcgcggccgaccugac

SEQ ID NO: 7146 - RNA, 20 nt, Artificial Sequence
  ELANE RNA Guide
ccaacuucgucaggucggcc

SEQ ID NO: 7147 - RNA, 20 nt, Artificial Sequence
  ELANE RNA Guide
cccaacuucgucaggucggc

SEQ ID NO: 7148 - RNA, 20 nt, Artificial Sequence
  ELANE RNA Guide
ccgaccugacgaaguugggc

SEQ ID NO: 7149 - RNA, 20 nt, Artificial Sequence
  ELANE RNA Guide
ccugacgaaguugggcgcaa

SEQ ID NO: 7150 - RNA, 20 nt, Artificial Sequence
  ELANE RNA Guide
cgaccugacgaaguugggcg

SEQ ID NO: 7151 - RNA, 20 nt, Artificial Sequence
  ELANE RNA Guide
cgcagugcgcggccgaccug

SEQ ID NO: 7152 - RNA, 20 nt, Artificial Sequence
  ELANE RNA Guide
cgcccaacuucgucaggucg

SEQ ID NO: 7153 - RNA, 20 nt, Artificial Sequence
  ELANE RNA Guide
cgcggccgaccugacgaagu

SEQ ID NO: 7154 - RNA, 20 nt, Artificial Sequence
  ELANE RNA Guide
cggccgaccugacgaaguug

SEQ ID NO: 7155 - RNA, 20 nt, Artificial Sequence
  ELANE RNA Guide
cgucaggucggccgcgcacu

SEQ ID NO: 7156 - RNA, 20 nt, Artificial Sequence
  ELANE RNA Guide
cuucgucaggucggccgcgc

SEQ ID NO: 7157 - RNA, 20 nt, Artificial Sequence
  ELANE RNA Guide
gaccugacgaaguugggcgc

SEQ ID NO: 7158 - RNA, 20 nt, Artificial Sequence
  ELANE RNA Guide
gauugcgcccaacuucguca

SEQ ID NO: 7159 - RNA, 20 nt, Artificial Sequence
  ELANE RNA Guide
gcagugcgcggccgaccuga

SEQ ID NO: 7160 - RNA, 20 nt, Artificial Sequence
  ELANE RNA Guide
gccacgcagugcgcggccga

SEQ ID NO: 7161 - RNA, 20 nt, Artificial Sequence
  ELANE RNA Guide
gcccaacuucgucaggucgg

SEQ ID NO: 7162 - RNA, 20 nt, Artificial Sequence
  ELANE RNA Guide
gccgaccugacgaaguuggg

SEQ ID NO: 7163 - RNA, 20 nt, Artificial Sequence
  ELANE RNA Guide
gcgcccaacuucgucagguc

SEQ ID NO: 7164 - RNA, 20 nt, Artificial Sequence
  ELANE RNA Guide
gcgcggccgaccugacgaag

SEQ ID NO: 7165 - RNA, 20 nt, Artificial Sequence
  ELANE RNA Guide
gcggccgaccugacgaaguu

SEQ ID NO: 7166 - RNA, 20 nt, Artificial Sequence
  ELANE RNA Guide
ggccgaccugacgaaguugg

SEQ ID NO: 7167 - RNA, 20 nt, Artificial Sequence
  ELANE RNA Guide
gucaggucggccgcgcacug

SEQ ID NO: 7168 - RNA, 20 nt, Artificial Sequence
  ELANE RNA Guide
gugcgcggccgaccugacga

SEQ ID NO: 7169 - RNA, 20 nt, Artificial Sequence
  ELANE RNA Guide
ucaggucggccgcgcacugc

SEQ ID NO: 7170 - RNA, 20 nt, Artificial Sequence
  ELANE RNA Guide
ucgccacgcagugcgcggcc

SEQ ID NO: 7171 - RNA, 20 nt, Artificial Sequence
  ELANE RNA Guide
ucgucaggucggccgcgcac

SEQ ID NO: 7172 - RNA, 20 nt, Artificial Sequence
  ELANE RNA Guide
ugauugcgcccaacuucguc

SEQ ID NO: 7173 - RNA, 20 nt, Artificial Sequence
  ELANE RNA Guide
ugcgcccaacuucgucaggu

SEQ ID NO: 7174 - RNA, 20 nt, Artificial Sequence
  ELANE RNA Guide
ugcgcggccgaccugacgaa

SEQ ID NO: 7175 - RNA, 20 nt, Artificial Sequence
  ELANE RNA Guide
uucgucaggucggccgcgca

SEQ ID NO: 7176 - RNA, 20 nt, Artificial Sequence
  ELANE RNA Guide
uugcgcccaacuucgucagg

SEQ ID NO: 7177 - RNA, 21 nt, Artificial Sequence
  ELANE RNA Guide
aacuucgucaggucggccgcg

SEQ ID NO: 7178 - RNA, 21 nt, Artificial Sequence
  ELANE RNA Guide
accugacgaaguugggcgcaa

SEQ ID NO: 7179 - RNA, 21 nt, Artificial Sequence
  ELANE RNA Guide
acgcagugcgcggccgaccug

SEQ ID NO: 7180 - RNA, 21 nt, Artificial Sequence
  ELANE RNA Guide
acuucgucaggucggccgcgc

SEQ ID NO: 7181 - RNA, 21 nt, Artificial Sequence
  ELANE RNA Guide
aggucggccgcgcacugcgug

SEQ ID NO: 7182 - RNA, 21 nt, Artificial Sequence
  ELANE RNA Guide
agugcgcggccgaccugacga

SEQ ID NO: 7183 - RNA, 21 nt, Artificial Sequence
  ELANE RNA Guide
auugcgcccaacuucgucagg

SEQ ID NO: 7184 - RNA, 21 nt, Artificial Sequence
  ELANE RNA Guide
caacuucgucaggucggccgc

SEQ ID NO: 7185 - RNA, 21 nt, Artificial Sequence
  ELANE RNA Guide
cacgcagugcgcggccgaccu

SEQ ID NO: 7186 - RNA, 21 nt, Artificial Sequence
  ELANE RNA Guide
caggucggccgcgcacugcgu

SEQ ID NO: 7187 - RNA, 21 nt, Artificial Sequence
  ELANE RNA Guide
cagugcgcggccgaccugacg

SEQ ID NO: 7188 - RNA, 21 nt, Artificial Sequence
  ELANE RNA Guide
ccaacuucgucaggucggccg

SEQ ID NO: 7189 - RNA, 21 nt, Artificial Sequence
  ELANE RNA Guide
cccaacuucgucaggucggcc

SEQ ID NO: 7190 - RNA, 21 nt, Artificial Sequence
  ELANE RNA Guide
ccgaccugacgaaguugggcg

SEQ ID NO: 7191 - RNA, 21 nt, Artificial Sequence
  ELANE RNA Guide
ccugacgaaguugggcgcaau

SEQ ID NO: 7192 - RNA, 21 nt, Artificial Sequence
  ELANE RNA Guide
cgaccugacgaaguugggcgc

SEQ ID NO: 7193 - RNA, 21 nt, Artificial Sequence
  ELANE RNA Guide
cgcagugcgcggccgaccuga

SEQ ID NO: 7194 - RNA, 21 nt, Artificial Sequence
  ELANE RNA Guide
cgcccaacuucgucaggucgg

SEQ ID NO: 7195 - RNA, 21 nt, Artificial Sequence
  ELANE RNA Guide
cgcggccgaccugacgaaguu

SEQ ID NO: 7196 - RNA, 21 nt, Artificial Sequence
  ELANE RNA Guide
cggccgaccugacgaaguugg

SEQ ID NO: 7197 - RNA, 21 nt, Artificial Sequence
  ELANE RNA Guide
cgucaggucggccgcgcacug

SEQ ID NO: 7198 - RNA, 21 nt, Artificial Sequence
  ELANE RNA Guide
cugauugcgcccaacuucguc

SEQ ID NO: 7199 - RNA, 21 nt, Artificial Sequence
  ELANE RNA Guide
cuucgucaggucggccgcgca

SEQ ID NO: 7200 - RNA, 21 nt, Artificial Sequence
  ELANE RNA Guide
gaccugacgaaguugggcgca

SEQ ID NO: 7201 - RNA, 21 nt, Artificial Sequence
  ELANE RNA Guide
gauugcgcccaacuucgucag

SEQ ID NO: 7202 - RNA, 21 nt, Artificial Sequence
  ELANE RNA Guide
gcagugcgcggccgaccugac

SEQ ID NO: 7203 - RNA, 21 nt, Artificial Sequence
  ELANE RNA Guide
gcccaacuucgucaggucggc

SEQ ID NO: 7204 - RNA, 21 nt, Artificial Sequence
  ELANE RNA Guide
gccgaccugacgaaguugggc

SEQ ID NO: 7205 - RNA, 21 nt, Artificial Sequence
  ELANE RNA Guide
gcgcccaacuucgucaggucg

SEQ ID NO: 7206 - RNA, 21 nt, Artificial Sequence
  ELANE RNA Guide
gcgcggccgaccugacgaagu

SEQ ID NO: 7207 - RNA, 21 nt, Artificial Sequence
  ELANE RNA Guide
gcggccgaccugacgaaguug

SEQ ID NO: 7208 - RNA, 21 nt, Artificial Sequence
  ELANE RNA Guide
ggccgaccugacgaaguuggg

SEQ ID NO: 7209 - RNA, 21 nt, Artificial Sequence
  ELANE RNA Guide
gucaggucggccgcgcacugc

SEQ ID NO: 7210 - RNA, 21 nt, Artificial Sequence
  ELANE RNA Guide
gugcgcggccgaccugacgaa

SEQ ID NO: 7211 - RNA, 21 nt, Artificial Sequence
  ELANE RNA Guide
ucaggucggccgcgcacugcg

SEQ ID NO: 7212 - RNA, 21 nt, Artificial Sequence
  ELANE RNA Guide
ucgucaggucggccgcgcacu

SEQ ID NO: 7213 - RNA, 21 nt, Artificial Sequence
  ELANE RNA Guide
ugauugcgcccaacuucguca

SEQ ID NO: 7214 - RNA, 21 nt, Artificial Sequence
  ELANE RNA Guide
ugcgcccaacuucgucagguc

SEQ ID NO: 7215 - RNA, 21 nt, Artificial Sequence
  ELANE RNA Guide
ugcgcggccgaccugacgaag

SEQ ID NO: 7216 - RNA, 21 nt, Artificial Sequence
  ELANE RNA Guide
uucgccacgcagugcgcggcc

SEQ ID NO: 7217 - RNA, 21 nt, Artificial Sequence
  ELANE RNA Guide
uucgucaggucggccgcgcac

SEQ ID NO: 7218 - RNA, 21 nt, Artificial Sequence
  ELANE RNA Guide
uugcgcccaacuucgucaggu

SEQ ID NO: 7219 - RNA, 22 nt, Artificial Sequence
  ELANE RNA Guide
aacuucgucaggucggccgcgc

SEQ ID NO: 7220 - RNA, 22 nt, Artificial Sequence
  ELANE RNA Guide
accugacgaaguugggcgcaau

SEQ ID NO: 7221 - RNA, 22 nt, Artificial Sequence
  ELANE RNA Guide
acgcagugcgcggccgaccuga

SEQ ID NO: 7222 - RNA, 22 nt, Artificial Sequence
  ELANE RNA Guide
acuucgucaggucggccgcgca

SEQ ID NO: 7223 - RNA, 22 nt, Artificial Sequence
  ELANE RNA Guide
aggucggccgcgcacugcgugg

SEQ ID NO: 7224 - RNA, 22 nt, Artificial Sequence
  ELANE RNA Guide
agugcgcggccgaccugacgaa

SEQ ID NO: 7225 - RNA, 22 nt, Artificial Sequence
  ELANE RNA Guide
auucgccacgcagugcgcggcc

SEQ ID NO: 7226 - RNA, 22 nt, Artificial Sequence
  ELANE RNA Guide
auugcgcccaacuucgucaggu

SEQ ID NO: 7227 - RNA, 22 nt, Artificial Sequence
  ELANE RNA Guide
caacuucgucaggucggccgcg

SEQ ID NO: 7228 - RNA, 22 nt, Artificial Sequence
  ELANE RNA Guide
cacgcagugcgcggccgaccug

SEQ ID NO: 7229 - RNA, 22 nt, Artificial Sequence
  ELANE RNA Guide
caggucggccgcgcacugcgug

SEQ ID NO: 7230 - RNA, 22 nt, Artificial Sequence
  ELANE RNA Guide
cagugcgcggccgaccugacga

SEQ ID NO: 7231 - RNA, 22 nt, Artificial Sequence
  ELANE RNA Guide
ccaacuucgucaggucggccgc

SEQ ID NO: 7232 - RNA, 22 nt, Artificial Sequence
  ELANE RNA Guide
ccacgcagugcgcggccgaccu

SEQ ID NO: 7233 - RNA, 22 nt, Artificial Sequence
  ELANE RNA Guide
cccaacuucgucaggucggccg

SEQ ID NO: 7234 - RNA, 22 nt, Artificial Sequence
  ELANE RNA Guide
ccgaccugacgaaguugggcgc

SEQ ID NO: 7235 - RNA, 22 nt, Artificial Sequence
  ELANE RNA Guide
ccugacgaaguugggcgcaauc

SEQ ID NO: 7236 - RNA, 22 nt, Artificial Sequence
  ELANE RNA Guide
ccugauugcgcccaacuucguc

SEQ ID NO: 7237 - RNA, 22 nt, Artificial Sequence
  ELANE RNA Guide
cgaccugacgaaguugggcgca

SEQ ID NO: 7238 - RNA, 22 nt, Artificial Sequence
  ELANE RNA Guide
cgcagugcgcggccgaccugac

SEQ ID NO: 7239 - RNA, 22 nt, Artificial Sequence
  ELANE RNA Guide
cgcccaacuucgucaggucggc

SEQ ID NO: 7240 - RNA, 22 nt, Artificial Sequence
  ELANE RNA Guide
cgcggccgaccugacgaaguug

SEQ ID NO: 7241 - RNA, 22 nt, Artificial Sequence
  ELANE RNA Guide
cggccgaccugacgaaguuggg

SEQ ID NO: 7242 - RNA, 22 nt, Artificial Sequence
  ELANE RNA Guide
cgucaggucggccgcgcacugc

SEQ ID NO: 7243 - RNA, 22 nt, Artificial Sequence
  ELANE RNA Guide
cugauugcgcccaacuucguca

SEQ ID NO: 7244 - RNA, 22 nt, Artificial Sequence
  ELANE RNA Guide
cuucgucaggucggccgcgcac

SEQ ID NO: 7245 - RNA, 22 nt, Artificial Sequence
  ELANE RNA Guide
gaccugacgaaguugggcgcaa

SEQ ID NO: 7246 - RNA, 22 nt, Artificial Sequence
  ELANE RNA Guide
gauugcgcccaacuucgucagg

SEQ ID NO: 7247 - RNA, 22 nt, Artificial Sequence
  ELANE RNA Guide
gcagugcgcggccgaccugacg

SEQ ID NO: 7248 - RNA, 22 nt, Artificial Sequence
  ELANE RNA Guide
gcccaacuucgucaggucggcc

SEQ ID NO: 7249 - RNA, 22 nt, Artificial Sequence
  ELANE RNA Guide
gccgaccugacgaaguugggcg

SEQ ID NO: 7250 - RNA, 22 nt, Artificial Sequence
  ELANE RNA Guide
gcgcccaacuucgucaggucgg

SEQ ID NO: 7251 - RNA, 22 nt, Artificial Sequence
  ELANE RNA Guide
gcgcggccgaccugacgaaguu

SEQ ID NO: 7252 - RNA, 22 nt, Artificial Sequence
  ELANE RNA Guide
gcggccgaccugacgaaguugg

SEQ ID NO: 7253 - RNA, 22 nt, Artificial Sequence
  ELANE RNA Guide
ggccgaccugacgaaguugggc

SEQ ID NO: 7254 - RNA, 22 nt, Artificial Sequence
  ELANE RNA Guide
gucaggucggccgcgcacugcg

SEQ ID NO: 7255 - RNA, 22 nt, Artificial Sequence
  ELANE RNA Guide
gugcgcggccgaccugacgaag

SEQ ID NO: 7256 - RNA, 22 nt, Artificial Sequence
  ELANE RNA Guide
ucaggucggccgcgcacugcgu

SEQ ID NO: 7257 - RNA, 22 nt, Artificial Sequence
  ELANE RNA Guide
ucgccacgcagugcgcggccga

SEQ ID NO: 7258 - RNA, 22 nt, Artificial Sequence
  ELANE RNA Guide
ucgucaggucggccgcgcacug

SEQ ID NO: 7259 - RNA, 22 nt, Artificial Sequence
  ELANE RNA Guide
ugauugcgcccaacuucgucag

SEQ ID NO: 7260 - RNA, 22 nt, Artificial Sequence
  ELANE RNA Guide
ugcgcccaacuucgucaggucg

SEQ ID NO: 7261 - RNA, 22 nt, Artificial Sequence
  ELANE RNA Guide
ugcgcggccgaccugacgaagu

SEQ ID NO: 7262 - RNA, 22 nt, Artificial Sequence
  ELANE RNA Guide
uucgccacgcagugcgcggccg

SEQ ID NO: 7263 - RNA, 22 nt, Artificial Sequence
  ELANE RNA Guide
uucgucaggucggccgcgcacu

SEQ ID NO: 7264 - RNA, 22 nt, Artificial Sequence
  ELANE RNA Guide
uugcgcccaacuucgucagguc

SEQ ID NO: 7265 - RNA, 20 nt, Artificial Sequence
  ELANE RNA Guide
aacuucgucaugucgcacug

SEQ ID NO: 7266 - RNA, 20 nt, Artificial Sequence
  ELANE RNA Guide
acauucgccacgcagugcga

SEQ ID NO: 7267 - RNA, 20 nt, Artificial Sequence
  ELANE RNA Guide
acgcagugcgacaugacgaa

SEQ ID NO: 7268 - RNA, 20 nt, Artificial Sequence
  ELANE RNA Guide
acuucgucaugucgcacugc

SEQ ID NO: 7269 - RNA, 20 nt, Artificial Sequence
  ELANE RNA Guide
agugcgacaugacgaaguug

SEQ ID NO: 7270 - RNA, 20 nt, Artificial Sequence
  ELANE RNA Guide
augucgcacugcguggcgaa

SEQ ID NO: 7271 - RNA, 20 nt, Artificial Sequence
  ELANE RNA Guide
auucgccacgcagugcgaca

SEQ ID NO: 7272 - RNA, 20 nt, Artificial Sequence
  ELANE RNA Guide
caacuucgucaugucgcacu

SEQ ID NO: 7273 - RNA, 20 nt, Artificial Sequence
  ELANE RNA Guide
cacgcagugcgacaugacga

SEQ ID NO: 7274 - RNA, 20 nt, Artificial Sequence
  ELANE RNA Guide
cagugcgacaugacgaaguu

SEQ ID NO: 7275 - RNA, 20 nt, Artificial Sequence
  ELANE RNA Guide
caugucgcacugcguggcga

SEQ ID NO: 7276 - RNA, 20 nt, Artificial Sequence
  ELANE RNA Guide
cauucgccacgcagugcgac

SEQ ID NO: 7277 - RNA, 20 nt, Artificial Sequence
  ELANE RNA Guide
ccaacuucgucaugucgcac

SEQ ID NO: 7278 - RNA, 20 nt, Artificial Sequence
  ELANE RNA Guide
ccacgcagugcgacaugacg

SEQ ID NO: 7279 - RNA, 20 nt, Artificial Sequence
  ELANE RNA Guide
cccaacuucgucaugucgca

SEQ ID NO: 7280 - RNA, 20 nt, Artificial Sequence
  ELANE RNA Guide
cgcagugcgacaugacgaag

SEQ ID NO: 7281 - RNA, 20 nt, Artificial Sequence
  ELANE RNA Guide
cgccacgcagugcgacauga

SEQ ID NO: 7282 - RNA, 20 nt, Artificial Sequence
  ELANE RNA Guide
cgcccaacuucgucaugucg

SEQ ID NO: 7283 - RNA, 20 nt, Artificial Sequence
  ELANE RNA Guide
cgucaugucgcacugcgugg

SEQ ID NO: 7284 - RNA, 20 nt, Artificial Sequence
  ELANE RNA Guide
cuucgucaugucgcacugcg

SEQ ID NO: 7285 - RNA, 20 nt, Artificial Sequence
  ELANE RNA Guide
gcagugcgacaugacgaagu

SEQ ID NO: 7286 - RNA, 20 nt, Artificial Sequence
  ELANE RNA Guide
gccacgcagugcgacaugac

SEQ ID NO: 7287 - RNA, 20 nt, Artificial Sequence
  ELANE RNA Guide
gcccaacuucgucaugucgc

SEQ ID NO: 7288 - RNA, 20 nt, Artificial Sequence
  ELANE RNA Guide
gcgacaugacgaaguugggc

SEQ ID NO: 7289 - RNA, 20 nt, Artificial Sequence
  ELANE RNA Guide
gcgcccaacuucgucauguc

SEQ ID NO: 7290 - RNA, 20 nt, Artificial Sequence
  ELANE RNA Guide
gucaugucgcacugcguggc

SEQ ID NO: 7291 - RNA, 20 nt, Artificial Sequence
  ELANE RNA Guide
gucgcacugcguggcgaaug

SEQ ID NO: 7292 - RNA, 20 nt, Artificial Sequence
  ELANE RNA Guide
gugcgacaugacgaaguugg

SEQ ID NO: 7293 - RNA, 20 nt, Artificial Sequence
  ELANE RNA Guide
ucacacauucgccacgcagu

SEQ ID NO: 7294 - RNA, 20 nt, Artificial Sequence
  ELANE RNA Guide
ucaugucgcacugcguggcg

SEQ ID NO: 7295 - RNA, 20 nt, Artificial Sequence
  ELANE RNA Guide
ucgccacgcagugcgacaug

SEQ ID NO: 7296 - RNA, 20 nt, Artificial Sequence
  ELANE RNA Guide
ucgucaugucgcacugcgug

SEQ ID NO: 7297 - RNA, 20 nt, Artificial Sequence
  ELANE RNA Guide
ugcgacaugacgaaguuggg

SEQ ID NO: 7298 - RNA, 20 nt, Artificial Sequence
  ELANE RNA Guide
ugcgcccaacuucgucaugu

SEQ ID NO: 7299 - RNA, 20 nt, Artificial Sequence
  ELANE RNA Guide
ugucgcacugcguggcgaau

SEQ ID NO: 7300 - RNA, 20 nt, Artificial Sequence
  ELANE RNA Guide
uucgccacgcagugcgacau

SEQ ID NO: 7301 - RNA, 20 nt, Artificial Sequence
  ELANE RNA Guide
uucgucaugucgcacugcgu

SEQ ID NO: 7302 - RNA, 20 nt, Artificial Sequence
  ELANE RNA Guide
uugcgcccaacuucgucaug

SEQ ID NO: 7303 - RNA, 21 nt, Artificial Sequence
  ELANE RNA Guide
aacuucgucaugucgcacugc

SEQ ID NO: 7304 - RNA, 21 nt, Artificial Sequence
  ELANE RNA Guide
acauucgccacgcagugcgac

SEQ ID NO: 7305 - RNA, 21 nt, Artificial Sequence
  ELANE RNA Guide
acgcagugcgacaugacgaag

SEQ ID NO: 7306 - RNA, 21 nt, Artificial Sequence
  ELANE RNA Guide
acuucgucaugucgcacugcg

SEQ ID NO: 7307 - RNA, 21 nt, Artificial Sequence
  ELANE RNA Guide
agugcgacaugacgaaguugg

SEQ ID NO: 7308 - RNA, 21 nt, Artificial Sequence
  ELANE RNA Guide
augucgcacugcguggcgaau

SEQ ID NO: 7309 - RNA, 21 nt, Artificial Sequence
  ELANE RNA Guide
auucgccacgcagugcgacau

SEQ ID NO: 7310 - RNA, 21 nt, Artificial Sequence
  ELANE RNA Guide
auugcgcccaacuucgucaug

SEQ ID NO: 7311 - RNA, 21 nt, Artificial Sequence
  ELANE RNA Guide
caacuucgucaugucgcacug

SEQ ID NO: 7312 - RNA, 21 nt, Artificial Sequence
  ELANE RNA Guide
cacauucgccacgcagugcga

SEQ ID NO: 7313 - RNA, 21 nt, Artificial Sequence
  ELANE RNA Guide
cacgcagugcgacaugacgaa

SEQ ID NO: 7314 - RNA, 21 nt, Artificial Sequence
  ELANE RNA Guide
cagugcgacaugacgaaguug

SEQ ID NO: 7315 - RNA, 21 nt, Artificial Sequence
  ELANE RNA Guide
caugucgcacugcguggcgaa

SEQ ID NO: 7316 - RNA, 21 nt, Artificial Sequence
  ELANE RNA Guide
cauucgccacgcagugcgaca

SEQ ID NO: 7317 - RNA, 21 nt, Artificial Sequence
  ELANE RNA Guide
ccaacuucgucaugucgcacu

SEQ ID NO: 7318 - RNA, 21 nt, Artificial Sequence
  ELANE RNA Guide
ccacgcagugcgacaugacga

SEQ ID NO: 7319 - RNA, 21 nt, Artificial Sequence
  ELANE RNA Guide
cccaacuucgucaugucgcac

SEQ ID NO: 7320 - RNA, 21 nt, Artificial Sequence
  ELANE RNA Guide
cgcagugcgacaugacgaagu

SEQ ID NO: 7321 - RNA, 21 nt, Artificial Sequence
  ELANE RNA Guide
cgccacgcagugcgacaugac

SEQ ID NO: 7322 - RNA, 21 nt, Artificial Sequence
  ELANE RNA Guide
cgcccaacuucgucaugucgc

SEQ ID NO: 7323 - RNA, 21 nt, Artificial Sequence
  ELANE RNA Guide
cgucaugucgcacugcguggc

SEQ ID NO: 7324 - RNA, 21 nt, Artificial Sequence
  ELANE RNA Guide
cucacacauucgccacgcagu

SEQ ID NO: 7325 - RNA, 21 nt, Artificial Sequence
  ELANE RNA Guide
cuucgucaugucgcacugcgu

SEQ ID NO: 7326 - RNA, 21 nt, Artificial Sequence
  ELANE RNA Guide
gcagugcgacaugacgaaguu

SEQ ID NO: 7327 - RNA, 21 nt, Artificial Sequence
  ELANE RNA Guide
gccacgcagugcgacaugacg

SEQ ID NO: 7328 - RNA, 21 nt, Artificial Sequence
  ELANE RNA Guide
gcccaacuucgucaugucgca

SEQ ID NO: 7329 - RNA, 21 nt, Artificial Sequence
  ELANE RNA Guide
gcgacaugacgaaguugggcg

SEQ ID NO: 7330 - RNA, 21 nt, Artificial Sequence
  ELANE RNA Guide
gcgcccaacuucgucaugucg

SEQ ID NO: 7331 - RNA, 21 nt, Artificial Sequence
  ELANE RNA Guide
gucaugucgcacugcguggcg

SEQ ID NO: 7332 - RNA, 21 nt, Artificial Sequence
  ELANE RNA Guide
gucgcacugcguggcgaaugu

SEQ ID NO: 7333 - RNA, 21 nt, Artificial Sequence
  ELANE RNA Guide
gugcgacaugacgaaguuggg

SEQ ID NO: 7334 - RNA, 21 nt, Artificial Sequence
  ELANE RNA Guide
ucaugucgcacugcguggcga

SEQ ID NO: 7335 - RNA, 21 nt, Artificial Sequence
  ELANE RNA Guide
ucgccacgcagugcgacauga

SEQ ID NO: 7336 - RNA, 21 nt, Artificial Sequence
  ELANE RNA Guide
ucgucaugucgcacugcgugg

SEQ ID NO: 7337 - RNA, 21 nt, Artificial Sequence
  ELANE RNA Guide
ugcgacaugacgaaguugggc

SEQ ID NO: 7338 - RNA, 21 nt, Artificial Sequence
  ELANE RNA Guide
ugcgcccaacuucgucauguc

SEQ ID NO: 7339 - RNA, 21 nt, Artificial Sequence
  ELANE RNA Guide
ugucgcacugcguggcgaaug

SEQ ID NO: 7340 - RNA, 21 nt, Artificial Sequence
  ELANE RNA Guide
uucgccacgcagugcgacaug

SEQ ID NO: 7341 - RNA, 21 nt, Artificial Sequence
  ELANE RNA Guide
uucgucaugucgcacugcgug

SEQ ID NO: 7342 - RNA, 21 nt, Artificial Sequence
  ELANE RNA Guide
uugcgcccaacuucgucaugu

SEQ ID NO: 7343 - RNA, 22 nt, Artificial Sequence
  ELANE RNA Guide
aacuucgucaugucgcacugcg

SEQ ID NO: 7344 - RNA, 22 nt, Artificial Sequence
  ELANE RNA Guide
acacauucgccacgcagugcga

SEQ ID NO: 7345 - RNA, 22 nt, Artificial Sequence
  ELANE RNA Guide
acauucgccacgcagugcgaca

SEQ ID NO: 7346 - RNA, 22 nt, Artificial Sequence
  ELANE RNA Guide
acgcagugcgacaugacgaagu

SEQ ID NO: 7347 - RNA, 22 nt, Artificial Sequence
  ELANE RNA Guide
acucacacauucgccacgcagu

SEQ ID NO: 7348 - RNA, 22 nt, Artificial Sequence
  ELANE RNA Guide
acuucgucaugucgcacugcgu

SEQ ID NO: 7349 - RNA, 22 nt, Artificial Sequence
  ELANE RNA Guide
agugcgacaugacgaaguuggg

SEQ ID NO: 7350 - RNA, 22 nt, Artificial Sequence
  ELANE RNA Guide
augucgcacugcguggcgaaug

SEQ ID NO: 7351 - RNA, 22 nt, Artificial Sequence
  ELANE RNA Guide
auucgccacgcagugcgacaug

SEQ ID NO: 7352 - RNA, 22 nt, Artificial Sequence
  ELANE RNA Guide
auugcgcccaacuucgucaugu

SEQ ID NO: 7353 - RNA, 22 nt, Artificial Sequence
  ELANE RNA Guide
caacuucgucaugucgcacugc

SEQ ID NO: 7354 - RNA, 22 nt, Artificial Sequence
  ELANE RNA Guide
cacauucgccacgcagugcgac

SEQ ID NO: 7355 - RNA, 22 nt, Artificial Sequence
  ELANE RNA Guide
cacgcagugcgacaugacgaag

SEQ ID NO: 7356 - RNA, 22 nt, Artificial Sequence
  ELANE RNA Guide
cagugcgacaugacgaaguugg

SEQ ID NO: 7357 - RNA, 22 nt, Artificial Sequence
  ELANE RNA Guide
caugucgcacugcguggcgaau

SEQ ID NO: 7358 - RNA, 22 nt, Artificial Sequence
  ELANE RNA Guide
cauucgccacgcagugcgacau

SEQ ID NO: 7359 - RNA, 22 nt, Artificial Sequence
  ELANE RNA Guide
ccaacuucgucaugucgcacug

SEQ ID NO: 7360 - RNA, 22 nt, Artificial Sequence
  ELANE RNA Guide
ccacgcagugcgacaugacgaa

SEQ ID NO: 7361 - RNA, 22 nt, Artificial Sequence
  ELANE RNA Guide
cccaacuucgucaugucgcacu

SEQ ID NO: 7362 - RNA, 22 nt, Artificial Sequence
  ELANE RNA Guide
cgcagugcgacaugacgaaguu

SEQ ID NO: 7363 - RNA, 22 nt, Artificial Sequence
  ELANE RNA Guide
cgccacgcagugcgacaugacg

SEQ ID NO: 7364 - RNA, 22 nt, Artificial Sequence
  ELANE RNA Guide
cgcccaacuucgucaugucgca

SEQ ID NO: 7365 - RNA, 22 nt, Artificial Sequence
  ELANE RNA Guide
cgucaugucgcacugcguggcg

SEQ ID NO: 7366 - RNA, 22 nt, Artificial Sequence
  ELANE RNA Guide
cuucgucaugucgcacugcgug

SEQ ID NO: 7367 - RNA, 22 nt, Artificial Sequence
  ELANE RNA Guide
gauugcgcccaacuucgucaug

SEQ ID NO: 7368 - RNA, 22 nt, Artificial Sequence
  ELANE RNA Guide
gcagugcgacaugacgaaguug

SEQ ID NO: 7369 - RNA, 22 nt, Artificial Sequence
  ELANE RNA Guide
gccacgcagugcgacaugacga

SEQ ID NO: 7370 - RNA, 22 nt, Artificial Sequence
  ELANE RNA Guide
gcccaacuucgucaugucgcac

SEQ ID NO: 7371 - RNA, 22 nt, Artificial Sequence
  ELANE RNA Guide
gcgacaugacgaaguugggcgc

SEQ ID NO: 7372 - RNA, 22 nt, Artificial Sequence
  ELANE RNA Guide
gcgcccaacuucgucaugucgc

SEQ ID NO: 7373 - RNA, 22 nt, Artificial Sequence
  ELANE RNA Guide
gucaugucgcacugcguggcga

SEQ ID NO: 7374 - RNA, 22 nt, Artificial Sequence
  ELANE RNA Guide
gucgcacugcguggcgaaugug

SEQ ID NO: 7375 - RNA, 22 nt, Artificial Sequence
  ELANE RNA Guide
gugcgacaugacgaaguugggc

SEQ ID NO: 7376 - RNA, 22 nt, Artificial Sequence
  ELANE RNA Guide
ucaugucgcacugcguggcgaa

SEQ ID NO: 7377 - RNA, 22 nt, Artificial Sequence
  ELANE RNA Guide
ucgccacgcagugcgacaugac

SEQ ID NO: 7378 - RNA, 22 nt, Artificial Sequence
  ELANE RNA Guide
ucgucaugucgcacugcguggc

SEQ ID NO: 7379 - RNA, 22 nt, Artificial Sequence
  ELANE RNA Guide
ugcgacaugacgaaguugggcg

SEQ ID NO: 7380 - RNA, 22 nt, Artificial Sequence
  ELANE RNA Guide
ugcgcccaacuucgucaugucg

SEQ ID NO: 7381 - RNA, 22 nt, Artificial Sequence
  ELANE RNA Guide
ugucgcacugcguggcgaaugu

SEQ ID NO: 7382 - RNA, 22 nt, Artificial Sequence
  ELANE RNA Guide
uucgccacgcagugcgacauga

SEQ ID NO: 7383 - RNA, 22 nt, Artificial Sequence
  ELANE RNA Guide
uucgucaugucgcacugcgugg

SEQ ID NO: 7384 - RNA, 22 nt, Artificial Sequence
  ELANE RNA Guide
uugcgcccaacuucgucauguc

SEQ ID NO: 7385 - RNA, 20 nt, Artificial Sequence
  ELANE RNA Guide
aacuucgucaugugggccgc

SEQ ID NO: 7386 - RNA, 20 nt, Artificial Sequence
  ELANE RNA Guide
acgcagugcgcggcccacau

SEQ ID NO: 7387 - RNA, 20 nt, Artificial Sequence
  ELANE RNA Guide
acuucgucaugugggccgcg

SEQ ID NO: 7388 - RNA, 20 nt, Artificial Sequence
  ELANE RNA Guide
agugcgcggcccacaugacg

SEQ ID NO: 7389 - RNA, 20 nt, Artificial Sequence
  ELANE RNA Guide
augugggccgcgcacugcgu

SEQ ID NO: 7390 - RNA, 20 nt, Artificial Sequence
  ELANE RNA Guide
auucgccacgcagugcgcgg

SEQ ID NO: 7391 - RNA, 20 nt, Artificial Sequence
  ELANE RNA Guide
auugcgcccaacuucgucau

SEQ ID NO: 7392 - RNA, 20 nt, Artificial Sequence
  ELANE RNA Guide
caacuucgucaugugggccg

SEQ ID NO: 7393 - RNA, 20 nt, Artificial Sequence
  ELANE RNA Guide
cacgcagugcgcggcccaca

SEQ ID NO: 7394 - RNA, 20 nt, Artificial Sequence
  ELANE RNA Guide
cagugcgcggcccacaugac

SEQ ID NO: 7395 - RNA, 20 nt, Artificial Sequence
  ELANE RNA Guide
caugugggccgcgcacugcg

SEQ ID NO: 7396 - RNA, 20 nt, Artificial Sequence
  ELANE RNA Guide
cauucgccacgcagugcgcg

SEQ ID NO: 7397 - RNA, 20 nt, Artificial Sequence
  ELANE RNA Guide
ccaacuucgucaugugggcc

SEQ ID NO: 7398 - RNA, 20 nt, Artificial Sequence
  ELANE RNA Guide
ccacaugacgaaguugggcg

SEQ ID NO: 7399 - RNA, 20 nt, Artificial Sequence
  ELANE RNA Guide
ccacgcagugcgcggcccac

SEQ ID NO: 7400 - RNA, 20 nt, Artificial Sequence
  ELANE RNA Guide
cccaacuucgucaugugggc

SEQ ID NO: 7401 - RNA, 20 nt, Artificial Sequence
  ELANE RNA Guide
cccacaugacgaaguugggc

SEQ ID NO: 7402 - RNA, 20 nt, Artificial Sequence
  ELANE RNA Guide
cgcagugcgcggcccacaug

SEQ ID NO: 7403 - RNA, 20 nt, Artificial Sequence
  ELANE RNA Guide
cgcccaacuucgucaugugg

SEQ ID NO: 7404 - RNA, 20 nt, Artificial Sequence
  ELANE RNA Guide
cgcggcccacaugacgaagu

SEQ ID NO: 7405 - RNA, 20 nt, Artificial Sequence
  ELANE RNA Guide
cggcccacaugacgaaguug

SEQ ID NO: 7406 - RNA, 20 nt, Artificial Sequence
  ELANE RNA Guide
cgucaugugggccgcgcacu

SEQ ID NO: 7407 - RNA, 20 nt, Artificial Sequence
  ELANE RNA Guide
cuucgucaugugggccgcgc

SEQ ID NO: 7408 - RNA, 20 nt, Artificial Sequence
  ELANE RNA Guide
gcagugcgcggcccacauga

SEQ ID NO: 7409 - RNA, 20 nt, Artificial Sequence
  ELANE RNA Guide
gccacgcagugcgcggccca

SEQ ID NO: 7410 - RNA, 20 nt, Artificial Sequence
  ELANE RNA Guide
gcccaacuucgucauguggg

SEQ ID NO: 7411 - RNA, 20 nt, Artificial Sequence
  ELANE RNA Guide
gcccacaugacgaaguuggg

SEQ ID NO: 7412 - RNA, 20 nt, Artificial Sequence
  ELANE RNA Guide
gcgcccaacuucgucaugug

SEQ ID NO: 7413 - RNA, 20 nt, Artificial Sequence
  ELANE RNA Guide
gcgcggcccacaugacgaag

SEQ ID NO: 7414 - RNA, 20 nt, Artificial Sequence
  ELANE RNA Guide
gcggcccacaugacgaaguu

SEQ ID NO: 7415 - RNA, 20 nt, Artificial Sequence
  ELANE RNA Guide
ggcccacaugacgaaguugg

SEQ ID NO: 7416 - RNA, 20 nt, Artificial Sequence
  ELANE RNA Guide
gucaugugggccgcgcacug

SEQ ID NO: 7417 - RNA, 20 nt, Artificial Sequence
  ELANE RNA Guide
gugcgcggcccacaugacga

SEQ ID NO: 7418 - RNA, 20 nt, Artificial Sequence
  ELANE RNA Guide
gugggccgcgcacugcgugg

SEQ ID NO: 7419 - RNA, 20 nt, Artificial Sequence
  ELANE RNA Guide
ucaugugggccgcgcacugc

SEQ ID NO: 7420 - RNA, 20 nt, Artificial Sequence
  ELANE RNA Guide
ucgucaugugggccgcgcac

SEQ ID NO: 7421 - RNA, 20 nt, Artificial Sequence
  ELANE RNA Guide
ugcgcggcccacaugacgaa

SEQ ID NO: 7422 - RNA, 20 nt, Artificial Sequence
  ELANE RNA Guide
ugggccgcgcacugcguggc

SEQ ID NO: 7423 - RNA, 20 nt, Artificial Sequence
  ELANE RNA Guide
ugugggccgcgcacugcgug

SEQ ID NO: 7424 - RNA, 20 nt, Artificial Sequence
  ELANE RNA Guide
uucgccacgcagugcgcggc

SEQ ID NO: 7425 - RNA, 20 nt, Artificial Sequence
  ELANE RNA Guide
uucgucaugugggccgcgca

SEQ ID NO: 7426 - RNA, 21 nt, Artificial Sequence
  ELANE RNA Guide
aacuucgucaugugggccgcg

SEQ ID NO: 7427 - RNA, 21 nt, Artificial Sequence
  ELANE RNA Guide
acauucgccacgcagugcgcg

SEQ ID NO: 7428 - RNA, 21 nt, Artificial Sequence
  ELANE RNA Guide
acgcagugcgcggcccacaug

SEQ ID NO: 7429 - RNA, 21 nt, Artificial Sequence
  ELANE RNA Guide
acuucgucaugugggccgcgc

SEQ ID NO: 7430 - RNA, 21 nt, Artificial Sequence
  ELANE RNA Guide
agugcgcggcccacaugacga

SEQ ID NO: 7431 - RNA, 21 nt, Artificial Sequence
  ELANE RNA Guide
augugggccgcgcacugcgug

SEQ ID NO: 7432 - RNA, 21 nt, Artificial Sequence
  ELANE RNA Guide
auucgccacgcagugcgcggc

SEQ ID NO: 7433 - RNA, 21 nt, Artificial Sequence
  ELANE RNA Guide
caacuucgucaugugggccgc

SEQ ID NO: 7434 - RNA, 21 nt, Artificial Sequence
  ELANE RNA Guide
cacgcagugcgcggcccacau

SEQ ID NO: 7435 - RNA, 21 nt, Artificial Sequence
  ELANE RNA Guide
cagugcgcggcccacaugacg

SEQ ID NO: 7436 - RNA, 21 nt, Artificial Sequence
  ELANE RNA Guide
caugugggccgcgcacugcgu

SEQ ID NO: 7437 - RNA, 21 nt, Artificial Sequence
  ELANE RNA Guide
cauucgccacgcagugcgcgg

SEQ ID NO: 7438 - RNA, 21 nt, Artificial Sequence
  ELANE RNA Guide
ccaacuucgucaugugggccg

SEQ ID NO: 7439 - RNA, 21 nt, Artificial Sequence
  ELANE RNA Guide
ccacaugacgaaguugggcgc

SEQ ID NO: 7440 - RNA, 21 nt, Artificial Sequence
  ELANE RNA Guide
ccacgcagugcgcggcccaca

SEQ ID NO: 7441 - RNA, 21 nt, Artificial Sequence
  ELANE RNA Guide
cccaacuucgucaugugggcc

SEQ ID NO: 7442 - RNA, 21 nt, Artificial Sequence
  ELANE RNA Guide
cccacaugacgaaguugggcg

SEQ ID NO: 7443 - RNA, 21 nt, Artificial Sequence
  ELANE RNA Guide
cgcagugcgcggcccacauga

SEQ ID NO: 7444 - RNA, 21 nt, Artificial Sequence
  ELANE RNA Guide
cgcccaacuucgucauguggg

SEQ ID NO: 7445 - RNA, 21 nt, Artificial Sequence
  ELANE RNA Guide
cgcggcccacaugacgaaguu

SEQ ID NO: 7446 - RNA, 21 nt, Artificial Sequence
  ELANE RNA Guide
cggcccacaugacgaaguugg

SEQ ID NO: 7447 - RNA, 21 nt, Artificial Sequence
  ELANE RNA Guide
cgucaugugggccgcgcacug

SEQ ID NO: 7448 - RNA, 21 nt, Artificial Sequence
  ELANE RNA Guide
cuucgucaugugggccgcgca

SEQ ID NO: 7449 - RNA, 21 nt, Artificial Sequence
  ELANE RNA Guide
gauugcgcccaacuucgucau

SEQ ID NO: 7450 - RNA, 21 nt, Artificial Sequence
  ELANE RNA Guide
gcagugcgcggcccacaugac

SEQ ID NO: 7451 - RNA, 21 nt, Artificial Sequence
  ELANE RNA Guide
gcccaacuucgucaugugggc

SEQ ID NO: 7452 - RNA, 21 nt, Artificial Sequence
  ELANE RNA Guide
gcccacaugacgaaguugggc

SEQ ID NO: 7453 - RNA, 21 nt, Artificial Sequence
  ELANE RNA Guide
gcgcccaacuucgucaugugg

SEQ ID NO: 7454 - RNA, 21 nt, Artificial Sequence
  ELANE RNA Guide
gcgcggcccacaugacgaagu

SEQ ID NO: 7455 - RNA, 21 nt, Artificial Sequence
  ELANE RNA Guide
gcggcccacaugacgaaguug

SEQ ID NO: 7456 - RNA, 21 nt, Artificial Sequence
  ELANE RNA Guide
ggcccacaugacgaaguuggg

SEQ ID NO: 7457 - RNA, 21 nt, Artificial Sequence
  ELANE RNA Guide
gucaugugggccgcgcacugc

SEQ ID NO: 7458 - RNA, 21 nt, Artificial Sequence
  ELANE RNA Guide
gugcgcggcccacaugacgaa

SEQ ID NO: 7459 - RNA, 21 nt, Artificial Sequence
  ELANE RNA Guide
ucaugugggccgcgcacugcg

SEQ ID NO: 7460 - RNA, 21 nt, Artificial Sequence
  ELANE RNA Guide
ucgucaugugggccgcgcacu

SEQ ID NO: 7461 - RNA, 21 nt, Artificial Sequence
  ELANE RNA Guide
ugcgcccaacuucgucaugug

SEQ ID NO: 7462 - RNA, 21 nt, Artificial Sequence
  ELANE RNA Guide
ugcgcggcccacaugacgaag

SEQ ID NO: 7463 - RNA, 21 nt, Artificial Sequence
  ELANE RNA Guide
ugugggccgcgcacugcgugg

SEQ ID NO: 7464 - RNA, 21 nt, Artificial Sequence
  ELANE RNA Guide
uucgucaugugggccgcgcac

SEQ ID NO: 7465 - RNA, 22 nt, Artificial Sequence
  ELANE RNA Guide
aacuucgucaugugggccgcgc

SEQ ID NO: 7466 - RNA, 22 nt, Artificial Sequence
  ELANE RNA Guide
acauucgccacgcagugcgcgg

SEQ ID NO: 7467 - RNA, 22 nt, Artificial Sequence
  ELANE RNA Guide
acgcagugcgcggcccacauga

SEQ ID NO: 7468 - RNA, 22 nt, Artificial Sequence
  ELANE RNA Guide
acuucgucaugugggccgcgca

SEQ ID NO: 7469 - RNA, 22 nt, Artificial Sequence
  ELANE RNA Guide
agugcgcggcccacaugacgaa

SEQ ID NO: 7470 - RNA, 22 nt, Artificial Sequence
  ELANE RNA Guide
augugggccgcgcacugcgugg

SEQ ID NO: 7471 - RNA, 22 nt, Artificial Sequence
  ELANE RNA Guide
caacuucgucaugugggccgcg

SEQ ID NO: 7472 - RNA, 22 nt, Artificial Sequence
  ELANE RNA Guide
cacauucgccacgcagugcgcg

SEQ ID NO: 7473 - RNA, 22 nt, Artificial Sequence
  ELANE RNA Guide
cacgcagugcgcggcccacaug

SEQ ID NO: 7474 - RNA, 22 nt, Artificial Sequence
  ELANE RNA Guide
cagugcgcggcccacaugacga

SEQ ID NO: 7475 - RNA, 22 nt, Artificial Sequence
  ELANE RNA Guide
caugugggccgcgcacugcgug

SEQ ID NO: 7476 - RNA, 22 nt, Artificial Sequence
  ELANE RNA Guide
cauucgccacgcagugcgcggc

SEQ ID NO: 7477 - RNA, 22 nt, Artificial Sequence
  ELANE RNA Guide
ccaacuucgucaugugggccgc

SEQ ID NO: 7478 - RNA, 22 nt, Artificial Sequence
  ELANE RNA Guide
ccacaugacgaaguugggcgca

SEQ ID NO: 7479 - RNA, 22 nt, Artificial Sequence
  ELANE RNA Guide
ccacgcagugcgcggcccacau

SEQ ID NO: 7480 - RNA, 22 nt, Artificial Sequence
  ELANE RNA Guide
cccaacuucgucaugugggccg

SEQ ID NO: 7481 - RNA, 22 nt, Artificial Sequence
  ELANE RNA Guide
cccacaugacgaaguugggcgc

SEQ ID NO: 7482 - RNA, 22 nt, Artificial Sequence
  ELANE RNA Guide
cgcagugcgcggcccacaugac

SEQ ID NO: 7483 - RNA, 22 nt, Artificial Sequence
  ELANE RNA Guide
cgcccaacuucgucaugugggc

SEQ ID NO: 7484 - RNA, 22 nt, Artificial Sequence
  ELANE RNA Guide
cgcggcccacaugacgaaguug

SEQ ID NO: 7485 - RNA, 22 nt, Artificial Sequence
  ELANE RNA Guide
cggcccacaugacgaaguuggg

SEQ ID NO: 7486 - RNA, 22 nt, Artificial Sequence
  ELANE RNA Guide
cgucaugugggccgcgcacugc

SEQ ID NO: 7487 - RNA, 22 nt, Artificial Sequence
  ELANE RNA Guide
cuucgucaugugggccgcgcac

SEQ ID NO: 7488 - RNA, 22 nt, Artificial Sequence
  ELANE RNA Guide
gcagugcgcggcccacaugacg

SEQ ID NO: 7489 - RNA, 22 nt, Artificial Sequence
  ELANE RNA Guide
gccacgcagugcgcggcccaca

SEQ ID NO: 7490 - RNA, 22 nt, Artificial Sequence
  ELANE RNA Guide
gcccaacuucgucaugugggcc

SEQ ID NO: 7491 - RNA, 22 nt, Artificial Sequence
  ELANE RNA Guide
gcccacaugacgaaguugggcg

SEQ ID NO: 7492 - RNA, 22 nt, Artificial Sequence
  ELANE RNA Guide
gcgcccaacuucgucauguggg

SEQ ID NO: 7493 - RNA, 22 nt, Artificial Sequence
  ELANE RNA Guide
gcgcggcccacaugacgaaguu

SEQ ID NO: 7494 - RNA, 22 nt, Artificial Sequence
  ELANE RNA Guide
gcggcccacaugacgaaguugg

SEQ ID NO: 7495 - RNA, 22 nt, Artificial Sequence
  ELANE RNA Guide
ggcccacaugacgaaguugggc

SEQ ID NO: 7496 - RNA, 22 nt, Artificial Sequence
  ELANE RNA Guide
gucaugugggccgcgcacugcg

SEQ ID NO: 7497 - RNA, 22 nt, Artificial Sequence
  ELANE RNA Guide
gugcgcggcccacaugacgaag

SEQ ID NO: 7498 - RNA, 22 nt, Artificial Sequence
  ELANE RNA Guide
ucaugugggccgcgcacugcgu

SEQ ID NO: 7499 - RNA, 22 nt, Artificial Sequence
  ELANE RNA Guide
ucgccacgcagugcgcggccca

SEQ ID NO: 7500 - RNA, 22 nt, Artificial Sequence
  ELANE RNA Guide
ucgucaugugggccgcgcacug

SEQ ID NO: 7501 - RNA, 22 nt, Artificial Sequence
  ELANE RNA Guide
ugauugcgcccaacuucgucau

SEQ ID NO: 7502 - RNA, 22 nt, Artificial Sequence
  ELANE RNA Guide
ugcgcccaacuucgucaugugg

SEQ ID NO: 7503 - RNA, 22 nt, Artificial Sequence
  ELANE RNA Guide
ugcgcggcccacaugacgaagu

SEQ ID NO: 7504 - RNA, 22 nt, Artificial Sequence
  ELANE RNA Guide
ugggccgcgcacugcguggcga

SEQ ID NO: 7505 - RNA, 22 nt, Artificial Sequence
  ELANE RNA Guide
ugugggccgcgcacugcguggc

SEQ ID NO: 7506 - RNA, 22 nt, Artificial Sequence
  ELANE RNA Guide
uucgccacgcagugcgcggccc

SEQ ID NO: 7507 - RNA, 22 nt, Artificial Sequence
  ELANE RNA Guide
uucgucaugugggccgcgcacu

SEQ ID NO: 7508 - RNA, 22 nt, Artificial Sequence
  ELANE RNA Guide
uugcgcccaacuucgucaugug

SEQ ID NO: 7509 - RNA, 20 nt, Artificial Sequence
  ELANE RNA Guide
acacauucgccacgcugugc

SEQ ID NO: 7510 - RNA, 20 nt, Artificial Sequence
  ELANE RNA Guide
acagcguggcgaauguguga

SEQ ID NO: 7511 - RNA, 20 nt, Artificial Sequence
  ELANE RNA Guide
acauucgccacgcugugcgc

SEQ ID NO: 7512 - RNA, 20 nt, Artificial Sequence
  ELANE RNA Guide
acgcugugcgcggccgacau

SEQ ID NO: 7513 - RNA, 20 nt, Artificial Sequence
  ELANE RNA Guide
acucacacauucgccacgcu

SEQ ID NO: 7514 - RNA, 20 nt, Artificial Sequence
  ELANE RNA Guide
acuucgucaugucggccgcg

SEQ ID NO: 7515 - RNA, 20 nt, Artificial Sequence
  ELANE RNA Guide
augucggccgcgcacagcgu

SEQ ID NO: 7516 - RNA, 20 nt, Artificial Sequence
  ELANE RNA Guide
auucgccacgcugugcgcgg

SEQ ID NO: 7517 - RNA, 20 nt, Artificial Sequence
  ELANE RNA Guide
cacacauucgccacgcugug

SEQ ID NO: 7518 - RNA, 20 nt, Artificial Sequence
  ELANE RNA Guide
cacagcguggcgaaugugug

SEQ ID NO: 7519 - RNA, 20 nt, Artificial Sequence
  ELANE RNA Guide
cacauucgccacgcugugcg

SEQ ID NO: 7520 - RNA, 20 nt, Artificial Sequence
  ELANE RNA Guide
cacgcugugcgcggccgaca

SEQ ID NO: 7521 - RNA, 20 nt, Artificial Sequence
  ELANE RNA Guide
cagcguggcgaaugugugag

SEQ ID NO: 7522 - RNA, 20 nt, Artificial Sequence
  ELANE RNA Guide
caugucggccgcgcacagcg

SEQ ID NO: 7523 - RNA, 20 nt, Artificial Sequence
  ELANE RNA Guide
cauucgccacgcugugcgcg

SEQ ID NO: 7524 - RNA, 20 nt, Artificial Sequence
  ELANE RNA Guide
ccacgcugugcgcggccgac

SEQ ID NO: 7525 - RNA, 20 nt, Artificial Sequence
  ELANE RNA Guide
ccgcgcacagcguggcgaau

SEQ ID NO: 7526 - RNA, 20 nt, Artificial Sequence
  ELANE RNA Guide
cgcacagcguggcgaaugug

SEQ ID NO: 7527 - RNA, 20 nt, Artificial Sequence
  ELANE RNA Guide
cgcgcacagcguggcgaaug

SEQ ID NO: 7528 - RNA, 20 nt, Artificial Sequence
  ELANE RNA Guide
cgcugugcgcggccgacaug

SEQ ID NO: 7529 - RNA, 20 nt, Artificial Sequence
  ELANE RNA Guide
cgucaugucggccgcgcaca

SEQ ID NO: 7530 - RNA, 20 nt, Artificial Sequence
  ELANE RNA Guide
cucacacauucgccacgcug

SEQ ID NO: 7531 - RNA, 20 nt, Artificial Sequence
  ELANE RNA Guide
cugugcgcggccgacaugac

SEQ ID NO: 7532 - RNA, 20 nt, Artificial Sequence
  ELANE RNA Guide
cuucgucaugucggccgcgc

SEQ ID NO: 7533 - RNA, 20 nt, Artificial Sequence
  ELANE RNA Guide
gcacagcguggcgaaugugu

SEQ ID NO: 7534 - RNA, 20 nt, Artificial Sequence
  ELANE RNA Guide
gccacgcugugcgcggccga

SEQ ID NO: 7535 - RNA, 20 nt, Artificial Sequence
  ELANE RNA Guide
gccgcgcacagcguggcgaa

SEQ ID NO: 7536 - RNA, 20 nt, Artificial Sequence
  ELANE RNA Guide
gcgcacagcguggcgaaugu

SEQ ID NO: 7537 - RNA, 20 nt, Artificial Sequence
  ELANE RNA Guide
gcuacucacacauucgccac

SEQ ID NO: 7538 - RNA, 20 nt, Artificial Sequence
  ELANE RNA Guide
gcugugcgcggccgacauga

SEQ ID NO: 7539 - RNA, 20 nt, Artificial Sequence
  ELANE RNA Guide
ggccgcgcacagcguggcga

SEQ ID NO: 7540 - RNA, 20 nt, Artificial Sequence
  ELANE RNA Guide
ggcuacucacacauucgcca

SEQ ID NO: 7541 - RNA, 20 nt, Artificial Sequence
  ELANE RNA Guide
gucaugucggccgcgcacag

SEQ ID NO: 7542 - RNA, 20 nt, Artificial Sequence
  ELANE RNA Guide
gucggccgcgcacagcgugg

SEQ ID NO: 7543 - RNA, 20 nt, Artificial Sequence
  ELANE RNA Guide
ucacacauucgccacgcugu

SEQ ID NO: 7544 - RNA, 20 nt, Artificial Sequence
  ELANE RNA Guide
ucaugucggccgcgcacagc

SEQ ID NO: 7545 - RNA, 20 nt, Artificial Sequence
  ELANE RNA Guide
ucgccacgcugugcgcggcc

SEQ ID NO: 7546 - RNA, 20 nt, Artificial Sequence
  ELANE RNA Guide
ucggccgcgcacagcguggc

SEQ ID NO: 7547 - RNA, 20 nt, Artificial Sequence
  ELANE RNA Guide
ucgucaugucggccgcgcac

SEQ ID NO: 7548 - RNA, 20 nt, Artificial Sequence
  ELANE RNA Guide
ugucggccgcgcacagcgug

SEQ ID NO: 7549 - RNA, 20 nt, Artificial Sequence
  ELANE RNA Guide
uucgccacgcugugcgcggc

SEQ ID NO: 7550 - RNA, 20 nt, Artificial Sequence
  ELANE RNA Guide
uucgucaugucggccgcgca

SEQ ID NO: 7551 - RNA, 21 nt, Artificial Sequence
  ELANE RNA Guide
aacuucgucaugucggccgcg

SEQ ID NO: 7552 - RNA, 21 nt, Artificial Sequence
  ELANE RNA Guide
acacauucgccacgcugugcg

SEQ ID NO: 7553 - RNA, 21 nt, Artificial Sequence
  ELANE RNA Guide
acagcguggcgaaugugugag

SEQ ID NO: 7554 - RNA, 21 nt, Artificial Sequence
  ELANE RNA Guide
acauucgccacgcugugcgcg

SEQ ID NO: 7555 - RNA, 21 nt, Artificial Sequence
  ELANE RNA Guide
acgcugugcgcggccgacaug

SEQ ID NO: 7556 - RNA, 21 nt, Artificial Sequence
  ELANE RNA Guide
acucacacauucgccacgcug

SEQ ID NO: 7557 - RNA, 21 nt, Artificial Sequence
  ELANE RNA Guide
acuucgucaugucggccgcgc

SEQ ID NO: 7558 - RNA, 21 nt, Artificial Sequence
  ELANE RNA Guide
augucggccgcgcacagcgug

SEQ ID NO: 7559 - RNA, 21 nt, Artificial Sequence
  ELANE RNA Guide
auucgccacgcugugcgcggc

SEQ ID NO: 7560 - RNA, 21 nt, Artificial Sequence
  ELANE RNA Guide
cacacauucgccacgcugugc

SEQ ID NO: 7561 - RNA, 21 nt, Artificial Sequence
  ELANE RNA Guide
cacagcguggcgaauguguga

SEQ ID NO: 7562 - RNA, 21 nt, Artificial Sequence
  ELANE RNA Guide
cacauucgccacgcugugcgc

SEQ ID NO: 7563 - RNA, 21 nt, Artificial Sequence
  ELANE RNA Guide
cacgcugugcgcggccgacau

SEQ ID NO: 7564 - RNA, 21 nt, Artificial Sequence
  ELANE RNA Guide
cagcguggcgaaugugugagu

SEQ ID NO: 7565 - RNA, 21 nt, Artificial Sequence
  ELANE RNA Guide
caugucggccgcgcacagcgu

SEQ ID NO: 7566 - RNA, 21 nt, Artificial Sequence
  ELANE RNA Guide
cauucgccacgcugugcgcgg

SEQ ID NO: 7567 - RNA, 21 nt, Artificial Sequence
  ELANE RNA Guide
ccacgcugugcgcggccgaca

SEQ ID NO: 7568 - RNA, 21 nt, Artificial Sequence
  ELANE RNA Guide
ccgcgcacagcguggcgaaug

SEQ ID NO: 7569 - RNA, 21 nt, Artificial Sequence
  ELANE RNA Guide
cgcacagcguggcgaaugugu

SEQ ID NO: 7570 - RNA, 21 nt, Artificial Sequence
  ELANE RNA Guide
cgcgcacagcguggcgaaugu

SEQ ID NO: 7571 - RNA, 21 nt, Artificial Sequence
  ELANE RNA Guide
cgcugugcgcggccgacauga

SEQ ID NO: 7572 - RNA, 21 nt, Artificial Sequence
  ELANE RNA Guide
cggcuacucacacauucgcca

SEQ ID NO: 7573 - RNA, 21 nt, Artificial Sequence
  ELANE RNA Guide
cgucaugucggccgcgcacag

SEQ ID NO: 7574 - RNA, 21 nt, Artificial Sequence
  ELANE RNA Guide
cucacacauucgccacgcugu

SEQ ID NO: 7575 - RNA, 21 nt, Artificial Sequence
  ELANE RNA Guide
cugugcgcggccgacaugacg

SEQ ID NO: 7576 - RNA, 21 nt, Artificial Sequence
  ELANE RNA Guide
cuucgucaugucggccgcgca

SEQ ID NO: 7577 - RNA, 21 nt, Artificial Sequence
  ELANE RNA Guide
gcacagcguggcgaaugugug

SEQ ID NO: 7578 - RNA, 21 nt, Artificial Sequence
  ELANE RNA Guide
gccgcgcacagcguggcgaau

SEQ ID NO: 7579 - RNA, 21 nt, Artificial Sequence
  ELANE RNA Guide
gcgcacagcguggcgaaugug

SEQ ID NO: 7580 - RNA, 21 nt, Artificial Sequence
  ELANE RNA Guide
gcugugcgcggccgacaugac

SEQ ID NO: 7581 - RNA, 21 nt, Artificial Sequence
  ELANE RNA Guide
ggccgcgcacagcguggcgaa

SEQ ID NO: 7582 - RNA, 21 nt, Artificial Sequence
  ELANE RNA Guide
ggcuacucacacauucgccac

SEQ ID NO: 7583 - RNA, 21 nt, Artificial Sequence
  ELANE RNA Guide
gucaugucggccgcgcacagc

SEQ ID NO: 7584 - RNA, 21 nt, Artificial Sequence
  ELANE RNA Guide
uacucacacauucgccacgcu

SEQ ID NO: 7585 - RNA, 21 nt, Artificial Sequence
  ELANE RNA Guide
ucacacauucgccacgcugug

SEQ ID NO: 7586 - RNA, 21 nt, Artificial Sequence
  ELANE RNA Guide
ucaugucggccgcgcacagcg

SEQ ID NO: 7587 - RNA, 21 nt, Artificial Sequence
  ELANE RNA Guide
ucgucaugucggccgcgcaca

SEQ ID NO: 7588 - RNA, 21 nt, Artificial Sequence
  ELANE RNA Guide
ugucggccgcgcacagcgugg

SEQ ID NO: 7589 - RNA, 21 nt, Artificial Sequence
  ELANE RNA Guide
uucgccacgcugugcgcggcc

SEQ ID NO: 7590 - RNA, 21 nt, Artificial Sequence
  ELANE RNA Guide
uucgucaugucggccgcgcac

SEQ ID NO: 7591 - RNA, 22 nt, Artificial Sequence
  ELANE RNA Guide
aacuucgucaugucggccgcgc

SEQ ID NO: 7592 - RNA, 22 nt, Artificial Sequence
  ELANE RNA Guide
acacauucgccacgcugugcgc

SEQ ID NO: 7593 - RNA, 22 nt, Artificial Sequence
  ELANE RNA Guide
acagcguggcgaaugugugagu

SEQ ID NO: 7594 - RNA, 22 nt, Artificial Sequence
  ELANE RNA Guide
acauucgccacgcugugcgcgg

SEQ ID NO: 7595 - RNA, 22 nt, Artificial Sequence
  ELANE RNA Guide
acgcugugcgcggccgacauga

SEQ ID NO: 7596 - RNA, 22 nt, Artificial Sequence
  ELANE RNA Guide
acucacacauucgccacgcugu

SEQ ID NO: 7597 - RNA, 22 nt, Artificial Sequence
  ELANE RNA Guide
acuucgucaugucggccgcgca

SEQ ID NO: 7598 - RNA, 22 nt, Artificial Sequence
  ELANE RNA Guide
augucggccgcgcacagcgugg

SEQ ID NO: 7599 - RNA, 22 nt, Artificial Sequence
  ELANE RNA Guide
auucgccacgcugugcgcggcc

SEQ ID NO: 7600 - RNA, 22 nt, Artificial Sequence
  ELANE RNA Guide
caacuucgucaugucggccgcg

SEQ ID NO: 7601 - RNA, 22 nt, Artificial Sequence
  ELANE RNA Guide
cacacauucgccacgcugugcg

SEQ ID NO: 7602 - RNA, 22 nt, Artificial Sequence
  ELANE RNA Guide
cacagcguggcgaaugugugag

SEQ ID NO: 7603 - RNA, 22 nt, Artificial Sequence
  ELANE RNA Guide
cacauucgccacgcugugcgcg

SEQ ID NO: 7604 - RNA, 22 nt, Artificial Sequence
  ELANE RNA Guide
cacgcugugcgcggccgacaug

SEQ ID NO: 7605 - RNA, 22 nt, Artificial Sequence
  ELANE RNA Guide
cagcguggcgaaugugugagua

SEQ ID NO: 7606 - RNA, 22 nt, Artificial Sequence
  ELANE RNA Guide
caugucggccgcgcacagcgug

SEQ ID NO: 7607 - RNA, 22 nt, Artificial Sequence
  ELANE RNA Guide
cauucgccacgcugugcgcggc

SEQ ID NO: 7608 - RNA, 22 nt, Artificial Sequence
  ELANE RNA Guide
ccacgcugugcgcggccgacau

SEQ ID NO: 7609 - RNA, 22 nt, Artificial Sequence
  ELANE RNA Guide
ccgcgcacagcguggcgaaugu

SEQ ID NO: 7610 - RNA, 22 nt, Artificial Sequence
  ELANE RNA Guide
ccggcuacucacacauucgcca

SEQ ID NO: 7611 - RNA, 22 nt, Artificial Sequence
  ELANE RNA Guide
cgcacagcguggcgaaugugug

SEQ ID NO: 7612 - RNA, 22 nt, Artificial Sequence
  ELANE RNA Guide
cgcgcacagcguggcgaaugug

SEQ ID NO: 7613 - RNA, 22 nt, Artificial Sequence
  ELANE RNA Guide
cgcugugcgcggccgacaugac

SEQ ID NO: 7614 - RNA, 22 nt, Artificial Sequence
  ELANE RNA Guide
cggccgcgcacagcguggcgaa

SEQ ID NO: 7615 - RNA, 22 nt, Artificial Sequence
  ELANE RNA Guide
cggcuacucacacauucgccac

SEQ ID NO: 7616 - RNA, 22 nt, Artificial Sequence
  ELANE RNA Guide
cgucaugucggccgcgcacagc

SEQ ID NO: 7617 - RNA, 22 nt, Artificial Sequence
  ELANE RNA Guide
cuacucacacauucgccacgcu

SEQ ID NO: 7618 - RNA, 22 nt, Artificial Sequence
  ELANE RNA Guide
cucacacauucgccacgcugug

SEQ ID NO: 7619 - RNA, 22 nt, Artificial Sequence
  ELANE RNA Guide
cugugcgcggccgacaugacga

SEQ ID NO: 7620 - RNA, 22 nt, Artificial Sequence
  ELANE RNA Guide
cuucgucaugucggccgcgcac

SEQ ID NO: 7621 - RNA, 22 nt, Artificial Sequence
  ELANE RNA Guide
gcacagcguggcgaauguguga

SEQ ID NO: 7622 - RNA, 22 nt, Artificial Sequence
  ELANE RNA Guide
gccacgcugugcgcggccgaca

SEQ ID NO: 7623 - RNA, 22 nt, Artificial Sequence
  ELANE RNA Guide
gccgcgcacagcguggcgaaug

SEQ ID NO: 7624 - RNA, 22 nt, Artificial Sequence
  ELANE RNA Guide
gcgcacagcguggcgaaugugu

SEQ ID NO: 7625 - RNA, 22 nt, Artificial Sequence
  ELANE RNA Guide
gcugugcgcggccgacaugacg

SEQ ID NO: 7626 - RNA, 22 nt, Artificial Sequence
  ELANE RNA Guide
ggccgcgcacagcguggcgaau

SEQ ID NO: 7627 - RNA, 22 nt, Artificial Sequence
  ELANE RNA Guide
gucaugucggccgcgcacagcg

SEQ ID NO: 7628 - RNA, 22 nt, Artificial Sequence
  ELANE RNA Guide
uacucacacauucgccacgcug

SEQ ID NO: 7629 - RNA, 22 nt, Artificial Sequence
  ELANE RNA Guide
ucacacauucgccacgcugugc

SEQ ID NO: 7630 - RNA, 22 nt, Artificial Sequence
  ELANE RNA Guide
ucaugucggccgcgcacagcgu

SEQ ID NO: 7631 - RNA, 22 nt, Artificial Sequence
  ELANE RNA Guide
ucgccacgcugugcgcggccga

SEQ ID NO: 7632 - RNA, 22 nt, Artificial Sequence
  ELANE RNA Guide
ucggccgcgcacagcguggcga

SEQ ID NO: 7633 - RNA, 22 nt, Artificial Sequence
  ELANE RNA Guide
ucgucaugucggccgcgcacag

SEQ ID NO: 7634 - RNA, 22 nt, Artificial Sequence
  ELANE RNA Guide
ugucggccgcgcacagcguggc

SEQ ID NO: 7635 - RNA, 22 nt, Artificial Sequence
  ELANE RNA Guide
uucgccacgcugugcgcggccg

SEQ ID NO: 7636 - RNA, 22 nt, Artificial Sequence
  ELANE RNA Guide
uucgucaugucggccgcgcaca

SEQ ID NO: 7637 - RNA, 20 nt, Artificial Sequence
  ELANE RNA Guide
acacauucgccacgcggugc

SEQ ID NO: 7638 - RNA, 20 nt, Artificial Sequence
  ELANE RNA Guide
acauucgccacgcggugcgc

SEQ ID NO: 7639 - RNA, 20 nt, Artificial Sequence
  ELANE RNA Guide
accgcguggcgaauguguga

SEQ ID NO: 7640 - RNA, 20 nt, Artificial Sequence
  ELANE RNA Guide
acgcggugcgcggccgacau

SEQ ID NO: 7641 - RNA, 20 nt, Artificial Sequence
  ELANE RNA Guide
acucacacauucgccacgcg

SEQ ID NO: 7642 - RNA, 20 nt, Artificial Sequence
  ELANE RNA Guide
augucggccgcgcaccgcgu

SEQ ID NO: 7643 - RNA, 20 nt, Artificial Sequence
  ELANE RNA Guide
auucgccacgcggugcgcgg

SEQ ID NO: 7644 - RNA, 20 nt, Artificial Sequence
  ELANE RNA Guide
cacacauucgccacgcggug

SEQ ID NO: 7645 - RNA, 20 nt, Artificial Sequence
  ELANE RNA Guide
cacauucgccacgcggugcg

SEQ ID NO: 7646 - RNA, 20 nt, Artificial Sequence
  ELANE RNA Guide
caccgcguggcgaaugugug

SEQ ID NO: 7647 - RNA, 20 nt, Artificial Sequence
  ELANE RNA Guide
cacgcggugcgcggccgaca

SEQ ID NO: 7648 - RNA, 20 nt, Artificial Sequence
  ELANE RNA Guide
caugucggccgcgcaccgcg

SEQ ID NO: 7649 - RNA, 20 nt, Artificial Sequence
  ELANE RNA Guide
cauucgccacgcggugcgcg

SEQ ID NO: 7650 - RNA, 20 nt, Artificial Sequence
  ELANE RNA Guide
ccgcgcaccgcguggcgaau

SEQ ID NO: 7651 - RNA, 20 nt, Artificial Sequence
  ELANE RNA Guide
ccgcguggcgaaugugugag

SEQ ID NO: 7652 - RNA, 20 nt, Artificial Sequence
  ELANE RNA Guide
cgcaccgcguggcgaaugug

SEQ ID NO: 7653 - RNA, 20 nt, Artificial Sequence
  ELANE RNA Guide
cgcgcaccgcguggcgaaug

SEQ ID NO: 7654 - RNA, 20 nt, Artificial Sequence
  ELANE RNA Guide
cgcggugcgcggccgacaug

SEQ ID NO: 7655 - RNA, 20 nt, Artificial Sequence
  ELANE RNA Guide
cggugcgcggccgacaugac

SEQ ID NO: 7656 - RNA, 20 nt, Artificial Sequence
  ELANE RNA Guide
cgucaugucggccgcgcacc

SEQ ID NO: 7657 - RNA, 20 nt, Artificial Sequence
  ELANE RNA Guide
cucacacauucgccacgcgg

SEQ ID NO: 7658 - RNA, 20 nt, Artificial Sequence
  ELANE RNA Guide
gcaccgcguggcgaaugugu

SEQ ID NO: 7659 - RNA, 20 nt, Artificial Sequence
  ELANE RNA Guide
gccgcgcaccgcguggcgaa

SEQ ID NO: 7660 - RNA, 20 nt, Artificial Sequence
  ELANE RNA Guide
gcgcaccgcguggcgaaugu

SEQ ID NO: 7661 - RNA, 20 nt, Artificial Sequence
  ELANE RNA Guide
gcggugcgcggccgacauga

SEQ ID NO: 7662 - RNA, 20 nt, Artificial Sequence
  ELANE RNA Guide
gucaugucggccgcgcaccg

SEQ ID NO: 7663 - RNA, 20 nt, Artificial Sequence
  ELANE RNA Guide
ucacacauucgccacgcggu

SEQ ID NO: 7664 - RNA, 20 nt, Artificial Sequence
  ELANE RNA Guide
ucaugucggccgcgcaccgc

SEQ ID NO: 7665 - RNA, 20 nt, Artificial Sequence
  ELANE RNA Guide
ugucggccgcgcaccgcgug

SEQ ID NO: 7666 - RNA, 20 nt, Artificial Sequence
  ELANE RNA Guide
uucgccacgcggugcgcggc

SEQ ID NO: 7667 - RNA, 21 nt, Artificial Sequence
  ELANE RNA Guide
acacauucgccacgcggugcg

SEQ ID NO: 7668 - RNA, 21 nt, Artificial Sequence
  ELANE RNA Guide
acauucgccacgcggugcgcg

SEQ ID NO: 7669 - RNA, 21 nt, Artificial Sequence
  ELANE RNA Guide
accgcguggcgaaugugugag

SEQ ID NO: 7670 - RNA, 21 nt, Artificial Sequence
  ELANE RNA Guide
acgcggugcgcggccgacaug

SEQ ID NO: 7671 - RNA, 21 nt, Artificial Sequence
  ELANE RNA Guide
acucacacauucgccacgcgg

SEQ ID NO: 7672 - RNA, 21 nt, Artificial Sequence
  ELANE RNA Guide
augucggccgcgcaccgcgug

SEQ ID NO: 7673 - RNA, 21 nt, Artificial Sequence
  ELANE RNA Guide
auucgccacgcggugcgcggc

SEQ ID NO: 7674 - RNA, 21 nt, Artificial Sequence
  ELANE RNA Guide
cacacauucgccacgcggugc

SEQ ID NO: 7675 - RNA, 21 nt, Artificial Sequence
  ELANE RNA Guide
cacauucgccacgcggugcgc

SEQ ID NO: 7676 - RNA, 21 nt, Artificial Sequence
  ELANE RNA Guide
caccgcguggcgaauguguga

SEQ ID NO: 7677 - RNA, 21 nt, Artificial Sequence
  ELANE RNA Guide
cacgcggugcgcggccgacau

SEQ ID NO: 7678 - RNA, 21 nt, Artificial Sequence
  ELANE RNA Guide
caugucggccgcgcaccgcgu

SEQ ID NO: 7679 - RNA, 21 nt, Artificial Sequence
  ELANE RNA Guide
cauucgccacgcggugcgcgg

SEQ ID NO: 7680 - RNA, 21 nt, Artificial Sequence
  ELANE RNA Guide
ccgcgcaccgcguggcgaaug

SEQ ID NO: 7681 - RNA, 21 nt, Artificial Sequence
  ELANE RNA Guide
ccgcguggcgaaugugugagu

SEQ ID NO: 7682 - RNA, 21 nt, Artificial Sequence
  ELANE RNA Guide
cgcaccgcguggcgaaugugu

SEQ ID NO: 7683 - RNA, 21 nt, Artificial Sequence
  ELANE RNA Guide
cgcgcaccgcguggcgaaugu

SEQ ID NO: 7684 - RNA, 21 nt, Artificial Sequence
  ELANE RNA Guide
cgcggugcgcggccgacauga

SEQ ID NO: 7685 - RNA, 21 nt, Artificial Sequence
  ELANE RNA Guide
cggugcgcggccgacaugacg

SEQ ID NO: 7686 - RNA, 21 nt, Artificial Sequence
  ELANE RNA Guide
cgucaugucggccgcgcaccg

SEQ ID NO: 7687 - RNA, 21 nt, Artificial Sequence
  ELANE RNA Guide
cucacacauucgccacgcggu

SEQ ID NO: 7688 - RNA, 21 nt, Artificial Sequence
  ELANE RNA Guide
gcaccgcguggcgaaugugug

SEQ ID NO: 7689 - RNA, 21 nt, Artificial Sequence
  ELANE RNA Guide
gccgcgcaccgcguggcgaau

SEQ ID NO: 7690 - RNA, 21 nt, Artificial Sequence
  ELANE RNA Guide
gcgcaccgcguggcgaaugug

SEQ ID NO: 7691 - RNA, 21 nt, Artificial Sequence
  ELANE RNA Guide
gcggugcgcggccgacaugac

SEQ ID NO: 7692 - RNA, 21 nt, Artificial Sequence
  ELANE RNA Guide
gucaugucggccgcgcaccgc

SEQ ID NO: 7693 - RNA, 21 nt, Artificial Sequence
  ELANE RNA Guide
uacucacacauucgccacgcg

SEQ ID NO: 7694 - RNA, 21 nt, Artificial Sequence
  ELANE RNA Guide
ucacacauucgccacgcggug

SEQ ID NO: 7695 - RNA, 21 nt, Artificial Sequence
  ELANE RNA Guide
ucaugucggccgcgcaccgcg

SEQ ID NO: 7696 - RNA, 21 nt, Artificial Sequence
  ELANE RNA Guide
ucgucaugucggccgcgcacc

SEQ ID NO: 7697 - RNA, 22 nt, Artificial Sequence
  ELANE RNA Guide
acacauucgccacgcggugcgc

SEQ ID NO: 7698 - RNA, 22 nt, Artificial Sequence
  ELANE RNA Guide
acauucgccacgcggugcgcgg

SEQ ID NO: 7699 - RNA, 22 nt, Artificial Sequence
  ELANE RNA Guide
accgcguggcgaaugugugagu

SEQ ID NO: 7700 - RNA, 22 nt, Artificial Sequence
  ELANE RNA Guide
acgcggugcgcggccgacauga

SEQ ID NO: 7701 - RNA, 22 nt, Artificial Sequence
  ELANE RNA Guide
acucacacauucgccacgcggu

SEQ ID NO: 7702 - RNA, 22 nt, Artificial Sequence
  ELANE RNA Guide
augucggccgcgcaccgcgugg

SEQ ID NO: 7703 - RNA, 22 nt, Artificial Sequence
  ELANE RNA Guide
auucgccacgcggugcgcggcc

SEQ ID NO: 7704 - RNA, 22 nt, Artificial Sequence
  ELANE RNA Guide
cacacauucgccacgcggugcg

SEQ ID NO: 7705 - RNA, 22 nt, Artificial Sequence
  ELANE RNA Guide
cacauucgccacgcggugcgcg

SEQ ID NO: 7706 - RNA, 22 nt, Artificial Sequence
  ELANE RNA Guide
caccgcguggcgaaugugugag

SEQ ID NO: 7707 - RNA, 22 nt, Artificial Sequence
  ELANE RNA Guide
cacgcggugcgcggccgacaug

SEQ ID NO: 7708 - RNA, 22 nt, Artificial Sequence
  ELANE RNA Guide
caugucggccgcgcaccgcgug

SEQ ID NO: 7709 - RNA, 22 nt, Artificial Sequence
  ELANE RNA Guide
cauucgccacgcggugcgcggc

SEQ ID NO: 7710 - RNA, 22 nt, Artificial Sequence
  ELANE RNA Guide
ccacgcggugcgcggccgacau

SEQ ID NO: 7711 - RNA, 22 nt, Artificial Sequence
  ELANE RNA Guide
ccgcgcaccgcguggcgaaugu

SEQ ID NO: 7712 - RNA, 22 nt, Artificial Sequence
  ELANE RNA Guide
ccgcguggcgaaugugugagua

SEQ ID NO: 7713 - RNA, 22 nt, Artificial Sequence
  ELANE RNA Guide
cgcaccgcguggcgaaugugug

SEQ ID NO: 7714 - RNA, 22 nt, Artificial Sequence
  ELANE RNA Guide
cgcgcaccgcguggcgaaugug

SEQ ID NO: 7715 - RNA, 22 nt, Artificial Sequence
  ELANE RNA Guide
cgcggugcgcggccgacaugac

SEQ ID NO: 7716 - RNA, 22 nt, Artificial Sequence
  ELANE RNA Guide
cggugcgcggccgacaugacga

SEQ ID NO: 7717 - RNA, 22 nt, Artificial Sequence
  ELANE RNA Guide
cgucaugucggccgcgcaccgc

SEQ ID NO: 7718 - RNA, 22 nt, Artificial Sequence
  ELANE RNA Guide
cuacucacacauucgccacgcg

SEQ ID NO: 7719 - RNA, 22 nt, Artificial Sequence
  ELANE RNA Guide
cucacacauucgccacgcggug

SEQ ID NO: 7720 - RNA, 22 nt, Artificial Sequence
  ELANE RNA Guide
gcaccgcguggcgaauguguga

SEQ ID NO: 7721 - RNA, 22 nt, Artificial Sequence
  ELANE RNA Guide
gccgcgcaccgcguggcgaaug

SEQ ID NO: 7722 - RNA, 22 nt, Artificial Sequence
  ELANE RNA Guide
gcgcaccgcguggcgaaugugu

SEQ ID NO: 7723 - RNA, 22 nt, Artificial Sequence
  ELANE RNA Guide
gcggugcgcggccgacaugacg

SEQ ID NO: 7724 - RNA, 22 nt, Artificial Sequence
  ELANE RNA Guide
ggccgcgcaccgcguggcgaau

SEQ ID NO: 7725 - RNA, 22 nt, Artificial Sequence
  ELANE RNA Guide
gucaugucggccgcgcaccgcg

SEQ ID NO: 7726 - RNA, 22 nt, Artificial Sequence
  ELANE RNA Guide
uacucacacauucgccacgcgg

SEQ ID NO: 7727 - RNA, 22 nt, Artificial Sequence
  ELANE RNA Guide
ucacacauucgccacgcggugc

SEQ ID NO: 7728 - RNA, 22 nt, Artificial Sequence
  ELANE RNA Guide
ucaugucggccgcgcaccgcgu

SEQ ID NO: 7729 - RNA, 22 nt, Artificial Sequence
  ELANE RNA Guide
ucgucaugucggccgcgcaccg

SEQ ID NO: 7730 - RNA, 22 nt, Artificial Sequence
  ELANE RNA Guide
uucgucaugucggccgcgcacc

SEQ ID NO: 7731 - RNA, 20 nt, Artificial Sequence
  ELANE RNA Guide
acacauucgccacguagugc

SEQ ID NO: 7732 - RNA, 20 nt, Artificial Sequence
  ELANE RNA Guide
acauucgccacguagugcgc

SEQ ID NO: 7733 - RNA, 20 nt, Artificial Sequence
  ELANE RNA Guide
acguagugcgcggccgacau

SEQ ID NO: 7734 - RNA, 20 nt, Artificial Sequence
  ELANE RNA Guide
acuacguggcgaauguguga

SEQ ID NO: 7735 - RNA, 20 nt, Artificial Sequence
  ELANE RNA Guide
acucacacauucgccacgua

SEQ ID NO: 7736 - RNA, 20 nt, Artificial Sequence
  ELANE RNA Guide
augucggccgcgcacuacgu

SEQ ID NO: 7737 - RNA, 20 nt, Artificial Sequence
  ELANE RNA Guide
auucgccacguagugcgcgg

SEQ ID NO: 7738 - RNA, 20 nt, Artificial Sequence
  ELANE RNA Guide
cacacauucgccacguagug

SEQ ID NO: 7739 - RNA, 20 nt, Artificial Sequence
  ELANE RNA Guide
cacauucgccacguagugcg

SEQ ID NO: 7740 - RNA, 20 nt, Artificial Sequence
  ELANE RNA Guide
cacguagugcgcggccgaca

SEQ ID NO: 7741 - RNA, 20 nt, Artificial Sequence
  ELANE RNA Guide
cacuacguggcgaaugugug

SEQ ID NO: 7742 - RNA, 20 nt, Artificial Sequence
  ELANE RNA Guide
caugucggccgcgcacuacg

SEQ ID NO: 7743 - RNA, 20 nt, Artificial Sequence
  ELANE RNA Guide
cauucgccacguagugcgcg

SEQ ID NO: 7744 - RNA, 20 nt, Artificial Sequence
  ELANE RNA Guide
ccacguagugcgcggccgac

SEQ ID NO: 7745 - RNA, 20 nt, Artificial Sequence
  ELANE RNA Guide
ccgcgcacuacguggcgaau

SEQ ID NO: 7746 - RNA, 20 nt, Artificial Sequence
  ELANE RNA Guide
cgcacuacguggcgaaugug

SEQ ID NO: 7747 - RNA, 20 nt, Artificial Sequence
  ELANE RNA Guide
cgccacguagugcgcggccg

SEQ ID NO: 7748 - RNA, 20 nt, Artificial Sequence
  ELANE RNA Guide
cgcgcacuacguggcgaaug

SEQ ID NO: 7749 - RNA, 20 nt, Artificial Sequence
  ELANE RNA Guide
cggccgcgcacuacguggcg

SEQ ID NO: 7750 - RNA, 20 nt, Artificial Sequence
  ELANE RNA Guide
cggcuacucacacauucgcc

SEQ ID NO: 7751 - RNA, 20 nt, Artificial Sequence
  ELANE RNA Guide
cguagugcgcggccgacaug

SEQ ID NO: 7752 - RNA, 20 nt, Artificial Sequence
  ELANE RNA Guide
cgucaugucggccgcgcacu

SEQ ID NO: 7753 - RNA, 20 nt, Artificial Sequence
  ELANE RNA Guide
cuacguggcgaaugugugag

SEQ ID NO: 7754 - RNA, 20 nt, Artificial Sequence
  ELANE RNA Guide
cucacacauucgccacguag

SEQ ID NO: 7755 - RNA, 20 nt, Artificial Sequence
  ELANE RNA Guide
gcacuacguggcgaaugugu

SEQ ID NO: 7756 - RNA, 20 nt, Artificial Sequence
  ELANE RNA Guide
gccacguagugcgcggccga

SEQ ID NO: 7757 - RNA, 20 nt, Artificial Sequence
  ELANE RNA Guide
gccgcgcacuacguggcgaa

SEQ ID NO: 7758 - RNA, 20 nt, Artificial Sequence
  ELANE RNA Guide
gcgcacuacguggcgaaugu

SEQ ID NO: 7759 - RNA, 20 nt, Artificial Sequence
  ELANE RNA Guide
ggccgcgcacuacguggcga

SEQ ID NO: 7760 - RNA, 20 nt, Artificial Sequence
  ELANE RNA Guide
guagugcgcggccgacauga

SEQ ID NO: 7761 - RNA, 20 nt, Artificial Sequence
  ELANE RNA Guide
gucaugucggccgcgcacua

SEQ ID NO: 7762 - RNA, 20 nt, Artificial Sequence
  ELANE RNA Guide
gucggccgcgcacuacgugg

SEQ ID NO: 7763 - RNA, 20 nt, Artificial Sequence
  ELANE RNA Guide
uacguggcgaaugugugagu

SEQ ID NO: 7764 - RNA, 20 nt, Artificial Sequence
  ELANE RNA Guide
uacucacacauucgccacgu

SEQ ID NO: 7765 - RNA, 20 nt, Artificial Sequence
  ELANE RNA Guide
ucacacauucgccacguagu

SEQ ID NO: 7766 - RNA, 20 nt, Artificial Sequence
  ELANE RNA Guide
ucaugucggccgcgcacuac

SEQ ID NO: 7767 - RNA, 20 nt, Artificial Sequence
  ELANE RNA Guide
ucgccacguagugcgcggcc

SEQ ID NO: 7768 - RNA, 20 nt, Artificial Sequence
  ELANE RNA Guide
ucggccgcgcacuacguggc

SEQ ID NO: 7769 - RNA, 20 nt, Artificial Sequence
  ELANE RNA Guide
ugucggccgcgcacuacgug

SEQ ID NO: 7770 - RNA, 20 nt, Artificial Sequence
  ELANE RNA Guide
uucgccacguagugcgcggc

SEQ ID NO: 7771 - RNA, 21 nt, Artificial Sequence
  ELANE RNA Guide
acacauucgccacguagugcg

SEQ ID NO: 7772 - RNA, 21 nt, Artificial Sequence
  ELANE RNA Guide
acauucgccacguagugcgcg

SEQ ID NO: 7773 - RNA, 21 nt, Artificial Sequence
  ELANE RNA Guide
acguagugcgcggccgacaug

SEQ ID NO: 7774 - RNA, 21 nt, Artificial Sequence
  ELANE RNA Guide
acuacguggcgaaugugugag

SEQ ID NO: 7775 - RNA, 21 nt, Artificial Sequence
  ELANE RNA Guide
acucacacauucgccacguag

SEQ ID NO: 7776 - RNA, 21 nt, Artificial Sequence
  ELANE RNA Guide
augucggccgcgcacuacgug

SEQ ID NO: 7777 - RNA, 21 nt, Artificial Sequence
  ELANE RNA Guide
auucgccacguagugcgcggc

SEQ ID NO: 7778 - RNA, 21 nt, Artificial Sequence
  ELANE RNA Guide
cacacauucgccacguagugc

SEQ ID NO: 7779 - RNA, 21 nt, Artificial Sequence
  ELANE RNA Guide
cacauucgccacguagugcgc

SEQ ID NO: 7780 - RNA, 21 nt, Artificial Sequence
  ELANE RNA Guide
cacguagugcgcggccgacau

SEQ ID NO: 7781 - RNA, 21 nt, Artificial Sequence
  ELANE RNA Guide
cacuacguggcgaauguguga

SEQ ID NO: 7782 - RNA, 21 nt, Artificial Sequence
  ELANE RNA Guide
caugucggccgcgcacuacgu

SEQ ID NO: 7783 - RNA, 21 nt, Artificial Sequence
  ELANE RNA Guide
cauucgccacguagugcgcgg

SEQ ID NO: 7784 - RNA, 21 nt, Artificial Sequence
  ELANE RNA Guide
ccacguagugcgcggccgaca

SEQ ID NO: 7785 - RNA, 21 nt, Artificial Sequence
  ELANE RNA Guide
ccgcgcacuacguggcgaaug

SEQ ID NO: 7786 - RNA, 21 nt, Artificial Sequence
  ELANE RNA Guide
ccggcuacucacacauucgcc

SEQ ID NO: 7787 - RNA, 21 nt, Artificial Sequence
  ELANE RNA Guide
cgcacuacguggcgaaugugu

SEQ ID NO: 7788 - RNA, 21 nt, Artificial Sequence
  ELANE RNA Guide
cgccacguagugcgcggccga

SEQ ID NO: 7789 - RNA, 21 nt, Artificial Sequence
  ELANE RNA Guide
cgcgcacuacguggcgaaugu

SEQ ID NO: 7790 - RNA, 21 nt, Artificial Sequence
  ELANE RNA Guide
cggccgcgcacuacguggcga

SEQ ID NO: 7791 - RNA, 21 nt, Artificial Sequence
  ELANE RNA Guide
cguagugcgcggccgacauga

SEQ ID NO: 7792 - RNA, 21 nt, Artificial Sequence
  ELANE RNA Guide
cgucaugucggccgcgcacua

SEQ ID NO: 7793 - RNA, 21 nt, Artificial Sequence
  ELANE RNA Guide
cuacguggcgaaugugugagu

SEQ ID NO: 7794 - RNA, 21 nt, Artificial Sequence
  ELANE RNA Guide
cuacucacacauucgccacgu

SEQ ID NO: 7795 - RNA, 21 nt, Artificial Sequence
  ELANE RNA Guide
cucacacauucgccacguagu

SEQ ID NO: 7796 - RNA, 21 nt, Artificial Sequence
  ELANE RNA Guide
gcacuacguggcgaaugugug

SEQ ID NO: 7797 - RNA, 21 nt, Artificial Sequence
  ELANE RNA Guide
gccacguagugcgcggccgac

SEQ ID NO: 7798 - RNA, 21 nt, Artificial Sequence
  ELANE RNA Guide
gccgcgcacuacguggcgaau

SEQ ID NO: 7799 - RNA, 21 nt, Artificial Sequence
  ELANE RNA Guide
gcgcacuacguggcgaaugug

SEQ ID NO: 7800 - RNA, 21 nt, Artificial Sequence
  ELANE RNA Guide
ggccgcgcacuacguggcgaa

SEQ ID NO: 7801 - RNA, 21 nt, Artificial Sequence
  ELANE RNA Guide
guagugcgcggccgacaugac

SEQ ID NO: 7802 - RNA, 21 nt, Artificial Sequence
  ELANE RNA Guide
gucaugucggccgcgcacuac

SEQ ID NO: 7803 - RNA, 21 nt, Artificial Sequence
  ELANE RNA Guide
gucggccgcgcacuacguggc

SEQ ID NO: 7804 - RNA, 21 nt, Artificial Sequence
  ELANE RNA Guide
uacguggcgaaugugugagua

SEQ ID NO: 7805 - RNA, 21 nt, Artificial Sequence
  ELANE RNA Guide
uacucacacauucgccacgua

SEQ ID NO: 7806 - RNA, 21 nt, Artificial Sequence
  ELANE RNA Guide
ucacacauucgccacguagug

SEQ ID NO: 7807 - RNA, 21 nt, Artificial Sequence
  ELANE RNA Guide
ucaugucggccgcgcacuacg

SEQ ID NO: 7808 - RNA, 21 nt, Artificial Sequence
  ELANE RNA Guide
ucgccacguagugcgcggccg

SEQ ID NO: 7809 - RNA, 21 nt, Artificial Sequence
  ELANE RNA Guide
ucggccgcgcacuacguggcg

SEQ ID NO: 7810 - RNA, 21 nt, Artificial Sequence
  ELANE RNA Guide
ucgucaugucggccgcgcacu

SEQ ID NO: 7811 - RNA, 21 nt, Artificial Sequence
  ELANE RNA Guide
ugucggccgcgcacuacgugg

SEQ ID NO: 7812 - RNA, 21 nt, Artificial Sequence
  ELANE RNA Guide
uucgccacguagugcgcggcc

SEQ ID NO: 7813 - RNA, 22 nt, Artificial Sequence
  ELANE RNA Guide
acacauucgccacguagugcgc

SEQ ID NO: 7814 - RNA, 22 nt, Artificial Sequence
  ELANE RNA Guide
acauucgccacguagugcgcgg

SEQ ID NO: 7815 - RNA, 22 nt, Artificial Sequence
  ELANE RNA Guide
acguagugcgcggccgacauga

SEQ ID NO: 7816 - RNA, 22 nt, Artificial Sequence
  ELANE RNA Guide
acuacguggcgaaugugugagu

SEQ ID NO: 7817 - RNA, 22 nt, Artificial Sequence
  ELANE RNA Guide
acucacacauucgccacguagu

SEQ ID NO: 7818 - RNA, 22 nt, Artificial Sequence
  ELANE RNA Guide
augucggccgcgcacuacgugg

SEQ ID NO: 7819 - RNA, 22 nt, Artificial Sequence
  ELANE RNA Guide
auucgccacguagugcgcggcc

SEQ ID NO: 7820 - RNA, 22 nt, Artificial Sequence
  ELANE RNA Guide
cacacauucgccacguagugcg

SEQ ID NO: 7821 - RNA, 22 nt, Artificial Sequence
  ELANE RNA Guide
cacauucgccacguagugcgcg

SEQ ID NO: 7822 - RNA, 22 nt, Artificial Sequence
  ELANE RNA Guide
cacguagugcgcggccgacaug

SEQ ID NO: 7823 - RNA, 22 nt, Artificial Sequence
  ELANE RNA Guide
cacuacguggcgaaugugugag

SEQ ID NO: 7824 - RNA, 22 nt, Artificial Sequence
  ELANE RNA Guide
caugucggccgcgcacuacgug

SEQ ID NO: 7825 - RNA, 22 nt, Artificial Sequence
  ELANE RNA Guide
cauucgccacguagugcgcggc

SEQ ID NO: 7826 - RNA, 22 nt, Artificial Sequence
  ELANE RNA Guide
ccacguagugcgcggccgacau

SEQ ID NO: 7827 - RNA, 22 nt, Artificial Sequence
  ELANE RNA Guide
cccggcuacucacacauucgcc

SEQ ID NO: 7828 - RNA, 22 nt, Artificial Sequence
  ELANE RNA Guide
ccgcgcacuacguggcgaaugu

SEQ ID NO: 7829 - RNA, 22 nt, Artificial Sequence
  ELANE RNA Guide
cgcacuacguggcgaaugugug

SEQ ID NO: 7830 - RNA, 22 nt, Artificial Sequence
  ELANE RNA Guide
cgccacguagugcgcggccgac

SEQ ID NO: 7831 - RNA, 22 nt, Artificial Sequence
  ELANE RNA Guide
cgcgcacuacguggcgaaugug

SEQ ID NO: 7832 - RNA, 22 nt, Artificial Sequence
  ELANE RNA Guide
cggccgcgcacuacguggcgaa

SEQ ID NO: 7833 - RNA, 22 nt, Artificial Sequence
  ELANE RNA Guide
cguagugcgcggccgacaugac

SEQ ID NO: 7834 - RNA, 22 nt, Artificial Sequence
  ELANE RNA Guide
cgucaugucggccgcgcacuac

SEQ ID NO: 7835 - RNA, 22 nt, Artificial Sequence
  ELANE RNA Guide
cuacguggcgaaugugugagua

SEQ ID NO: 7836 - RNA, 22 nt, Artificial Sequence
  ELANE RNA Guide
cuacucacacauucgccacgua

SEQ ID NO: 7837 - RNA, 22 nt, Artificial Sequence
  ELANE RNA Guide
cucacacauucgccacguagug

SEQ ID NO: 7838 - RNA, 22 nt, Artificial Sequence
  ELANE RNA Guide
gcacuacguggcgaauguguga

SEQ ID NO: 7839 - RNA, 22 nt, Artificial Sequence
  ELANE RNA Guide
gccacguagugcgcggccgaca

SEQ ID NO: 7840 - RNA, 22 nt, Artificial Sequence
  ELANE RNA Guide
gccgcgcacuacguggcgaaug

SEQ ID NO: 7841 - RNA, 22 nt, Artificial Sequence
  ELANE RNA Guide
gcgcacuacguggcgaaugugu

SEQ ID NO: 7842 - RNA, 22 nt, Artificial Sequence
  ELANE RNA Guide
gcuacucacacauucgccacgu

SEQ ID NO: 7843 - RNA, 22 nt, Artificial Sequence
  ELANE RNA Guide
ggccgcgcacuacguggcgaau

SEQ ID NO: 7844 - RNA, 22 nt, Artificial Sequence
  ELANE RNA Guide
guagugcgcggccgacaugacg

SEQ ID NO: 7845 - RNA, 22 nt, Artificial Sequence
  ELANE RNA Guide
gucaugucggccgcgcacuacg

SEQ ID NO: 7846 - RNA, 22 nt, Artificial Sequence
  ELANE RNA Guide
gucggccgcgcacuacguggcg

SEQ ID NO: 7847 - RNA, 22 nt, Artificial Sequence
  ELANE RNA Guide
uacguggcgaaugugugaguag

SEQ ID NO: 7848 - RNA, 22 nt, Artificial Sequence
  ELANE RNA Guide
uacucacacauucgccacguag

SEQ ID NO: 7849 - RNA, 22 nt, Artificial Sequence
  ELANE RNA Guide
ucacacauucgccacguagugc

SEQ ID NO: 7850 - RNA, 22 nt, Artificial Sequence
  ELANE RNA Guide
ucaugucggccgcgcacuacgu

SEQ ID NO: 7851 - RNA, 22 nt, Artificial Sequence
  ELANE RNA Guide
ucgccacguagugcgcggccga

SEQ ID NO: 7852 - RNA, 22 nt, Artificial Sequence
  ELANE RNA Guide
ucggccgcgcacuacguggcga

SEQ ID NO: 7853 - RNA, 22 nt, Artificial Sequence
  ELANE RNA Guide
ucgucaugucggccgcgcacua

SEQ ID NO: 7854 - RNA, 22 nt, Artificial Sequence
  ELANE RNA Guide
ugucggccgcgcacuacguggc

SEQ ID NO: 7855 - RNA, 22 nt, Artificial Sequence
  ELANE RNA Guide
uucgccacguagugcgcggccg

SEQ ID NO: 7856 - RNA, 22 nt, Artificial Sequence
  ELANE RNA Guide
uucgucaugucggccgcgcacu

SEQ ID NO: 7857 - RNA, 20 nt, Artificial Sequence
  ELANE RNA Guide
acacauucgccacgaagugc

SEQ ID NO: 7858 - RNA, 20 nt, Artificial Sequence
  ELANE RNA Guide
acauucgccacgaagugcgc

SEQ ID NO: 7859 - RNA, 20 nt, Artificial Sequence
  ELANE RNA Guide
acgaagugcgcggccgacau

SEQ ID NO: 7860 - RNA, 20 nt, Artificial Sequence
  ELANE RNA Guide
acucacacauucgccacgaa

SEQ ID NO: 7861 - RNA, 20 nt, Artificial Sequence
  ELANE RNA Guide
acuucguggcgaauguguga

SEQ ID NO: 7862 - RNA, 20 nt, Artificial Sequence
  ELANE RNA Guide
augucggccgcgcacuucgu

SEQ ID NO: 7863 - RNA, 20 nt, Artificial Sequence
  ELANE RNA Guide
auucgccacgaagugcgcgg

SEQ ID NO: 7864 - RNA, 20 nt, Artificial Sequence
  ELANE RNA Guide
cacacauucgccacgaagug

SEQ ID NO: 7865 - RNA, 20 nt, Artificial Sequence
  ELANE RNA Guide
cacauucgccacgaagugcg

SEQ ID NO: 7866 - RNA, 20 nt, Artificial Sequence
  ELANE RNA Guide
cacgaagugcgcggccgaca

SEQ ID NO: 7867 - RNA, 20 nt, Artificial Sequence
  ELANE RNA Guide
cacuucguggcgaaugugug

SEQ ID NO: 7868 - RNA, 20 nt, Artificial Sequence
  ELANE RNA Guide
caugucggccgcgcacuucg

SEQ ID NO: 7869 - RNA, 20 nt, Artificial Sequence
  ELANE RNA Guide
cauucgccacgaagugcgcg

SEQ ID NO: 7870 - RNA, 20 nt, Artificial Sequence
  ELANE RNA Guide
ccacgaagugcgcggccgac

SEQ ID NO: 7871 - RNA, 20 nt, Artificial Sequence
  ELANE RNA Guide
ccgcgcacuucguggcgaau

SEQ ID NO: 7872 - RNA, 20 nt, Artificial Sequence
  ELANE RNA Guide
cgaagugcgcggccgacaug

SEQ ID NO: 7873 - RNA, 20 nt, Artificial Sequence
  ELANE RNA Guide
cgcacuucguggcgaaugug

SEQ ID NO: 7874 - RNA, 20 nt, Artificial Sequence
  ELANE RNA Guide
cgccacgaagugcgcggccg

SEQ ID NO: 7875 - RNA, 20 nt, Artificial Sequence
  ELANE RNA Guide
cgcgcacuucguggcgaaug

SEQ ID NO: 7876 - RNA, 20 nt, Artificial Sequence
  ELANE RNA Guide
cggccgcgcacuucguggcg

SEQ ID NO: 7877 - RNA, 20 nt, Artificial Sequence
  ELANE RNA Guide
cucacacauucgccacgaag

SEQ ID NO: 7878 - RNA, 20 nt, Artificial Sequence
  ELANE RNA Guide
cuucguggcgaaugugugag

SEQ ID NO: 7879 - RNA, 20 nt, Artificial Sequence
  ELANE RNA Guide
gaagugcgcggccgacauga

SEQ ID NO: 7880 - RNA, 20 nt, Artificial Sequence
  ELANE RNA Guide
gcacuucguggcgaaugugu

SEQ ID NO: 7881 - RNA, 20 nt, Artificial Sequence
  ELANE RNA Guide
gccacgaagugcgcggccga

SEQ ID NO: 7882 - RNA, 20 nt, Artificial Sequence
  ELANE RNA Guide
gccgcgcacuucguggcgaa

SEQ ID NO: 7883 - RNA, 20 nt, Artificial Sequence
  ELANE RNA Guide
gcgcacuucguggcgaaugu

SEQ ID NO: 7884 - RNA, 20 nt, Artificial Sequence
  ELANE RNA Guide
ggccgcgcacuucguggcga

SEQ ID NO: 7885 - RNA, 20 nt, Artificial Sequence
  ELANE RNA Guide
gucaugucggccgcgcacuu

SEQ ID NO: 7886 - RNA, 20 nt, Artificial Sequence
  ELANE RNA Guide
gucggccgcgcacuucgugg

SEQ ID NO: 7887 - RNA, 20 nt, Artificial Sequence
  ELANE RNA Guide
uacucacacauucgccacga

SEQ ID NO: 7888 - RNA, 20 nt, Artificial Sequence
  ELANE RNA Guide
ucacacauucgccacgaagu

SEQ ID NO: 7889 - RNA, 20 nt, Artificial Sequence
  ELANE RNA Guide
ucaugucggccgcgcacuuc

SEQ ID NO: 7890 - RNA, 20 nt, Artificial Sequence
  ELANE RNA Guide
ucgccacgaagugcgcggcc

SEQ ID NO: 7891 - RNA, 20 nt, Artificial Sequence
  ELANE RNA Guide
ucggccgcgcacuucguggc

SEQ ID NO: 7892 - RNA, 20 nt, Artificial Sequence
  ELANE RNA Guide
ugucggccgcgcacuucgug

SEQ ID NO: 7893 - RNA, 20 nt, Artificial Sequence
  ELANE RNA Guide
uucgccacgaagugcgcggc

SEQ ID NO: 7894 - RNA, 20 nt, Artificial Sequence
  ELANE RNA Guide
uucguggcgaaugugugagu

SEQ ID NO: 7895 - RNA, 21 nt, Artificial Sequence
  ELANE RNA Guide
acacauucgccacgaagugcg

SEQ ID NO: 7896 - RNA, 21 nt, Artificial Sequence
  ELANE RNA Guide
acauucgccacgaagugcgcg

SEQ ID NO: 7897 - RNA, 21 nt, Artificial Sequence
  ELANE RNA Guide
acgaagugcgcggccgacaug

SEQ ID NO: 7898 - RNA, 21 nt, Artificial Sequence
  ELANE RNA Guide
acucacacauucgccacgaag

SEQ ID NO: 7899 - RNA, 21 nt, Artificial Sequence
  ELANE RNA Guide
acuucguggcgaaugugugag

SEQ ID NO: 7900 - RNA, 21 nt, Artificial Sequence
  ELANE RNA Guide
augucggccgcgcacuucgug

SEQ ID NO: 7901 - RNA, 21 nt, Artificial Sequence
  ELANE RNA Guide
auucgccacgaagugcgcggc

SEQ ID NO: 7902 - RNA, 21 nt, Artificial Sequence
  ELANE RNA Guide
cacacauucgccacgaagugc

SEQ ID NO: 7903 - RNA, 21 nt, Artificial Sequence
  ELANE RNA Guide
cacauucgccacgaagugcgc

SEQ ID NO: 7904 - RNA, 21 nt, Artificial Sequence
  ELANE RNA Guide
cacgaagugcgcggccgacau

SEQ ID NO: 7905 - RNA, 21 nt, Artificial Sequence
  ELANE RNA Guide
cacuucguggcgaauguguga

SEQ ID NO: 7906 - RNA, 21 nt, Artificial Sequence
  ELANE RNA Guide
caugucggccgcgcacuucgu

SEQ ID NO: 7907 - RNA, 21 nt, Artificial Sequence
  ELANE RNA Guide
cauucgccacgaagugcgcgg

SEQ ID NO: 7908 - RNA, 21 nt, Artificial Sequence
  ELANE RNA Guide
ccacgaagugcgcggccgaca

SEQ ID NO: 7909 - RNA, 21 nt, Artificial Sequence
  ELANE RNA Guide
ccgcgcacuucguggcgaaug

SEQ ID NO: 7910 - RNA, 21 nt, Artificial Sequence
  ELANE RNA Guide
cgaagugcgcggccgacauga

SEQ ID NO: 7911 - RNA, 21 nt, Artificial Sequence
  ELANE RNA Guide
cgcacuucguggcgaaugugu

SEQ ID NO: 7912 - RNA, 21 nt, Artificial Sequence
  ELANE RNA Guide
cgccacgaagugcgcggccga

SEQ ID NO: 7913 - RNA, 21 nt, Artificial Sequence
  ELANE RNA Guide
cgcgcacuucguggcgaaugu

SEQ ID NO: 7914 - RNA, 21 nt, Artificial Sequence
  ELANE RNA Guide
cggccgcgcacuucguggcga

SEQ ID NO: 7915 - RNA, 21 nt, Artificial Sequence
  ELANE RNA Guide
cgucaugucggccgcgcacuu

SEQ ID NO: 7916 - RNA, 21 nt, Artificial Sequence
  ELANE RNA Guide
cuacucacacauucgccacga

SEQ ID NO: 7917 - RNA, 21 nt, Artificial Sequence
  ELANE RNA Guide
cucacacauucgccacgaagu

SEQ ID NO: 7918 - RNA, 21 nt, Artificial Sequence
  ELANE RNA Guide
cuucguggcgaaugugugagu

SEQ ID NO: 7919 - RNA, 21 nt, Artificial Sequence
  ELANE RNA Guide
gaagugcgcggccgacaugac

SEQ ID NO: 7920 - RNA, 21 nt, Artificial Sequence
  ELANE RNA Guide
gcacuucguggcgaaugugug

SEQ ID NO: 7921 - RNA, 21 nt, Artificial Sequence
  ELANE RNA Guide
gccacgaagugcgcggccgac

SEQ ID NO: 7922 - RNA, 21 nt, Artificial Sequence
  ELANE RNA Guide
gccgcgcacuucguggcgaau

SEQ ID NO: 7923 - RNA, 21 nt, Artificial Sequence
  ELANE RNA Guide
gcgcacuucguggcgaaugug

SEQ ID NO: 7924 - RNA, 21 nt, Artificial Sequence
  ELANE RNA Guide
ggccgcgcacuucguggcgaa

SEQ ID NO: 7925 - RNA, 21 nt, Artificial Sequence
  ELANE RNA Guide
gucaugucggccgcgcacuuc

SEQ ID NO: 7926 - RNA, 21 nt, Artificial Sequence
  ELANE RNA Guide
gucggccgcgcacuucguggc

SEQ ID NO: 7927 - RNA, 21 nt, Artificial Sequence
  ELANE RNA Guide
uacucacacauucgccacgaa

SEQ ID NO: 7928 - RNA, 21 nt, Artificial Sequence
  ELANE RNA Guide
ucacacauucgccacgaagug

SEQ ID NO: 7929 - RNA, 21 nt, Artificial Sequence
  ELANE RNA Guide
ucaugucggccgcgcacuucg

SEQ ID NO: 7930 - RNA, 21 nt, Artificial Sequence
  ELANE RNA Guide
ucgccacgaagugcgcggccg

SEQ ID NO: 7931 - RNA, 21 nt, Artificial Sequence
  ELANE RNA Guide
ucggccgcgcacuucguggcg

SEQ ID NO: 7932 - RNA, 21 nt, Artificial Sequence
  ELANE RNA Guide
ugucggccgcgcacuucgugg

SEQ ID NO: 7933 - RNA, 21 nt, Artificial Sequence
  ELANE RNA Guide
uucgccacgaagugcgcggcc

SEQ ID NO: 7934 - RNA, 21 nt, Artificial Sequence
  ELANE RNA Guide
uucguggcgaaugugugagua

SEQ ID NO: 7935 - RNA, 22 nt, Artificial Sequence
  ELANE RNA Guide
acacauucgccacgaagugcgc

SEQ ID NO: 7936 - RNA, 22 nt, Artificial Sequence
  ELANE RNA Guide
acauucgccacgaagugcgcgg

SEQ ID NO: 7937 - RNA, 22 nt, Artificial Sequence
  ELANE RNA Guide
acgaagugcgcggccgacauga

SEQ ID NO: 7938 - RNA, 22 nt, Artificial Sequence
  ELANE RNA Guide
acucacacauucgccacgaagu

SEQ ID NO: 7939 - RNA, 22 nt, Artificial Sequence
  ELANE RNA Guide
acuucguggcgaaugugugagu

SEQ ID NO: 7940 - RNA, 22 nt, Artificial Sequence
  ELANE RNA Guide
augucggccgcgcacuucgugg

SEQ ID NO: 7941 - RNA, 22 nt, Artificial Sequence
  ELANE RNA Guide
auucgccacgaagugcgcggcc

SEQ ID NO: 7942 - RNA, 22 nt, Artificial Sequence
  ELANE RNA Guide
cacacauucgccacgaagugcg

SEQ ID NO: 7943 - RNA, 22 nt, Artificial Sequence
  ELANE RNA Guide
cacauucgccacgaagugcgcg

SEQ ID NO: 7944 - RNA, 22 nt, Artificial Sequence
  ELANE RNA Guide
cacgaagugcgcggccgacaug

SEQ ID NO: 7945 - RNA, 22 nt, Artificial Sequence
  ELANE RNA Guide
cacuucguggcgaaugugugag

SEQ ID NO: 7946 - RNA, 22 nt, Artificial Sequence
  ELANE RNA Guide
caugucggccgcgcacuucgug

SEQ ID NO: 7947 - RNA, 22 nt, Artificial Sequence
  ELANE RNA Guide
cauucgccacgaagugcgcggc

SEQ ID NO: 7948 - RNA, 22 nt, Artificial Sequence
  ELANE RNA Guide
ccacgaagugcgcggccgacau

SEQ ID NO: 7949 - RNA, 22 nt, Artificial Sequence
  ELANE RNA Guide
ccgcgcacuucguggcgaaugu

SEQ ID NO: 7950 - RNA, 22 nt, Artificial Sequence
  ELANE RNA Guide
cgaagugcgcggccgacaugac

SEQ ID NO: 7951 - RNA, 22 nt, Artificial Sequence
  ELANE RNA Guide
cgcacuucguggcgaaugugug

SEQ ID NO: 7952 - RNA, 22 nt, Artificial Sequence
  ELANE RNA Guide
cgccacgaagugcgcggccgac

SEQ ID NO: 7953 - RNA, 22 nt, Artificial Sequence
  ELANE RNA Guide
cgcgcacuucguggcgaaugug

SEQ ID NO: 7954 - RNA, 22 nt, Artificial Sequence
  ELANE RNA Guide
cggccgcgcacuucguggcgaa

SEQ ID NO: 7955 - RNA, 22 nt, Artificial Sequence
  ELANE RNA Guide
cgucaugucggccgcgcacuuc

SEQ ID NO: 7956 - RNA, 22 nt, Artificial Sequence
  ELANE RNA Guide
cuacucacacauucgccacgaa

SEQ ID NO: 7957 - RNA, 22 nt, Artificial Sequence
  ELANE RNA Guide
cucacacauucgccacgaagug

SEQ ID NO: 7958 - RNA, 22 nt, Artificial Sequence
  ELANE RNA Guide
cuucguggcgaaugugugagua

SEQ ID NO: 7959 - RNA, 22 nt, Artificial Sequence
  ELANE RNA Guide
gaagugcgcggccgacaugacg

SEQ ID NO: 7960 - RNA, 22 nt, Artificial Sequence
  ELANE RNA Guide
gcacuucguggcgaauguguga

SEQ ID NO: 7961 - RNA, 22 nt, Artificial Sequence
  ELANE RNA Guide
gccacgaagugcgcggccgaca

SEQ ID NO: 7962 - RNA, 22 nt, Artificial Sequence
  ELANE RNA Guide
gccgcgcacuucguggcgaaug

SEQ ID NO: 7963 - RNA, 22 nt, Artificial Sequence
  ELANE RNA Guide
gcgcacuucguggcgaaugugu

SEQ ID NO: 7964 - RNA, 22 nt, Artificial Sequence
  ELANE RNA Guide
gcuacucacacauucgccacga

SEQ ID NO: 7965 - RNA, 22 nt, Artificial Sequence
  ELANE RNA Guide
ggccgcgcacuucguggcgaau

SEQ ID NO: 7966 - RNA, 22 nt, Artificial Sequence
  ELANE RNA Guide
gucaugucggccgcgcacuucg

SEQ ID NO: 7967 - RNA, 22 nt, Artificial Sequence
  ELANE RNA Guide
gucggccgcgcacuucguggcg

SEQ ID NO: 7968 - RNA, 22 nt, Artificial Sequence
  ELANE RNA Guide
uacucacacauucgccacgaag

SEQ ID NO: 7969 - RNA, 22 nt, Artificial Sequence
  ELANE RNA Guide
ucacacauucgccacgaagugc

SEQ ID NO: 7970 - RNA, 22 nt, Artificial Sequence
  ELANE RNA Guide
ucaugucggccgcgcacuucgu

SEQ ID NO: 7971 - RNA, 22 nt, Artificial Sequence
  ELANE RNA Guide
ucgccacgaagugcgcggccga

SEQ ID NO: 7972 - RNA, 22 nt, Artificial Sequence
  ELANE RNA Guide
ucggccgcgcacuucguggcga

SEQ ID NO: 7973 - RNA, 22 nt, Artificial Sequence
  ELANE RNA Guide
ucgucaugucggccgcgcacuu

SEQ ID NO: 7974 - RNA, 22 nt, Artificial Sequence
  ELANE RNA Guide
ugucggccgcgcacuucguggc

SEQ ID NO: 7975 - RNA, 22 nt, Artificial Sequence
  ELANE RNA Guide
uucgccacgaagugcgcggccg

SEQ ID NO: 7976 - RNA, 22 nt, Artificial Sequence
  ELANE RNA Guide
uucguggcgaaugugugaguag

SEQ ID NO: 7977 - RNA, 20 nt, Artificial Sequence
  ELANE RNA Guide
acacauucgccaugcagugc

SEQ ID NO: 7978 - RNA, 20 nt, Artificial Sequence
  ELANE RNA Guide
acauucgccaugcagugcgc

SEQ ID NO: 7979 - RNA, 20 nt, Artificial Sequence
  ELANE RNA Guide
acucacacauucgccaugca

SEQ ID NO: 7980 - RNA, 20 nt, Artificial Sequence
  ELANE RNA Guide
acugcauggcgaauguguga

SEQ ID NO: 7981 - RNA, 20 nt, Artificial Sequence
  ELANE RNA Guide
augcagugcgcggccgacau

SEQ ID NO: 7982 - RNA, 20 nt, Artificial Sequence
  ELANE RNA Guide
augucggccgcgcacugcau

SEQ ID NO: 7983 - RNA, 20 nt, Artificial Sequence
  ELANE RNA Guide
auucgccaugcagugcgcgg

SEQ ID NO: 7984 - RNA, 20 nt, Artificial Sequence
  ELANE RNA Guide
cacacauucgccaugcagug

SEQ ID NO: 7985 - RNA, 20 nt, Artificial Sequence
  ELANE RNA Guide
cacauucgccaugcagugcg

SEQ ID NO: 7986 - RNA, 20 nt, Artificial Sequence
  ELANE RNA Guide
cacugcauggcgaaugugug

SEQ ID NO: 7987 - RNA, 20 nt, Artificial Sequence
  ELANE RNA Guide
caugcagugcgcggccgaca

SEQ ID NO: 7988 - RNA, 20 nt, Artificial Sequence
  ELANE RNA Guide
cauggcgaaugugugaguag

SEQ ID NO: 7989 - RNA, 20 nt, Artificial Sequence
  ELANE RNA Guide
caugucggccgcgcacugca

SEQ ID NO: 7990 - RNA, 20 nt, Artificial Sequence
  ELANE RNA Guide
cauucgccaugcagugcgcg

SEQ ID NO: 7991 - RNA, 20 nt, Artificial Sequence
  ELANE RNA Guide
ccaugcagugcgcggccgac

SEQ ID NO: 7992 - RNA, 20 nt, Artificial Sequence
  ELANE RNA Guide
cccggcuacucacacauucg

SEQ ID NO: 7993 - RNA, 20 nt, Artificial Sequence
  ELANE RNA Guide
ccgcgcacugcauggcgaau

SEQ ID NO: 7994 - RNA, 20 nt, Artificial Sequence
  ELANE RNA Guide
ccggcuacucacacauucgc

SEQ ID NO: 7995 - RNA, 20 nt, Artificial Sequence
  ELANE RNA Guide
cgcacugcauggcgaaugug

SEQ ID NO: 7996 - RNA, 20 nt, Artificial Sequence
  ELANE RNA Guide
cgccaugcagugcgcggccg

SEQ ID NO: 7997 - RNA, 20 nt, Artificial Sequence
  ELANE RNA Guide
cgcgcacugcauggcgaaug

SEQ ID NO: 7998 - RNA, 20 nt, Artificial Sequence
  ELANE RNA Guide
cggccgcgcacugcauggcg

SEQ ID NO: 7999 - RNA, 20 nt, Artificial Sequence
  ELANE RNA Guide
cuacucacacauucgccaug

SEQ ID NO: 8000 - RNA, 20 nt, Artificial Sequence
  ELANE RNA Guide
cucacacauucgccaugcag

SEQ ID NO: 8001 - RNA, 20 nt, Artificial Sequence
  ELANE RNA Guide
cugcauggcgaaugugugag

SEQ ID NO: 8002 - RNA, 20 nt, Artificial Sequence
  ELANE RNA Guide
gcacugcauggcgaaugugu

SEQ ID NO: 8003 - RNA, 20 nt, Artificial Sequence
  ELANE RNA Guide
gcauggcgaaugugugagua

SEQ ID NO: 8004 - RNA, 20 nt, Artificial Sequence
  ELANE RNA Guide
gccaugcagugcgcggccga

SEQ ID NO: 8005 - RNA, 20 nt, Artificial Sequence
  ELANE RNA Guide
gccgcgcacugcauggcgaa

SEQ ID NO: 8006 - RNA, 20 nt, Artificial Sequence
  ELANE RNA Guide
gcgcacugcauggcgaaugu

SEQ ID NO: 8007 - RNA, 20 nt, Artificial Sequence
  ELANE RNA Guide
gcuacucacacauucgccau

SEQ ID NO: 8008 - RNA, 20 nt, Artificial Sequence
  ELANE RNA Guide
ggccgcgcacugcauggcga

SEQ ID NO: 8009 - RNA, 20 nt, Artificial Sequence
  ELANE RNA Guide
gucaugucggccgcgcacug

SEQ ID NO: 8010 - RNA, 20 nt, Artificial Sequence
  ELANE RNA Guide
gucggccgcgcacugcaugg

SEQ ID NO: 8011 - RNA, 20 nt, Artificial Sequence
  ELANE RNA Guide
uacucacacauucgccaugc

SEQ ID NO: 8012 - RNA, 20 nt, Artificial Sequence
  ELANE RNA Guide
ucacacauucgccaugcagu

SEQ ID NO: 8013 - RNA, 20 nt, Artificial Sequence
  ELANE RNA Guide
ucaugucggccgcgcacugc

SEQ ID NO: 8014 - RNA, 20 nt, Artificial Sequence
  ELANE RNA Guide
ucgccaugcagugcgcggcc

SEQ ID NO: 8015 - RNA, 20 nt, Artificial Sequence
  ELANE RNA Guide
ucggccgcgcacugcauggc

SEQ ID NO: 8016 - RNA, 20 nt, Artificial Sequence
  ELANE RNA Guide
ugcauggcgaaugugugagu

SEQ ID NO: 8017 - RNA, 20 nt, Artificial Sequence
  ELANE RNA Guide
ugucggccgcgcacugcaug

SEQ ID NO: 8018 - RNA, 20 nt, Artificial Sequence
  ELANE RNA Guide
uucgccaugcagugcgcggc

SEQ ID NO: 8019 - RNA, 21 nt, Artificial Sequence
  ELANE RNA Guide
acacauucgccaugcagugcg

SEQ ID NO: 8020 - RNA, 21 nt, Artificial Sequence
  ELANE RNA Guide
acauucgccaugcagugcgcg

SEQ ID NO: 8021 - RNA, 21 nt, Artificial Sequence
  ELANE RNA Guide
acucacacauucgccaugcag

SEQ ID NO: 8022 - RNA, 21 nt, Artificial Sequence
  ELANE RNA Guide
acugcauggcgaaugugugag

SEQ ID NO: 8023 - RNA, 21 nt, Artificial Sequence
  ELANE RNA Guide
augcagugcgcggccgacaug

SEQ ID NO: 8024 - RNA, 21 nt, Artificial Sequence
  ELANE RNA Guide
augucggccgcgcacugcaug

SEQ ID NO: 8025 - RNA, 21 nt, Artificial Sequence
  ELANE RNA Guide
auucgccaugcagugcgcggc

SEQ ID NO: 8026 - RNA, 21 nt, Artificial Sequence
  ELANE RNA Guide
cacacauucgccaugcagugc

SEQ ID NO: 8027 - RNA, 21 nt, Artificial Sequence
  ELANE RNA Guide
cacauucgccaugcagugcgc

SEQ ID NO: 8028 - RNA, 21 nt, Artificial Sequence
  ELANE RNA Guide
cacugcauggcgaauguguga

SEQ ID NO: 8029 - RNA, 21 nt, Artificial Sequence
  ELANE RNA Guide
caugcagugcgcggccgacau

SEQ ID NO: 8030 - RNA, 21 nt, Artificial Sequence
  ELANE RNA Guide
cauggcgaaugugugaguagc

SEQ ID NO: 8031 - RNA, 21 nt, Artificial Sequence
  ELANE RNA Guide
caugucggccgcgcacugcau

SEQ ID NO: 8032 - RNA, 21 nt, Artificial Sequence
  ELANE RNA Guide
cauucgccaugcagugcgcgg

SEQ ID NO: 8033 - RNA, 21 nt, Artificial Sequence
  ELANE RNA Guide
ccaugcagugcgcggccgaca

SEQ ID NO: 8034 - RNA, 21 nt, Artificial Sequence
  ELANE RNA Guide
cccggcuacucacacauucgc

SEQ ID NO: 8035 - RNA, 21 nt, Artificial Sequence
  ELANE RNA Guide
ccgcgcacugcauggcgaaug

SEQ ID NO: 8036 - RNA, 21 nt, Artificial Sequence
  ELANE RNA Guide
cgcacugcauggcgaaugugu

SEQ ID NO: 8037 - RNA, 21 nt, Artificial Sequence
  ELANE RNA Guide
cgccaugcagugcgcggccga

SEQ ID NO: 8038 - RNA, 21 nt, Artificial Sequence
  ELANE RNA Guide
cgcgcacugcauggcgaaugu

SEQ ID NO: 8039 - RNA, 21 nt, Artificial Sequence
  ELANE RNA Guide
cggccgcgcacugcauggcga

SEQ ID NO: 8040 - RNA, 21 nt, Artificial Sequence
  ELANE RNA Guide
cgucaugucggccgcgcacug

SEQ ID NO: 8041 - RNA, 21 nt, Artificial Sequence
  ELANE RNA Guide
cuacucacacauucgccaugc

SEQ ID NO: 8042 - RNA, 21 nt, Artificial Sequence
  ELANE RNA Guide
cucacacauucgccaugcagu

SEQ ID NO: 8043 - RNA, 21 nt, Artificial Sequence
  ELANE RNA Guide
cugcauggcgaaugugugagu

SEQ ID NO: 8044 - RNA, 21 nt, Artificial Sequence
  ELANE RNA Guide
gcacugcauggcgaaugugug

SEQ ID NO: 8045 - RNA, 21 nt, Artificial Sequence
  ELANE RNA Guide
gcauggcgaaugugugaguag

SEQ ID NO: 8046 - RNA, 21 nt, Artificial Sequence
  ELANE RNA Guide
gccaugcagugcgcggccgac

SEQ ID NO: 8047 - RNA, 21 nt, Artificial Sequence
  ELANE RNA Guide
gccgcgcacugcauggcgaau

SEQ ID NO: 8048 - RNA, 21 nt, Artificial Sequence
  ELANE RNA Guide
gcgcacugcauggcgaaugug

SEQ ID NO: 8049 - RNA, 21 nt, Artificial Sequence
  ELANE RNA Guide
gcuacucacacauucgccaug

SEQ ID NO: 8050 - RNA, 21 nt, Artificial Sequence
  ELANE RNA Guide
ggccgcgcacugcauggcgaa

SEQ ID NO: 8051 - RNA, 21 nt, Artificial Sequence
  ELANE RNA Guide
ggcuacucacacauucgccau

SEQ ID NO: 8052 - RNA, 21 nt, Artificial Sequence
  ELANE RNA Guide
gucaugucggccgcgcacugc

SEQ ID NO: 8053 - RNA, 21 nt, Artificial Sequence
  ELANE RNA Guide
gucggccgcgcacugcauggc

SEQ ID NO: 8054 - RNA, 21 nt, Artificial Sequence
  ELANE RNA Guide
uacucacacauucgccaugca

SEQ ID NO: 8055 - RNA, 21 nt, Artificial Sequence
  ELANE RNA Guide
ucacacauucgccaugcagug

SEQ ID NO: 8056 - RNA, 21 nt, Artificial Sequence
  ELANE RNA Guide
ucaugucggccgcgcacugca

SEQ ID NO: 8057 - RNA, 21 nt, Artificial Sequence
  ELANE RNA Guide
ucccggcuacucacacauucg

SEQ ID NO: 8058 - RNA, 21 nt, Artificial Sequence
  ELANE RNA Guide
ucgccaugcagugcgcggccg

SEQ ID NO: 8059 - RNA, 21 nt, Artificial Sequence
  ELANE RNA Guide
ucggccgcgcacugcauggcg

SEQ ID NO: 8060 - RNA, 21 nt, Artificial Sequence
  ELANE RNA Guide
ugcauggcgaaugugugagua

SEQ ID NO: 8061 - RNA, 21 nt, Artificial Sequence
  ELANE RNA Guide
ugucggccgcgcacugcaugg

SEQ ID NO: 8062 - RNA, 21 nt, Artificial Sequence
  ELANE RNA Guide
uucgccaugcagugcgcggcc

SEQ ID NO: 8063 - RNA, 22 nt, Artificial Sequence
  ELANE RNA Guide
acacauucgccaugcagugcgc

SEQ ID NO: 8064 - RNA, 22 nt, Artificial Sequence
  ELANE RNA Guide
acauucgccaugcagugcgcgg

SEQ ID NO: 8065 - RNA, 22 nt, Artificial Sequence
  ELANE RNA Guide
acucacacauucgccaugcagu

SEQ ID NO: 8066 - RNA, 22 nt, Artificial Sequence
  ELANE RNA Guide
acugcauggcgaaugugugagu

SEQ ID NO: 8067 - RNA, 22 nt, Artificial Sequence
  ELANE RNA Guide
augcagugcgcggccgacauga

SEQ ID NO: 8068 - RNA, 22 nt, Artificial Sequence
  ELANE RNA Guide
augucggccgcgcacugcaugg

SEQ ID NO: 8069 - RNA, 22 nt, Artificial Sequence
  ELANE RNA Guide
auucgccaugcagugcgcggcc

SEQ ID NO: 8070 - RNA, 22 nt, Artificial Sequence
  ELANE RNA Guide
cacacauucgccaugcagugcg

SEQ ID NO: 8071 - RNA, 22 nt, Artificial Sequence
  ELANE RNA Guide
cacauucgccaugcagugcgcg

SEQ ID NO: 8072 - RNA, 22 nt, Artificial Sequence
  ELANE RNA Guide
cacugcauggcgaaugugugag

SEQ ID NO: 8073 - RNA, 22 nt, Artificial Sequence
  ELANE RNA Guide
caugcagugcgcggccgacaug

SEQ ID NO: 8074 - RNA, 22 nt, Artificial Sequence
  ELANE RNA Guide
cauggcgaaugugugaguagcc

SEQ ID NO: 8075 - RNA, 22 nt, Artificial Sequence
  ELANE RNA Guide
caugucggccgcgcacugcaug

SEQ ID NO: 8076 - RNA, 22 nt, Artificial Sequence
  ELANE RNA Guide
cauucgccaugcagugcgcggc

SEQ ID NO: 8077 - RNA, 22 nt, Artificial Sequence
  ELANE RNA Guide
ccaugcagugcgcggccgacau

SEQ ID NO: 8078 - RNA, 22 nt, Artificial Sequence
  ELANE RNA Guide
ccgcgcacugcauggcgaaugu

SEQ ID NO: 8079 - RNA, 22 nt, Artificial Sequence
  ELANE RNA Guide
cgcacugcauggcgaaugugug

SEQ ID NO: 8080 - RNA, 22 nt, Artificial Sequence
  ELANE RNA Guide
cgccaugcagugcgcggccgac

SEQ ID NO: 8081 - RNA, 22 nt, Artificial Sequence
  ELANE RNA Guide
cgcgcacugcauggcgaaugug

SEQ ID NO: 8082 - RNA, 22 nt, Artificial Sequence
  ELANE RNA Guide
cggccgcgcacugcauggcgaa

SEQ ID NO: 8083 - RNA, 22 nt, Artificial Sequence
  ELANE RNA Guide
cggcuacucacacauucgccau

SEQ ID NO: 8084 - RNA, 22 nt, Artificial Sequence
  ELANE RNA Guide
cgucaugucggccgcgcacugc

SEQ ID NO: 8085 - RNA, 22 nt, Artificial Sequence
  ELANE RNA Guide
cuacucacacauucgccaugca

SEQ ID NO: 8086 - RNA, 22 nt, Artificial Sequence
  ELANE RNA Guide
cucacacauucgccaugcagug

SEQ ID NO: 8087 - RNA, 22 nt, Artificial Sequence
  ELANE RNA Guide
cucccggcuacucacacauucg

SEQ ID NO: 8088 - RNA, 22 nt, Artificial Sequence
  ELANE RNA Guide
cugcauggcgaaugugugagua

SEQ ID NO: 8089 - RNA, 22 nt, Artificial Sequence
  ELANE RNA Guide
gcacugcauggcgaauguguga

SEQ ID NO: 8090 - RNA, 22 nt, Artificial Sequence
  ELANE RNA Guide
gcauggcgaaugugugaguagc

SEQ ID NO: 8091 - RNA, 22 nt, Artificial Sequence
  ELANE RNA Guide
gccaugcagugcgcggccgaca

SEQ ID NO: 8092 - RNA, 22 nt, Artificial Sequence
  ELANE RNA Guide
gccgcgcacugcauggcgaaug

SEQ ID NO: 8093 - RNA, 22 nt, Artificial Sequence
  ELANE RNA Guide
gcgcacugcauggcgaaugugu

SEQ ID NO: 8094 - RNA, 22 nt, Artificial Sequence
  ELANE RNA Guide
gcuacucacacauucgccaugc

SEQ ID NO: 8095 - RNA, 22 nt, Artificial Sequence
  ELANE RNA Guide
ggccgcgcacugcauggcgaau

SEQ ID NO: 8096 - RNA, 22 nt, Artificial Sequence
  ELANE RNA Guide
ggcuacucacacauucgccaug

SEQ ID NO: 8097 - RNA, 22 nt, Artificial Sequence
  ELANE RNA Guide
gucaugucggccgcgcacugca

SEQ ID NO: 8098 - RNA, 22 nt, Artificial Sequence
  ELANE RNA Guide
gucggccgcgcacugcauggcg

SEQ ID NO: 8099 - RNA, 22 nt, Artificial Sequence
  ELANE RNA Guide
uacucacacauucgccaugcag

SEQ ID NO: 8100 - RNA, 22 nt, Artificial Sequence
  ELANE RNA Guide
ucacacauucgccaugcagugc

SEQ ID NO: 8101 - RNA, 22 nt, Artificial Sequence
  ELANE RNA Guide
ucaugucggccgcgcacugcau

SEQ ID NO: 8102 - RNA, 22 nt, Artificial Sequence
  ELANE RNA Guide
ucccggcuacucacacauucgc

SEQ ID NO: 8103 - RNA, 22 nt, Artificial Sequence
  ELANE RNA Guide
ucgccaugcagugcgcggccga

SEQ ID NO: 8104 - RNA, 22 nt, Artificial Sequence
  ELANE RNA Guide
ucggccgcgcacugcauggcga

SEQ ID NO: 8105 - RNA, 22 nt, Artificial Sequence
  ELANE RNA Guide
ucgucaugucggccgcgcacug

SEQ ID NO: 8106 - RNA, 22 nt, Artificial Sequence
  ELANE RNA Guide
ugcauggcgaaugugugaguag

SEQ ID NO: 8107 - RNA, 22 nt, Artificial Sequence
  ELANE RNA Guide
ugucggccgcgcacugcauggc

SEQ ID NO: 8108 - RNA, 22 nt, Artificial Sequence
  ELANE RNA Guide
uucgccaugcagugcgcggccg

SEQ ID NO: 8109 - RNA, 20 nt, Artificial Sequence
  ELANE RNA Guide
acacauucgccucgcagugc

SEQ ID NO: 8110 - RNA, 20 nt, Artificial Sequence
  ELANE RNA Guide
acauucgccucgcagugcgc

SEQ ID NO: 8111 - RNA, 20 nt, Artificial Sequence
  ELANE RNA Guide
acucacacauucgccucgca

SEQ ID NO: 8112 - RNA, 20 nt, Artificial Sequence
  ELANE RNA Guide
acugcgaggcgaauguguga

SEQ ID NO: 8113 - RNA, 20 nt, Artificial Sequence
  ELANE RNA Guide
augucggccgcgcacugcga

SEQ ID NO: 8114 - RNA, 20 nt, Artificial Sequence
  ELANE RNA Guide
auucgccucgcagugcgcgg

SEQ ID NO: 8115 - RNA, 20 nt, Artificial Sequence
  ELANE RNA Guide
cacacauucgccucgcagug

SEQ ID NO: 8116 - RNA, 20 nt, Artificial Sequence
  ELANE RNA Guide
cacauucgccucgcagugcg

SEQ ID NO: 8117 - RNA, 20 nt, Artificial Sequence
  ELANE RNA Guide
cacugcgaggcgaaugugug

SEQ ID NO: 8118 - RNA, 20 nt, Artificial Sequence
  ELANE RNA Guide
caugucggccgcgcacugcg

SEQ ID NO: 8119 - RNA, 20 nt, Artificial Sequence
  ELANE RNA Guide
cauucgccucgcagugcgcg

SEQ ID NO: 8120 - RNA, 20 nt, Artificial Sequence
  ELANE RNA Guide
ccgcgcacugcgaggcgaau

SEQ ID NO: 8121 - RNA, 20 nt, Artificial Sequence
  ELANE RNA Guide
ccucgcagugcgcggccgac

SEQ ID NO: 8122 - RNA, 20 nt, Artificial Sequence
  ELANE RNA Guide
cgaggcgaaugugugaguag

SEQ ID NO: 8123 - RNA, 20 nt, Artificial Sequence
  ELANE RNA Guide
cgcacugcgaggcgaaugug

SEQ ID NO: 8124 - RNA, 20 nt, Artificial Sequence
  ELANE RNA Guide
cgcgcacugcgaggcgaaug

SEQ ID NO: 8125 - RNA, 20 nt, Artificial Sequence
  ELANE RNA Guide
cuacucacacauucgccucg

SEQ ID NO: 8126 - RNA, 20 nt, Artificial Sequence
  ELANE RNA Guide
cucacacauucgccucgcag

SEQ ID NO: 8127 - RNA, 20 nt, Artificial Sequence
  ELANE RNA Guide
cucgcagugcgcggccgaca

SEQ ID NO: 8128 - RNA, 20 nt, Artificial Sequence
  ELANE RNA Guide
cugcgaggcgaaugugugag

SEQ ID NO: 8129 - RNA, 20 nt, Artificial Sequence
  ELANE RNA Guide
gaggcgaaugugugaguagc

SEQ ID NO: 8130 - RNA, 20 nt, Artificial Sequence
  ELANE RNA Guide
gcacugcgaggcgaaugugu

SEQ ID NO: 8131 - RNA, 20 nt, Artificial Sequence
  ELANE RNA Guide
gccgcgcacugcgaggcgaa

SEQ ID NO: 8132 - RNA, 20 nt, Artificial Sequence
  ELANE RNA Guide
gccucgcagugcgcggccga

SEQ ID NO: 8133 - RNA, 20 nt, Artificial Sequence
  ELANE RNA Guide
gcgaggcgaaugugugagua

SEQ ID NO: 8134 - RNA, 20 nt, Artificial Sequence
  ELANE RNA Guide
gcgcacugcgaggcgaaugu

SEQ ID NO: 8135 - RNA, 20 nt, Artificial Sequence
  ELANE RNA Guide
gcuacucacacauucgccuc

SEQ ID NO: 8136 - RNA, 20 nt, Artificial Sequence
  ELANE RNA Guide
ggccgcgcacugcgaggcga

SEQ ID NO: 8137 - RNA, 20 nt, Artificial Sequence
  ELANE RNA Guide
ggcuacucacacauucgccu

SEQ ID NO: 8138 - RNA, 20 nt, Artificial Sequence
  ELANE RNA Guide
gucggccgcgcacugcgagg

SEQ ID NO: 8139 - RNA, 20 nt, Artificial Sequence
  ELANE RNA Guide
uacucacacauucgccucgc

SEQ ID NO: 8140 - RNA, 20 nt, Artificial Sequence
  ELANE RNA Guide
ucacacauucgccucgcagu

SEQ ID NO: 8141 - RNA, 20 nt, Artificial Sequence
  ELANE RNA Guide
ucccggcuacucacacauuc

SEQ ID NO: 8142 - RNA, 20 nt, Artificial Sequence
  ELANE RNA Guide
ucgccucgcagugcgcggcc

SEQ ID NO: 8143 - RNA, 20 nt, Artificial Sequence
  ELANE RNA Guide
ucggccgcgcacugcgaggc

SEQ ID NO: 8144 - RNA, 20 nt, Artificial Sequence
  ELANE RNA Guide
ugcgaggcgaaugugugagu

SEQ ID NO: 8145 - RNA, 20 nt, Artificial Sequence
  ELANE RNA Guide
ugucggccgcgcacugcgag

SEQ ID NO: 8146 - RNA, 20 nt, Artificial Sequence
  ELANE RNA Guide
uucgccucgcagugcgcggc

SEQ ID NO: 8147 - RNA, 21 nt, Artificial Sequence
  ELANE RNA Guide
acacauucgccucgcagugcg

SEQ ID NO: 8148 - RNA, 21 nt, Artificial Sequence
  ELANE RNA Guide
acauucgccucgcagugcgcg

SEQ ID NO: 8149 - RNA, 21 nt, Artificial Sequence
  ELANE RNA Guide
acucacacauucgccucgcag

SEQ ID NO: 8150 - RNA, 21 nt, Artificial Sequence
  ELANE RNA Guide
acugcgaggcgaaugugugag

SEQ ID NO: 8151 - RNA, 21 nt, Artificial Sequence
  ELANE RNA Guide
augucggccgcgcacugcgag

SEQ ID NO: 8152 - RNA, 21 nt, Artificial Sequence
  ELANE RNA Guide
auucgccucgcagugcgcggc

SEQ ID NO: 8153 - RNA, 21 nt, Artificial Sequence
  ELANE RNA Guide
cacacauucgccucgcagugc

SEQ ID NO: 8154 - RNA, 21 nt, Artificial Sequence
  ELANE RNA Guide
cacauucgccucgcagugcgc

SEQ ID NO: 8155 - RNA, 21 nt, Artificial Sequence
  ELANE RNA Guide
cacugcgaggcgaauguguga

SEQ ID NO: 8156 - RNA, 21 nt, Artificial Sequence
  ELANE RNA Guide
caugucggccgcgcacugcga

SEQ ID NO: 8157 - RNA, 21 nt, Artificial Sequence
  ELANE RNA Guide
cauucgccucgcagugcgcgg

SEQ ID NO: 8158 - RNA, 21 nt, Artificial Sequence
  ELANE RNA Guide
ccgcgcacugcgaggcgaaug

SEQ ID NO: 8159 - RNA, 21 nt, Artificial Sequence
  ELANE RNA Guide
ccucgcagugcgcggccgaca

SEQ ID NO: 8160 - RNA, 21 nt, Artificial Sequence
  ELANE RNA Guide
cgaggcgaaugugugaguagc

SEQ ID NO: 8161 - RNA, 21 nt, Artificial Sequence
  ELANE RNA Guide
cgcacugcgaggcgaaugugu

SEQ ID NO: 8162 - RNA, 21 nt, Artificial Sequence
  ELANE RNA Guide
cgcgcacugcgaggcgaaugu

SEQ ID NO: 8163 - RNA, 21 nt, Artificial Sequence
  ELANE RNA Guide
cggcuacucacacauucgccu

SEQ ID NO: 8164 - RNA, 21 nt, Artificial Sequence
  ELANE RNA Guide
cuacucacacauucgccucgc

SEQ ID NO: 8165 - RNA, 21 nt, Artificial Sequence
  ELANE RNA Guide
cucacacauucgccucgcagu

SEQ ID NO: 8166 - RNA, 21 nt, Artificial Sequence
  ELANE RNA Guide
cucccggcuacucacacauuc

SEQ ID NO: 8167 - RNA, 21 nt, Artificial Sequence
  ELANE RNA Guide
cucgcagugcgcggccgacau

SEQ ID NO: 8168 - RNA, 21 nt, Artificial Sequence
  ELANE RNA Guide
cugcgaggcgaaugugugagu

SEQ ID NO: 8169 - RNA, 21 nt, Artificial Sequence
  ELANE RNA Guide
gaggcgaaugugugaguagcc

SEQ ID NO: 8170 - RNA, 21 nt, Artificial Sequence
  ELANE RNA Guide
gcacugcgaggcgaaugugug

SEQ ID NO: 8171 - RNA, 21 nt, Artificial Sequence
  ELANE RNA Guide
gccgcgcacugcgaggcgaau

SEQ ID NO: 8172 - RNA, 21 nt, Artificial Sequence
  ELANE RNA Guide
gcgaggcgaaugugugaguag

SEQ ID NO: 8173 - RNA, 21 nt, Artificial Sequence
  ELANE RNA Guide
gcgcacugcgaggcgaaugug

SEQ ID NO: 8174 - RNA, 21 nt, Artificial Sequence
  ELANE RNA Guide
gcuacucacacauucgccucg

SEQ ID NO: 8175 - RNA, 21 nt, Artificial Sequence
  ELANE RNA Guide
ggccgcgcacugcgaggcgaa

SEQ ID NO: 8176 - RNA, 21 nt, Artificial Sequence
  ELANE RNA Guide
ggcuacucacacauucgccuc

SEQ ID NO: 8177 - RNA, 21 nt, Artificial Sequence
  ELANE RNA Guide
uacucacacauucgccucgca

SEQ ID NO: 8178 - RNA, 21 nt, Artificial Sequence
  ELANE RNA Guide
ucacacauucgccucgcagug

SEQ ID NO: 8179 - RNA, 21 nt, Artificial Sequence
  ELANE RNA Guide
ucaugucggccgcgcacugcg

SEQ ID NO: 8180 - RNA, 21 nt, Artificial Sequence
  ELANE RNA Guide
ugcgaggcgaaugugugagua

SEQ ID NO: 8181 - RNA, 21 nt, Artificial Sequence
  ELANE RNA Guide
ugucggccgcgcacugcgagg

SEQ ID NO: 8182 - RNA, 21 nt, Artificial Sequence
  ELANE RNA Guide
uucgccucgcagugcgcggcc

SEQ ID NO: 8183 - RNA, 22 nt, Artificial Sequence
  ELANE RNA Guide
acacauucgccucgcagugcgc

SEQ ID NO: 8184 - RNA, 22 nt, Artificial Sequence
  ELANE RNA Guide
acauucgccucgcagugcgcgg

SEQ ID NO: 8185 - RNA, 22 nt, Artificial Sequence
  ELANE RNA Guide
acucacacauucgccucgcagu

SEQ ID NO: 8186 - RNA, 22 nt, Artificial Sequence
  ELANE RNA Guide
acucccggcuacucacacauuc

SEQ ID NO: 8187 - RNA, 22 nt, Artificial Sequence
  ELANE RNA Guide
acugcgaggcgaaugugugagu

SEQ ID NO: 8188 - RNA, 22 nt, Artificial Sequence
  ELANE RNA Guide
augucggccgcgcacugcgagg

SEQ ID NO: 8189 - RNA, 22 nt, Artificial Sequence
  ELANE RNA Guide
auucgccucgcagugcgcggcc

SEQ ID NO: 8190 - RNA, 22 nt, Artificial Sequence
  ELANE RNA Guide
cacacauucgccucgcagugcg

SEQ ID NO: 8191 - RNA, 22 nt, Artificial Sequence
  ELANE RNA Guide
cacauucgccucgcagugcgcg

SEQ ID NO: 8192 - RNA, 22 nt, Artificial Sequence
  ELANE RNA Guide
cacugcgaggcgaaugugugag

SEQ ID NO: 8193 - RNA, 22 nt, Artificial Sequence
  ELANE RNA Guide
caugucggccgcgcacugcgag

SEQ ID NO: 8194 - RNA, 22 nt, Artificial Sequence
  ELANE RNA Guide
cauucgccucgcagugcgcggc

SEQ ID NO: 8195 - RNA, 22 nt, Artificial Sequence
  ELANE RNA Guide
ccgcgcacugcgaggcgaaugu

SEQ ID NO: 8196 - RNA, 22 nt, Artificial Sequence
  ELANE RNA Guide
ccggcuacucacacauucgccu

SEQ ID NO: 8197 - RNA, 22 nt, Artificial Sequence
  ELANE RNA Guide
ccucgcagugcgcggccgacau

SEQ ID NO: 8198 - RNA, 22 nt, Artificial Sequence
  ELANE RNA Guide
cgaggcgaaugugugaguagcc

SEQ ID NO: 8199 - RNA, 22 nt, Artificial Sequence
  ELANE RNA Guide
cgcacugcgaggcgaaugugug

SEQ ID NO: 8200 - RNA, 22 nt, Artificial Sequence
  ELANE RNA Guide
cgcgcacugcgaggcgaaugug

SEQ ID NO: 8201 - RNA, 22 nt, Artificial Sequence
  ELANE RNA Guide
cggccgcgcacugcgaggcgaa

SEQ ID NO: 8202 - RNA, 22 nt, Artificial Sequence
  ELANE RNA Guide
cggcuacucacacauucgccuc

SEQ ID NO: 8203 - RNA, 22 nt, Artificial Sequence
  ELANE RNA Guide
cuacucacacauucgccucgca

SEQ ID NO: 8204 - RNA, 22 nt, Artificial Sequence
  ELANE RNA Guide
cucacacauucgccucgcagug

SEQ ID NO: 8205 - RNA, 22 nt, Artificial Sequence
  ELANE RNA Guide
cucgcagugcgcggccgacaug

SEQ ID NO: 8206 - RNA, 22 nt, Artificial Sequence
  ELANE RNA Guide
cugcgaggcgaaugugugagua

SEQ ID NO: 8207 - RNA, 22 nt, Artificial Sequence
  ELANE RNA Guide
gaggcgaaugugugaguagccg

SEQ ID NO: 8208 - RNA, 22 nt, Artificial Sequence
  ELANE RNA Guide
gcacugcgaggcgaauguguga

SEQ ID NO: 8209 - RNA, 22 nt, Artificial Sequence
  ELANE RNA Guide
gccgcgcacugcgaggcgaaug

SEQ ID NO: 8210 - RNA, 22 nt, Artificial Sequence
  ELANE RNA Guide
gccucgcagugcgcggccgaca

SEQ ID NO: 8211 - RNA, 22 nt, Artificial Sequence
  ELANE RNA Guide
gcgaggcgaaugugugaguagc

SEQ ID NO: 8212 - RNA, 22 nt, Artificial Sequence
  ELANE RNA Guide
gcgcacugcgaggcgaaugugu

SEQ ID NO: 8213 - RNA, 22 nt, Artificial Sequence
  ELANE RNA Guide
gcuacucacacauucgccucgc

SEQ ID NO: 8214 - RNA, 22 nt, Artificial Sequence
  ELANE RNA Guide
ggccgcgcacugcgaggcgaau

SEQ ID NO: 8215 - RNA, 22 nt, Artificial Sequence
  ELANE RNA Guide
ggcuacucacacauucgccucg

SEQ ID NO: 8216 - RNA, 22 nt, Artificial Sequence
  ELANE RNA Guide
gucaugucggccgcgcacugcg

SEQ ID NO: 8217 - RNA, 22 nt, Artificial Sequence
  ELANE RNA Guide
uacucacacauucgccucgcag

SEQ ID NO: 8218 - RNA, 22 nt, Artificial Sequence
  ELANE RNA Guide
ucacacauucgccucgcagugc

SEQ ID NO: 8219 - RNA, 22 nt, Artificial Sequence
  ELANE RNA Guide
ucaugucggccgcgcacugcga

SEQ ID NO: 8220 - RNA, 22 nt, Artificial Sequence
  ELANE RNA Guide
ucgccucgcagugcgcggccga

SEQ ID NO: 8221 - RNA, 22 nt, Artificial Sequence
  ELANE RNA Guide
ucggccgcgcacugcgaggcga

SEQ ID NO: 8222 - RNA, 22 nt, Artificial Sequence
  ELANE RNA Guide
ugcgaggcgaaugugugaguag

SEQ ID NO: 8223 - RNA, 22 nt, Artificial Sequence
  ELANE RNA Guide
ugucggccgcgcacugcgaggc

SEQ ID NO: 8224 - RNA, 22 nt, Artificial Sequence
  ELANE RNA Guide
uucgccucgcagugcgcggccg

SEQ ID NO: 8225 - RNA, 20 nt, Artificial Sequence
  ELANE RNA Guide
acacauucgccccgcagugc

SEQ ID NO: 8226 - RNA, 20 nt, Artificial Sequence
  ELANE RNA Guide
acauucgccccgcagugcgc

SEQ ID NO: 8227 - RNA, 20 nt, Artificial Sequence
  ELANE RNA Guide
acucacacauucgccccgca

SEQ ID NO: 8228 - RNA, 20 nt, Artificial Sequence
  ELANE RNA Guide
acugcggggcgaauguguga

SEQ ID NO: 8229 - RNA, 20 nt, Artificial Sequence
  ELANE RNA Guide
augucggccgcgcacugcgg

SEQ ID NO: 8230 - RNA, 20 nt, Artificial Sequence
  ELANE RNA Guide
auucgccccgcagugcgcgg

SEQ ID NO: 8231 - RNA, 20 nt, Artificial Sequence
  ELANE RNA Guide
cacacauucgccccgcagug

SEQ ID NO: 8232 - RNA, 20 nt, Artificial Sequence
  ELANE RNA Guide
cacauucgccccgcagugcg

SEQ ID NO: 8233 - RNA, 20 nt, Artificial Sequence
  ELANE RNA Guide
cacugcggggcgaaugugug

SEQ ID NO: 8234 - RNA, 20 nt, Artificial Sequence
  ELANE RNA Guide
cauucgccccgcagugcgcg

SEQ ID NO: 8235 - RNA, 20 nt, Artificial Sequence
  ELANE RNA Guide
cccgcagugcgcggccgaca

SEQ ID NO: 8236 - RNA, 20 nt, Artificial Sequence
  ELANE RNA Guide
ccgcgcacugcggggcgaau

SEQ ID NO: 8237 - RNA, 20 nt, Artificial Sequence
  ELANE RNA Guide
cgcacugcggggcgaaugug

SEQ ID NO: 8238 - RNA, 20 nt, Artificial Sequence
  ELANE RNA Guide
cgcgcacugcggggcgaaug

SEQ ID NO: 8239 - RNA, 20 nt, Artificial Sequence
  ELANE RNA Guide
cggggcgaaugugugaguag

SEQ ID NO: 8240 - RNA, 20 nt, Artificial Sequence
  ELANE RNA Guide
cuacucacacauucgccccg

SEQ ID NO: 8241 - RNA, 20 nt, Artificial Sequence
  ELANE RNA Guide
cucacacauucgccccgcag

SEQ ID NO: 8242 - RNA, 20 nt, Artificial Sequence
  ELANE RNA Guide
cugcggggcgaaugugugag

SEQ ID NO: 8243 - RNA, 20 nt, Artificial Sequence
  ELANE RNA Guide
gcacugcggggcgaaugugu

SEQ ID NO: 8244 - RNA, 20 nt, Artificial Sequence
  ELANE RNA Guide
gccgcgcacugcggggcgaa

SEQ ID NO: 8245 - RNA, 20 nt, Artificial Sequence
  ELANE RNA Guide
gcgcacugcggggcgaaugu

SEQ ID NO: 8246 - RNA, 20 nt, Artificial Sequence
  ELANE RNA Guide
gcggggcgaaugugugagua

SEQ ID NO: 8247 - RNA, 20 nt, Artificial Sequence
  ELANE RNA Guide
gcuacucacacauucgcccc

SEQ ID NO: 8248 - RNA, 20 nt, Artificial Sequence
  ELANE RNA Guide
ggcuacucacacauucgccc

SEQ ID NO: 8249 - RNA, 20 nt, Artificial Sequence
  ELANE RNA Guide
ggggcgaaugugugaguagc

SEQ ID NO: 8250 - RNA, 20 nt, Artificial Sequence
  ELANE RNA Guide
uacucacacauucgccccgc

SEQ ID NO: 8251 - RNA, 20 nt, Artificial Sequence
  ELANE RNA Guide
ucacacauucgccccgcagu

SEQ ID NO: 8252 - RNA, 20 nt, Artificial Sequence
  ELANE RNA Guide
ugcggggcgaaugugugagu

SEQ ID NO: 8253 - RNA, 20 nt, Artificial Sequence
  ELANE RNA Guide
ugucggccgcgcacugcggg

SEQ ID NO: 8254 - RNA, 20 nt, Artificial Sequence
  ELANE RNA Guide
uucgccccgcagugcgcggc

SEQ ID NO: 8255 - RNA, 21 nt, Artificial Sequence
  ELANE RNA Guide
acacauucgccccgcagugcg

SEQ ID NO: 8256 - RNA, 21 nt, Artificial Sequence
  ELANE RNA Guide
acauucgccccgcagugcgcg

SEQ ID NO: 8257 - RNA, 21 nt, Artificial Sequence
  ELANE RNA Guide
acucacacauucgccccgcag

SEQ ID NO: 8258 - RNA, 21 nt, Artificial Sequence
  ELANE RNA Guide
acugcggggcgaaugugugag

SEQ ID NO: 8259 - RNA, 21 nt, Artificial Sequence
  ELANE RNA Guide
augucggccgcgcacugcggg

SEQ ID NO: 8260 - RNA, 21 nt, Artificial Sequence
  ELANE RNA Guide
auucgccccgcagugcgcggc

SEQ ID NO: 8261 - RNA, 21 nt, Artificial Sequence
  ELANE RNA Guide
cacacauucgccccgcagugc

SEQ ID NO: 8262 - RNA, 21 nt, Artificial Sequence
  ELANE RNA Guide
cacauucgccccgcagugcgc

SEQ ID NO: 8263 - RNA, 21 nt, Artificial Sequence
  ELANE RNA Guide
cacugcggggcgaauguguga

SEQ ID NO: 8264 - RNA, 21 nt, Artificial Sequence
  ELANE RNA Guide
caugucggccgcgcacugcgg

SEQ ID NO: 8265 - RNA, 21 nt, Artificial Sequence
  ELANE RNA Guide
cauucgccccgcagugcgcgg

SEQ ID NO: 8266 - RNA, 21 nt, Artificial Sequence
  ELANE RNA Guide
cccgcagugcgcggccgacau

SEQ ID NO: 8267 - RNA, 21 nt, Artificial Sequence
  ELANE RNA Guide
ccgcgcacugcggggcgaaug

SEQ ID NO: 8268 - RNA, 21 nt, Artificial Sequence
  ELANE RNA Guide
cgcacugcggggcgaaugugu

SEQ ID NO: 8269 - RNA, 21 nt, Artificial Sequence
  ELANE RNA Guide
cgcgcacugcggggcgaaugu

SEQ ID NO: 8270 - RNA, 21 nt, Artificial Sequence
  ELANE RNA Guide
cggcuacucacacauucgccc

SEQ ID NO: 8271 - RNA, 21 nt, Artificial Sequence
  ELANE RNA Guide
cggggcgaaugugugaguagc

SEQ ID NO: 8272 - RNA, 21 nt, Artificial Sequence
  ELANE RNA Guide
cuacucacacauucgccccgc

SEQ ID NO: 8273 - RNA, 21 nt, Artificial Sequence
  ELANE RNA Guide
cucacacauucgccccgcagu

SEQ ID NO: 8274 - RNA, 21 nt, Artificial Sequence
  ELANE RNA Guide
cugcggggcgaaugugugagu

SEQ ID NO: 8275 - RNA, 21 nt, Artificial Sequence
  ELANE RNA Guide
gcacugcggggcgaaugugug

SEQ ID NO: 8276 - RNA, 21 nt, Artificial Sequence
  ELANE RNA Guide
gccgcgcacugcggggcgaau

SEQ ID NO: 8277 - RNA, 21 nt, Artificial Sequence
  ELANE RNA Guide
gcgcacugcggggcgaaugug

SEQ ID NO: 8278 - RNA, 21 nt, Artificial Sequence
  ELANE RNA Guide
gcggggcgaaugugugaguag

SEQ ID NO: 8279 - RNA, 21 nt, Artificial Sequence
  ELANE RNA Guide
gcuacucacacauucgccccg

SEQ ID NO: 8280 - RNA, 21 nt, Artificial Sequence
  ELANE RNA Guide
ggcuacucacacauucgcccc

SEQ ID NO: 8281 - RNA, 21 nt, Artificial Sequence
  ELANE RNA Guide
ggggcgaaugugugaguagcc

SEQ ID NO: 8282 - RNA, 21 nt, Artificial Sequence
  ELANE RNA Guide
uacucacacauucgccccgca

SEQ ID NO: 8283 - RNA, 21 nt, Artificial Sequence
  ELANE RNA Guide
ucacacauucgccccgcagug

SEQ ID NO: 8284 - RNA, 21 nt, Artificial Sequence
  ELANE RNA Guide
ugcggggcgaaugugugagua

SEQ ID NO: 8285 - RNA, 22 nt, Artificial Sequence
  ELANE RNA Guide
acacauucgccccgcagugcgc

SEQ ID NO: 8286 - RNA, 22 nt, Artificial Sequence
  ELANE RNA Guide
acauucgccccgcagugcgcgg

SEQ ID NO: 8287 - RNA, 22 nt, Artificial Sequence
  ELANE RNA Guide
acucacacauucgccccgcagu

SEQ ID NO: 8288 - RNA, 22 nt, Artificial Sequence
  ELANE RNA Guide
acugcggggcgaaugugugagu

SEQ ID NO: 8289 - RNA, 22 nt, Artificial Sequence
  ELANE RNA Guide
augucggccgcgcacugcgggg

SEQ ID NO: 8290 - RNA, 22 nt, Artificial Sequence
  ELANE RNA Guide
auucgccccgcagugcgcggcc

SEQ ID NO: 8291 - RNA, 22 nt, Artificial Sequence
  ELANE RNA Guide
cacacauucgccccgcagugcg

SEQ ID NO: 8292 - RNA, 22 nt, Artificial Sequence
  ELANE RNA Guide
cacauucgccccgcagugcgcg

SEQ ID NO: 8293 - RNA, 22 nt, Artificial Sequence
  ELANE RNA Guide
cacugcggggcgaaugugugag

SEQ ID NO: 8294 - RNA, 22 nt, Artificial Sequence
  ELANE RNA Guide
caugucggccgcgcacugcggg

SEQ ID NO: 8295 - RNA, 22 nt, Artificial Sequence
  ELANE RNA Guide
cauucgccccgcagugcgcggc

SEQ ID NO: 8296 - RNA, 22 nt, Artificial Sequence
  ELANE RNA Guide
ccccgcagugcgcggccgacau

SEQ ID NO: 8297 - RNA, 22 nt, Artificial Sequence
  ELANE RNA Guide
cccgcagugcgcggccgacaug

SEQ ID NO: 8298 - RNA, 22 nt, Artificial Sequence
  ELANE RNA Guide
ccgcgcacugcggggcgaaugu

SEQ ID NO: 8299 - RNA, 22 nt, Artificial Sequence
  ELANE RNA Guide
ccggcuacucacacauucgccc

SEQ ID NO: 8300 - RNA, 22 nt, Artificial Sequence
  ELANE RNA Guide
cgcacugcggggcgaaugugug

SEQ ID NO: 8301 - RNA, 22 nt, Artificial Sequence
  ELANE RNA Guide
cgcgcacugcggggcgaaugug

SEQ ID NO: 8302 - RNA, 22 nt, Artificial Sequence
  ELANE RNA Guide
cggcuacucacacauucgcccc

SEQ ID NO: 8303 - RNA, 22 nt, Artificial Sequence
  ELANE RNA Guide
cggggcgaaugugugaguagcc

SEQ ID NO: 8304 - RNA, 22 nt, Artificial Sequence
  ELANE RNA Guide
cuacucacacauucgccccgca

SEQ ID NO: 8305 - RNA, 22 nt, Artificial Sequence
  ELANE RNA Guide
cucacacauucgccccgcagug

SEQ ID NO: 8306 - RNA, 22 nt, Artificial Sequence
  ELANE RNA Guide
cugcggggcgaaugugugagua

SEQ ID NO: 8307 - RNA, 22 nt, Artificial Sequence
  ELANE RNA Guide
gcacugcggggcgaauguguga

SEQ ID NO: 8308 - RNA, 22 nt, Artificial Sequence
  ELANE RNA Guide
gccgcgcacugcggggcgaaug

SEQ ID NO: 8309 - RNA, 22 nt, Artificial Sequence
  ELANE RNA Guide
gcgcacugcggggcgaaugugu

SEQ ID NO: 8310 - RNA, 22 nt, Artificial Sequence
  ELANE RNA Guide
gcggggcgaaugugugaguagc

SEQ ID NO: 8311 - RNA, 22 nt, Artificial Sequence
  ELANE RNA Guide
gcuacucacacauucgccccgc

SEQ ID NO: 8312 - RNA, 22 nt, Artificial Sequence
  ELANE RNA Guide
ggccgcgcacugcggggcgaau

SEQ ID NO: 8313 - RNA, 22 nt, Artificial Sequence
  ELANE RNA Guide
ggcuacucacacauucgccccg

SEQ ID NO: 8314 - RNA, 22 nt, Artificial Sequence
  ELANE RNA Guide
ggggcgaaugugugaguagccg

SEQ ID NO: 8315 - RNA, 22 nt, Artificial Sequence
  ELANE RNA Guide
uacucacacauucgccccgcag

SEQ ID NO: 8316 - RNA, 22 nt, Artificial Sequence
  ELANE RNA Guide
ucacacauucgccccgcagugc

SEQ ID NO: 8317 - RNA, 22 nt, Artificial Sequence
  ELANE RNA Guide
ucaugucggccgcgcacugcgg

SEQ ID NO: 8318 - RNA, 22 nt, Artificial Sequence
  ELANE RNA Guide
ugcggggcgaaugugugaguag

SEQ ID NO: 8319 - RNA, 20 nt, Artificial Sequence
  ELANE RNA Guide
acacauucgucacgcagugc

SEQ ID NO: 8320 - RNA, 20 nt, Artificial Sequence
  ELANE RNA Guide
acauucgucacgcagugcgc

SEQ ID NO: 8321 - RNA, 20 nt, Artificial Sequence
  ELANE RNA Guide
acucacacauucgucacgca

SEQ ID NO: 8322 - RNA, 20 nt, Artificial Sequence
  ELANE RNA Guide
acucccggcuacucacacau

SEQ ID NO: 8323 - RNA, 20 nt, Artificial Sequence
  ELANE RNA Guide
acugcgugacgaauguguga

SEQ ID NO: 8324 - RNA, 20 nt, Artificial Sequence
  ELANE RNA Guide
augucggccgcgcacugcgu

SEQ ID NO: 8325 - RNA, 20 nt, Artificial Sequence
  ELANE RNA Guide
auucgucacgcagugcgcgg

SEQ ID NO: 8326 - RNA, 20 nt, Artificial Sequence
  ELANE RNA Guide
cacacauucgucacgcagug

SEQ ID NO: 8327 - RNA, 20 nt, Artificial Sequence
  ELANE RNA Guide
cacauucgucacgcagugcg

SEQ ID NO: 8328 - RNA, 20 nt, Artificial Sequence
  ELANE RNA Guide
cacugcgugacgaaugugug

SEQ ID NO: 8329 - RNA, 20 nt, Artificial Sequence
  ELANE RNA Guide
cauucgucacgcagugcgcg

SEQ ID NO: 8330 - RNA, 20 nt, Artificial Sequence
  ELANE RNA Guide
ccgcgcacugcgugacgaau

SEQ ID NO: 8331 - RNA, 20 nt, Artificial Sequence
  ELANE RNA Guide
ccggcuacucacacauucgu

SEQ ID NO: 8332 - RNA, 20 nt, Artificial Sequence
  ELANE RNA Guide
cgcacugcgugacgaaugug

SEQ ID NO: 8333 - RNA, 20 nt, Artificial Sequence
  ELANE RNA Guide
cgcgcacugcgugacgaaug

SEQ ID NO: 8334 - RNA, 20 nt, Artificial Sequence
  ELANE RNA Guide
cggccgcgcacugcgugacg

SEQ ID NO: 8335 - RNA, 20 nt, Artificial Sequence
  ELANE RNA Guide
cggcuacucacacauucguc

SEQ ID NO: 8336 - RNA, 20 nt, Artificial Sequence
  ELANE RNA Guide
cgucacgcagugcgcggccg

SEQ ID NO: 8337 - RNA, 20 nt, Artificial Sequence
  ELANE RNA Guide
cgugacgaaugugugaguag

SEQ ID NO: 8338 - RNA, 20 nt, Artificial Sequence
  ELANE RNA Guide
cuacucacacauucgucacg

SEQ ID NO: 8339 - RNA, 20 nt, Artificial Sequence
  ELANE RNA Guide
cucacacauucgucacgcag

SEQ ID NO: 8340 - RNA, 20 nt, Artificial Sequence
  ELANE RNA Guide
cucccggcuacucacacauu

SEQ ID NO: 8341 - RNA, 20 nt, Artificial Sequence
  ELANE RNA Guide
cugcgugacgaaugugugag

SEQ ID NO: 8342 - RNA, 20 nt, Artificial Sequence
  ELANE RNA Guide
gacgaaugugugaguagccg

SEQ ID NO: 8343 - RNA, 20 nt, Artificial Sequence
  ELANE RNA Guide
gcacugcgugacgaaugugu

SEQ ID NO: 8344 - RNA, 20 nt, Artificial Sequence
  ELANE RNA Guide
gccgcgcacugcgugacgaa

SEQ ID NO: 8345 - RNA, 20 nt, Artificial Sequence
  ELANE RNA Guide
gcgcacugcgugacgaaugu

SEQ ID NO: 8346 - RNA, 20 nt, Artificial Sequence
  ELANE RNA Guide
gcgugacgaaugugugagua

SEQ ID NO: 8347 - RNA, 20 nt, Artificial Sequence
  ELANE RNA Guide
gcuacucacacauucgucac

SEQ ID NO: 8348 - RNA, 20 nt, Artificial Sequence
  ELANE RNA Guide
ggccgcgcacugcgugacga

SEQ ID NO: 8349 - RNA, 20 nt, Artificial Sequence
  ELANE RNA Guide
ggcuacucacacauucguca

SEQ ID NO: 8350 - RNA, 20 nt, Artificial Sequence
  ELANE RNA Guide
gucacgcagugcgcggccga

SEQ ID NO: 8351 - RNA, 20 nt, Artificial Sequence
  ELANE RNA Guide
gucggccgcgcacugcguga

SEQ ID NO: 8352 - RNA, 20 nt, Artificial Sequence
  ELANE RNA Guide
gugacgaaugugugaguagc

SEQ ID NO: 8353 - RNA, 20 nt, Artificial Sequence
  ELANE RNA Guide
uacucacacauucgucacgc

SEQ ID NO: 8354 - RNA, 20 nt, Artificial Sequence
  ELANE RNA Guide
ucacacauucgucacgcagu

SEQ ID NO: 8355 - RNA, 20 nt, Artificial Sequence
  ELANE RNA Guide
ucggccgcgcacugcgugac

SEQ ID NO: 8356 - RNA, 20 nt, Artificial Sequence
  ELANE RNA Guide
ucgucacgcagugcgcggcc

SEQ ID NO: 8357 - RNA, 20 nt, Artificial Sequence
  ELANE RNA Guide
ugacgaaugugugaguagcc

SEQ ID NO: 8358 - RNA, 20 nt, Artificial Sequence
  ELANE RNA Guide
ugcgugacgaaugugugagu

SEQ ID NO: 8359 - RNA, 20 nt, Artificial Sequence
  ELANE RNA Guide
ugucggccgcgcacugcgug

SEQ ID NO: 8360 - RNA, 20 nt, Artificial Sequence
  ELANE RNA Guide
uucgucacgcagugcgcggc

SEQ ID NO: 8361 - RNA, 21 nt, Artificial Sequence
  ELANE RNA Guide
acacauucgucacgcagugcg

SEQ ID NO: 8362 - RNA, 21 nt, Artificial Sequence
  ELANE RNA Guide
acauucgucacgcagugcgcg

SEQ ID NO: 8363 - RNA, 21 nt, Artificial Sequence
  ELANE RNA Guide
acucacacauucgucacgcag

SEQ ID NO: 8364 - RNA, 21 nt, Artificial Sequence
  ELANE RNA Guide
acucccggcuacucacacauu

SEQ ID NO: 8365 - RNA, 21 nt, Artificial Sequence
  ELANE RNA Guide
acugcgugacgaaugugugag

SEQ ID NO: 8366 - RNA, 21 nt, Artificial Sequence
  ELANE RNA Guide
augucggccgcgcacugcgug

SEQ ID NO: 8367 - RNA, 21 nt, Artificial Sequence
  ELANE RNA Guide
auucgucacgcagugcgcggc

SEQ ID NO: 8368 - RNA, 21 nt, Artificial Sequence
  ELANE RNA Guide
cacacauucgucacgcagugc

SEQ ID NO: 8369 - RNA, 21 nt, Artificial Sequence
  ELANE RNA Guide
cacauucgucacgcagugcgc

SEQ ID NO: 8370 - RNA, 21 nt, Artificial Sequence
  ELANE RNA Guide
cacucccggcuacucacacau

SEQ ID NO: 8371 - RNA, 21 nt, Artificial Sequence
  ELANE RNA Guide
cacugcgugacgaauguguga

SEQ ID NO: 8372 - RNA, 21 nt, Artificial Sequence
  ELANE RNA Guide
caugucggccgcgcacugcgu

SEQ ID NO: 8373 - RNA, 21 nt, Artificial Sequence
  ELANE RNA Guide
cauucgucacgcagugcgcgg

SEQ ID NO: 8374 - RNA, 21 nt, Artificial Sequence
  ELANE RNA Guide
cccggcuacucacacauucgu

SEQ ID NO: 8375 - RNA, 21 nt, Artificial Sequence
  ELANE RNA Guide
ccgcgcacugcgugacgaaug

SEQ ID NO: 8376 - RNA, 21 nt, Artificial Sequence
  ELANE RNA Guide
ccggcuacucacacauucguc

SEQ ID NO: 8377 - RNA, 21 nt, Artificial Sequence
  ELANE RNA Guide
cgcacugcgugacgaaugugu

SEQ ID NO: 8378 - RNA, 21 nt, Artificial Sequence
  ELANE RNA Guide
cgcgcacugcgugacgaaugu

SEQ ID NO: 8379 - RNA, 21 nt, Artificial Sequence
  ELANE RNA Guide
cggccgcgcacugcgugacga

SEQ ID NO: 8380 - RNA, 21 nt, Artificial Sequence
  ELANE RNA Guide
cggcuacucacacauucguca

SEQ ID NO: 8381 - RNA, 21 nt, Artificial Sequence
  ELANE RNA Guide
cgucacgcagugcgcggccga

SEQ ID NO: 8382 - RNA, 21 nt, Artificial Sequence
  ELANE RNA Guide
cgugacgaaugugugaguagc

SEQ ID NO: 8383 - RNA, 21 nt, Artificial Sequence
  ELANE RNA Guide
cuacucacacauucgucacgc

SEQ ID NO: 8384 - RNA, 21 nt, Artificial Sequence
  ELANE RNA Guide
cucacacauucgucacgcagu

SEQ ID NO: 8385 - RNA, 21 nt, Artificial Sequence
  ELANE RNA Guide
cugcgugacgaaugugugagu

SEQ ID NO: 8386 - RNA, 21 nt, Artificial Sequence
  ELANE RNA Guide
gacgaaugugugaguagccgg

SEQ ID NO: 8387 - RNA, 21 nt, Artificial Sequence
  ELANE RNA Guide
gcacugcgugacgaaugugug

SEQ ID NO: 8388 - RNA, 21 nt, Artificial Sequence
  ELANE RNA Guide
gccgcgcacugcgugacgaau

SEQ ID NO: 8389 - RNA, 21 nt, Artificial Sequence
  ELANE RNA Guide
gcgcacugcgugacgaaugug

SEQ ID NO: 8390 - RNA, 21 nt, Artificial Sequence
  ELANE RNA Guide
gcgugacgaaugugugaguag

SEQ ID NO: 8391 - RNA, 21 nt, Artificial Sequence
  ELANE RNA Guide
gcuacucacacauucgucacg

SEQ ID NO: 8392 - RNA, 21 nt, Artificial Sequence
  ELANE RNA Guide
ggccgcgcacugcgugacgaa

SEQ ID NO: 8393 - RNA, 21 nt, Artificial Sequence
  ELANE RNA Guide
ggcuacucacacauucgucac

SEQ ID NO: 8394 - RNA, 21 nt, Artificial Sequence
  ELANE RNA Guide
gucacgcagugcgcggccgac

SEQ ID NO: 8395 - RNA, 21 nt, Artificial Sequence
  ELANE RNA Guide
gucggccgcgcacugcgugac

SEQ ID NO: 8396 - RNA, 21 nt, Artificial Sequence
  ELANE RNA Guide
gugacgaaugugugaguagcc

SEQ ID NO: 8397 - RNA, 21 nt, Artificial Sequence
  ELANE RNA Guide
uacucacacauucgucacgca

SEQ ID NO: 8398 - RNA, 21 nt, Artificial Sequence
  ELANE RNA Guide
ucacacauucgucacgcagug

SEQ ID NO: 8399 - RNA, 21 nt, Artificial Sequence
  ELANE RNA Guide
ucggccgcgcacugcgugacg

SEQ ID NO: 8400 - RNA, 21 nt, Artificial Sequence
  ELANE RNA Guide
ucgucacgcagugcgcggccg

SEQ ID NO: 8401 - RNA, 21 nt, Artificial Sequence
  ELANE RNA Guide
ugacgaaugugugaguagccg

SEQ ID NO: 8402 - RNA, 21 nt, Artificial Sequence
  ELANE RNA Guide
ugcgugacgaaugugugagua

SEQ ID NO: 8403 - RNA, 21 nt, Artificial Sequence
  ELANE RNA Guide
ugucggccgcgcacugcguga

SEQ ID NO: 8404 - RNA, 21 nt, Artificial Sequence
  ELANE RNA Guide
uucgucacgcagugcgcggcc

SEQ ID NO: 8405 - RNA, 22 nt, Artificial Sequence
  ELANE RNA Guide
acacauucgucacgcagugcgc

SEQ ID NO: 8406 - RNA, 22 nt, Artificial Sequence
  ELANE RNA Guide
acacucccggcuacucacacau

SEQ ID NO: 8407 - RNA, 22 nt, Artificial Sequence
  ELANE RNA Guide
acauucgucacgcagugcgcgg

SEQ ID NO: 8408 - RNA, 22 nt, Artificial Sequence
  ELANE RNA Guide
acucacacauucgucacgcagu

SEQ ID NO: 8409 - RNA, 22 nt, Artificial Sequence
  ELANE RNA Guide
acugcgugacgaaugugugagu

SEQ ID NO: 8410 - RNA, 22 nt, Artificial Sequence
  ELANE RNA Guide
augucggccgcgcacugcguga

SEQ ID NO: 8411 - RNA, 22 nt, Artificial Sequence
  ELANE RNA Guide
auucgucacgcagugcgcggcc

SEQ ID NO: 8412 - RNA, 22 nt, Artificial Sequence
  ELANE RNA Guide
cacacauucgucacgcagugcg

SEQ ID NO: 8413 - RNA, 22 nt, Artificial Sequence
  ELANE RNA Guide
cacauucgucacgcagugcgcg

SEQ ID NO: 8414 - RNA, 22 nt, Artificial Sequence
  ELANE RNA Guide
cacucccggcuacucacacauu

SEQ ID NO: 8415 - RNA, 22 nt, Artificial Sequence
  ELANE RNA Guide
cacugcgugacgaaugugugag

SEQ ID NO: 8416 - RNA, 22 nt, Artificial Sequence
  ELANE RNA Guide
caugucggccgcgcacugcgug

SEQ ID NO: 8417 - RNA, 22 nt, Artificial Sequence
  ELANE RNA Guide
cauucgucacgcagugcgcggc

SEQ ID NO: 8418 - RNA, 22 nt, Artificial Sequence
  ELANE RNA Guide
cccggcuacucacacauucguc

SEQ ID NO: 8419 - RNA, 22 nt, Artificial Sequence
  ELANE RNA Guide
ccgcgcacugcgugacgaaugu

SEQ ID NO: 8420 - RNA, 22 nt, Artificial Sequence
  ELANE RNA Guide
ccggcuacucacacauucguca

SEQ ID NO: 8421 - RNA, 22 nt, Artificial Sequence
  ELANE RNA Guide
cgcacugcgugacgaaugugug

SEQ ID NO: 8422 - RNA, 22 nt, Artificial Sequence
  ELANE RNA Guide
cgcgcacugcgugacgaaugug

SEQ ID NO: 8423 - RNA, 22 nt, Artificial Sequence
  ELANE RNA Guide
cggccgcgcacugcgugacgaa

SEQ ID NO: 8424 - RNA, 22 nt, Artificial Sequence
  ELANE RNA Guide
cggcuacucacacauucgucac

SEQ ID NO: 8425 - RNA, 22 nt, Artificial Sequence
  ELANE RNA Guide
cgucacgcagugcgcggccgac

SEQ ID NO: 8426 - RNA, 22 nt, Artificial Sequence
  ELANE RNA Guide
cgugacgaaugugugaguagcc

SEQ ID NO: 8427 - RNA, 22 nt, Artificial Sequence
  ELANE RNA Guide
cuacucacacauucgucacgca

SEQ ID NO: 8428 - RNA, 22 nt, Artificial Sequence
  ELANE RNA Guide
cucacacauucgucacgcagug

SEQ ID NO: 8429 - RNA, 22 nt, Artificial Sequence
  ELANE RNA Guide
cugcgugacgaaugugugagua

SEQ ID NO: 8430 - RNA, 22 nt, Artificial Sequence
  ELANE RNA Guide
gacgaaugugugaguagccggg

SEQ ID NO: 8431 - RNA, 22 nt, Artificial Sequence
  ELANE RNA Guide
gcacugcgugacgaauguguga

SEQ ID NO: 8432 - RNA, 22 nt, Artificial Sequence
  ELANE RNA Guide
gccgcgcacugcgugacgaaug

SEQ ID NO: 8433 - RNA, 22 nt, Artificial Sequence
  ELANE RNA Guide
gcgcacugcgugacgaaugugu

SEQ ID NO: 8434 - RNA, 22 nt, Artificial Sequence
  ELANE RNA Guide
gcgugacgaaugugugaguagc

SEQ ID NO: 8435 - RNA, 22 nt, Artificial Sequence
  ELANE RNA Guide
gcuacucacacauucgucacgc

SEQ ID NO: 8436 - RNA, 22 nt, Artificial Sequence
  ELANE RNA Guide
ggccgcgcacugcgugacgaau

SEQ ID NO: 8437 - RNA, 22 nt, Artificial Sequence
  ELANE RNA Guide
ggcuacucacacauucgucacg

SEQ ID NO: 8438 - RNA, 22 nt, Artificial Sequence
  ELANE RNA Guide
gucacgcagugcgcggccgaca

SEQ ID NO: 8439 - RNA, 22 nt, Artificial Sequence
  ELANE RNA Guide
gucggccgcgcacugcgugacg

SEQ ID NO: 8440 - RNA, 22 nt, Artificial Sequence
  ELANE RNA Guide
gugacgaaugugugaguagccg

SEQ ID NO: 8441 - RNA, 22 nt, Artificial Sequence
  ELANE RNA Guide
uacucacacauucgucacgcag

SEQ ID NO: 8442 - RNA, 22 nt, Artificial Sequence
  ELANE RNA Guide
ucacacauucgucacgcagugc

SEQ ID NO: 8443 - RNA, 22 nt, Artificial Sequence
  ELANE RNA Guide
ucaugucggccgcgcacugcgu

SEQ ID NO: 8444 - RNA, 22 nt, Artificial Sequence
  ELANE RNA Guide
ucccggcuacucacacauucgu

SEQ ID NO: 8445 - RNA, 22 nt, Artificial Sequence
  ELANE RNA Guide
ucggccgcgcacugcgugacga

SEQ ID NO: 8446 - RNA, 22 nt, Artificial Sequence
  ELANE RNA Guide
ucgucacgcagugcgcggccga

SEQ ID NO: 8447 - RNA, 22 nt, Artificial Sequence
  ELANE RNA Guide
ugacgaaugugugaguagccgg

SEQ ID NO: 8448 - RNA, 22 nt, Artificial Sequence
  ELANE RNA Guide
ugcgugacgaaugugugaguag

SEQ ID NO: 8449 - RNA, 22 nt, Artificial Sequence
  ELANE RNA Guide
ugucggccgcgcacugcgugac

SEQ ID NO: 8450 - RNA, 22 nt, Artificial Sequence
  ELANE RNA Guide
uucgucacgcagugcgcggccg

SEQ ID NO: 8451 - RNA, 20 nt, Artificial Sequence
  ELANE RNA Guide
aaacgugcgggugguccugg

SEQ ID NO: 8452 - RNA, 20 nt, Artificial Sequence
  ELANE RNA Guide
aacgugcgggugguccuggg

SEQ ID NO: 8453 - RNA, 20 nt, Artificial Sequence
  ELANE RNA Guide
accacccgcacguuucugcc

SEQ ID NO: 8454 - RNA, 20 nt, Artificial Sequence
  ELANE RNA Guide
acccgcacguuucugccggg

SEQ ID NO: 8455 - RNA, 20 nt, Artificial Sequence
  ELANE RNA Guide
acgugcgggugguccuggga

SEQ ID NO: 8456 - RNA, 20 nt, Artificial Sequence
  ELANE RNA Guide
agaaacgugcgggugguccu

SEQ ID NO: 8457 - RNA, 20 nt, Artificial Sequence
  ELANE RNA Guide
aggaccacccgcacguuucu

SEQ ID NO: 8458 - RNA, 20 nt, Artificial Sequence
  ELANE RNA Guide
cacccgcacguuucugccgg

SEQ ID NO: 8459 - RNA, 20 nt, Artificial Sequence
  ELANE RNA Guide
cacguuucugccggggaggg

SEQ ID NO: 8460 - RNA, 20 nt, Artificial Sequence
  ELANE RNA Guide
cagaaacgugcggguggucc

SEQ ID NO: 8461 - RNA, 20 nt, Artificial Sequence
  ELANE RNA Guide
caggaccacccgcacguuuc

SEQ ID NO: 8462 - RNA, 20 nt, Artificial Sequence
  ELANE RNA Guide
ccacccgcacguuucugccg

SEQ ID NO: 8463 - RNA, 20 nt, Artificial Sequence
  ELANE RNA Guide
ccaggaccacccgcacguuu

SEQ ID NO: 8464 - RNA, 20 nt, Artificial Sequence
  ELANE RNA Guide
cccaggaccacccgcacguu

SEQ ID NO: 8465 - RNA, 20 nt, Artificial Sequence
  ELANE RNA Guide
ccccggcagaaacgugcggg

SEQ ID NO: 8466 - RNA, 20 nt, Artificial Sequence
  ELANE RNA Guide
cccgcacguuucugccgggg

SEQ ID NO: 8467 - RNA, 20 nt, Artificial Sequence
  ELANE RNA Guide
cccggcagaaacgugcgggu

SEQ ID NO: 8468 - RNA, 20 nt, Artificial Sequence
  ELANE RNA Guide
cccuccccggcagaaacgug

SEQ ID NO: 8469 - RNA, 20 nt, Artificial Sequence
  ELANE RNA Guide
ccgcacguuucugccgggga

SEQ ID NO: 8470 - RNA, 20 nt, Artificial Sequence
  ELANE RNA Guide
ccggcagaaacgugcgggug

SEQ ID NO: 8471 - RNA, 20 nt, Artificial Sequence
  ELANE RNA Guide
ccuccccggcagaaacgugc

SEQ ID NO: 8472 - RNA, 20 nt, Artificial Sequence
  ELANE RNA Guide
cgcacguuucugccggggag

SEQ ID NO: 8473 - RNA, 20 nt, Artificial Sequence
  ELANE RNA Guide
cggcagaaacgugcgggugg

SEQ ID NO: 8474 - RNA, 20 nt, Artificial Sequence
  ELANE RNA Guide
cucccaggaccacccgcacg

SEQ ID NO: 8475 - RNA, 20 nt, Artificial Sequence
  ELANE RNA Guide
cuccccggcagaaacgugcg

SEQ ID NO: 8476 - RNA, 20 nt, Artificial Sequence
  ELANE RNA Guide
cucccuccccggcagaaacg

SEQ ID NO: 8477 - RNA, 20 nt, Artificial Sequence
  ELANE RNA Guide
cucucccuccccggcagaaa

SEQ ID NO: 8478 - RNA, 20 nt, Artificial Sequence
  ELANE RNA Guide
gaaacgugcgggugguccug

SEQ ID NO: 8479 - RNA, 20 nt, Artificial Sequence
  ELANE RNA Guide
gaccacccgcacguuucugc

SEQ ID NO: 8480 - RNA, 20 nt, Artificial Sequence
  ELANE RNA Guide
gcacguuucugccggggagg

SEQ ID NO: 8481 - RNA, 20 nt, Artificial Sequence
  ELANE RNA Guide
gcagaaacgugcgggugguc

SEQ ID NO: 8482 - RNA, 20 nt, Artificial Sequence
  ELANE RNA Guide
gcucccaggaccacccgcac

SEQ ID NO: 8483 - RNA, 20 nt, Artificial Sequence
  ELANE RNA Guide
ggaccacccgcacguuucug

SEQ ID NO: 8484 - RNA, 20 nt, Artificial Sequence
  ELANE RNA Guide
ggcagaaacgugcggguggu

SEQ ID NO: 8485 - RNA, 20 nt, Artificial Sequence
  ELANE RNA Guide
ggcucccaggaccacccgca

SEQ ID NO: 8486 - RNA, 20 nt, Artificial Sequence
  ELANE RNA Guide
gggcucccaggaccacccgc

SEQ ID NO: 8487 - RNA, 20 nt, Artificial Sequence
  ELANE RNA Guide
ucccaggaccacccgcacgu

SEQ ID NO: 8488 - RNA, 20 nt, Artificial Sequence
  ELANE RNA Guide
uccccggcagaaacgugcgg

SEQ ID NO: 8489 - RNA, 20 nt, Artificial Sequence
  ELANE RNA Guide
ucccuccccggcagaaacgu

SEQ ID NO: 8490 - RNA, 20 nt, Artificial Sequence
  ELANE RNA Guide
ucucccuccccggcagaaac

SEQ ID NO: 8491 - RNA, 20 nt, Artificial Sequence
  ELANE RNA Guide
ugggcucccaggaccacccg

SEQ ID NO: 8492 - RNA, 21 nt, Artificial Sequence
  ELANE RNA Guide
aaacgugcgggugguccuggg

SEQ ID NO: 8493 - RNA, 21 nt, Artificial Sequence
  ELANE RNA Guide
aacgugcgggugguccuggga

SEQ ID NO: 8494 - RNA, 21 nt, Artificial Sequence
  ELANE RNA Guide
accacccgcacguuucugccg

SEQ ID NO: 8495 - RNA, 21 nt, Artificial Sequence
  ELANE RNA Guide
acccgcacguuucugccgggg

SEQ ID NO: 8496 - RNA, 21 nt, Artificial Sequence
  ELANE RNA Guide
acgugcgggugguccugggag

SEQ ID NO: 8497 - RNA, 21 nt, Artificial Sequence
  ELANE RNA Guide
agaaacgugcgggugguccug

SEQ ID NO: 8498 - RNA, 21 nt, Artificial Sequence
  ELANE RNA Guide
aggaccacccgcacguuucug

SEQ ID NO: 8499 - RNA, 21 nt, Artificial Sequence
  ELANE RNA Guide
augggcucccaggaccacccg

SEQ ID NO: 8500 - RNA, 21 nt, Artificial Sequence
  ELANE RNA Guide
cacccgcacguuucugccggg

SEQ ID NO: 8501 - RNA, 21 nt, Artificial Sequence
  ELANE RNA Guide
cacguuucugccggggaggga

SEQ ID NO: 8502 - RNA, 21 nt, Artificial Sequence
  ELANE RNA Guide
cagaaacgugcgggugguccu

SEQ ID NO: 8503 - RNA, 21 nt, Artificial Sequence
  ELANE RNA Guide
caggaccacccgcacguuucu

SEQ ID NO: 8504 - RNA, 21 nt, Artificial Sequence
  ELANE RNA Guide
ccacccgcacguuucugccgg

SEQ ID NO: 8505 - RNA, 21 nt, Artificial Sequence
  ELANE RNA Guide
ccaggaccacccgcacguuuc

SEQ ID NO: 8506 - RNA, 21 nt, Artificial Sequence
  ELANE RNA Guide
cccaggaccacccgcacguuu

SEQ ID NO: 8507 - RNA, 21 nt, Artificial Sequence
  ELANE RNA Guide
ccccggcagaaacgugcgggu

SEQ ID NO: 8508 - RNA, 21 nt, Artificial Sequence
  ELANE RNA Guide
cccgcacguuucugccgggga

SEQ ID NO: 8509 - RNA, 21 nt, Artificial Sequence
  ELANE RNA Guide
cccggcagaaacgugcgggug

SEQ ID NO: 8510 - RNA, 21 nt, Artificial Sequence
  ELANE RNA Guide
cccuccccggcagaaacgugc

SEQ ID NO: 8511 - RNA, 21 nt, Artificial Sequence
  ELANE RNA Guide
ccgcacguuucugccggggag

SEQ ID NO: 8512 - RNA, 21 nt, Artificial Sequence
  ELANE RNA Guide
ccggcagaaacgugcgggugg

SEQ ID NO: 8513 - RNA, 21 nt, Artificial Sequence
  ELANE RNA Guide
ccuccccggcagaaacgugcg

SEQ ID NO: 8514 - RNA, 21 nt, Artificial Sequence
  ELANE RNA Guide
ccucucccuccccggcagaaa

SEQ ID NO: 8515 - RNA, 21 nt, Artificial Sequence
  ELANE RNA Guide
cgcacguuucugccggggagg

SEQ ID NO: 8516 - RNA, 21 nt, Artificial Sequence
  ELANE RNA Guide
cggcagaaacgugcggguggu

SEQ ID NO: 8517 - RNA, 21 nt, Artificial Sequence
  ELANE RNA Guide
cucccaggaccacccgcacgu

SEQ ID NO: 8518 - RNA, 21 nt, Artificial Sequence
  ELANE RNA Guide
cuccccggcagaaacgugcgg

SEQ ID NO: 8519 - RNA, 21 nt, Artificial Sequence
  ELANE RNA Guide
cucccuccccggcagaaacgu

SEQ ID NO: 8520 - RNA, 21 nt, Artificial Sequence
  ELANE RNA Guide
cucucccuccccggcagaaac

SEQ ID NO: 8521 - RNA, 21 nt, Artificial Sequence
  ELANE RNA Guide
gaaacgugcgggugguccugg

SEQ ID NO: 8522 - RNA, 21 nt, Artificial Sequence
  ELANE RNA Guide
gaccacccgcacguuucugcc

SEQ ID NO: 8523 - RNA, 21 nt, Artificial Sequence
  ELANE RNA Guide
gcacguuucugccggggaggg

SEQ ID NO: 8524 - RNA, 21 nt, Artificial Sequence
  ELANE RNA Guide
gcagaaacgugcggguggucc

SEQ ID NO: 8525 - RNA, 21 nt, Artificial Sequence
  ELANE RNA Guide
gcucccaggaccacccgcacg

SEQ ID NO: 8526 - RNA, 21 nt, Artificial Sequence
  ELANE RNA Guide
ggaccacccgcacguuucugc

SEQ ID NO: 8527 - RNA, 21 nt, Artificial Sequence
  ELANE RNA Guide
ggcagaaacgugcgggugguc

SEQ ID NO: 8528 - RNA, 21 nt, Artificial Sequence
  ELANE RNA Guide
ggcucccaggaccacccgcac

SEQ ID NO: 8529 - RNA, 21 nt, Artificial Sequence
  ELANE RNA Guide
gggcucccaggaccacccgca

SEQ ID NO: 8530 - RNA, 21 nt, Artificial Sequence
  ELANE RNA Guide
ucccaggaccacccgcacguu

SEQ ID NO: 8531 - RNA, 21 nt, Artificial Sequence
  ELANE RNA Guide
uccccggcagaaacgugcggg

SEQ ID NO: 8532 - RNA, 21 nt, Artificial Sequence
  ELANE RNA Guide
ucccuccccggcagaaacgug

SEQ ID NO: 8533 - RNA, 21 nt, Artificial Sequence
  ELANE RNA Guide
ucucccuccccggcagaaacg

SEQ ID NO: 8534 - RNA, 21 nt, Artificial Sequence
  ELANE RNA Guide
ugggcucccaggaccacccgc

SEQ ID NO: 8535 - RNA, 22 nt, Artificial Sequence
  ELANE RNA Guide
aaacgugcgggugguccuggga

SEQ ID NO: 8536 - RNA, 22 nt, Artificial Sequence
  ELANE RNA Guide
aacgugcgggugguccugggag

SEQ ID NO: 8537 - RNA, 22 nt, Artificial Sequence
  ELANE RNA Guide
accacccgcacguuucugccgg

SEQ ID NO: 8538 - RNA, 22 nt, Artificial Sequence
  ELANE RNA Guide
acccgcacguuucugccgggga

SEQ ID NO: 8539 - RNA, 22 nt, Artificial Sequence
  ELANE RNA Guide
acgugcgggugguccugggagc

SEQ ID NO: 8540 - RNA, 22 nt, Artificial Sequence
  ELANE RNA Guide
agaaacgugcgggugguccugg

SEQ ID NO: 8541 - RNA, 22 nt, Artificial Sequence
  ELANE RNA Guide
aggaccacccgcacguuucugc

SEQ ID NO: 8542 - RNA, 22 nt, Artificial Sequence
  ELANE RNA Guide
augggcucccaggaccacccgc

SEQ ID NO: 8543 - RNA, 22 nt, Artificial Sequence
  ELANE RNA Guide
cacccgcacguuucugccgggg

SEQ ID NO: 8544 - RNA, 22 nt, Artificial Sequence
  ELANE RNA Guide
cacguuucugccggggagggag

SEQ ID NO: 8545 - RNA, 22 nt, Artificial Sequence
  ELANE RNA Guide
cagaaacgugcgggugguccug

SEQ ID NO: 8546 - RNA, 22 nt, Artificial Sequence
  ELANE RNA Guide
caggaccacccgcacguuucug

SEQ ID NO: 8547 - RNA, 22 nt, Artificial Sequence
  ELANE RNA Guide
ccacccgcacguuucugccggg

SEQ ID NO: 8548 - RNA, 22 nt, Artificial Sequence
  ELANE RNA Guide
ccaggaccacccgcacguuucu

SEQ ID NO: 8549 - RNA, 22 nt, Artificial Sequence
  ELANE RNA Guide
cccaggaccacccgcacguuuc

SEQ ID NO: 8550 - RNA, 22 nt, Artificial Sequence
  ELANE RNA Guide
ccccggcagaaacgugcgggug

SEQ ID NO: 8551 - RNA, 22 nt, Artificial Sequence
  ELANE RNA Guide
cccgcacguuucugccggggag

SEQ ID NO: 8552 - RNA, 22 nt, Artificial Sequence
  ELANE RNA Guide
cccggcagaaacgugcgggugg

SEQ ID NO: 8553 - RNA, 22 nt, Artificial Sequence
  ELANE RNA Guide
cccuccccggcagaaacgugcg

SEQ ID NO: 8554 - RNA, 22 nt, Artificial Sequence
  ELANE RNA Guide
ccgcacguuucugccggggagg

SEQ ID NO: 8555 - RNA, 22 nt, Artificial Sequence
  ELANE RNA Guide
ccggcagaaacgugcggguggu

SEQ ID NO: 8556 - RNA, 22 nt, Artificial Sequence
  ELANE RNA Guide
ccuccccggcagaaacgugcgg

SEQ ID NO: 8557 - RNA, 22 nt, Artificial Sequence
  ELANE RNA Guide
ccucucccuccccggcagaaac

SEQ ID NO: 8558 - RNA, 22 nt, Artificial Sequence
  ELANE RNA Guide
cgcacguuucugccggggaggg

SEQ ID NO: 8559 - RNA, 22 nt, Artificial Sequence
  ELANE RNA Guide
cggcagaaacgugcgggugguc

SEQ ID NO: 8560 - RNA, 22 nt, Artificial Sequence
  ELANE RNA Guide
cucccaggaccacccgcacguu

SEQ ID NO: 8561 - RNA, 22 nt, Artificial Sequence
  ELANE RNA Guide
cuccccggcagaaacgugcggg

SEQ ID NO: 8562 - RNA, 22 nt, Artificial Sequence
  ELANE RNA Guide
cucccuccccggcagaaacgug

SEQ ID NO: 8563 - RNA, 22 nt, Artificial Sequence
  ELANE RNA Guide
cucucccuccccggcagaaacg

SEQ ID NO: 8564 - RNA, 22 nt, Artificial Sequence
  ELANE RNA Guide
gaaacgugcgggugguccuggg

SEQ ID NO: 8565 - RNA, 22 nt, Artificial Sequence
  ELANE RNA Guide
gaccacccgcacguuucugccg

SEQ ID NO: 8566 - RNA, 22 nt, Artificial Sequence
  ELANE RNA Guide
gcacguuucugccggggaggga

SEQ ID NO: 8567 - RNA, 22 nt, Artificial Sequence
  ELANE RNA Guide
gcagaaacgugcgggugguccu

SEQ ID NO: 8568 - RNA, 22 nt, Artificial Sequence
  ELANE RNA Guide
gccucucccuccccggcagaaa

SEQ ID NO: 8569 - RNA, 22 nt, Artificial Sequence
  ELANE RNA Guide
gcucccaggaccacccgcacgu

SEQ ID NO: 8570 - RNA, 22 nt, Artificial Sequence
  ELANE RNA Guide
ggaccacccgcacguuucugcc

SEQ ID NO: 8571 - RNA, 22 nt, Artificial Sequence
  ELANE RNA Guide
ggcagaaacgugcggguggucc

SEQ ID NO: 8572 - RNA, 22 nt, Artificial Sequence
  ELANE RNA Guide
ggcucccaggaccacccgcacg

SEQ ID NO: 8573 - RNA, 22 nt, Artificial Sequence
  ELANE RNA Guide
gggcucccaggaccacccgcac

SEQ ID NO: 8574 - RNA, 22 nt, Artificial Sequence
  ELANE RNA Guide
uaugggcucccaggaccacccg

SEQ ID NO: 8575 - RNA, 22 nt, Artificial Sequence
  ELANE RNA Guide
ucccaggaccacccgcacguuu

SEQ ID NO: 8576 - RNA, 22 nt, Artificial Sequence
  ELANE RNA Guide
uccccggcagaaacgugcgggu

SEQ ID NO: 8577 - RNA, 22 nt, Artificial Sequence
  ELANE RNA Guide
ucccuccccggcagaaacgugc

SEQ ID NO: 8578 - RNA, 22 nt, Artificial Sequence
  ELANE RNA Guide
ucucccuccccggcagaaacgu

SEQ ID NO: 8579 - RNA, 22 nt, Artificial Sequence
  ELANE RNA Guide
ugggcucccaggaccacccgca

SEQ ID NO: 8580 - RNA, 20 nt, Artificial Sequence
  ELANE RNA Guide
aaacccuccccggcaggacc

SEQ ID NO: 8581 - RNA, 20 nt, Artificial Sequence
  ELANE RNA Guide
aacccuccccggcaggaccu

SEQ ID NO: 8582 - RNA, 20 nt, Artificial Sequence
  ELANE RNA Guide
acccuccccggcaggaccuc

SEQ ID NO: 8583 - RNA, 20 nt, Artificial Sequence
  ELANE RNA Guide
agaaacccuccccggcagga

SEQ ID NO: 8584 - RNA, 20 nt, Artificial Sequence
  ELANE RNA Guide
aggguuucugccggggaggg

SEQ ID NO: 8585 - RNA, 20 nt, Artificial Sequence
  ELANE RNA Guide
agguccugccggggaggguu

SEQ ID NO: 8586 - RNA, 20 nt, Artificial Sequence
  ELANE RNA Guide
cagaaacccuccccggcagg

SEQ ID NO: 8587 - RNA, 20 nt, Artificial Sequence
  ELANE RNA Guide
ccccggcagaaacccucccc

SEQ ID NO: 8588 - RNA, 20 nt, Artificial Sequence
  ELANE RNA Guide
cccggcagaaacccuccccg

SEQ ID NO: 8589 - RNA, 20 nt, Artificial Sequence
  ELANE RNA Guide
cccuccccggcagaaacccu

SEQ ID NO: 8590 - RNA, 20 nt, Artificial Sequence
  ELANE RNA Guide
ccggcagaaacccuccccgg

SEQ ID NO: 8591 - RNA, 20 nt, Artificial Sequence
  ELANE RNA Guide
ccggggaggguuucugccgg

SEQ ID NO: 8592 - RNA, 20 nt, Artificial Sequence
  ELANE RNA Guide
ccuccccggcagaaacccuc

SEQ ID NO: 8593 - RNA, 20 nt, Artificial Sequence
  ELANE RNA Guide
ccucucccuccccggcagaa

SEQ ID NO: 8594 - RNA, 20 nt, Artificial Sequence
  ELANE RNA Guide
ccugccggggaggguuucug

SEQ ID NO: 8595 - RNA, 20 nt, Artificial Sequence
  ELANE RNA Guide
cggcagaaacccuccccggc

SEQ ID NO: 8596 - RNA, 20 nt, Artificial Sequence
  ELANE RNA Guide
cggggaggguuucugccggg

SEQ ID NO: 8597 - RNA, 20 nt, Artificial Sequence
  ELANE RNA Guide
cggggagguccugccgggga

SEQ ID NO: 8598 - RNA, 20 nt, Artificial Sequence
  ELANE RNA Guide
cuccccggcagaaacccucc

SEQ ID NO: 8599 - RNA, 20 nt, Artificial Sequence
  ELANE RNA Guide
cucccuccccggcagaaacc

SEQ ID NO: 8600 - RNA, 20 nt, Artificial Sequence
  ELANE RNA Guide
cugccggggaggguuucugc

SEQ ID NO: 8601 - RNA, 20 nt, Artificial Sequence
  ELANE RNA Guide
gaaacccuccccggcaggac

SEQ ID NO: 8602 - RNA, 20 nt, Artificial Sequence
  ELANE RNA Guide
gaggguuucugccggggagg

SEQ ID NO: 8603 - RNA, 20 nt, Artificial Sequence
  ELANE RNA Guide
gagguccugccggggagggu

SEQ ID NO: 8604 - RNA, 20 nt, Artificial Sequence
  ELANE RNA Guide
gcagaaacccuccccggcag

SEQ ID NO: 8605 - RNA, 20 nt, Artificial Sequence
  ELANE RNA Guide
gccggggaggguuucugccg

SEQ ID NO: 8606 - RNA, 20 nt, Artificial Sequence
  ELANE RNA Guide
gccucucccuccccggcaga

SEQ ID NO: 8607 - RNA, 20 nt, Artificial Sequence
  ELANE RNA Guide
ggaggguuucugccggggag

SEQ ID NO: 8608 - RNA, 20 nt, Artificial Sequence
  ELANE RNA Guide
ggagguccugccggggaggg

SEQ ID NO: 8609 - RNA, 20 nt, Artificial Sequence
  ELANE RNA Guide
ggcagaaacccuccccggca

SEQ ID NO: 8610 - RNA, 20 nt, Artificial Sequence
  ELANE RNA Guide
gggaggguuucugccgggga

SEQ ID NO: 8611 - RNA, 20 nt, Artificial Sequence
  ELANE RNA Guide
gggagguccugccggggagg

SEQ ID NO: 8612 - RNA, 20 nt, Artificial Sequence
  ELANE RNA Guide
ggggaggguuucugccgggg

SEQ ID NO: 8613 - RNA, 20 nt, Artificial Sequence
  ELANE RNA Guide
ggggagguccugccggggag

SEQ ID NO: 8614 - RNA, 20 nt, Artificial Sequence
  ELANE RNA Guide
ggguuucugccggggaggga

SEQ ID NO: 8615 - RNA, 20 nt, Artificial Sequence
  ELANE RNA Guide
gguccugccggggaggguuu

SEQ ID NO: 8616 - RNA, 20 nt, Artificial Sequence
  ELANE RNA Guide
gguuucugccggggagggag

SEQ ID NO: 8617 - RNA, 20 nt, Artificial Sequence
  ELANE RNA Guide
guccugccggggaggguuuc

SEQ ID NO: 8618 - RNA, 20 nt, Artificial Sequence
  ELANE RNA Guide
uccccggcagaaacccuccc

SEQ ID NO: 8619 - RNA, 20 nt, Artificial Sequence
  ELANE RNA Guide
ucccuccccggcagaaaccc

SEQ ID NO: 8620 - RNA, 20 nt, Artificial Sequence
  ELANE RNA Guide
uccugccggggaggguuucu

SEQ ID NO: 8621 - RNA, 20 nt, Artificial Sequence
  ELANE RNA Guide
ugccggggaggguuucugcc

SEQ ID NO: 8622 - RNA, 21 nt, Artificial Sequence
  ELANE RNA Guide
aaacccuccccggcaggaccu

SEQ ID NO: 8623 - RNA, 21 nt, Artificial Sequence
  ELANE RNA Guide
aacccuccccggcaggaccuc

SEQ ID NO: 8624 - RNA, 21 nt, Artificial Sequence
  ELANE RNA Guide
acccuccccggcaggaccucc

SEQ ID NO: 8625 - RNA, 21 nt, Artificial Sequence
  ELANE RNA Guide
agaaacccuccccggcaggac

SEQ ID NO: 8626 - RNA, 21 nt, Artificial Sequence
  ELANE RNA Guide
aggguuucugccggggaggga

SEQ ID NO: 8627 - RNA, 21 nt, Artificial Sequence
  ELANE RNA Guide
agguccugccggggaggguuu

SEQ ID NO: 8628 - RNA, 21 nt, Artificial Sequence
  ELANE RNA Guide
cagaaacccuccccggcagga

SEQ ID NO: 8629 - RNA, 21 nt, Artificial Sequence
  ELANE RNA Guide
ccccggcagaaacccuccccg

SEQ ID NO: 8630 - RNA, 21 nt, Artificial Sequence
  ELANE RNA Guide
cccggcagaaacccuccccgg

SEQ ID NO: 8631 - RNA, 21 nt, Artificial Sequence
  ELANE RNA Guide
cccuccccggcagaaacccuc

SEQ ID NO: 8632 - RNA, 21 nt, Artificial Sequence
  ELANE RNA Guide
ccggcagaaacccuccccggc

SEQ ID NO: 8633 - RNA, 21 nt, Artificial Sequence
  ELANE RNA Guide
ccggggaggguuucugccggg

SEQ ID NO: 8634 - RNA, 21 nt, Artificial Sequence
  ELANE RNA Guide
ccuccccggcagaaacccucc

SEQ ID NO: 8635 - RNA, 21 nt, Artificial Sequence
  ELANE RNA Guide
ccugccggggaggguuucugc

SEQ ID NO: 8636 - RNA, 21 nt, Artificial Sequence
  ELANE RNA Guide
cgccucucccuccccggcaga

SEQ ID NO: 8637 - RNA, 21 nt, Artificial Sequence
  ELANE RNA Guide
cggcagaaacccuccccggca

SEQ ID NO: 8638 - RNA, 21 nt, Artificial Sequence
  ELANE RNA Guide
cggggaggguuucugccgggg

SEQ ID NO: 8639 - RNA, 21 nt, Artificial Sequence
  ELANE RNA Guide
cuccccggcagaaacccuccc

SEQ ID NO: 8640 - RNA, 21 nt, Artificial Sequence
  ELANE RNA Guide
cucccuccccggcagaaaccc

SEQ ID NO: 8641 - RNA, 21 nt, Artificial Sequence
  ELANE RNA Guide
cugccggggaggguuucugcc

SEQ ID NO: 8642 - RNA, 21 nt, Artificial Sequence
  ELANE RNA Guide
gaaacccuccccggcaggacc

SEQ ID NO: 8643 - RNA, 21 nt, Artificial Sequence
  ELANE RNA Guide
gaggguuucugccggggaggg

SEQ ID NO: 8644 - RNA, 21 nt, Artificial Sequence
  ELANE RNA Guide
gagguccugccggggaggguu

SEQ ID NO: 8645 - RNA, 21 nt, Artificial Sequence
  ELANE RNA Guide
gcagaaacccuccccggcagg

SEQ ID NO: 8646 - RNA, 21 nt, Artificial Sequence
  ELANE RNA Guide
gccggggaggguuucugccgg

SEQ ID NO: 8647 - RNA, 21 nt, Artificial Sequence
  ELANE RNA Guide
gccucucccuccccggcagaa

SEQ ID NO: 8648 - RNA, 21 nt, Artificial Sequence
  ELANE RNA Guide
ggaggguuucugccggggagg

SEQ ID NO: 8649 - RNA, 21 nt, Artificial Sequence
  ELANE RNA Guide
ggagguccugccggggagggu

SEQ ID NO: 8650 - RNA, 21 nt, Artificial Sequence
  ELANE RNA Guide
ggcagaaacccuccccggcag

SEQ ID NO: 8651 - RNA, 21 nt, Artificial Sequence
  ELANE RNA Guide
gggaggguuucugccggggag

SEQ ID NO: 8652 - RNA, 21 nt, Artificial Sequence
  ELANE RNA Guide
ggggaggguuucugccgggga

SEQ ID NO: 8653 - RNA, 21 nt, Artificial Sequence
  ELANE RNA Guide
ggguuucugccggggagggag

SEQ ID NO: 8654 - RNA, 21 nt, Artificial Sequence
  ELANE RNA Guide
gguccugccggggaggguuuc

SEQ ID NO: 8655 - RNA, 21 nt, Artificial Sequence
  ELANE RNA Guide
gguuucugccggggagggaga

SEQ ID NO: 8656 - RNA, 21 nt, Artificial Sequence
  ELANE RNA Guide
guccugccggggaggguuucu

SEQ ID NO: 8657 - RNA, 21 nt, Artificial Sequence
  ELANE RNA Guide
uccccggcagaaacccucccc

SEQ ID NO: 8658 - RNA, 21 nt, Artificial Sequence
  ELANE RNA Guide
ucccuccccggcagaaacccu

SEQ ID NO: 8659 - RNA, 21 nt, Artificial Sequence
  ELANE RNA Guide
uccugccggggaggguuucug

SEQ ID NO: 8660 - RNA, 21 nt, Artificial Sequence
  ELANE RNA Guide
ucucccuccccggcagaaacc

SEQ ID NO: 8661 - RNA, 21 nt, Artificial Sequence
  ELANE RNA Guide
ugccggggaggguuucugccg

SEQ ID NO: 8662 - RNA, 22 nt, Artificial Sequence
  ELANE RNA Guide
aaacccuccccggcaggaccuc

SEQ ID NO: 8663 - RNA, 22 nt, Artificial Sequence
  ELANE RNA Guide
aacccuccccggcaggaccucc

SEQ ID NO: 8664 - RNA, 22 nt, Artificial Sequence
  ELANE RNA Guide
acccuccccggcaggaccuccc

SEQ ID NO: 8665 - RNA, 22 nt, Artificial Sequence
  ELANE RNA Guide
agaaacccuccccggcaggacc

SEQ ID NO: 8666 - RNA, 22 nt, Artificial Sequence
  ELANE RNA Guide
aggguuucugccggggagggag

SEQ ID NO: 8667 - RNA, 22 nt, Artificial Sequence
  ELANE RNA Guide
agguccugccggggaggguuuc

SEQ ID NO: 8668 - RNA, 22 nt, Artificial Sequence
  ELANE RNA Guide
cagaaacccuccccggcaggac

SEQ ID NO: 8669 - RNA, 22 nt, Artificial Sequence
  ELANE RNA Guide
ccccggcagaaacccuccccgg

SEQ ID NO: 8670 - RNA, 22 nt, Artificial Sequence
  ELANE RNA Guide
cccggcagaaacccuccccggc

SEQ ID NO: 8671 - RNA, 22 nt, Artificial Sequence
  ELANE RNA Guide
cccuccccggcagaaacccucc

SEQ ID NO: 8672 - RNA, 22 nt, Artificial Sequence
  ELANE RNA Guide
ccgccucucccuccccggcaga

SEQ ID NO: 8673 - RNA, 22 nt, Artificial Sequence
  ELANE RNA Guide
ccggcagaaacccuccccggca

SEQ ID NO: 8674 - RNA, 22 nt, Artificial Sequence
  ELANE RNA Guide
ccggggaggguuucugccgggg

SEQ ID NO: 8675 - RNA, 22 nt, Artificial Sequence
  ELANE RNA Guide
ccuccccggcagaaacccuccc

SEQ ID NO: 8676 - RNA, 22 nt, Artificial Sequence
  ELANE RNA Guide
ccugccggggaggguuucugcc

SEQ ID NO: 8677 - RNA, 22 nt, Artificial Sequence
  ELANE RNA Guide
cgccucucccuccccggcagaa

SEQ ID NO: 8678 - RNA, 22 nt, Artificial Sequence
  ELANE RNA Guide
cggcagaaacccuccccggcag

SEQ ID NO: 8679 - RNA, 22 nt, Artificial Sequence
  ELANE RNA Guide
cggggaggguuucugccgggga

SEQ ID NO: 8680 - RNA, 22 nt, Artificial Sequence
  ELANE RNA Guide
cuccccggcagaaacccucccc

SEQ ID NO: 8681 - RNA, 22 nt, Artificial Sequence
  ELANE RNA Guide
cucccuccccggcagaaacccu

SEQ ID NO: 8682 - RNA, 22 nt, Artificial Sequence
  ELANE RNA Guide
cucucccuccccggcagaaacc

SEQ ID NO: 8683 - RNA, 22 nt, Artificial Sequence
  ELANE RNA Guide
cugccggggaggguuucugccg

SEQ ID NO: 8684 - RNA, 22 nt, Artificial Sequence
  ELANE RNA Guide
gaaacccuccccggcaggaccu

SEQ ID NO: 8685 - RNA, 22 nt, Artificial Sequence
  ELANE RNA Guide
gaggguuucugccggggaggga

SEQ ID NO: 8686 - RNA, 22 nt, Artificial Sequence
  ELANE RNA Guide
gagguccugccggggaggguuu

SEQ ID NO: 8687 - RNA, 22 nt, Artificial Sequence
  ELANE RNA Guide
gcagaaacccuccccggcagga

SEQ ID NO: 8688 - RNA, 22 nt, Artificial Sequence
  ELANE RNA Guide
gccggggaggguuucugccggg

SEQ ID NO: 8689 - RNA, 22 nt, Artificial Sequence
  ELANE RNA Guide
ggaggguuucugccggggaggg

SEQ ID NO: 8690 - RNA, 22 nt, Artificial Sequence
  ELANE RNA Guide
ggagguccugccggggaggguu

SEQ ID NO: 8691 - RNA, 22 nt, Artificial Sequence
  ELANE RNA Guide
ggcagaaacccuccccggcagg

SEQ ID NO: 8692 - RNA, 22 nt, Artificial Sequence
  ELANE RNA Guide
gggaggguuucugccggggagg

SEQ ID NO: 8693 - RNA, 22 nt, Artificial Sequence
  ELANE RNA Guide
gggagguccugccggggagggu

SEQ ID NO: 8694 - RNA, 22 nt, Artificial Sequence
  ELANE RNA Guide
ggggaggguuucugccggggag

SEQ ID NO: 8695 - RNA, 22 nt, Artificial Sequence
  ELANE RNA Guide
ggguuucugccggggagggaga

SEQ ID NO: 8696 - RNA, 22 nt, Artificial Sequence
  ELANE RNA Guide
gguccugccggggaggguuucu

SEQ ID NO: 8697 - RNA, 22 nt, Artificial Sequence
  ELANE RNA Guide
gguuucugccggggagggagag

SEQ ID NO: 8698 - RNA, 22 nt, Artificial Sequence
  ELANE RNA Guide
guccugccggggaggguuucug

SEQ ID NO: 8699 - RNA, 22 nt, Artificial Sequence
  ELANE RNA Guide
uccccggcagaaacccuccccg

SEQ ID NO: 8700 - RNA, 22 nt, Artificial Sequence
  ELANE RNA Guide
ucccuccccggcagaaacccuc

SEQ ID NO: 8701 - RNA, 22 nt, Artificial Sequence
  ELANE RNA Guide
uccugccggggaggguuucugc

SEQ ID NO: 8702 - RNA, 22 nt, Artificial Sequence
  ELANE RNA Guide
ucucccuccccggcagaaaccc

SEQ ID NO: 8703 - RNA, 22 nt, Artificial Sequence
  ELANE RNA Guide
ugccggggaggguuucugccgg

SEQ ID NO: 8704 - RNA, 20 nt, Artificial Sequence
  ELANE RNA Guide
aaacguccgggugcgggugg

SEQ ID NO: 8705 - RNA, 20 nt, Artificial Sequence
  ELANE RNA Guide
aacguccgggugcggguggu

SEQ ID NO: 8706 - RNA, 20 nt, Artificial Sequence
  ELANE RNA Guide
accacccgcacccggacguu

SEQ ID NO: 8707 - RNA, 20 nt, Artificial Sequence
  ELANE RNA Guide
acccgcacccggacguuucu

SEQ ID NO: 8708 - RNA, 20 nt, Artificial Sequence
  ELANE RNA Guide
acccggacguuucugccggg

SEQ ID NO: 8709 - RNA, 20 nt, Artificial Sequence
  ELANE RNA Guide
acguccgggugcgggugguc

SEQ ID NO: 8710 - RNA, 20 nt, Artificial Sequence
  ELANE RNA Guide
agaaacguccgggugcgggu

SEQ ID NO: 8711 - RNA, 20 nt, Artificial Sequence
  ELANE RNA Guide
aggaccacccgcacccggac

SEQ ID NO: 8712 - RNA, 20 nt, Artificial Sequence
  ELANE RNA Guide
cacccgcacccggacguuuc

SEQ ID NO: 8713 - RNA, 20 nt, Artificial Sequence
  ELANE RNA Guide
cacccggacguuucugccgg

SEQ ID NO: 8714 - RNA, 20 nt, Artificial Sequence
  ELANE RNA Guide
cagaaacguccgggugcggg

SEQ ID NO: 8715 - RNA, 20 nt, Artificial Sequence
  ELANE RNA Guide
caggaccacccgcacccgga

SEQ ID NO: 8716 - RNA, 20 nt, Artificial Sequence
  ELANE RNA Guide
ccacccgcacccggacguuu

SEQ ID NO: 8717 - RNA, 20 nt, Artificial Sequence
  ELANE RNA Guide
ccaggaccacccgcacccgg

SEQ ID NO: 8718 - RNA, 20 nt, Artificial Sequence
  ELANE RNA Guide
cccaggaccacccgcacccg

SEQ ID NO: 8719 - RNA, 20 nt, Artificial Sequence
  ELANE RNA Guide
ccccggcagaaacguccggg

SEQ ID NO: 8720 - RNA, 20 nt, Artificial Sequence
  ELANE RNA Guide
cccgcacccggacguuucug

SEQ ID NO: 8721 - RNA, 20 nt, Artificial Sequence
  ELANE RNA Guide
cccggacguuucugccgggg

SEQ ID NO: 8722 - RNA, 20 nt, Artificial Sequence
  ELANE RNA Guide
cccggcagaaacguccgggu

SEQ ID NO: 8723 - RNA, 20 nt, Artificial Sequence
  ELANE RNA Guide
cccuccccggcagaaacguc

SEQ ID NO: 8724 - RNA, 20 nt, Artificial Sequence
  ELANE RNA Guide
ccgcacccggacguuucugc

SEQ ID NO: 8725 - RNA, 20 nt, Artificial Sequence
  ELANE RNA Guide
ccggacguuucugccgggga

SEQ ID NO: 8726 - RNA, 20 nt, Artificial Sequence
  ELANE RNA Guide
ccggcagaaacguccgggug

SEQ ID NO: 8727 - RNA, 20 nt, Artificial Sequence
  ELANE RNA Guide
ccgggugcgggugguccugg

SEQ ID NO: 8728 - RNA, 20 nt, Artificial Sequence
  ELANE RNA Guide
ccuccccggcagaaacgucc

SEQ ID NO: 8729 - RNA, 20 nt, Artificial Sequence
  ELANE RNA Guide
cgcacccggacguuucugcc

SEQ ID NO: 8730 - RNA, 20 nt, Artificial Sequence
  ELANE RNA Guide
cggcagaaacguccgggugc

SEQ ID NO: 8731 - RNA, 20 nt, Artificial Sequence
  ELANE RNA Guide
cgggugcgggugguccuggg

SEQ ID NO: 8732 - RNA, 20 nt, Artificial Sequence
  ELANE RNA Guide
cguccgggugcggguggucc

SEQ ID NO: 8733 - RNA, 20 nt, Artificial Sequence
  ELANE RNA Guide
cucccaggaccacccgcacc

SEQ ID NO: 8734 - RNA, 20 nt, Artificial Sequence
  ELANE RNA Guide
cuccccggcagaaacguccg

SEQ ID NO: 8735 - RNA, 20 nt, Artificial Sequence
  ELANE RNA Guide
gaaacguccgggugcgggug

SEQ ID NO: 8736 - RNA, 20 nt, Artificial Sequence
  ELANE RNA Guide
gaccacccgcacccggacgu

SEQ ID NO: 8737 - RNA, 20 nt, Artificial Sequence
  ELANE RNA Guide
gcacccggacguuucugccg

SEQ ID NO: 8738 - RNA, 20 nt, Artificial Sequence
  ELANE RNA Guide
gcagaaacguccgggugcgg

SEQ ID NO: 8739 - RNA, 20 nt, Artificial Sequence
  ELANE RNA Guide
ggaccacccgcacccggacg

SEQ ID NO: 8740 - RNA, 20 nt, Artificial Sequence
  ELANE RNA Guide
ggcagaaacguccgggugcg

SEQ ID NO: 8741 - RNA, 20 nt, Artificial Sequence
  ELANE RNA Guide
guccgggugcgggugguccu

SEQ ID NO: 8742 - RNA, 20 nt, Artificial Sequence
  ELANE RNA Guide
ucccaggaccacccgcaccc

SEQ ID NO: 8743 - RNA, 20 nt, Artificial Sequence
  ELANE RNA Guide
uccccggcagaaacguccgg

SEQ ID NO: 8744 - RNA, 20 nt, Artificial Sequence
  ELANE RNA Guide
uccgggugcgggugguccug

SEQ ID NO: 8745 - RNA, 21 nt, Artificial Sequence
  ELANE RNA Guide
aaacguccgggugcggguggu

SEQ ID NO: 8746 - RNA, 21 nt, Artificial Sequence
  ELANE RNA Guide
aacguccgggugcgggugguc

SEQ ID NO: 8747 - RNA, 21 nt, Artificial Sequence
  ELANE RNA Guide
accacccgcacccggacguuu

SEQ ID NO: 8748 - RNA, 21 nt, Artificial Sequence
  ELANE RNA Guide
acccgcacccggacguuucug

SEQ ID NO: 8749 - RNA, 21 nt, Artificial Sequence
  ELANE RNA Guide
acccggacguuucugccgggg

SEQ ID NO: 8750 - RNA, 21 nt, Artificial Sequence
  ELANE RNA Guide
acguccgggugcggguggucc

SEQ ID NO: 8751 - RNA, 21 nt, Artificial Sequence
  ELANE RNA Guide
agaaacguccgggugcgggug

SEQ ID NO: 8752 - RNA, 21 nt, Artificial Sequence
  ELANE RNA Guide
aggaccacccgcacccggacg

SEQ ID NO: 8753 - RNA, 21 nt, Artificial Sequence
  ELANE RNA Guide
cacccgcacccggacguuucu

SEQ ID NO: 8754 - RNA, 21 nt, Artificial Sequence
  ELANE RNA Guide
cacccggacguuucugccggg

SEQ ID NO: 8755 - RNA, 21 nt, Artificial Sequence
  ELANE RNA Guide
cagaaacguccgggugcgggu

SEQ ID NO: 8756 - RNA, 21 nt, Artificial Sequence
  ELANE RNA Guide
caggaccacccgcacccggac

SEQ ID NO: 8757 - RNA, 21 nt, Artificial Sequence
  ELANE RNA Guide
ccacccgcacccggacguuuc

SEQ ID NO: 8758 - RNA, 21 nt, Artificial Sequence
  ELANE RNA Guide
ccaggaccacccgcacccgga

SEQ ID NO: 8759 - RNA, 21 nt, Artificial Sequence
  ELANE RNA Guide
ccccggcagaaacguccgggu

SEQ ID NO: 8760 - RNA, 21 nt, Artificial Sequence
  ELANE RNA Guide
cccgcacccggacguuucugc

SEQ ID NO: 8761 - RNA, 21 nt, Artificial Sequence
  ELANE RNA Guide
cccggacguuucugccgggga

SEQ ID NO: 8762 - RNA, 21 nt, Artificial Sequence
  ELANE RNA Guide
cccggcagaaacguccgggug

SEQ ID NO: 8763 - RNA, 21 nt, Artificial Sequence
  ELANE RNA Guide
cccuccccggcagaaacgucc

SEQ ID NO: 8764 - RNA, 21 nt, Artificial Sequence
  ELANE RNA Guide
ccgcacccggacguuucugcc

SEQ ID NO: 8765 - RNA, 21 nt, Artificial Sequence
  ELANE RNA Guide
ccggacguuucugccggggag

SEQ ID NO: 8766 - RNA, 21 nt, Artificial Sequence
  ELANE RNA Guide
ccggcagaaacguccgggugc

SEQ ID NO: 8767 - RNA, 21 nt, Artificial Sequence
  ELANE RNA Guide
ccuccccggcagaaacguccg

SEQ ID NO: 8768 - RNA, 21 nt, Artificial Sequence
  ELANE RNA Guide
cgcacccggacguuucugccg

SEQ ID NO: 8769 - RNA, 21 nt, Artificial Sequence
  ELANE RNA Guide
cggcagaaacguccgggugcg

SEQ ID NO: 8770 - RNA, 21 nt, Artificial Sequence
  ELANE RNA Guide
cgggugcgggugguccuggga

SEQ ID NO: 8771 - RNA, 21 nt, Artificial Sequence
  ELANE RNA Guide
cguccgggugcgggugguccu

SEQ ID NO: 8772 - RNA, 21 nt, Artificial Sequence
  ELANE RNA Guide
cucccaggaccacccgcaccc

SEQ ID NO: 8773 - RNA, 21 nt, Artificial Sequence
  ELANE RNA Guide
cuccccggcagaaacguccgg

SEQ ID NO: 8774 - RNA, 21 nt, Artificial Sequence
  ELANE RNA Guide
gaaacguccgggugcgggugg

SEQ ID NO: 8775 - RNA, 21 nt, Artificial Sequence
  ELANE RNA Guide
gaccacccgcacccggacguu

SEQ ID NO: 8776 - RNA, 21 nt, Artificial Sequence
  ELANE RNA Guide
gcacccggacguuucugccgg

SEQ ID NO: 8777 - RNA, 21 nt, Artificial Sequence
  ELANE RNA Guide
gcagaaacguccgggugcggg

SEQ ID NO: 8778 - RNA, 21 nt, Artificial Sequence
  ELANE RNA Guide
gcucccaggaccacccgcacc

SEQ ID NO: 8779 - RNA, 21 nt, Artificial Sequence
  ELANE RNA Guide
ggaccacccgcacccggacgu

SEQ ID NO: 8780 - RNA, 21 nt, Artificial Sequence
  ELANE RNA Guide
ggcagaaacguccgggugcgg

SEQ ID NO: 8781 - RNA, 21 nt, Artificial Sequence
  ELANE RNA Guide
guccgggugcgggugguccug

SEQ ID NO: 8782 - RNA, 21 nt, Artificial Sequence
  ELANE RNA Guide
ucccaggaccacccgcacccg

SEQ ID NO: 8783 - RNA, 21 nt, Artificial Sequence
  ELANE RNA Guide
uccccggcagaaacguccggg

SEQ ID NO: 8784 - RNA, 21 nt, Artificial Sequence
  ELANE RNA Guide
ucccuccccggcagaaacguc

SEQ ID NO: 8785 - RNA, 21 nt, Artificial Sequence
  ELANE RNA Guide
uccgggugcgggugguccugg

SEQ ID NO: 8786 - RNA, 22 nt, Artificial Sequence
  ELANE RNA Guide
aaacguccgggugcgggugguc

SEQ ID NO: 8787 - RNA, 22 nt, Artificial Sequence
  ELANE RNA Guide
aacguccgggugcggguggucc

SEQ ID NO: 8788 - RNA, 22 nt, Artificial Sequence
  ELANE RNA Guide
accacccgcacccggacguuuc

SEQ ID NO: 8789 - RNA, 22 nt, Artificial Sequence
  ELANE RNA Guide
acccgcacccggacguuucugc

SEQ ID NO: 8790 - RNA, 22 nt, Artificial Sequence
  ELANE RNA Guide
acccggacguuucugccgggga

SEQ ID NO: 8791 - RNA, 22 nt, Artificial Sequence
  ELANE RNA Guide
acguccgggugcgggugguccu

SEQ ID NO: 8792 - RNA, 22 nt, Artificial Sequence
  ELANE RNA Guide
agaaacguccgggugcgggugg

SEQ ID NO: 8793 - RNA, 22 nt, Artificial Sequence
  ELANE RNA Guide
aggaccacccgcacccggacgu

SEQ ID NO: 8794 - RNA, 22 nt, Artificial Sequence
  ELANE RNA Guide
cacccgcacccggacguuucug

SEQ ID NO: 8795 - RNA, 22 nt, Artificial Sequence
  ELANE RNA Guide
cacccggacguuucugccgggg

SEQ ID NO: 8796 - RNA, 22 nt, Artificial Sequence
  ELANE RNA Guide
cagaaacguccgggugcgggug

SEQ ID NO: 8797 - RNA, 22 nt, Artificial Sequence
  ELANE RNA Guide
caggaccacccgcacccggacg

SEQ ID NO: 8798 - RNA, 22 nt, Artificial Sequence
  ELANE RNA Guide
ccacccgcacccggacguuucu

SEQ ID NO: 8799 - RNA, 22 nt, Artificial Sequence
  ELANE RNA Guide
ccaggaccacccgcacccggac

SEQ ID NO: 8800 - RNA, 22 nt, Artificial Sequence
  ELANE RNA Guide
cccaggaccacccgcacccgga

SEQ ID NO: 8801 - RNA, 22 nt, Artificial Sequence
  ELANE RNA Guide
ccccggcagaaacguccgggug

SEQ ID NO: 8802 - RNA, 22 nt, Artificial Sequence
  ELANE RNA Guide
cccgcacccggacguuucugcc

SEQ ID NO: 8803 - RNA, 22 nt, Artificial Sequence
  ELANE RNA Guide
cccggacguuucugccggggag

SEQ ID NO: 8804 - RNA, 22 nt, Artificial Sequence
  ELANE RNA Guide
cccggcagaaacguccgggugc

SEQ ID NO: 8805 - RNA, 22 nt, Artificial Sequence
  ELANE RNA Guide
cccuccccggcagaaacguccg

SEQ ID NO: 8806 - RNA, 22 nt, Artificial Sequence
  ELANE RNA Guide
ccgcacccggacguuucugccg

SEQ ID NO: 8807 - RNA, 22 nt, Artificial Sequence
  ELANE RNA Guide
ccggacguuucugccggggagg

SEQ ID NO: 8808 - RNA, 22 nt, Artificial Sequence
  ELANE RNA Guide
ccggcagaaacguccgggugcg

SEQ ID NO: 8809 - RNA, 22 nt, Artificial Sequence
  ELANE RNA Guide
ccgggugcgggugguccuggga

SEQ ID NO: 8810 - RNA, 22 nt, Artificial Sequence
  ELANE RNA Guide
ccuccccggcagaaacguccgg

SEQ ID NO: 8811 - RNA, 22 nt, Artificial Sequence
  ELANE RNA Guide
cgcacccggacguuucugccgg

SEQ ID NO: 8812 - RNA, 22 nt, Artificial Sequence
  ELANE RNA Guide
cggcagaaacguccgggugcgg

SEQ ID NO: 8813 - RNA, 22 nt, Artificial Sequence
  ELANE RNA Guide
cgggugcgggugguccugggag

SEQ ID NO: 8814 - RNA, 22 nt, Artificial Sequence
  ELANE RNA Guide
cguccgggugcgggugguccug

SEQ ID NO: 8815 - RNA, 22 nt, Artificial Sequence
  ELANE RNA Guide
cucccaggaccacccgcacccg

SEQ ID NO: 8816 - RNA, 22 nt, Artificial Sequence
  ELANE RNA Guide
cuccccggcagaaacguccggg

SEQ ID NO: 8817 - RNA, 22 nt, Artificial Sequence
  ELANE RNA Guide
cucccuccccggcagaaacguc

SEQ ID NO: 8818 - RNA, 22 nt, Artificial Sequence
  ELANE RNA Guide
gaaacguccgggugcggguggu

SEQ ID NO: 8819 - RNA, 22 nt, Artificial Sequence
  ELANE RNA Guide
gaccacccgcacccggacguuu

SEQ ID NO: 8820 - RNA, 22 nt, Artificial Sequence
  ELANE RNA Guide
gcacccggacguuucugccggg

SEQ ID NO: 8821 - RNA, 22 nt, Artificial Sequence
  ELANE RNA Guide
gcagaaacguccgggugcgggu

SEQ ID NO: 8822 - RNA, 22 nt, Artificial Sequence
  ELANE RNA Guide
gcucccaggaccacccgcaccc

SEQ ID NO: 8823 - RNA, 22 nt, Artificial Sequence
  ELANE RNA Guide
ggaccacccgcacccggacguu

SEQ ID NO: 8824 - RNA, 22 nt, Artificial Sequence
  ELANE RNA Guide
ggcagaaacguccgggugcggg

SEQ ID NO: 8825 - RNA, 22 nt, Artificial Sequence
  ELANE RNA Guide
ggcucccaggaccacccgcacc

SEQ ID NO: 8826 - RNA, 22 nt, Artificial Sequence
  ELANE RNA Guide
guccgggugcgggugguccugg

SEQ ID NO: 8827 - RNA, 22 nt, Artificial Sequence
  ELANE RNA Guide
ucccaggaccacccgcacccgg

SEQ ID NO: 8828 - RNA, 22 nt, Artificial Sequence
  ELANE RNA Guide
uccccggcagaaacguccgggu

SEQ ID NO: 8829 - RNA, 22 nt, Artificial Sequence
  ELANE RNA Guide
ucccuccccggcagaaacgucc

SEQ ID NO: 8830 - RNA, 22 nt, Artificial Sequence
  ELANE RNA Guide
uccgggugcgggugguccuggg

SEQ ID NO: 8831 - RNA, 20 nt, Artificial Sequence
  ELANE RNA Guide
aaacguccacgcggugcggg

SEQ ID NO: 8832 - RNA, 20 nt, Artificial Sequence
  ELANE RNA Guide
aacguccacgcggugcgggu

SEQ ID NO: 8833 - RNA, 20 nt, Artificial Sequence
  ELANE RNA Guide
accacccgcaccgcguggac

SEQ ID NO: 8834 - RNA, 20 nt, Artificial Sequence
  ELANE RNA Guide
acccgcaccgcguggacguu

SEQ ID NO: 8835 - RNA, 20 nt, Artificial Sequence
  ELANE RNA Guide
accgcguggacguuucugcc

SEQ ID NO: 8836 - RNA, 20 nt, Artificial Sequence
  ELANE RNA Guide
acguccacgcggugcgggug

SEQ ID NO: 8837 - RNA, 20 nt, Artificial Sequence
  ELANE RNA Guide
agaaacguccacgcggugcg

SEQ ID NO: 8838 - RNA, 20 nt, Artificial Sequence
  ELANE RNA Guide
aggaccacccgcaccgcgug

SEQ ID NO: 8839 - RNA, 20 nt, Artificial Sequence
  ELANE RNA Guide
cacccgcaccgcguggacgu

SEQ ID NO: 8840 - RNA, 20 nt, Artificial Sequence
  ELANE RNA Guide
caccgcguggacguuucugc

SEQ ID NO: 8841 - RNA, 20 nt, Artificial Sequence
  ELANE RNA Guide
cacgcggugcgggugguccu

SEQ ID NO: 8842 - RNA, 20 nt, Artificial Sequence
  ELANE RNA Guide
cagaaacguccacgcggugc

SEQ ID NO: 8843 - RNA, 20 nt, Artificial Sequence
  ELANE RNA Guide
caggaccacccgcaccgcgu

SEQ ID NO: 8844 - RNA, 20 nt, Artificial Sequence
  ELANE RNA Guide
ccacccgcaccgcguggacg

SEQ ID NO: 8845 - RNA, 20 nt, Artificial Sequence
  ELANE RNA Guide
ccacgcggugcggguggucc

SEQ ID NO: 8846 - RNA, 20 nt, Artificial Sequence
  ELANE RNA Guide
ccaggaccacccgcaccgcg

SEQ ID NO: 8847 - RNA, 20 nt, Artificial Sequence
  ELANE RNA Guide
cccaggaccacccgcaccgc

SEQ ID NO: 8848 - RNA, 20 nt, Artificial Sequence
  ELANE RNA Guide
ccccggcagaaacguccacg

SEQ ID NO: 8849 - RNA, 20 nt, Artificial Sequence
  ELANE RNA Guide
cccgcaccgcguggacguuu

SEQ ID NO: 8850 - RNA, 20 nt, Artificial Sequence
  ELANE RNA Guide
cccggcagaaacguccacgc

SEQ ID NO: 8851 - RNA, 20 nt, Artificial Sequence
  ELANE RNA Guide
ccgcaccgcguggacguuuc

SEQ ID NO: 8852 - RNA, 20 nt, Artificial Sequence
  ELANE RNA Guide
ccgcguggacguuucugccg

SEQ ID NO: 8853 - RNA, 20 nt, Artificial Sequence
  ELANE RNA Guide
ccggcagaaacguccacgcg

SEQ ID NO: 8854 - RNA, 20 nt, Artificial Sequence
  ELANE RNA Guide
cgcaccgcguggacguuucu

SEQ ID NO: 8855 - RNA, 20 nt, Artificial Sequence
  ELANE RNA Guide
cgcguggacguuucugccgg

SEQ ID NO: 8856 - RNA, 20 nt, Artificial Sequence
  ELANE RNA Guide
cggcagaaacguccacgcgg

SEQ ID NO: 8857 - RNA, 20 nt, Artificial Sequence
  ELANE RNA Guide
cguccacgcggugcgggugg

SEQ ID NO: 8858 - RNA, 20 nt, Artificial Sequence
  ELANE RNA Guide
cguggacguuucugccgggg

SEQ ID NO: 8859 - RNA, 20 nt, Artificial Sequence
  ELANE RNA Guide
cuccccggcagaaacgucca

SEQ ID NO: 8860 - RNA, 20 nt, Artificial Sequence
  ELANE RNA Guide
gaaacguccacgcggugcgg

SEQ ID NO: 8861 - RNA, 20 nt, Artificial Sequence
  ELANE RNA Guide
gaccacccgcaccgcgugga

SEQ ID NO: 8862 - RNA, 20 nt, Artificial Sequence
  ELANE RNA Guide
gcaccgcguggacguuucug

SEQ ID NO: 8863 - RNA, 20 nt, Artificial Sequence
  ELANE RNA Guide
gcagaaacguccacgcggug

SEQ ID NO: 8864 - RNA, 20 nt, Artificial Sequence
  ELANE RNA Guide
gcguggacguuucugccggg

SEQ ID NO: 8865 - RNA, 20 nt, Artificial Sequence
  ELANE RNA Guide
ggaccacccgcaccgcgugg

SEQ ID NO: 8866 - RNA, 20 nt, Artificial Sequence
  ELANE RNA Guide
ggcagaaacguccacgcggu

SEQ ID NO: 8867 - RNA, 20 nt, Artificial Sequence
  ELANE RNA Guide
guccacgcggugcggguggu

SEQ ID NO: 8868 - RNA, 20 nt, Artificial Sequence
  ELANE RNA Guide
guggacguuucugccgggga

SEQ ID NO: 8869 - RNA, 20 nt, Artificial Sequence
  ELANE RNA Guide
uccacgcggugcgggugguc

SEQ ID NO: 8870 - RNA, 20 nt, Artificial Sequence
  ELANE RNA Guide
ucccaggaccacccgcaccg

SEQ ID NO: 8871 - RNA, 20 nt, Artificial Sequence
  ELANE RNA Guide
uccccggcagaaacguccac

SEQ ID NO: 8872 - RNA, 21 nt, Artificial Sequence
  ELANE RNA Guide
aaacguccacgcggugcgggu

SEQ ID NO: 8873 - RNA, 21 nt, Artificial Sequence
  ELANE RNA Guide
aacguccacgcggugcgggug

SEQ ID NO: 8874 - RNA, 21 nt, Artificial Sequence
  ELANE RNA Guide
accacccgcaccgcguggacg

SEQ ID NO: 8875 - RNA, 21 nt, Artificial Sequence
  ELANE RNA Guide
acccgcaccgcguggacguuu

SEQ ID NO: 8876 - RNA, 21 nt, Artificial Sequence
  ELANE RNA Guide
accgcguggacguuucugccg

SEQ ID NO: 8877 - RNA, 21 nt, Artificial Sequence
  ELANE RNA Guide
acguccacgcggugcgggugg

SEQ ID NO: 8878 - RNA, 21 nt, Artificial Sequence
  ELANE RNA Guide
agaaacguccacgcggugcgg

SEQ ID NO: 8879 - RNA, 21 nt, Artificial Sequence
  ELANE RNA Guide
aggaccacccgcaccgcgugg

SEQ ID NO: 8880 - RNA, 21 nt, Artificial Sequence
  ELANE RNA Guide
cacccgcaccgcguggacguu

SEQ ID NO: 8881 - RNA, 21 nt, Artificial Sequence
  ELANE RNA Guide
caccgcguggacguuucugcc

SEQ ID NO: 8882 - RNA, 21 nt, Artificial Sequence
  ELANE RNA Guide
cacgcggugcgggugguccug

SEQ ID NO: 8883 - RNA, 21 nt, Artificial Sequence
  ELANE RNA Guide
cagaaacguccacgcggugcg

SEQ ID NO: 8884 - RNA, 21 nt, Artificial Sequence
  ELANE RNA Guide
caggaccacccgcaccgcgug

SEQ ID NO: 8885 - RNA, 21 nt, Artificial Sequence
  ELANE RNA Guide
ccacccgcaccgcguggacgu

SEQ ID NO: 8886 - RNA, 21 nt, Artificial Sequence
  ELANE RNA Guide
ccacgcggugcgggugguccu

SEQ ID NO: 8887 - RNA, 21 nt, Artificial Sequence
  ELANE RNA Guide
ccaggaccacccgcaccgcgu

SEQ ID NO: 8888 - RNA, 21 nt, Artificial Sequence
  ELANE RNA Guide
ccccggcagaaacguccacgc

SEQ ID NO: 8889 - RNA, 21 nt, Artificial Sequence
  ELANE RNA Guide
cccgcaccgcguggacguuuc

SEQ ID NO: 8890 - RNA, 21 nt, Artificial Sequence
  ELANE RNA Guide
cccggcagaaacguccacgcg

SEQ ID NO: 8891 - RNA, 21 nt, Artificial Sequence
  ELANE RNA Guide
ccgcaccgcguggacguuucu

SEQ ID NO: 8892 - RNA, 21 nt, Artificial Sequence
  ELANE RNA Guide
ccgcguggacguuucugccgg

SEQ ID NO: 8893 - RNA, 21 nt, Artificial Sequence
  ELANE RNA Guide
ccggcagaaacguccacgcgg

SEQ ID NO: 8894 - RNA, 21 nt, Artificial Sequence
  ELANE RNA Guide
ccuccccggcagaaacgucca

SEQ ID NO: 8895 - RNA, 21 nt, Artificial Sequence
  ELANE RNA Guide
cgcaccgcguggacguuucug

SEQ ID NO: 8896 - RNA, 21 nt, Artificial Sequence
  ELANE RNA Guide
cgcguggacguuucugccggg

SEQ ID NO: 8897 - RNA, 21 nt, Artificial Sequence
  ELANE RNA Guide
cggcagaaacguccacgcggu

SEQ ID NO: 8898 - RNA, 21 nt, Artificial Sequence
  ELANE RNA Guide
cguccacgcggugcggguggu

SEQ ID NO: 8899 - RNA, 21 nt, Artificial Sequence
  ELANE RNA Guide
cguggacguuucugccgggga

SEQ ID NO: 8900 - RNA, 21 nt, Artificial Sequence
  ELANE RNA Guide
cucccaggaccacccgcaccg

SEQ ID NO: 8901 - RNA, 21 nt, Artificial Sequence
  ELANE RNA Guide
cuccccggcagaaacguccac

SEQ ID NO: 8902 - RNA, 21 nt, Artificial Sequence
  ELANE RNA Guide
gaaacguccacgcggugcggg

SEQ ID NO: 8903 - RNA, 21 nt, Artificial Sequence
  ELANE RNA Guide
gaccacccgcaccgcguggac

SEQ ID NO: 8904 - RNA, 21 nt, Artificial Sequence
  ELANE RNA Guide
gcaccgcguggacguuucugc

SEQ ID NO: 8905 - RNA, 21 nt, Artificial Sequence
  ELANE RNA Guide
gcagaaacguccacgcggugc

SEQ ID NO: 8906 - RNA, 21 nt, Artificial Sequence
  ELANE RNA Guide
gcguggacguuucugccgggg

SEQ ID NO: 8907 - RNA, 21 nt, Artificial Sequence
  ELANE RNA Guide
ggaccacccgcaccgcgugga

SEQ ID NO: 8908 - RNA, 21 nt, Artificial Sequence
  ELANE RNA Guide
ggcagaaacguccacgcggug

SEQ ID NO: 8909 - RNA, 21 nt, Artificial Sequence
  ELANE RNA Guide
guccacgcggugcgggugguc

SEQ ID NO: 8910 - RNA, 21 nt, Artificial Sequence
  ELANE RNA Guide
guggacguuucugccggggag

SEQ ID NO: 8911 - RNA, 21 nt, Artificial Sequence
  ELANE RNA Guide
uccacgcggugcggguggucc

SEQ ID NO: 8912 - RNA, 21 nt, Artificial Sequence
  ELANE RNA Guide
ucccaggaccacccgcaccgc

SEQ ID NO: 8913 - RNA, 21 nt, Artificial Sequence
  ELANE RNA Guide
uccccggcagaaacguccacg

SEQ ID NO: 8914 - RNA, 22 nt, Artificial Sequence
  ELANE RNA Guide
aaacguccacgcggugcgggug

SEQ ID NO: 8915 - RNA, 22 nt, Artificial Sequence
  ELANE RNA Guide
aacguccacgcggugcgggugg

SEQ ID NO: 8916 - RNA, 22 nt, Artificial Sequence
  ELANE RNA Guide
accacccgcaccgcguggacgu

SEQ ID NO: 8917 - RNA, 22 nt, Artificial Sequence
  ELANE RNA Guide
acccgcaccgcguggacguuuc

SEQ ID NO: 8918 - RNA, 22 nt, Artificial Sequence
  ELANE RNA Guide
accgcguggacguuucugccgg

SEQ ID NO: 8919 - RNA, 22 nt, Artificial Sequence
  ELANE RNA Guide
acguccacgcggugcggguggu

SEQ ID NO: 8920 - RNA, 22 nt, Artificial Sequence
  ELANE RNA Guide
agaaacguccacgcggugcggg

SEQ ID NO: 8921 - RNA, 22 nt, Artificial Sequence
  ELANE RNA Guide
aggaccacccgcaccgcgugga

SEQ ID NO: 8922 - RNA, 22 nt, Artificial Sequence
  ELANE RNA Guide
cacccgcaccgcguggacguuu

SEQ ID NO: 8923 - RNA, 22 nt, Artificial Sequence
  ELANE RNA Guide
caccgcguggacguuucugccg

SEQ ID NO: 8924 - RNA, 22 nt, Artificial Sequence
  ELANE RNA Guide
cacgcggugcgggugguccugg

SEQ ID NO: 8925 - RNA, 22 nt, Artificial Sequence
  ELANE RNA Guide
cagaaacguccacgcggugcgg

SEQ ID NO: 8926 - RNA, 22 nt, Artificial Sequence
  ELANE RNA Guide
caggaccacccgcaccgcgugg

SEQ ID NO: 8927 - RNA, 22 nt, Artificial Sequence
  ELANE RNA Guide
ccacccgcaccgcguggacguu

SEQ ID NO: 8928 - RNA, 22 nt, Artificial Sequence
  ELANE RNA Guide
ccacgcggugcgggugguccug

SEQ ID NO: 8929 - RNA, 22 nt, Artificial Sequence
  ELANE RNA Guide
ccaggaccacccgcaccgcgug

SEQ ID NO: 8930 - RNA, 22 nt, Artificial Sequence
  ELANE RNA Guide
cccaggaccacccgcaccgcgu

SEQ ID NO: 8931 - RNA, 22 nt, Artificial Sequence
  ELANE RNA Guide
ccccggcagaaacguccacgcg

SEQ ID NO: 8932 - RNA, 22 nt, Artificial Sequence
  ELANE RNA Guide
cccgcaccgcguggacguuucu

SEQ ID NO: 8933 - RNA, 22 nt, Artificial Sequence
  ELANE RNA Guide
cccggcagaaacguccacgcgg

SEQ ID NO: 8934 - RNA, 22 nt, Artificial Sequence
  ELANE RNA Guide
cccuccccggcagaaacgucca

SEQ ID NO: 8935 - RNA, 22 nt, Artificial Sequence
  ELANE RNA Guide
ccgcaccgcguggacguuucug

SEQ ID NO: 8936 - RNA, 22 nt, Artificial Sequence
  ELANE RNA Guide
ccgcguggacguuucugccggg

SEQ ID NO: 8937 - RNA, 22 nt, Artificial Sequence
  ELANE RNA Guide
ccggcagaaacguccacgcggu

SEQ ID NO: 8938 - RNA, 22 nt, Artificial Sequence
  ELANE RNA Guide
ccuccccggcagaaacguccac

SEQ ID NO: 8939 - RNA, 22 nt, Artificial Sequence
  ELANE RNA Guide
cgcaccgcguggacguuucugc

SEQ ID NO: 8940 - RNA, 22 nt, Artificial Sequence
  ELANE RNA Guide
cgcguggacguuucugccgggg

SEQ ID NO: 8941 - RNA, 22 nt, Artificial Sequence
  ELANE RNA Guide
cggcagaaacguccacgcggug

SEQ ID NO: 8942 - RNA, 22 nt, Artificial Sequence
  ELANE RNA Guide
cguccacgcggugcgggugguc

SEQ ID NO: 8943 - RNA, 22 nt, Artificial Sequence
  ELANE RNA Guide
cguggacguuucugccggggag

SEQ ID NO: 8944 - RNA, 22 nt, Artificial Sequence
  ELANE RNA Guide
cucccaggaccacccgcaccgc

SEQ ID NO: 8945 - RNA, 22 nt, Artificial Sequence
  ELANE RNA Guide
cuccccggcagaaacguccacg

SEQ ID NO: 8946 - RNA, 22 nt, Artificial Sequence
  ELANE RNA Guide
gaaacguccacgcggugcgggu

SEQ ID NO: 8947 - RNA, 22 nt, Artificial Sequence
  ELANE RNA Guide
gaccacccgcaccgcguggacg

SEQ ID NO: 8948 - RNA, 22 nt, Artificial Sequence
  ELANE RNA Guide
gcaccgcguggacguuucugcc

SEQ ID NO: 8949 - RNA, 22 nt, Artificial Sequence
  ELANE RNA Guide
gcagaaacguccacgcggugcg

SEQ ID NO: 8950 - RNA, 22 nt, Artificial Sequence
  ELANE RNA Guide
gcguggacguuucugccgggga

SEQ ID NO: 8951 - RNA, 22 nt, Artificial Sequence
  ELANE RNA Guide
gcucccaggaccacccgcaccg

SEQ ID NO: 8952 - RNA, 22 nt, Artificial Sequence
  ELANE RNA Guide
ggaccacccgcaccgcguggac

SEQ ID NO: 8953 - RNA, 22 nt, Artificial Sequence
  ELANE RNA Guide
ggcagaaacguccacgcggugc

SEQ ID NO: 8954 - RNA, 22 nt, Artificial Sequence
  ELANE RNA Guide
guccacgcggugcggguggucc

SEQ ID NO: 8955 - RNA, 22 nt, Artificial Sequence
  ELANE RNA Guide
guggacguuucugccggggagg

SEQ ID NO: 8956 - RNA, 22 nt, Artificial Sequence
  ELANE RNA Guide
uccacgcggugcgggugguccu

SEQ ID NO: 8957 - RNA, 22 nt, Artificial Sequence
  ELANE RNA Guide
ucccaggaccacccgcaccgcg

SEQ ID NO: 8958 - RNA, 22 nt, Artificial Sequence
  ELANE RNA Guide
uccccggcagaaacguccacgc

SEQ ID NO: 8959 - RNA, 20 nt, Artificial Sequence
  ELANE RNA Guide
aaacguccgcccggugcggg

SEQ ID NO: 8960 - RNA, 20 nt, Artificial Sequence
  ELANE RNA Guide
aacguccgcccggugcgggu

SEQ ID NO: 8961 - RNA, 20 nt, Artificial Sequence
  ELANE RNA Guide
accacccgcaccgggcggac

SEQ ID NO: 8962 - RNA, 20 nt, Artificial Sequence
  ELANE RNA Guide
acccgcaccgggcggacguu

SEQ ID NO: 8963 - RNA, 20 nt, Artificial Sequence
  ELANE RNA Guide
accgggcggacguuucugcc

SEQ ID NO: 8964 - RNA, 20 nt, Artificial Sequence
  ELANE RNA Guide
acguccgcccggugcgggug

SEQ ID NO: 8965 - RNA, 20 nt, Artificial Sequence
  ELANE RNA Guide
agaaacguccgcccggugcg

SEQ ID NO: 8966 - RNA, 20 nt, Artificial Sequence
  ELANE RNA Guide
aggaccacccgcaccgggcg

SEQ ID NO: 8967 - RNA, 20 nt, Artificial Sequence
  ELANE RNA Guide
cacccgcaccgggcggacgu

SEQ ID NO: 8968 - RNA, 20 nt, Artificial Sequence
  ELANE RNA Guide
caccgggcggacguuucugc

SEQ ID NO: 8969 - RNA, 20 nt, Artificial Sequence
  ELANE RNA Guide
cagaaacguccgcccggugc

SEQ ID NO: 8970 - RNA, 20 nt, Artificial Sequence
  ELANE RNA Guide
caggaccacccgcaccgggc

SEQ ID NO: 8971 - RNA, 20 nt, Artificial Sequence
  ELANE RNA Guide
ccaggaccacccgcaccggg

SEQ ID NO: 8972 - RNA, 20 nt, Artificial Sequence
  ELANE RNA Guide
cccaggaccacccgcaccgg

SEQ ID NO: 8973 - RNA, 20 nt, Artificial Sequence
  ELANE RNA Guide
ccccggcagaaacguccgcc

SEQ ID NO: 8974 - RNA, 20 nt, Artificial Sequence
  ELANE RNA Guide
cccgcaccgggcggacguuu

SEQ ID NO: 8975 - RNA, 20 nt, Artificial Sequence
  ELANE RNA Guide
cccggcagaaacguccgccc

SEQ ID NO: 8976 - RNA, 20 nt, Artificial Sequence
  ELANE RNA Guide
cccggugcgggugguccugg

SEQ ID NO: 8977 - RNA, 20 nt, Artificial Sequence
  ELANE RNA Guide
ccgcaccgggcggacguuuc

SEQ ID NO: 8978 - RNA, 20 nt, Artificial Sequence
  ELANE RNA Guide
ccggcagaaacguccgcccg

SEQ ID NO: 8979 - RNA, 20 nt, Artificial Sequence
  ELANE RNA Guide
ccgggcggacguuucugccg

SEQ ID NO: 8980 - RNA, 20 nt, Artificial Sequence
  ELANE RNA Guide
cgcaccgggcggacguuucu

SEQ ID NO: 8981 - RNA, 20 nt, Artificial Sequence
  ELANE RNA Guide
cgcccggugcgggugguccu

SEQ ID NO: 8982 - RNA, 20 nt, Artificial Sequence
  ELANE RNA Guide
cggcagaaacguccgcccgg

SEQ ID NO: 8983 - RNA, 20 nt, Artificial Sequence
  ELANE RNA Guide
cgggcggacguuucugccgg

SEQ ID NO: 8984 - RNA, 20 nt, Artificial Sequence
  ELANE RNA Guide
gaaacguccgcccggugcgg

SEQ ID NO: 8985 - RNA, 20 nt, Artificial Sequence
  ELANE RNA Guide
gaccacccgcaccgggcgga

SEQ ID NO: 8986 - RNA, 20 nt, Artificial Sequence
  ELANE RNA Guide
gcaccgggcggacguuucug

SEQ ID NO: 8987 - RNA, 20 nt, Artificial Sequence
  ELANE RNA Guide
gcagaaacguccgcccggug

SEQ ID NO: 8988 - RNA, 20 nt, Artificial Sequence
  ELANE RNA Guide
gcccggugcgggugguccug

SEQ ID NO: 8989 - RNA, 20 nt, Artificial Sequence
  ELANE RNA Guide
ggcagaaacguccgcccggu

SEQ ID NO: 8990 - RNA, 20 nt, Artificial Sequence
  ELANE RNA Guide
gggcggacguuucugccggg

SEQ ID NO: 8991 - RNA, 20 nt, Artificial Sequence
  ELANE RNA Guide
guccgcccggugcggguggu

SEQ ID NO: 8992 - RNA, 20 nt, Artificial Sequence
  ELANE RNA Guide
uccccggcagaaacguccgc

SEQ ID NO: 8993 - RNA, 20 nt, Artificial Sequence
  ELANE RNA Guide
uccgcccggugcgggugguc

SEQ ID NO: 8994 - RNA, 21 nt, Artificial Sequence
  ELANE RNA Guide
aaacguccgcccggugcgggu

SEQ ID NO: 8995 - RNA, 21 nt, Artificial Sequence
  ELANE RNA Guide
aacguccgcccggugcgggug

SEQ ID NO: 8996 - RNA, 21 nt, Artificial Sequence
  ELANE RNA Guide
acccgcaccgggcggacguuu

SEQ ID NO: 8997 - RNA, 21 nt, Artificial Sequence
  ELANE RNA Guide
accgggcggacguuucugccg

SEQ ID NO: 8998 - RNA, 21 nt, Artificial Sequence
  ELANE RNA Guide
agaaacguccgcccggugcgg

SEQ ID NO: 8999 - RNA, 21 nt, Artificial Sequence
  ELANE RNA Guide
cacccgcaccgggcggacguu

SEQ ID NO: 9000 - RNA, 21 nt, Artificial Sequence
  ELANE RNA Guide
caccgggcggacguuucugcc

SEQ ID NO: 9001 - RNA, 21 nt, Artificial Sequence
  ELANE RNA Guide
cagaaacguccgcccggugcg

SEQ ID NO: 9002 - RNA, 21 nt, Artificial Sequence
  ELANE RNA Guide
ccccggcagaaacguccgccc

SEQ ID NO: 9003 - RNA, 21 nt, Artificial Sequence
  ELANE RNA Guide
cccgcaccgggcggacguuuc

SEQ ID NO: 9004 - RNA, 21 nt, Artificial Sequence
  ELANE RNA Guide
cccggcagaaacguccgcccg

SEQ ID NO: 9005 - RNA, 21 nt, Artificial Sequence
  ELANE RNA Guide
ccgcaccgggcggacguuucu

SEQ ID NO: 9006 - RNA, 21 nt, Artificial Sequence
  ELANE RNA Guide
ccggcagaaacguccgcccgg

SEQ ID NO: 9007 - RNA, 21 nt, Artificial Sequence
  ELANE RNA Guide
ccgggcggacguuucugccgg

SEQ ID NO: 9008 - RNA, 21 nt, Artificial Sequence
  ELANE RNA Guide
cgcaccgggcggacguuucug

SEQ ID NO: 9009 - RNA, 21 nt, Artificial Sequence
  ELANE RNA Guide
cggcagaaacguccgcccggu

SEQ ID NO: 9010 - RNA, 21 nt, Artificial Sequence
  ELANE RNA Guide
cgggcggacguuucugccggg

SEQ ID NO: 9011 - RNA, 21 nt, Artificial Sequence
  ELANE RNA Guide
cuccccggcagaaacguccgc

SEQ ID NO: 9012 - RNA, 21 nt, Artificial Sequence
  ELANE RNA Guide
gaaacguccgcccggugcggg

SEQ ID NO: 9013 - RNA, 21 nt, Artificial Sequence
  ELANE RNA Guide
gcaccgggcggacguuucugc

SEQ ID NO: 9014 - RNA, 21 nt, Artificial Sequence
  ELANE RNA Guide
gcagaaacguccgcccggugc

SEQ ID NO: 9015 - RNA, 21 nt, Artificial Sequence
  ELANE RNA Guide
ggcagaaacguccgcccggug

SEQ ID NO: 9016 - RNA, 21 nt, Artificial Sequence
  ELANE RNA Guide
gggcggacguuucugccgggg

SEQ ID NO: 9017 - RNA, 21 nt, Artificial Sequence
  ELANE RNA Guide
ucccaggaccacccgcaccgg

SEQ ID NO: 9018 - RNA, 21 nt, Artificial Sequence
  ELANE RNA Guide
uccccggcagaaacguccgcc

SEQ ID NO: 9019 - RNA, 22 nt, Artificial Sequence
  ELANE RNA Guide
aaacguccgcccggugcgggug

SEQ ID NO: 9020 - RNA, 22 nt, Artificial Sequence
  ELANE RNA Guide
aacguccgcccggugcgggugg

SEQ ID NO: 9021 - RNA, 22 nt, Artificial Sequence
  ELANE RNA Guide
accacccgcaccgggcggacgu

SEQ ID NO: 9022 - RNA, 22 nt, Artificial Sequence
  ELANE RNA Guide
acccgcaccgggcggacguuuc

SEQ ID NO: 9023 - RNA, 22 nt, Artificial Sequence
  ELANE RNA Guide
accgggcggacguuucugccgg

SEQ ID NO: 9024 - RNA, 22 nt, Artificial Sequence
  ELANE RNA Guide
acguccgcccggugcggguggu

SEQ ID NO: 9025 - RNA, 22 nt, Artificial Sequence
  ELANE RNA Guide
agaaacguccgcccggugcggg

SEQ ID NO: 9026 - RNA, 22 nt, Artificial Sequence
  ELANE RNA Guide
aggaccacccgcaccgggcgga

SEQ ID NO: 9027 - RNA, 22 nt, Artificial Sequence
  ELANE RNA Guide
cacccgcaccgggcggacguuu

SEQ ID NO: 9028 - RNA, 22 nt, Artificial Sequence
  ELANE RNA Guide
caccgggcggacguuucugccg

SEQ ID NO: 9029 - RNA, 22 nt, Artificial Sequence
  ELANE RNA Guide
cagaaacguccgcccggugcgg

SEQ ID NO: 9030 - RNA, 22 nt, Artificial Sequence
  ELANE RNA Guide
ccacccgcaccgggcggacguu

SEQ ID NO: 9031 - RNA, 22 nt, Artificial Sequence
  ELANE RNA Guide
ccccggcagaaacguccgcccg

SEQ ID NO: 9032 - RNA, 22 nt, Artificial Sequence
  ELANE RNA Guide
cccgcaccgggcggacguuucu

SEQ ID NO: 9033 - RNA, 22 nt, Artificial Sequence
  ELANE RNA Guide
cccggcagaaacguccgcccgg

SEQ ID NO: 9034 - RNA, 22 nt, Artificial Sequence
  ELANE RNA Guide
cccggugcgggugguccuggga

SEQ ID NO: 9035 - RNA, 22 nt, Artificial Sequence
  ELANE RNA Guide
ccgcaccgggcggacguuucug

SEQ ID NO: 9036 - RNA, 22 nt, Artificial Sequence
  ELANE RNA Guide
ccggcagaaacguccgcccggu

SEQ ID NO: 9037 - RNA, 22 nt, Artificial Sequence
  ELANE RNA Guide
ccgggcggacguuucugccggg

SEQ ID NO: 9038 - RNA, 22 nt, Artificial Sequence
  ELANE RNA Guide
ccuccccggcagaaacguccgc

SEQ ID NO: 9039 - RNA, 22 nt, Artificial Sequence
  ELANE RNA Guide
cgcaccgggcggacguuucugc

SEQ ID NO: 9040 - RNA, 22 nt, Artificial Sequence
  ELANE RNA Guide
cggcagaaacguccgcccggug

SEQ ID NO: 9041 - RNA, 22 nt, Artificial Sequence
  ELANE RNA Guide
cgggcggacguuucugccgggg

SEQ ID NO: 9042 - RNA, 22 nt, Artificial Sequence
  ELANE RNA Guide
cucccaggaccacccgcaccgg

SEQ ID NO: 9043 - RNA, 22 nt, Artificial Sequence
  ELANE RNA Guide
cuccccggcagaaacguccgcc

SEQ ID NO: 9044 - RNA, 22 nt, Artificial Sequence
  ELANE RNA Guide
gaaacguccgcccggugcgggu

SEQ ID NO: 9045 - RNA, 22 nt, Artificial Sequence
  ELANE RNA Guide
gcaccgggcggacguuucugcc

SEQ ID NO: 9046 - RNA, 22 nt, Artificial Sequence
  ELANE RNA Guide
gcagaaacguccgcccggugcg

SEQ ID NO: 9047 - RNA, 22 nt, Artificial Sequence
  ELANE RNA Guide
ggcagaaacguccgcccggugc

SEQ ID NO: 9048 - RNA, 22 nt, Artificial Sequence
  ELANE RNA Guide
gggcggacguuucugccgggga

SEQ ID NO: 9049 - RNA, 22 nt, Artificial Sequence
  ELANE RNA Guide
ucccaggaccacccgcaccggg

SEQ ID NO: 9050 - RNA, 22 nt, Artificial Sequence
  ELANE RNA Guide
uccccggcagaaacguccgccc

SEQ ID NO: 9051 - RNA, 22 nt, Artificial Sequence
  ELANE RNA Guide
uccgcccggugcgggugguccu

SEQ ID NO: 9052 - RNA, 20 nt, Artificial Sequence
  ELANE RNA Guide
aaacguccgcucggugcggg

SEQ ID NO: 9053 - RNA, 20 nt, Artificial Sequence
  ELANE RNA Guide
aacguccgcucggugcgggu

SEQ ID NO: 9054 - RNA, 20 nt, Artificial Sequence
  ELANE RNA Guide
accacccgcaccgagcggac

SEQ ID NO: 9055 - RNA, 20 nt, Artificial Sequence
  ELANE RNA Guide
acccgcaccgagcggacguu

SEQ ID NO: 9056 - RNA, 20 nt, Artificial Sequence
  ELANE RNA Guide
accgagcggacguuucugcc

SEQ ID NO: 9057 - RNA, 20 nt, Artificial Sequence
  ELANE RNA Guide
acguccgcucggugcgggug

SEQ ID NO: 9058 - RNA, 20 nt, Artificial Sequence
  ELANE RNA Guide
agaaacguccgcucggugcg

SEQ ID NO: 9059 - RNA, 20 nt, Artificial Sequence
  ELANE RNA Guide
aggaccacccgcaccgagcg

SEQ ID NO: 9060 - RNA, 20 nt, Artificial Sequence
  ELANE RNA Guide
cacccgcaccgagcggacgu

SEQ ID NO: 9061 - RNA, 20 nt, Artificial Sequence
  ELANE RNA Guide
caccgagcggacguuucugc

SEQ ID NO: 9062 - RNA, 20 nt, Artificial Sequence
  ELANE RNA Guide
cagaaacguccgcucggugc

SEQ ID NO: 9063 - RNA, 20 nt, Artificial Sequence
  ELANE RNA Guide
caggaccacccgcaccgagc

SEQ ID NO: 9064 - RNA, 20 nt, Artificial Sequence
  ELANE RNA Guide
ccacccgcaccgagcggacg

SEQ ID NO: 9065 - RNA, 20 nt, Artificial Sequence
  ELANE RNA Guide
ccaggaccacccgcaccgag

SEQ ID NO: 9066 - RNA, 20 nt, Artificial Sequence
  ELANE RNA Guide
cccaggaccacccgcaccga

SEQ ID NO: 9067 - RNA, 20 nt, Artificial Sequence
  ELANE RNA Guide
ccccggcagaaacguccgcu

SEQ ID NO: 9068 - RNA, 20 nt, Artificial Sequence
  ELANE RNA Guide
cccgcaccgagcggacguuu

SEQ ID NO: 9069 - RNA, 20 nt, Artificial Sequence
  ELANE RNA Guide
cccggcagaaacguccgcuc

SEQ ID NO: 9070 - RNA, 20 nt, Artificial Sequence
  ELANE RNA Guide
ccgagcggacguuucugccg

SEQ ID NO: 9071 - RNA, 20 nt, Artificial Sequence
  ELANE RNA Guide
ccgcaccgagcggacguuuc

SEQ ID NO: 9072 - RNA, 20 nt, Artificial Sequence
  ELANE RNA Guide
ccgcucggugcggguggucc

SEQ ID NO: 9073 - RNA, 20 nt, Artificial Sequence
  ELANE RNA Guide
ccggcagaaacguccgcucg

SEQ ID NO: 9074 - RNA, 20 nt, Artificial Sequence
  ELANE RNA Guide
cgagcggacguuucugccgg

SEQ ID NO: 9075 - RNA, 20 nt, Artificial Sequence
  ELANE RNA Guide
cgcaccgagcggacguuucu

SEQ ID NO: 9076 - RNA, 20 nt, Artificial Sequence
  ELANE RNA Guide
cgcucggugcgggugguccu

SEQ ID NO: 9077 - RNA, 20 nt, Artificial Sequence
  ELANE RNA Guide
cggcagaaacguccgcucgg

SEQ ID NO: 9078 - RNA, 20 nt, Artificial Sequence
  ELANE RNA Guide
cguccgcucggugcgggugg

SEQ ID NO: 9079 - RNA, 20 nt, Artificial Sequence
  ELANE RNA Guide
cucggugcgggugguccugg

SEQ ID NO: 9080 - RNA, 20 nt, Artificial Sequence
  ELANE RNA Guide
gaaacguccgcucggugcgg

SEQ ID NO: 9081 - RNA, 20 nt, Artificial Sequence
  ELANE RNA Guide
gaccacccgcaccgagcgga

SEQ ID NO: 9082 - RNA, 20 nt, Artificial Sequence
  ELANE RNA Guide
gagcggacguuucugccggg

SEQ ID NO: 9083 - RNA, 20 nt, Artificial Sequence
  ELANE RNA Guide
gcaccgagcggacguuucug

SEQ ID NO: 9084 - RNA, 20 nt, Artificial Sequence
  ELANE RNA Guide
gcagaaacguccgcucggug

SEQ ID NO: 9085 - RNA, 20 nt, Artificial Sequence
  ELANE RNA Guide
gcucggugcgggugguccug

SEQ ID NO: 9086 - RNA, 20 nt, Artificial Sequence
  ELANE RNA Guide
ggaccacccgcaccgagcgg

SEQ ID NO: 9087 - RNA, 20 nt, Artificial Sequence
  ELANE RNA Guide
ggcagaaacguccgcucggu

SEQ ID NO: 9088 - RNA, 20 nt, Artificial Sequence
  ELANE RNA Guide
guccgcucggugcggguggu

SEQ ID NO: 9089 - RNA, 20 nt, Artificial Sequence
  ELANE RNA Guide
uccgcucggugcgggugguc

SEQ ID NO: 9090 - RNA, 21 nt, Artificial Sequence
  ELANE RNA Guide
aaacguccgcucggugcgggu

SEQ ID NO: 9091 - RNA, 21 nt, Artificial Sequence
  ELANE RNA Guide
aacguccgcucggugcgggug

SEQ ID NO: 9092 - RNA, 21 nt, Artificial Sequence
  ELANE RNA Guide
accacccgcaccgagcggacg

SEQ ID NO: 9093 - RNA, 21 nt, Artificial Sequence
  ELANE RNA Guide
acccgcaccgagcggacguuu

SEQ ID NO: 9094 - RNA, 21 nt, Artificial Sequence
  ELANE RNA Guide
accgagcggacguuucugccg

SEQ ID NO: 9095 - RNA, 21 nt, Artificial Sequence
  ELANE RNA Guide
acguccgcucggugcgggugg

SEQ ID NO: 9096 - RNA, 21 nt, Artificial Sequence
  ELANE RNA Guide
agaaacguccgcucggugcgg

SEQ ID NO: 9097 - RNA, 21 nt, Artificial Sequence
  ELANE RNA Guide
aggaccacccgcaccgagcgg

SEQ ID NO: 9098 - RNA, 21 nt, Artificial Sequence
  ELANE RNA Guide
cacccgcaccgagcggacguu

SEQ ID NO: 9099 - RNA, 21 nt, Artificial Sequence
  ELANE RNA Guide
caccgagcggacguuucugcc

SEQ ID NO: 9100 - RNA, 21 nt, Artificial Sequence
  ELANE RNA Guide
cagaaacguccgcucggugcg

SEQ ID NO: 9101 - RNA, 21 nt, Artificial Sequence
  ELANE RNA Guide
caggaccacccgcaccgagcg

SEQ ID NO: 9102 - RNA, 21 nt, Artificial Sequence
  ELANE RNA Guide
ccacccgcaccgagcggacgu

SEQ ID NO: 9103 - RNA, 21 nt, Artificial Sequence
  ELANE RNA Guide
ccaggaccacccgcaccgagc

SEQ ID NO: 9104 - RNA, 21 nt, Artificial Sequence
  ELANE RNA Guide
cccaggaccacccgcaccgag

SEQ ID NO: 9105 - RNA, 21 nt, Artificial Sequence
  ELANE RNA Guide
ccccggcagaaacguccgcuc

SEQ ID NO: 9106 - RNA, 21 nt, Artificial Sequence
  ELANE RNA Guide
cccgcaccgagcggacguuuc

SEQ ID NO: 9107 - RNA, 21 nt, Artificial Sequence
  ELANE RNA Guide
cccggcagaaacguccgcucg

SEQ ID NO: 9108 - RNA, 21 nt, Artificial Sequence
  ELANE RNA Guide
ccgagcggacguuucugccgg

SEQ ID NO: 9109 - RNA, 21 nt, Artificial Sequence
  ELANE RNA Guide
ccgcaccgagcggacguuucu

SEQ ID NO: 9110 - RNA, 21 nt, Artificial Sequence
  ELANE RNA Guide
ccgcucggugcgggugguccu

SEQ ID NO: 9111 - RNA, 21 nt, Artificial Sequence
  ELANE RNA Guide
ccggcagaaacguccgcucgg

SEQ ID NO: 9112 - RNA, 21 nt, Artificial Sequence
  ELANE RNA Guide
cgagcggacguuucugccggg

SEQ ID NO: 9113 - RNA, 21 nt, Artificial Sequence
  ELANE RNA Guide
cgcaccgagcggacguuucug

SEQ ID NO: 9114 - RNA, 21 nt, Artificial Sequence
  ELANE RNA Guide
cgcucggugcgggugguccug

SEQ ID NO: 9115 - RNA, 21 nt, Artificial Sequence
  ELANE RNA Guide
cggcagaaacguccgcucggu

SEQ ID NO: 9116 - RNA, 21 nt, Artificial Sequence
  ELANE RNA Guide
cguccgcucggugcggguggu

SEQ ID NO: 9117 - RNA, 21 nt, Artificial Sequence
  ELANE RNA Guide
cucggugcgggugguccuggg

SEQ ID NO: 9118 - RNA, 21 nt, Artificial Sequence
  ELANE RNA Guide
gaaacguccgcucggugcggg

SEQ ID NO: 9119 - RNA, 21 nt, Artificial Sequence
  ELANE RNA Guide
gaccacccgcaccgagcggac

SEQ ID NO: 9120 - RNA, 21 nt, Artificial Sequence
  ELANE RNA Guide
gagcggacguuucugccgggg

SEQ ID NO: 9121 - RNA, 21 nt, Artificial Sequence
  ELANE RNA Guide
gcaccgagcggacguuucugc

SEQ ID NO: 9122 - RNA, 21 nt, Artificial Sequence
  ELANE RNA Guide
gcagaaacguccgcucggugc

SEQ ID NO: 9123 - RNA, 21 nt, Artificial Sequence
  ELANE RNA Guide
gcucggugcgggugguccugg

SEQ ID NO: 9124 - RNA, 21 nt, Artificial Sequence
  ELANE RNA Guide
ggaccacccgcaccgagcgga

SEQ ID NO: 9125 - RNA, 21 nt, Artificial Sequence
  ELANE RNA Guide
ggcagaaacguccgcucggug

SEQ ID NO: 9126 - RNA, 21 nt, Artificial Sequence
  ELANE RNA Guide
guccgcucggugcgggugguc

SEQ ID NO: 9127 - RNA, 21 nt, Artificial Sequence
  ELANE RNA Guide
ucccaggaccacccgcaccga

SEQ ID NO: 9128 - RNA, 21 nt, Artificial Sequence
  ELANE RNA Guide
uccccggcagaaacguccgcu

SEQ ID NO: 9129 - RNA, 21 nt, Artificial Sequence
  ELANE RNA Guide
uccgcucggugcggguggucc

SEQ ID NO: 9130 - RNA, 22 nt, Artificial Sequence
  ELANE RNA Guide
aaacguccgcucggugcgggug

SEQ ID NO: 9131 - RNA, 22 nt, Artificial Sequence
  ELANE RNA Guide
aacguccgcucggugcgggugg

SEQ ID NO: 9132 - RNA, 22 nt, Artificial Sequence
  ELANE RNA Guide
accacccgcaccgagcggacgu

SEQ ID NO: 9133 - RNA, 22 nt, Artificial Sequence
  ELANE RNA Guide
acccgcaccgagcggacguuuc

SEQ ID NO: 9134 - RNA, 22 nt, Artificial Sequence
  ELANE RNA Guide
accgagcggacguuucugccgg

SEQ ID NO: 9135 - RNA, 22 nt, Artificial Sequence
  ELANE RNA Guide
acguccgcucggugcggguggu

SEQ ID NO: 9136 - RNA, 22 nt, Artificial Sequence
  ELANE RNA Guide
agaaacguccgcucggugcggg

SEQ ID NO: 9137 - RNA, 22 nt, Artificial Sequence
  ELANE RNA Guide
aggaccacccgcaccgagcgga

SEQ ID NO: 9138 - RNA, 22 nt, Artificial Sequence
  ELANE RNA Guide
cacccgcaccgagcggacguuu

SEQ ID NO: 9139 - RNA, 22 nt, Artificial Sequence
  ELANE RNA Guide
caccgagcggacguuucugccg

SEQ ID NO: 9140 - RNA, 22 nt, Artificial Sequence
  ELANE RNA Guide
cagaaacguccgcucggugcgg

SEQ ID NO: 9141 - RNA, 22 nt, Artificial Sequence
  ELANE RNA Guide
caggaccacccgcaccgagcgg

SEQ ID NO: 9142 - RNA, 22 nt, Artificial Sequence
  ELANE RNA Guide
ccacccgcaccgagcggacguu

SEQ ID NO: 9143 - RNA, 22 nt, Artificial Sequence
  ELANE RNA Guide
ccaggaccacccgcaccgagcg

SEQ ID NO: 9144 - RNA, 22 nt, Artificial Sequence
  ELANE RNA Guide
cccaggaccacccgcaccgagc

SEQ ID NO: 9145 - RNA, 22 nt, Artificial Sequence
  ELANE RNA Guide
ccccggcagaaacguccgcucg

SEQ ID NO: 9146 - RNA, 22 nt, Artificial Sequence
  ELANE RNA Guide
cccgcaccgagcggacguuucu

SEQ ID NO: 9147 - RNA, 22 nt, Artificial Sequence
  ELANE RNA Guide
cccggcagaaacguccgcucgg

SEQ ID NO: 9148 - RNA, 22 nt, Artificial Sequence
  ELANE RNA Guide
ccgagcggacguuucugccggg

SEQ ID NO: 9149 - RNA, 22 nt, Artificial Sequence
  ELANE RNA Guide
ccgcaccgagcggacguuucug

SEQ ID NO: 9150 - RNA, 22 nt, Artificial Sequence
  ELANE RNA Guide
ccgcucggugcgggugguccug

SEQ ID NO: 9151 - RNA, 22 nt, Artificial Sequence
  ELANE RNA Guide
ccggcagaaacguccgcucggu

SEQ ID NO: 9152 - RNA, 22 nt, Artificial Sequence
  ELANE RNA Guide
cgagcggacguuucugccgggg

SEQ ID NO: 9153 - RNA, 22 nt, Artificial Sequence
  ELANE RNA Guide
cgcaccgagcggacguuucugc

SEQ ID NO: 9154 - RNA, 22 nt, Artificial Sequence
  ELANE RNA Guide
cgcucggugcgggugguccugg

SEQ ID NO: 9155 - RNA, 22 nt, Artificial Sequence
  ELANE RNA Guide
cggcagaaacguccgcucggug

SEQ ID NO: 9156 - RNA, 22 nt, Artificial Sequence
  ELANE RNA Guide
cguccgcucggugcgggugguc

SEQ ID NO: 9157 - RNA, 22 nt, Artificial Sequence
  ELANE RNA Guide
cucccaggaccacccgcaccga

SEQ ID NO: 9158 - RNA, 22 nt, Artificial Sequence
  ELANE RNA Guide
cuccccggcagaaacguccgcu

SEQ ID NO: 9159 - RNA, 22 nt, Artificial Sequence
  ELANE RNA Guide
cucggugcgggugguccuggga

SEQ ID NO: 9160 - RNA, 22 nt, Artificial Sequence
  ELANE RNA Guide
gaaacguccgcucggugcgggu

SEQ ID NO: 9161 - RNA, 22 nt, Artificial Sequence
  ELANE RNA Guide
gaccacccgcaccgagcggacg

SEQ ID NO: 9162 - RNA, 22 nt, Artificial Sequence
  ELANE RNA Guide
gagcggacguuucugccgggga

SEQ ID NO: 9163 - RNA, 22 nt, Artificial Sequence
  ELANE RNA Guide
gcaccgagcggacguuucugcc

SEQ ID NO: 9164 - RNA, 22 nt, Artificial Sequence
  ELANE RNA Guide
gcagaaacguccgcucggugcg

SEQ ID NO: 9165 - RNA, 22 nt, Artificial Sequence
  ELANE RNA Guide
gcucggugcgggugguccuggg

SEQ ID NO: 9166 - RNA, 22 nt, Artificial Sequence
  ELANE RNA Guide
ggaccacccgcaccgagcggac

SEQ ID NO: 9167 - RNA, 22 nt, Artificial Sequence
  ELANE RNA Guide
ggcagaaacguccgcucggugc

SEQ ID NO: 9168 - RNA, 22 nt, Artificial Sequence
  ELANE RNA Guide
guccgcucggugcggguggucc

SEQ ID NO: 9169 - RNA, 22 nt, Artificial Sequence
  ELANE RNA Guide
ucccaggaccacccgcaccgag

SEQ ID NO: 9170 - RNA, 22 nt, Artificial Sequence
  ELANE RNA Guide
uccccggcagaaacguccgcuc

SEQ ID NO: 9171 - RNA, 22 nt, Artificial Sequence
  ELANE RNA Guide
uccgcucggugcgggugguccu

SEQ ID NO: 9172 - RNA, 20 nt, Artificial Sequence
  ELANE RNA Guide
aaacguccgcgcgguggucc

SEQ ID NO: 9173 - RNA, 20 nt, Artificial Sequence
  ELANE RNA Guide
aacguccgcgcggugguccu

SEQ ID NO: 9174 - RNA, 20 nt, Artificial Sequence
  ELANE RNA Guide
accaccgcgcggacguuucu

SEQ ID NO: 9175 - RNA, 20 nt, Artificial Sequence
  ELANE RNA Guide
acguccgcgcggugguccug

SEQ ID NO: 9176 - RNA, 20 nt, Artificial Sequence
  ELANE RNA Guide
agaaacguccgcgcgguggu

SEQ ID NO: 9177 - RNA, 20 nt, Artificial Sequence
  ELANE RNA Guide
aggaccaccgcgcggacguu

SEQ ID NO: 9178 - RNA, 20 nt, Artificial Sequence
  ELANE RNA Guide
augggcucccaggaccaccg

SEQ ID NO: 9179 - RNA, 20 nt, Artificial Sequence
  ELANE RNA Guide
cagaaacguccgcgcggugg

SEQ ID NO: 9180 - RNA, 20 nt, Artificial Sequence
  ELANE RNA Guide
caggaccaccgcgcggacgu

SEQ ID NO: 9181 - RNA, 20 nt, Artificial Sequence
  ELANE RNA Guide
ccaccgcgcggacguuucug

SEQ ID NO: 9182 - RNA, 20 nt, Artificial Sequence
  ELANE RNA Guide
ccaggaccaccgcgcggacg

SEQ ID NO: 9183 - RNA, 20 nt, Artificial Sequence
  ELANE RNA Guide
cccaggaccaccgcgcggac

SEQ ID NO: 9184 - RNA, 20 nt, Artificial Sequence
  ELANE RNA Guide
ccgcgcggugguccugggag

SEQ ID NO: 9185 - RNA, 20 nt, Artificial Sequence
  ELANE RNA Guide
ccggcagaaacguccgcgcg

SEQ ID NO: 9186 - RNA, 20 nt, Artificial Sequence
  ELANE RNA Guide
cgcgcggugguccugggagc

SEQ ID NO: 9187 - RNA, 20 nt, Artificial Sequence
  ELANE RNA Guide
cgcggugguccugggagccc

SEQ ID NO: 9188 - RNA, 20 nt, Artificial Sequence
  ELANE RNA Guide
cggcagaaacguccgcgcgg

SEQ ID NO: 9189 - RNA, 20 nt, Artificial Sequence
  ELANE RNA Guide
cguccgcgcggugguccugg

SEQ ID NO: 9190 - RNA, 20 nt, Artificial Sequence
  ELANE RNA Guide
cucccaggaccaccgcgcgg

SEQ ID NO: 9191 - RNA, 20 nt, Artificial Sequence
  ELANE RNA Guide
gaaacguccgcgcggugguc

SEQ ID NO: 9192 - RNA, 20 nt, Artificial Sequence
  ELANE RNA Guide
gaccaccgcgcggacguuuc

SEQ ID NO: 9193 - RNA, 20 nt, Artificial Sequence
  ELANE RNA Guide
gcagaaacguccgcgcggug

SEQ ID NO: 9194 - RNA, 20 nt, Artificial Sequence
  ELANE RNA Guide
gcgcggugguccugggagcc

SEQ ID NO: 9195 - RNA, 20 nt, Artificial Sequence
  ELANE RNA Guide
gcggugguccugggagccca

SEQ ID NO: 9196 - RNA, 20 nt, Artificial Sequence
  ELANE RNA Guide
gcucccaggaccaccgcgcg

SEQ ID NO: 9197 - RNA, 20 nt, Artificial Sequence
  ELANE RNA Guide
ggaccaccgcgcggacguuu

SEQ ID NO: 9198 - RNA, 20 nt, Artificial Sequence
  ELANE RNA Guide
ggcagaaacguccgcgcggu

SEQ ID NO: 9199 - RNA, 20 nt, Artificial Sequence
  ELANE RNA Guide
ggcucccaggaccaccgcgc

SEQ ID NO: 9200 - RNA, 20 nt, Artificial Sequence
  ELANE RNA Guide
gggcucccaggaccaccgcg

SEQ ID NO: 9201 - RNA, 20 nt, Artificial Sequence
  ELANE RNA Guide
gguuaugggcucccaggacc

SEQ ID NO: 9202 - RNA, 20 nt, Artificial Sequence
  ELANE RNA Guide
guccgcgcggugguccuggg

SEQ ID NO: 9203 - RNA, 20 nt, Artificial Sequence
  ELANE RNA Guide
guuaugggcucccaggacca

SEQ ID NO: 9204 - RNA, 20 nt, Artificial Sequence
  ELANE RNA Guide
uaugggcucccaggaccacc

SEQ ID NO: 9205 - RNA, 20 nt, Artificial Sequence
  ELANE RNA Guide
ucccaggaccaccgcgcgga

SEQ ID NO: 9206 - RNA, 20 nt, Artificial Sequence
  ELANE RNA Guide
uccgcgcggugguccuggga

SEQ ID NO: 9207 - RNA, 20 nt, Artificial Sequence
  ELANE RNA Guide
ugggcucccaggaccaccgc

SEQ ID NO: 9208 - RNA, 20 nt, Artificial Sequence
  ELANE RNA Guide
uuaugggcucccaggaccac

SEQ ID NO: 9209 - RNA, 21 nt, Artificial Sequence
  ELANE RNA Guide
aaacguccgcgcggugguccu

SEQ ID NO: 9210 - RNA, 21 nt, Artificial Sequence
  ELANE RNA Guide
aacguccgcgcggugguccug

SEQ ID NO: 9211 - RNA, 21 nt, Artificial Sequence
  ELANE RNA Guide
accaccgcgcggacguuucug

SEQ ID NO: 9212 - RNA, 21 nt, Artificial Sequence
  ELANE RNA Guide
acguccgcgcggugguccugg

SEQ ID NO: 9213 - RNA, 21 nt, Artificial Sequence
  ELANE RNA Guide
agaaacguccgcgcggugguc

SEQ ID NO: 9214 - RNA, 21 nt, Artificial Sequence
  ELANE RNA Guide
aggaccaccgcgcggacguuu

SEQ ID NO: 9215 - RNA, 21 nt, Artificial Sequence
  ELANE RNA Guide
agguuaugggcucccaggacc

SEQ ID NO: 9216 - RNA, 21 nt, Artificial Sequence
  ELANE RNA Guide
augggcucccaggaccaccgc

SEQ ID NO: 9217 - RNA, 21 nt, Artificial Sequence
  ELANE RNA Guide
cagaaacguccgcgcgguggu

SEQ ID NO: 9218 - RNA, 21 nt, Artificial Sequence
  ELANE RNA Guide
caggaccaccgcgcggacguu

SEQ ID NO: 9219 - RNA, 21 nt, Artificial Sequence
  ELANE RNA Guide
ccaccgcgcggacguuucugc

SEQ ID NO: 9220 - RNA, 21 nt, Artificial Sequence
  ELANE RNA Guide
ccaggaccaccgcgcggacgu

SEQ ID NO: 9221 - RNA, 21 nt, Artificial Sequence
  ELANE RNA Guide
cccggcagaaacguccgcgcg

SEQ ID NO: 9222 - RNA, 21 nt, Artificial Sequence
  ELANE RNA Guide
ccggcagaaacguccgcgcgg

SEQ ID NO: 9223 - RNA, 21 nt, Artificial Sequence
  ELANE RNA Guide
cgcggugguccugggagccca

SEQ ID NO: 9224 - RNA, 21 nt, Artificial Sequence
  ELANE RNA Guide
cggcagaaacguccgcgcggu

SEQ ID NO: 9225 - RNA, 21 nt, Artificial Sequence
  ELANE RNA Guide
cucccaggaccaccgcgcgga

SEQ ID NO: 9226 - RNA, 21 nt, Artificial Sequence
  ELANE RNA Guide
gaaacguccgcgcgguggucc

SEQ ID NO: 9227 - RNA, 21 nt, Artificial Sequence
  ELANE RNA Guide
gaccaccgcgcggacguuucu

SEQ ID NO: 9228 - RNA, 21 nt, Artificial Sequence
  ELANE RNA Guide
gcagaaacguccgcgcggugg

SEQ ID NO: 9229 - RNA, 21 nt, Artificial Sequence
  ELANE RNA Guide
gcggugguccugggagcccau

SEQ ID NO: 9230 - RNA, 21 nt, Artificial Sequence
  ELANE RNA Guide
ggaccaccgcgcggacguuuc

SEQ ID NO: 9231 - RNA, 21 nt, Artificial Sequence
  ELANE RNA Guide
ggcagaaacguccgcgcggug

SEQ ID NO: 9232 - RNA, 21 nt, Artificial Sequence
  ELANE RNA Guide
gguuaugggcucccaggacca

SEQ ID NO: 9233 - RNA, 21 nt, Artificial Sequence
  ELANE RNA Guide
guccgcgcggugguccuggga

SEQ ID NO: 9234 - RNA, 21 nt, Artificial Sequence
  ELANE RNA Guide
guuaugggcucccaggaccac

SEQ ID NO: 9235 - RNA, 21 nt, Artificial Sequence
  ELANE RNA Guide
uaugggcucccaggaccaccg

SEQ ID NO: 9236 - RNA, 21 nt, Artificial Sequence
  ELANE RNA Guide
ucccaggaccaccgcgcggac

SEQ ID NO: 9237 - RNA, 21 nt, Artificial Sequence
  ELANE RNA Guide
uccgcgcggugguccugggag

SEQ ID NO: 9238 - RNA, 21 nt, Artificial Sequence
  ELANE RNA Guide
ugggcucccaggaccaccgcg

SEQ ID NO: 9239 - RNA, 21 nt, Artificial Sequence
  ELANE RNA Guide
uuaugggcucccaggaccacc

SEQ ID NO: 9240 - RNA, 22 nt, Artificial Sequence
  ELANE RNA Guide
aaacguccgcgcggugguccug

SEQ ID NO: 9241 - RNA, 22 nt, Artificial Sequence
  ELANE RNA Guide
aacguccgcgcggugguccugg

SEQ ID NO: 9242 - RNA, 22 nt, Artificial Sequence
  ELANE RNA Guide
accaccgcgcggacguuucugc

SEQ ID NO: 9243 - RNA, 22 nt, Artificial Sequence
  ELANE RNA Guide
acguccgcgcggugguccuggg

SEQ ID NO: 9244 - RNA, 22 nt, Artificial Sequence
  ELANE RNA Guide
agaaacguccgcgcgguggucc

SEQ ID NO: 9245 - RNA, 22 nt, Artificial Sequence
  ELANE RNA Guide
aggaccaccgcgcggacguuuc

SEQ ID NO: 9246 - RNA, 22 nt, Artificial Sequence
  ELANE RNA Guide
agguuaugggcucccaggacca

SEQ ID NO: 9247 - RNA, 22 nt, Artificial Sequence
  ELANE RNA Guide
augggcucccaggaccaccgcg

SEQ ID NO: 9248 - RNA, 22 nt, Artificial Sequence
  ELANE RNA Guide
cagaaacguccgcgcggugguc

SEQ ID NO: 9249 - RNA, 22 nt, Artificial Sequence
  ELANE RNA Guide
caggaccaccgcgcggacguuu

SEQ ID NO: 9250 - RNA, 22 nt, Artificial Sequence
  ELANE RNA Guide
ccaccgcgcggacguuucugcc

SEQ ID NO: 9251 - RNA, 22 nt, Artificial Sequence
  ELANE RNA Guide
ccaggaccaccgcgcggacguu

SEQ ID NO: 9252 - RNA, 22 nt, Artificial Sequence
  ELANE RNA Guide
cccaggaccaccgcgcggacgu

SEQ ID NO: 9253 - RNA, 22 nt, Artificial Sequence
  ELANE RNA Guide
ccccggcagaaacguccgcgcg

SEQ ID NO: 9254 - RNA, 22 nt, Artificial Sequence
  ELANE RNA Guide
cccggcagaaacguccgcgcgg

SEQ ID NO: 9255 - RNA, 22 nt, Artificial Sequence
  ELANE RNA Guide
ccggcagaaacguccgcgcggu

SEQ ID NO: 9256 - RNA, 22 nt, Artificial Sequence
  ELANE RNA Guide
cgcggugguccugggagcccau

SEQ ID NO: 9257 - RNA, 22 nt, Artificial Sequence
  ELANE RNA Guide
cggcagaaacguccgcgcggug

SEQ ID NO: 9258 - RNA, 22 nt, Artificial Sequence
  ELANE RNA Guide
cguccgcgcggugguccuggga

SEQ ID NO: 9259 - RNA, 22 nt, Artificial Sequence
  ELANE RNA Guide
cucccaggaccaccgcgcggac

SEQ ID NO: 9260 - RNA, 22 nt, Artificial Sequence
  ELANE RNA Guide
gaaacguccgcgcggugguccu

SEQ ID NO: 9261 - RNA, 22 nt, Artificial Sequence
  ELANE RNA Guide
gaccaccgcgcggacguuucug

SEQ ID NO: 9262 - RNA, 22 nt, Artificial Sequence
  ELANE RNA Guide
gagguuaugggcucccaggacc

SEQ ID NO: 9263 - RNA, 22 nt, Artificial Sequence
  ELANE RNA Guide
gcagaaacguccgcgcgguggu

SEQ ID NO: 9264 - RNA, 22 nt, Artificial Sequence
  ELANE RNA Guide
gcgcggugguccugggagccca

SEQ ID NO: 9265 - RNA, 22 nt, Artificial Sequence
  ELANE RNA Guide
gcggugguccugggagcccaua

SEQ ID NO: 9266 - RNA, 22 nt, Artificial Sequence
  ELANE RNA Guide
gcucccaggaccaccgcgcgga

SEQ ID NO: 9267 - RNA, 22 nt, Artificial Sequence
  ELANE RNA Guide
ggaccaccgcgcggacguuucu

SEQ ID NO: 9268 - RNA, 22 nt, Artificial Sequence
  ELANE RNA Guide
ggcagaaacguccgcgcggugg

SEQ ID NO: 9269 - RNA, 22 nt, Artificial Sequence
  ELANE RNA Guide
gguuaugggcucccaggaccac

SEQ ID NO: 9270 - RNA, 22 nt, Artificial Sequence
  ELANE RNA Guide
guccgcgcggugguccugggag

SEQ ID NO: 9271 - RNA, 22 nt, Artificial Sequence
  ELANE RNA Guide
guuaugggcucccaggaccacc

SEQ ID NO: 9272 - RNA, 22 nt, Artificial Sequence
  ELANE RNA Guide
uaugggcucccaggaccaccgc

SEQ ID NO: 9273 - RNA, 22 nt, Artificial Sequence
  ELANE RNA Guide
ucccaggaccaccgcgcggacg

SEQ ID NO: 9274 - RNA, 22 nt, Artificial Sequence
  ELANE RNA Guide
uccgcgcggugguccugggagc

SEQ ID NO: 9275 - RNA, 22 nt, Artificial Sequence
  ELANE RNA Guide
ugggcucccaggaccaccgcgc

SEQ ID NO: 9276 - RNA, 22 nt, Artificial Sequence
  ELANE RNA Guide
uuaugggcucccaggaccaccg

SEQ ID NO: 9277 - RNA, 20 nt, Artificial Sequence
  ELANE RNA Guide
aaacguccgcgcggggcggg

SEQ ID NO: 9278 - RNA, 20 nt, Artificial Sequence
  ELANE RNA Guide
aacguccgcgcggggcgggu

SEQ ID NO: 9279 - RNA, 20 nt, Artificial Sequence
  ELANE RNA Guide
acccgccccgcgcggacguu

SEQ ID NO: 9280 - RNA, 20 nt, Artificial Sequence
  ELANE RNA Guide
agaaacguccgcgcggggcg

SEQ ID NO: 9281 - RNA, 20 nt, Artificial Sequence
  ELANE RNA Guide
augggcucccaggaccaccc

SEQ ID NO: 9282 - RNA, 20 nt, Artificial Sequence
  ELANE RNA Guide
cagaaacguccgcgcggggc

SEQ ID NO: 9283 - RNA, 20 nt, Artificial Sequence
  ELANE RNA Guide
ccccgcgcggacguuucugc

SEQ ID NO: 9284 - RNA, 20 nt, Artificial Sequence
  ELANE RNA Guide
ccccggcagaaacguccgcg

SEQ ID NO: 9285 - RNA, 20 nt, Artificial Sequence
  ELANE RNA Guide
cccgccccgcgcggacguuu

SEQ ID NO: 9286 - RNA, 20 nt, Artificial Sequence
  ELANE RNA Guide
cccggcagaaacguccgcgc

SEQ ID NO: 9287 - RNA, 20 nt, Artificial Sequence
  ELANE RNA Guide
ccgccccgcgcggacguuuc

SEQ ID NO: 9288 - RNA, 20 nt, Artificial Sequence
  ELANE RNA Guide
cgccccgcgcggacguuucu

SEQ ID NO: 9289 - RNA, 20 nt, Artificial Sequence
  ELANE RNA Guide
cggggcgggugguccuggga

SEQ ID NO: 9290 - RNA, 20 nt, Artificial Sequence
  ELANE RNA Guide
cucccaggaccacccgcccc

SEQ ID NO: 9291 - RNA, 20 nt, Artificial Sequence
  ELANE RNA Guide
gaaacguccgcgcggggcgg

SEQ ID NO: 9292 - RNA, 20 nt, Artificial Sequence
  ELANE RNA Guide
gcagaaacguccgcgcgggg

SEQ ID NO: 9293 - RNA, 20 nt, Artificial Sequence
  ELANE RNA Guide
gccccgcgcggacguuucug

SEQ ID NO: 9294 - RNA, 20 nt, Artificial Sequence
  ELANE RNA Guide
gcucccaggaccacccgccc

SEQ ID NO: 9295 - RNA, 20 nt, Artificial Sequence
  ELANE RNA Guide
ggcagaaacguccgcgcggg

SEQ ID NO: 9296 - RNA, 20 nt, Artificial Sequence
  ELANE RNA Guide
ggcucccaggaccacccgcc

SEQ ID NO: 9297 - RNA, 20 nt, Artificial Sequence
  ELANE RNA Guide
gggcgggugguccugggagc

SEQ ID NO: 9298 - RNA, 20 nt, Artificial Sequence
  ELANE RNA Guide
ggggcgggugguccugggag

SEQ ID NO: 9299 - RNA, 20 nt, Artificial Sequence
  ELANE RNA Guide
ucccaggaccacccgccccg

SEQ ID NO: 9300 - RNA, 21 nt, Artificial Sequence
  ELANE RNA Guide
aaacguccgcgcggggcgggu

SEQ ID NO: 9301 - RNA, 21 nt, Artificial Sequence
  ELANE RNA Guide
acccgccccgcgcggacguuu

SEQ ID NO: 9302 - RNA, 21 nt, Artificial Sequence
  ELANE RNA Guide
agaaacguccgcgcggggcgg

SEQ ID NO: 9303 - RNA, 21 nt, Artificial Sequence
  ELANE RNA Guide
cagaaacguccgcgcggggcg

SEQ ID NO: 9304 - RNA, 21 nt, Artificial Sequence
  ELANE RNA Guide
ccccgcgcggacguuucugcc

SEQ ID NO: 9305 - RNA, 21 nt, Artificial Sequence
  ELANE RNA Guide
ccccggcagaaacguccgcgc

SEQ ID NO: 9306 - RNA, 21 nt, Artificial Sequence
  ELANE RNA Guide
ccgccccgcgcggacguuucu

SEQ ID NO: 9307 - RNA, 21 nt, Artificial Sequence
  ELANE RNA Guide
cgccccgcgcggacguuucug

SEQ ID NO: 9308 - RNA, 21 nt, Artificial Sequence
  ELANE RNA Guide
cggcagaaacguccgcgcggg

SEQ ID NO: 9309 - RNA, 21 nt, Artificial Sequence
  ELANE RNA Guide
gcagaaacguccgcgcggggc

SEQ ID NO: 9310 - RNA, 21 nt, Artificial Sequence
  ELANE RNA Guide
gccccgcgcggacguuucugc

SEQ ID NO: 9311 - RNA, 21 nt, Artificial Sequence
  ELANE RNA Guide
ggcagaaacguccgcgcgggg

SEQ ID NO: 9312 - RNA, 21 nt, Artificial Sequence
  ELANE RNA Guide
uaugggcucccaggaccaccc

SEQ ID NO: 9313 - RNA, 21 nt, Artificial Sequence
  ELANE RNA Guide
uccccggcagaaacguccgcg

SEQ ID NO: 9314 - RNA, 22 nt, Artificial Sequence
  ELANE RNA Guide
aaacguccgcgcggggcgggug

SEQ ID NO: 9315 - RNA, 22 nt, Artificial Sequence
  ELANE RNA Guide
acccgccccgcgcggacguuuc

SEQ ID NO: 9316 - RNA, 22 nt, Artificial Sequence
  ELANE RNA Guide
agaaacguccgcgcggggcggg

SEQ ID NO: 9317 - RNA, 22 nt, Artificial Sequence
  ELANE RNA Guide
cacccgccccgcgcggacguuu

SEQ ID NO: 9318 - RNA, 22 nt, Artificial Sequence
  ELANE RNA Guide
cagaaacguccgcgcggggcgg

SEQ ID NO: 9319 - RNA, 22 nt, Artificial Sequence
  ELANE RNA Guide
ccccgcgcggacguuucugccg

SEQ ID NO: 9320 - RNA, 22 nt, Artificial Sequence
  ELANE RNA Guide
cccgccccgcgcggacguuucu

SEQ ID NO: 9321 - RNA, 22 nt, Artificial Sequence
  ELANE RNA Guide
ccgccccgcgcggacguuucug

SEQ ID NO: 9322 - RNA, 22 nt, Artificial Sequence
  ELANE RNA Guide
ccggcagaaacguccgcgcggg

SEQ ID NO: 9323 - RNA, 22 nt, Artificial Sequence
  ELANE RNA Guide
cgccccgcgcggacguuucugc

SEQ ID NO: 9324 - RNA, 22 nt, Artificial Sequence
  ELANE RNA Guide
cggcagaaacguccgcgcgggg

SEQ ID NO: 9325 - RNA, 22 nt, Artificial Sequence
  ELANE RNA Guide
cuccccggcagaaacguccgcg

SEQ ID NO: 9326 - RNA, 22 nt, Artificial Sequence
  ELANE RNA Guide
gaaacguccgcgcggggcgggu

SEQ ID NO: 9327 - RNA, 22 nt, Artificial Sequence
  ELANE RNA Guide
gcagaaacguccgcgcggggcg

SEQ ID NO: 9328 - RNA, 22 nt, Artificial Sequence
  ELANE RNA Guide
gccccgcgcggacguuucugcc

SEQ ID NO: 9329 - RNA, 22 nt, Artificial Sequence
  ELANE RNA Guide
ggcagaaacguccgcgcggggc

SEQ ID NO: 9330 - RNA, 22 nt, Artificial Sequence
  ELANE RNA Guide
uccccggcagaaacguccgcgc

SEQ ID NO: 9331 - RNA, 22 nt, Artificial Sequence
  ELANE RNA Guide
ugggcucccaggaccacccgcc

SEQ ID NO: 9332 - RNA, 22 nt, Artificial Sequence
  ELANE RNA Guide
uuaugggcucccaggaccaccc

SEQ ID NO: 9333 - RNA, 20 nt, Artificial Sequence
  ELANE RNA Guide
aaacguccgcgcgguguggg

SEQ ID NO: 9334 - RNA, 20 nt, Artificial Sequence
  ELANE RNA Guide
aacguccgcgcggugugggu

SEQ ID NO: 9335 - RNA, 20 nt, Artificial Sequence
  ELANE RNA Guide
accacccacaccgcgcggac

SEQ ID NO: 9336 - RNA, 20 nt, Artificial Sequence
  ELANE RNA Guide
acccacaccgcgcggacguu

SEQ ID NO: 9337 - RNA, 20 nt, Artificial Sequence
  ELANE RNA Guide
acguccgcgcggugugggug

SEQ ID NO: 9338 - RNA, 20 nt, Artificial Sequence
  ELANE RNA Guide
agaaacguccgcgcggugug

SEQ ID NO: 9339 - RNA, 20 nt, Artificial Sequence
  ELANE RNA Guide
aggaccacccacaccgcgcg

SEQ ID NO: 9340 - RNA, 20 nt, Artificial Sequence
  ELANE RNA Guide
cacaccgcgcggacguuucu

SEQ ID NO: 9341 - RNA, 20 nt, Artificial Sequence
  ELANE RNA Guide
cacccacaccgcgcggacgu

SEQ ID NO: 9342 - RNA, 20 nt, Artificial Sequence
  ELANE RNA Guide
cagaaacguccgcgcggugu

SEQ ID NO: 9343 - RNA, 20 nt, Artificial Sequence
  ELANE RNA Guide
caggaccacccacaccgcgc

SEQ ID NO: 9344 - RNA, 20 nt, Artificial Sequence
  ELANE RNA Guide
ccacaccgcgcggacguuuc

SEQ ID NO: 9345 - RNA, 20 nt, Artificial Sequence
  ELANE RNA Guide
ccacccacaccgcgcggacg

SEQ ID NO: 9346 - RNA, 20 nt, Artificial Sequence
  ELANE RNA Guide
ccaggaccacccacaccgcg

SEQ ID NO: 9347 - RNA, 20 nt, Artificial Sequence
  ELANE RNA Guide
cccacaccgcgcggacguuu

SEQ ID NO: 9348 - RNA, 20 nt, Artificial Sequence
  ELANE RNA Guide
cccaggaccacccacaccgc

SEQ ID NO: 9349 - RNA, 20 nt, Artificial Sequence
  ELANE RNA Guide
ccgcgcgguguggguggucc

SEQ ID NO: 9350 - RNA, 20 nt, Artificial Sequence
  ELANE RNA Guide
cgcgcggugugggugguccu

SEQ ID NO: 9351 - RNA, 20 nt, Artificial Sequence
  ELANE RNA Guide
cgcggugugggugguccugg

SEQ ID NO: 9352 - RNA, 20 nt, Artificial Sequence
  ELANE RNA Guide
cggugugggugguccuggga

SEQ ID NO: 9353 - RNA, 20 nt, Artificial Sequence
  ELANE RNA Guide
cguccgcgcggugugggugg

SEQ ID NO: 9354 - RNA, 20 nt, Artificial Sequence
  ELANE RNA Guide
cucccaggaccacccacacc

SEQ ID NO: 9355 - RNA, 20 nt, Artificial Sequence
  ELANE RNA Guide
gaaacguccgcgcggugugg

SEQ ID NO: 9356 - RNA, 20 nt, Artificial Sequence
  ELANE RNA Guide
gaccacccacaccgcgcgga

SEQ ID NO: 9357 - RNA, 20 nt, Artificial Sequence
  ELANE RNA Guide
gcgcggugugggugguccug

SEQ ID NO: 9358 - RNA, 20 nt, Artificial Sequence
  ELANE RNA Guide
gcggugugggugguccuggg

SEQ ID NO: 9359 - RNA, 20 nt, Artificial Sequence
  ELANE RNA Guide
gcucccaggaccacccacac

SEQ ID NO: 9360 - RNA, 20 nt, Artificial Sequence
  ELANE RNA Guide
ggaccacccacaccgcgcgg

SEQ ID NO: 9361 - RNA, 20 nt, Artificial Sequence
  ELANE RNA Guide
ggcucccaggaccacccaca

SEQ ID NO: 9362 - RNA, 20 nt, Artificial Sequence
  ELANE RNA Guide
gggcucccaggaccacccac

SEQ ID NO: 9363 - RNA, 20 nt, Artificial Sequence
  ELANE RNA Guide
ggugugggugguccugggag

SEQ ID NO: 9364 - RNA, 20 nt, Artificial Sequence
  ELANE RNA Guide
guccgcgcgguguggguggu

SEQ ID NO: 9365 - RNA, 20 nt, Artificial Sequence
  ELANE RNA Guide
gugggugguccugggagccc

SEQ ID NO: 9366 - RNA, 20 nt, Artificial Sequence
  ELANE RNA Guide
gugugggugguccugggagc

SEQ ID NO: 9367 - RNA, 20 nt, Artificial Sequence
  ELANE RNA Guide
ucccaggaccacccacaccg

SEQ ID NO: 9368 - RNA, 20 nt, Artificial Sequence
  ELANE RNA Guide
uccgcgcggugugggugguc

SEQ ID NO: 9369 - RNA, 20 nt, Artificial Sequence
  ELANE RNA Guide
ugggcucccaggaccaccca

SEQ ID NO: 9370 - RNA, 20 nt, Artificial Sequence
  ELANE RNA Guide
ugugggugguccugggagcc

SEQ ID NO: 9371 - RNA, 21 nt, Artificial Sequence
  ELANE RNA Guide
aaacguccgcgcggugugggu

SEQ ID NO: 9372 - RNA, 21 nt, Artificial Sequence
  ELANE RNA Guide
aacguccgcgcggugugggug

SEQ ID NO: 9373 - RNA, 21 nt, Artificial Sequence
  ELANE RNA Guide
accacccacaccgcgcggacg

SEQ ID NO: 9374 - RNA, 21 nt, Artificial Sequence
  ELANE RNA Guide
acccacaccgcgcggacguuu

SEQ ID NO: 9375 - RNA, 21 nt, Artificial Sequence
  ELANE RNA Guide
acguccgcgcggugugggugg

SEQ ID NO: 9376 - RNA, 21 nt, Artificial Sequence
  ELANE RNA Guide
agaaacguccgcgcggugugg

SEQ ID NO: 9377 - RNA, 21 nt, Artificial Sequence
  ELANE RNA Guide
aggaccacccacaccgcgcgg

SEQ ID NO: 9378 - RNA, 21 nt, Artificial Sequence
  ELANE RNA Guide
augggcucccaggaccaccca

SEQ ID NO: 9379 - RNA, 21 nt, Artificial Sequence
  ELANE RNA Guide
cacaccgcgcggacguuucug

SEQ ID NO: 9380 - RNA, 21 nt, Artificial Sequence
  ELANE RNA Guide
cacccacaccgcgcggacguu

SEQ ID NO: 9381 - RNA, 21 nt, Artificial Sequence
  ELANE RNA Guide
cagaaacguccgcgcggugug

SEQ ID NO: 9382 - RNA, 21 nt, Artificial Sequence
  ELANE RNA Guide
caggaccacccacaccgcgcg

SEQ ID NO: 9383 - RNA, 21 nt, Artificial Sequence
  ELANE RNA Guide
ccacaccgcgcggacguuucu

SEQ ID NO: 9384 - RNA, 21 nt, Artificial Sequence
  ELANE RNA Guide
ccacccacaccgcgcggacgu

SEQ ID NO: 9385 - RNA, 21 nt, Artificial Sequence
  ELANE RNA Guide
ccaggaccacccacaccgcgc

SEQ ID NO: 9386 - RNA, 21 nt, Artificial Sequence
  ELANE RNA Guide
cccacaccgcgcggacguuuc

SEQ ID NO: 9387 - RNA, 21 nt, Artificial Sequence
  ELANE RNA Guide
cccaggaccacccacaccgcg

SEQ ID NO: 9388 - RNA, 21 nt, Artificial Sequence
  ELANE RNA Guide
ccgcgcggugugggugguccu

SEQ ID NO: 9389 - RNA, 21 nt, Artificial Sequence
  ELANE RNA Guide
cgcgcggugugggugguccug

SEQ ID NO: 9390 - RNA, 21 nt, Artificial Sequence
  ELANE RNA Guide
cgcggugugggugguccuggg

SEQ ID NO: 9391 - RNA, 21 nt, Artificial Sequence
  ELANE RNA Guide
cggugugggugguccugggag

SEQ ID NO: 9392 - RNA, 21 nt, Artificial Sequence
  ELANE RNA Guide
cguccgcgcgguguggguggu

SEQ ID NO: 9393 - RNA, 21 nt, Artificial Sequence
  ELANE RNA Guide
cucccaggaccacccacaccg

SEQ ID NO: 9394 - RNA, 21 nt, Artificial Sequence
  ELANE RNA Guide
gaaacguccgcgcgguguggg

SEQ ID NO: 9395 - RNA, 21 nt, Artificial Sequence
  ELANE RNA Guide
gaccacccacaccgcgcggac

SEQ ID NO: 9396 - RNA, 21 nt, Artificial Sequence
  ELANE RNA Guide
gcagaaacguccgcgcggugu

SEQ ID NO: 9397 - RNA, 21 nt, Artificial Sequence
  ELANE RNA Guide
gcgcggugugggugguccugg

SEQ ID NO: 9398 - RNA, 21 nt, Artificial Sequence
  ELANE RNA Guide
gcggugugggugguccuggga

SEQ ID NO: 9399 - RNA, 21 nt, Artificial Sequence
  ELANE RNA Guide
gcucccaggaccacccacacc

SEQ ID NO: 9400 - RNA, 21 nt, Artificial Sequence
  ELANE RNA Guide
ggaccacccacaccgcgcgga

SEQ ID NO: 9401 - RNA, 21 nt, Artificial Sequence
  ELANE RNA Guide
ggcucccaggaccacccacac

SEQ ID NO: 9402 - RNA, 21 nt, Artificial Sequence
  ELANE RNA Guide
gggcucccaggaccacccaca

SEQ ID NO: 9403 - RNA, 21 nt, Artificial Sequence
  ELANE RNA Guide
ggugugggugguccugggagc

SEQ ID NO: 9404 - RNA, 21 nt, Artificial Sequence
  ELANE RNA Guide
guccgcgcggugugggugguc

SEQ ID NO: 9405 - RNA, 21 nt, Artificial Sequence
  ELANE RNA Guide
gugggugguccugggagccca

SEQ ID NO: 9406 - RNA, 21 nt, Artificial Sequence
  ELANE RNA Guide
gugugggugguccugggagcc

SEQ ID NO: 9407 - RNA, 21 nt, Artificial Sequence
  ELANE RNA Guide
ucccaggaccacccacaccgc

SEQ ID NO: 9408 - RNA, 21 nt, Artificial Sequence
  ELANE RNA Guide
uccgcgcgguguggguggucc

SEQ ID NO: 9409 - RNA, 21 nt, Artificial Sequence
  ELANE RNA Guide
ugggcucccaggaccacccac

SEQ ID NO: 9410 - RNA, 21 nt, Artificial Sequence
  ELANE RNA Guide
ugugggugguccugggagccc

SEQ ID NO: 9411 - RNA, 22 nt, Artificial Sequence
  ELANE RNA Guide
aaacguccgcgcggugugggug

SEQ ID NO: 9412 - RNA, 22 nt, Artificial Sequence
  ELANE RNA Guide
aacguccgcgcggugugggugg

SEQ ID NO: 9413 - RNA, 22 nt, Artificial Sequence
  ELANE RNA Guide
accacccacaccgcgcggacgu

SEQ ID NO: 9414 - RNA, 22 nt, Artificial Sequence
  ELANE RNA Guide
acccacaccgcgcggacguuuc

SEQ ID NO: 9415 - RNA, 22 nt, Artificial Sequence
  ELANE RNA Guide
acguccgcgcgguguggguggu

SEQ ID NO: 9416 - RNA, 22 nt, Artificial Sequence
  ELANE RNA Guide
agaaacguccgcgcgguguggg

SEQ ID NO: 9417 - RNA, 22 nt, Artificial Sequence
  ELANE RNA Guide
aggaccacccacaccgcgcgga

SEQ ID NO: 9418 - RNA, 22 nt, Artificial Sequence
  ELANE RNA Guide
augggcucccaggaccacccac

SEQ ID NO: 9419 - RNA, 22 nt, Artificial Sequence
  ELANE RNA Guide
cacaccgcgcggacguuucugc

SEQ ID NO: 9420 - RNA, 22 nt, Artificial Sequence
  ELANE RNA Guide
cacccacaccgcgcggacguuu

SEQ ID NO: 9421 - RNA, 22 nt, Artificial Sequence
  ELANE RNA Guide
cagaaacguccgcgcggugugg

SEQ ID NO: 9422 - RNA, 22 nt, Artificial Sequence
  ELANE RNA Guide
caggaccacccacaccgcgcgg

SEQ ID NO: 9423 - RNA, 22 nt, Artificial Sequence
  ELANE RNA Guide
ccacaccgcgcggacguuucug

SEQ ID NO: 9424 - RNA, 22 nt, Artificial Sequence
  ELANE RNA Guide
ccacccacaccgcgcggacguu

SEQ ID NO: 9425 - RNA, 22 nt, Artificial Sequence
  ELANE RNA Guide
ccaggaccacccacaccgcgcg

SEQ ID NO: 9426 - RNA, 22 nt, Artificial Sequence
  ELANE RNA Guide
cccacaccgcgcggacguuucu

SEQ ID NO: 9427 - RNA, 22 nt, Artificial Sequence
  ELANE RNA Guide
cccaggaccacccacaccgcgc

SEQ ID NO: 9428 - RNA, 22 nt, Artificial Sequence
  ELANE RNA Guide
ccgcgcggugugggugguccug

SEQ ID NO: 9429 - RNA, 22 nt, Artificial Sequence
  ELANE RNA Guide
cgcgcggugugggugguccugg

SEQ ID NO: 9430 - RNA, 22 nt, Artificial Sequence
  ELANE RNA Guide
cgcggugugggugguccuggga

SEQ ID NO: 9431 - RNA, 22 nt, Artificial Sequence
  ELANE RNA Guide
cggugugggugguccugggagc

SEQ ID NO: 9432 - RNA, 22 nt, Artificial Sequence
  ELANE RNA Guide
cguccgcgcggugugggugguc

SEQ ID NO: 9433 - RNA, 22 nt, Artificial Sequence
  ELANE RNA Guide
cucccaggaccacccacaccgc

SEQ ID NO: 9434 - RNA, 22 nt, Artificial Sequence
  ELANE RNA Guide
gaaacguccgcgcggugugggu

SEQ ID NO: 9435 - RNA, 22 nt, Artificial Sequence
  ELANE RNA Guide
gaccacccacaccgcgcggacg

SEQ ID NO: 9436 - RNA, 22 nt, Artificial Sequence
  ELANE RNA Guide
gcagaaacguccgcgcggugug

SEQ ID NO: 9437 - RNA, 22 nt, Artificial Sequence
  ELANE RNA Guide
gcgcggugugggugguccuggg

SEQ ID NO: 9438 - RNA, 22 nt, Artificial Sequence
  ELANE RNA Guide
gcggugugggugguccugggag

SEQ ID NO: 9439 - RNA, 22 nt, Artificial Sequence
  ELANE RNA Guide
gcucccaggaccacccacaccg

SEQ ID NO: 9440 - RNA, 22 nt, Artificial Sequence
  ELANE RNA Guide
ggaccacccacaccgcgcggac

SEQ ID NO: 9441 - RNA, 22 nt, Artificial Sequence
  ELANE RNA Guide
ggcagaaacguccgcgcggugu

SEQ ID NO: 9442 - RNA, 22 nt, Artificial Sequence
  ELANE RNA Guide
ggcucccaggaccacccacacc

SEQ ID NO: 9443 - RNA, 22 nt, Artificial Sequence
  ELANE RNA Guide
gggcucccaggaccacccacac

SEQ ID NO: 9444 - RNA, 22 nt, Artificial Sequence
  ELANE RNA Guide
ggugugggugguccugggagcc

SEQ ID NO: 9445 - RNA, 22 nt, Artificial Sequence
  ELANE RNA Guide
guccgcgcgguguggguggucc

SEQ ID NO: 9446 - RNA, 22 nt, Artificial Sequence
  ELANE RNA Guide
gugggugguccugggagcccau

SEQ ID NO: 9447 - RNA, 22 nt, Artificial Sequence
  ELANE RNA Guide
gugugggugguccugggagccc

SEQ ID NO: 9448 - RNA, 22 nt, Artificial Sequence
  ELANE RNA Guide
uaugggcucccaggaccaccca

SEQ ID NO: 9449 - RNA, 22 nt, Artificial Sequence
  ELANE RNA Guide
ucccaggaccacccacaccgcg

SEQ ID NO: 9450 - RNA, 22 nt, Artificial Sequence
  ELANE RNA Guide
uccgcgcggugugggugguccu

SEQ ID NO: 9451 - RNA, 22 nt, Artificial Sequence
  ELANE RNA Guide
ugggcucccaggaccacccaca

SEQ ID NO: 9452 - RNA, 22 nt, Artificial Sequence
  ELANE RNA Guide
ugugggugguccugggagccca

SEQ ID NO: 9453 - RNA, 20 nt, Artificial Sequence
  ELANE RNA Guide
aaacguccgcgcggugccgg

SEQ ID NO: 9454 - RNA, 20 nt, Artificial Sequence
  ELANE RNA Guide
aacguccgcgcggugccggu

SEQ ID NO: 9455 - RNA, 20 nt, Artificial Sequence
  ELANE RNA Guide
accaccggcaccgcgcggac

SEQ ID NO: 9456 - RNA, 20 nt, Artificial Sequence
  ELANE RNA Guide
accggcaccgcgcggacguu

SEQ ID NO: 9457 - RNA, 20 nt, Artificial Sequence
  ELANE RNA Guide
acguccgcgcggugccggug

SEQ ID NO: 9458 - RNA, 20 nt, Artificial Sequence
  ELANE RNA Guide
agaaacguccgcgcggugcc

SEQ ID NO: 9459 - RNA, 20 nt, Artificial Sequence
  ELANE RNA Guide
aggaccaccggcaccgcgcg

SEQ ID NO: 9460 - RNA, 20 nt, Artificial Sequence
  ELANE RNA Guide
caccggcaccgcgcggacgu

SEQ ID NO: 9461 - RNA, 20 nt, Artificial Sequence
  ELANE RNA Guide
cagaaacguccgcgcggugc

SEQ ID NO: 9462 - RNA, 20 nt, Artificial Sequence
  ELANE RNA Guide
caggaccaccggcaccgcgc

SEQ ID NO: 9463 - RNA, 20 nt, Artificial Sequence
  ELANE RNA Guide
ccaggaccaccggcaccgcg

SEQ ID NO: 9464 - RNA, 20 nt, Artificial Sequence
  ELANE RNA Guide
cccaggaccaccggcaccgc

SEQ ID NO: 9465 - RNA, 20 nt, Artificial Sequence
  ELANE RNA Guide
ccggcaccgcgcggacguuu

SEQ ID NO: 9466 - RNA, 20 nt, Artificial Sequence
  ELANE RNA Guide
ccggugguccugggagccca

SEQ ID NO: 9467 - RNA, 20 nt, Artificial Sequence
  ELANE RNA Guide
cgcgcggugccggugguccu

SEQ ID NO: 9468 - RNA, 20 nt, Artificial Sequence
  ELANE RNA Guide
cgcggugccggugguccugg

SEQ ID NO: 9469 - RNA, 20 nt, Artificial Sequence
  ELANE RNA Guide
cggcaccgcgcggacguuuc

SEQ ID NO: 9470 - RNA, 20 nt, Artificial Sequence
  ELANE RNA Guide
cggugccggugguccuggga

SEQ ID NO: 9471 - RNA, 20 nt, Artificial Sequence
  ELANE RNA Guide
cucccaggaccaccggcacc

SEQ ID NO: 9472 - RNA, 20 nt, Artificial Sequence
  ELANE RNA Guide
gaaacguccgcgcggugccg

SEQ ID NO: 9473 - RNA, 20 nt, Artificial Sequence
  ELANE RNA Guide
gaccaccggcaccgcgcgga

SEQ ID NO: 9474 - RNA, 20 nt, Artificial Sequence
  ELANE RNA Guide
gccggugguccugggagccc

SEQ ID NO: 9475 - RNA, 20 nt, Artificial Sequence
  ELANE RNA Guide
gcgcggugccggugguccug

SEQ ID NO: 9476 - RNA, 20 nt, Artificial Sequence
  ELANE RNA Guide
gcggugccggugguccuggg

SEQ ID NO: 9477 - RNA, 20 nt, Artificial Sequence
  ELANE RNA Guide
gcucccaggaccaccggcac

SEQ ID NO: 9478 - RNA, 20 nt, Artificial Sequence
  ELANE RNA Guide
ggcucccaggaccaccggca

SEQ ID NO: 9479 - RNA, 20 nt, Artificial Sequence
  ELANE RNA Guide
gggcucccaggaccaccggc

SEQ ID NO: 9480 - RNA, 20 nt, Artificial Sequence
  ELANE RNA Guide
ggugccggugguccugggag

SEQ ID NO: 9481 - RNA, 20 nt, Artificial Sequence
  ELANE RNA Guide
guccgcgcggugccgguggu

SEQ ID NO: 9482 - RNA, 20 nt, Artificial Sequence
  ELANE RNA Guide
gugccggugguccugggagc

SEQ ID NO: 9483 - RNA, 20 nt, Artificial Sequence
  ELANE RNA Guide
ucccaggaccaccggcaccg

SEQ ID NO: 9484 - RNA, 20 nt, Artificial Sequence
  ELANE RNA Guide
uccgcgcggugccggugguc

SEQ ID NO: 9485 - RNA, 20 nt, Artificial Sequence
  ELANE RNA Guide
ugccggugguccugggagcc

SEQ ID NO: 9486 - RNA, 20 nt, Artificial Sequence
  ELANE RNA Guide
ugggcucccaggaccaccgg

SEQ ID NO: 9487 - RNA, 21 nt, Artificial Sequence
  ELANE RNA Guide
aaacguccgcgcggugccggu

SEQ ID NO: 9488 - RNA, 21 nt, Artificial Sequence
  ELANE RNA Guide
aacguccgcgcggugccggug

SEQ ID NO: 9489 - RNA, 21 nt, Artificial Sequence
  ELANE RNA Guide
accggcaccgcgcggacguuu

SEQ ID NO: 9490 - RNA, 21 nt, Artificial Sequence
  ELANE RNA Guide
agaaacguccgcgcggugccg

SEQ ID NO: 9491 - RNA, 21 nt, Artificial Sequence
  ELANE RNA Guide
augggcucccaggaccaccgg

SEQ ID NO: 9492 - RNA, 21 nt, Artificial Sequence
  ELANE RNA Guide
caccggcaccgcgcggacguu

SEQ ID NO: 9493 - RNA, 21 nt, Artificial Sequence
  ELANE RNA Guide
cagaaacguccgcgcggugcc

SEQ ID NO: 9494 - RNA, 21 nt, Artificial Sequence
  ELANE RNA Guide
ccggcaccgcgcggacguuuc

SEQ ID NO: 9495 - RNA, 21 nt, Artificial Sequence
  ELANE RNA Guide
ccggugguccugggagcccau

SEQ ID NO: 9496 - RNA, 21 nt, Artificial Sequence
  ELANE RNA Guide
cggcaccgcgcggacguuucu

SEQ ID NO: 9497 - RNA, 21 nt, Artificial Sequence
  ELANE RNA Guide
cggugccggugguccugggag

SEQ ID NO: 9498 - RNA, 21 nt, Artificial Sequence
  ELANE RNA Guide
cucccaggaccaccggcaccg

SEQ ID NO: 9499 - RNA, 21 nt, Artificial Sequence
  ELANE RNA Guide
gaaacguccgcgcggugccgg

SEQ ID NO: 9500 - RNA, 21 nt, Artificial Sequence
  ELANE RNA Guide
gcagaaacguccgcgcggugc

SEQ ID NO: 9501 - RNA, 21 nt, Artificial Sequence
  ELANE RNA Guide
gccggugguccugggagccca

SEQ ID NO: 9502 - RNA, 21 nt, Artificial Sequence
  ELANE RNA Guide
gcggugccggugguccuggga

SEQ ID NO: 9503 - RNA, 21 nt, Artificial Sequence
  ELANE RNA Guide
gcucccaggaccaccggcacc

SEQ ID NO: 9504 - RNA, 21 nt, Artificial Sequence
  ELANE RNA Guide
ggcucccaggaccaccggcac

SEQ ID NO: 9505 - RNA, 21 nt, Artificial Sequence
  ELANE RNA Guide
gggcucccaggaccaccggca

SEQ ID NO: 9506 - RNA, 21 nt, Artificial Sequence
  ELANE RNA Guide
ggugccggugguccugggagc

SEQ ID NO: 9507 - RNA, 21 nt, Artificial Sequence
  ELANE RNA Guide
gugccggugguccugggagcc

SEQ ID NO: 9508 - RNA, 21 nt, Artificial Sequence
  ELANE RNA Guide
ucccaggaccaccggcaccgc

SEQ ID NO: 9509 - RNA, 21 nt, Artificial Sequence
  ELANE RNA Guide
ugccggugguccugggagccc

SEQ ID NO: 9510 - RNA, 21 nt, Artificial Sequence
  ELANE RNA Guide
ugggcucccaggaccaccggc

SEQ ID NO: 9511 - RNA, 22 nt, Artificial Sequence
  ELANE RNA Guide
aaacguccgcgcggugccggug

SEQ ID NO: 9512 - RNA, 22 nt, Artificial Sequence
  ELANE RNA Guide
aacguccgcgcggugccggugg

SEQ ID NO: 9513 - RNA, 22 nt, Artificial Sequence
  ELANE RNA Guide
accaccggcaccgcgcggacgu

SEQ ID NO: 9514 - RNA, 22 nt, Artificial Sequence
  ELANE RNA Guide
accggcaccgcgcggacguuuc

SEQ ID NO: 9515 - RNA, 22 nt, Artificial Sequence
  ELANE RNA Guide
acguccgcgcggugccgguggu

SEQ ID NO: 9516 - RNA, 22 nt, Artificial Sequence
  ELANE RNA Guide
agaaacguccgcgcggugccgg

SEQ ID NO: 9517 - RNA, 22 nt, Artificial Sequence
  ELANE RNA Guide
aggaccaccggcaccgcgcgga

SEQ ID NO: 9518 - RNA, 22 nt, Artificial Sequence
  ELANE RNA Guide
augggcucccaggaccaccggc

SEQ ID NO: 9519 - RNA, 22 nt, Artificial Sequence
  ELANE RNA Guide
caccggcaccgcgcggacguuu

SEQ ID NO: 9520 - RNA, 22 nt, Artificial Sequence
  ELANE RNA Guide
cagaaacguccgcgcggugccg

SEQ ID NO: 9521 - RNA, 22 nt, Artificial Sequence
  ELANE RNA Guide
ccaccggcaccgcgcggacguu

SEQ ID NO: 9522 - RNA, 22 nt, Artificial Sequence
  ELANE RNA Guide
ccggcaccgcgcggacguuucu

SEQ ID NO: 9523 - RNA, 22 nt, Artificial Sequence
  ELANE RNA Guide
ccggugguccugggagcccaua

SEQ ID NO: 9524 - RNA, 22 nt, Artificial Sequence
  ELANE RNA Guide
cgcggugccggugguccuggga

SEQ ID NO: 9525 - RNA, 22 nt, Artificial Sequence
  ELANE RNA Guide
cggcaccgcgcggacguuucug

SEQ ID NO: 9526 - RNA, 22 nt, Artificial Sequence
  ELANE RNA Guide
cggugccggugguccugggagc

SEQ ID NO: 9527 - RNA, 22 nt, Artificial Sequence
  ELANE RNA Guide
cucccaggaccaccggcaccgc

SEQ ID NO: 9528 - RNA, 22 nt, Artificial Sequence
  ELANE RNA Guide
gaaacguccgcgcggugccggu

SEQ ID NO: 9529 - RNA, 22 nt, Artificial Sequence
  ELANE RNA Guide
gcagaaacguccgcgcggugcc

SEQ ID NO: 9530 - RNA, 22 nt, Artificial Sequence
  ELANE RNA Guide
gccggugguccugggagcccau

SEQ ID NO: 9531 - RNA, 22 nt, Artificial Sequence
  ELANE RNA Guide
gcggugccggugguccugggag

SEQ ID NO: 9532 - RNA, 22 nt, Artificial Sequence
  ELANE RNA Guide
gcucccaggaccaccggcaccg

SEQ ID NO: 9533 - RNA, 22 nt, Artificial Sequence
  ELANE RNA Guide
ggcagaaacguccgcgcggugc

SEQ ID NO: 9534 - RNA, 22 nt, Artificial Sequence
  ELANE RNA Guide
ggcucccaggaccaccggcacc

SEQ ID NO: 9535 - RNA, 22 nt, Artificial Sequence
  ELANE RNA Guide
gggcucccaggaccaccggcac

SEQ ID NO: 9536 - RNA, 22 nt, Artificial Sequence
  ELANE RNA Guide
ggugccggugguccugggagcc

SEQ ID NO: 9537 - RNA, 22 nt, Artificial Sequence
  ELANE RNA Guide
gugccggugguccugggagccc

SEQ ID NO: 9538 - RNA, 22 nt, Artificial Sequence
  ELANE RNA Guide
uaugggcucccaggaccaccgg

SEQ ID NO: 9539 - RNA, 22 nt, Artificial Sequence
  ELANE RNA Guide
ucccaggaccaccggcaccgcg

SEQ ID NO: 9540 - RNA, 22 nt, Artificial Sequence
  ELANE RNA Guide
uccgcgcggugccggugguccu

SEQ ID NO: 9541 - RNA, 22 nt, Artificial Sequence
  ELANE RNA Guide
ugccggugguccugggagccca

SEQ ID NO: 9542 - RNA, 22 nt, Artificial Sequence
  ELANE RNA Guide
ugggcucccaggaccaccggca

SEQ ID NO: 9543 - RNA, 20 nt, Artificial Sequence
  ELANE RNA Guide
aaacguccgcgcggugcgga

SEQ ID NO: 9544 - RNA, 20 nt, Artificial Sequence
  ELANE RNA Guide
aacguccgcgcggugcggau

SEQ ID NO: 9545 - RNA, 20 nt, Artificial Sequence
  ELANE RNA Guide
accauccgcaccgcgcggac

SEQ ID NO: 9546 - RNA, 20 nt, Artificial Sequence
  ELANE RNA Guide
acguccgcgcggugcggaug

SEQ ID NO: 9547 - RNA, 20 nt, Artificial Sequence
  ELANE RNA Guide
agaaacguccgcgcggugcg

SEQ ID NO: 9548 - RNA, 20 nt, Artificial Sequence
  ELANE RNA Guide
aggaccauccgcaccgcgcg

SEQ ID NO: 9549 - RNA, 20 nt, Artificial Sequence
  ELANE RNA Guide
agguuaugggcucccaggac

SEQ ID NO: 9550 - RNA, 20 nt, Artificial Sequence
  ELANE RNA Guide
auccgcaccgcgcggacguu

SEQ ID NO: 9551 - RNA, 20 nt, Artificial Sequence
  ELANE RNA Guide
augggcucccaggaccaucc

SEQ ID NO: 9552 - RNA, 20 nt, Artificial Sequence
  ELANE RNA Guide
caggaccauccgcaccgcgc

SEQ ID NO: 9553 - RNA, 20 nt, Artificial Sequence
  ELANE RNA Guide
cauccgcaccgcgcggacgu

SEQ ID NO: 9554 - RNA, 20 nt, Artificial Sequence
  ELANE RNA Guide
ccaggaccauccgcaccgcg

SEQ ID NO: 9555 - RNA, 20 nt, Artificial Sequence
  ELANE RNA Guide
ccauccgcaccgcgcggacg

SEQ ID NO: 9556 - RNA, 20 nt, Artificial Sequence
  ELANE RNA Guide
cccaggaccauccgcaccgc

SEQ ID NO: 9557 - RNA, 20 nt, Artificial Sequence
  ELANE RNA Guide
ccgcgcggugcggauggucc

SEQ ID NO: 9558 - RNA, 20 nt, Artificial Sequence
  ELANE RNA Guide
cgcgcggugcggaugguccu

SEQ ID NO: 9559 - RNA, 20 nt, Artificial Sequence
  ELANE RNA Guide
cgcggugcggaugguccugg

SEQ ID NO: 9560 - RNA, 20 nt, Artificial Sequence
  ELANE RNA Guide
cggaugguccugggagccca

SEQ ID NO: 9561 - RNA, 20 nt, Artificial Sequence
  ELANE RNA Guide
cggugcggaugguccuggga

SEQ ID NO: 9562 - RNA, 20 nt, Artificial Sequence
  ELANE RNA Guide
cguccgcgcggugcggaugg

SEQ ID NO: 9563 - RNA, 20 nt, Artificial Sequence
  ELANE RNA Guide
cucccaggaccauccgcacc

SEQ ID NO: 9564 - RNA, 20 nt, Artificial Sequence
  ELANE RNA Guide
gaaacguccgcgcggugcgg

SEQ ID NO: 9565 - RNA, 20 nt, Artificial Sequence
  ELANE RNA Guide
gaccauccgcaccgcgcgga

SEQ ID NO: 9566 - RNA, 20 nt, Artificial Sequence
  ELANE RNA Guide
gagguuaugggcucccagga

SEQ ID NO: 9567 - RNA, 20 nt, Artificial Sequence
  ELANE RNA Guide
gaugguccugggagcccaua

SEQ ID NO: 9568 - RNA, 20 nt, Artificial Sequence
  ELANE RNA Guide
gcgcggugcggaugguccug

SEQ ID NO: 9569 - RNA, 20 nt, Artificial Sequence
  ELANE RNA Guide
gcggaugguccugggagccc

SEQ ID NO: 9570 - RNA, 20 nt, Artificial Sequence
  ELANE RNA Guide
gcggugcggaugguccuggg

SEQ ID NO: 9571 - RNA, 20 nt, Artificial Sequence
  ELANE RNA Guide
gcucccaggaccauccgcac

SEQ ID NO: 9572 - RNA, 20 nt, Artificial Sequence
  ELANE RNA Guide
ggaccauccgcaccgcgcgg

SEQ ID NO: 9573 - RNA, 20 nt, Artificial Sequence
  ELANE RNA Guide
ggaugguccugggagcccau

SEQ ID NO: 9574 - RNA, 20 nt, Artificial Sequence
  ELANE RNA Guide
ggcucccaggaccauccgca

SEQ ID NO: 9575 - RNA, 20 nt, Artificial Sequence
  ELANE RNA Guide
gggcucccaggaccauccgc

SEQ ID NO: 9576 - RNA, 20 nt, Artificial Sequence
  ELANE RNA Guide
ggugcggaugguccugggag

SEQ ID NO: 9577 - RNA, 20 nt, Artificial Sequence
  ELANE RNA Guide
guccgcgcggugcggauggu

SEQ ID NO: 9578 - RNA, 20 nt, Artificial Sequence
  ELANE RNA Guide
gugcggaugguccugggagc

SEQ ID NO: 9579 - RNA, 20 nt, Artificial Sequence
  ELANE RNA Guide
uaugggcucccaggaccauc

SEQ ID NO: 9580 - RNA, 20 nt, Artificial Sequence
  ELANE RNA Guide
ucccaggaccauccgcaccg

SEQ ID NO: 9581 - RNA, 20 nt, Artificial Sequence
  ELANE RNA Guide
uccgcgcggugcggaugguc

SEQ ID NO: 9582 - RNA, 20 nt, Artificial Sequence
  ELANE RNA Guide
ugcggaugguccugggagcc

SEQ ID NO: 9583 - RNA, 20 nt, Artificial Sequence
  ELANE RNA Guide
ugggcucccaggaccauccg

SEQ ID NO: 9584 - RNA, 20 nt, Artificial Sequence
  ELANE RNA Guide
uuaugggcucccaggaccau

SEQ ID NO: 9585 - RNA, 21 nt, Artificial Sequence
  ELANE RNA Guide
aaacguccgcgcggugcggau

SEQ ID NO: 9586 - RNA, 21 nt, Artificial Sequence
  ELANE RNA Guide
aacguccgcgcggugcggaug

SEQ ID NO: 9587 - RNA, 21 nt, Artificial Sequence
  ELANE RNA Guide
accauccgcaccgcgcggacg

SEQ ID NO: 9588 - RNA, 21 nt, Artificial Sequence
  ELANE RNA Guide
acguccgcgcggugcggaugg

SEQ ID NO: 9589 - RNA, 21 nt, Artificial Sequence
  ELANE RNA Guide
agaaacguccgcgcggugcgg

SEQ ID NO: 9590 - RNA, 21 nt, Artificial Sequence
  ELANE RNA Guide
agagguuaugggcucccagga

SEQ ID NO: 9591 - RNA, 21 nt, Artificial Sequence
  ELANE RNA Guide
aggaccauccgcaccgcgcgg

SEQ ID NO: 9592 - RNA, 21 nt, Artificial Sequence
  ELANE RNA Guide
auccgcaccgcgcggacguuu

SEQ ID NO: 9593 - RNA, 21 nt, Artificial Sequence
  ELANE RNA Guide
augggcucccaggaccauccg

SEQ ID NO: 9594 - RNA, 21 nt, Artificial Sequence
  ELANE RNA Guide
cagaaacguccgcgcggugcg

SEQ ID NO: 9595 - RNA, 21 nt, Artificial Sequence
  ELANE RNA Guide
caggaccauccgcaccgcgcg

SEQ ID NO: 9596 - RNA, 21 nt, Artificial Sequence
  ELANE RNA Guide
cauccgcaccgcgcggacguu

SEQ ID NO: 9597 - RNA, 21 nt, Artificial Sequence
  ELANE RNA Guide
ccaggaccauccgcaccgcgc

SEQ ID NO: 9598 - RNA, 21 nt, Artificial Sequence
  ELANE RNA Guide
ccauccgcaccgcgcggacgu

SEQ ID NO: 9599 - RNA, 21 nt, Artificial Sequence
  ELANE RNA Guide
cccaggaccauccgcaccgcg

SEQ ID NO: 9600 - RNA, 21 nt, Artificial Sequence
  ELANE RNA Guide
ccgcgcggugcggaugguccu

SEQ ID NO: 9601 - RNA, 21 nt, Artificial Sequence
  ELANE RNA Guide
cgcgcggugcggaugguccug

SEQ ID NO: 9602 - RNA, 21 nt, Artificial Sequence
  ELANE RNA Guide
cgcggugcggaugguccuggg

SEQ ID NO: 9603 - RNA, 21 nt, Artificial Sequence
  ELANE RNA Guide
cggaugguccugggagcccau

SEQ ID NO: 9604 - RNA, 21 nt, Artificial Sequence
  ELANE RNA Guide
cggugcggaugguccugggag

SEQ ID NO: 9605 - RNA, 21 nt, Artificial Sequence
  ELANE RNA Guide
cguccgcgcggugcggauggu

SEQ ID NO: 9606 - RNA, 21 nt, Artificial Sequence
  ELANE RNA Guide
cucccaggaccauccgcaccg

SEQ ID NO: 9607 - RNA, 21 nt, Artificial Sequence
  ELANE RNA Guide
gaaacguccgcgcggugcgga

SEQ ID NO: 9608 - RNA, 21 nt, Artificial Sequence
  ELANE RNA Guide
gaccauccgcaccgcgcggac

SEQ ID NO: 9609 - RNA, 21 nt, Artificial Sequence
  ELANE RNA Guide
gagguuaugggcucccaggac

SEQ ID NO: 9610 - RNA, 21 nt, Artificial Sequence
  ELANE RNA Guide
gaugguccugggagcccauaa

SEQ ID NO: 9611 - RNA, 21 nt, Artificial Sequence
  ELANE RNA Guide
gcgcggugcggaugguccugg

SEQ ID NO: 9612 - RNA, 21 nt, Artificial Sequence
  ELANE RNA Guide
gcggaugguccugggagccca

SEQ ID NO: 9613 - RNA, 21 nt, Artificial Sequence
  ELANE RNA Guide
gcggugcggaugguccuggga

SEQ ID NO: 9614 - RNA, 21 nt, Artificial Sequence
  ELANE RNA Guide
gcucccaggaccauccgcacc

SEQ ID NO: 9615 - RNA, 21 nt, Artificial Sequence
  ELANE RNA Guide
ggaccauccgcaccgcgcgga

SEQ ID NO: 9616 - RNA, 21 nt, Artificial Sequence
  ELANE RNA Guide
ggaugguccugggagcccaua

SEQ ID NO: 9617 - RNA, 21 nt, Artificial Sequence
  ELANE RNA Guide
ggcucccaggaccauccgcac

SEQ ID NO: 9618 - RNA, 21 nt, Artificial Sequence
  ELANE RNA Guide
gggcucccaggaccauccgca

SEQ ID NO: 9619 - RNA, 21 nt, Artificial Sequence
  ELANE RNA Guide
ggugcggaugguccugggagc

SEQ ID NO: 9620 - RNA, 21 nt, Artificial Sequence
  ELANE RNA Guide
guccgcgcggugcggaugguc

SEQ ID NO: 9621 - RNA, 21 nt, Artificial Sequence
  ELANE RNA Guide
gugcggaugguccugggagcc

SEQ ID NO: 9622 - RNA, 21 nt, Artificial Sequence
  ELANE RNA Guide
guuaugggcucccaggaccau

SEQ ID NO: 9623 - RNA, 21 nt, Artificial Sequence
  ELANE RNA Guide
uaugggcucccaggaccaucc

SEQ ID NO: 9624 - RNA, 21 nt, Artificial Sequence
  ELANE RNA Guide
ucccaggaccauccgcaccgc

SEQ ID NO: 9625 - RNA, 21 nt, Artificial Sequence
  ELANE RNA Guide
uccgcgcggugcggauggucc

SEQ ID NO: 9626 - RNA, 21 nt, Artificial Sequence
  ELANE RNA Guide
ugcggaugguccugggagccc

SEQ ID NO: 9627 - RNA, 21 nt, Artificial Sequence
  ELANE RNA Guide
ugggcucccaggaccauccgc

SEQ ID NO: 9628 - RNA, 21 nt, Artificial Sequence
  ELANE RNA Guide
uuaugggcucccaggaccauc

SEQ ID NO: 9629 - RNA, 22 nt, Artificial Sequence
  ELANE RNA Guide
aaacguccgcgcggugcggaug

SEQ ID NO: 9630 - RNA, 22 nt, Artificial Sequence
  ELANE RNA Guide
aacguccgcgcggugcggaugg

SEQ ID NO: 9631 - RNA, 22 nt, Artificial Sequence
  ELANE RNA Guide
accauccgcaccgcgcggacgu

SEQ ID NO: 9632 - RNA, 22 nt, Artificial Sequence
  ELANE RNA Guide
acguccgcgcggugcggauggu

SEQ ID NO: 9633 - RNA, 22 nt, Artificial Sequence
  ELANE RNA Guide
agaaacguccgcgcggugcgga

SEQ ID NO: 9634 - RNA, 22 nt, Artificial Sequence
  ELANE RNA Guide
agagguuaugggcucccaggac

SEQ ID NO: 9635 - RNA, 22 nt, Artificial Sequence
  ELANE RNA Guide
aggaccauccgcaccgcgcgga

SEQ ID NO: 9636 - RNA, 22 nt, Artificial Sequence
  ELANE RNA Guide
auccgcaccgcgcggacguuuc

SEQ ID NO: 9637 - RNA, 22 nt, Artificial Sequence
  ELANE RNA Guide
augggcucccaggaccauccgc

SEQ ID NO: 9638 - RNA, 22 nt, Artificial Sequence
  ELANE RNA Guide
cagaaacguccgcgcggugcgg

SEQ ID NO: 9639 - RNA, 22 nt, Artificial Sequence
  ELANE RNA Guide
caggaccauccgcaccgcgcgg

SEQ ID NO: 9640 - RNA, 22 nt, Artificial Sequence
  ELANE RNA Guide
cauccgcaccgcgcggacguuu

SEQ ID NO: 9641 - RNA, 22 nt, Artificial Sequence
  ELANE RNA Guide
ccaggaccauccgcaccgcgcg

SEQ ID NO: 9642 - RNA, 22 nt, Artificial Sequence
  ELANE RNA Guide
ccauccgcaccgcgcggacguu

SEQ ID NO: 9643 - RNA, 22 nt, Artificial Sequence
  ELANE RNA Guide
cccaggaccauccgcaccgcgc

SEQ ID NO: 9644 - RNA, 22 nt, Artificial Sequence
  ELANE RNA Guide
ccgcgcggugcggaugguccug

SEQ ID NO: 9645 - RNA, 22 nt, Artificial Sequence
  ELANE RNA Guide
cgcgcggugcggaugguccugg

SEQ ID NO: 9646 - RNA, 22 nt, Artificial Sequence
  ELANE RNA Guide
cgcggugcggaugguccuggga

SEQ ID NO: 9647 - RNA, 22 nt, Artificial Sequence
  ELANE RNA Guide
cggaugguccugggagcccaua

SEQ ID NO: 9648 - RNA, 22 nt, Artificial Sequence
  ELANE RNA Guide
cggugcggaugguccugggagc

SEQ ID NO: 9649 - RNA, 22 nt, Artificial Sequence
  ELANE RNA Guide
cguccgcgcggugcggaugguc

SEQ ID NO: 9650 - RNA, 22 nt, Artificial Sequence
  ELANE RNA Guide
cucccaggaccauccgcaccgc

SEQ ID NO: 9651 - RNA, 22 nt, Artificial Sequence
  ELANE RNA Guide
gaaacguccgcgcggugcggau

SEQ ID NO: 9652 - RNA, 22 nt, Artificial Sequence
  ELANE RNA Guide
gaccauccgcaccgcgcggacg

SEQ ID NO: 9653 - RNA, 22 nt, Artificial Sequence
  ELANE RNA Guide
gagagguuaugggcucccagga

SEQ ID NO: 9654 - RNA, 22 nt, Artificial Sequence
  ELANE RNA Guide
gaugguccugggagcccauaac

SEQ ID NO: 9655 - RNA, 22 nt, Artificial Sequence
  ELANE RNA Guide
gcagaaacguccgcgcggugcg

SEQ ID NO: 9656 - RNA, 22 nt, Artificial Sequence
  ELANE RNA Guide
gcgcggugcggaugguccuggg

SEQ ID NO: 9657 - RNA, 22 nt, Artificial Sequence
  ELANE RNA Guide
gcggaugguccugggagcccau

SEQ ID NO: 9658 - RNA, 22 nt, Artificial Sequence
  ELANE RNA Guide
gcggugcggaugguccugggag

SEQ ID NO: 9659 - RNA, 22 nt, Artificial Sequence
  ELANE RNA Guide
gcucccaggaccauccgcaccg

SEQ ID NO: 9660 - RNA, 22 nt, Artificial Sequence
  ELANE RNA Guide
ggaccauccgcaccgcgcggac

SEQ ID NO: 9661 - RNA, 22 nt, Artificial Sequence
  ELANE RNA Guide
ggaugguccugggagcccauaa

SEQ ID NO: 9662 - RNA, 22 nt, Artificial Sequence
  ELANE RNA Guide
ggcucccaggaccauccgcacc

SEQ ID NO: 9663 - RNA, 22 nt, Artificial Sequence
  ELANE RNA Guide
gggcucccaggaccauccgcac

SEQ ID NO: 9664 - RNA, 22 nt, Artificial Sequence
  ELANE RNA Guide
ggugcggaugguccugggagcc

SEQ ID NO: 9665 - RNA, 22 nt, Artificial Sequence
  ELANE RNA Guide
gguuaugggcucccaggaccau

SEQ ID NO: 9666 - RNA, 22 nt, Artificial Sequence
  ELANE RNA Guide
guccgcgcggugcggauggucc

SEQ ID NO: 9667 - RNA, 22 nt, Artificial Sequence
  ELANE RNA Guide
gugcggaugguccugggagccc

SEQ ID NO: 9668 - RNA, 22 nt, Artificial Sequence
  ELANE RNA Guide
guuaugggcucccaggaccauc

SEQ ID NO: 9669 - RNA, 22 nt, Artificial Sequence
  ELANE RNA Guide
uaugggcucccaggaccauccg

SEQ ID NO: 9670 - RNA, 22 nt, Artificial Sequence
  ELANE RNA Guide
ucccaggaccauccgcaccgcg

SEQ ID NO: 9671 - RNA, 22 nt, Artificial Sequence
  ELANE RNA Guide
uccgcgcggugcggaugguccu

SEQ ID NO: 9672 - RNA, 22 nt, Artificial Sequence
  ELANE RNA Guide
ugcggaugguccugggagccca

SEQ ID NO: 9673 - RNA, 22 nt, Artificial Sequence
  ELANE RNA Guide
ugggcucccaggaccauccgca

SEQ ID NO: 9674 - RNA, 22 nt, Artificial Sequence
  ELANE RNA Guide
uuaugggcucccaggaccaucc

SEQ ID NO: 9675 - RNA, 20 nt, Artificial Sequence
  ELANE RNA Guide
aaacguccgcgcggugcggg

SEQ ID NO: 9676 - RNA, 20 nt, Artificial Sequence
  ELANE RNA Guide
aacguccgcgcggugcgggu

SEQ ID NO: 9677 - RNA, 20 nt, Artificial Sequence
  ELANE RNA Guide
acguccgcgcggugcgggug

SEQ ID NO: 9678 - RNA, 20 nt, Artificial Sequence
  ELANE RNA Guide
agagguuaugggcucccagg

SEQ ID NO: 9679 - RNA, 20 nt, Artificial Sequence
  ELANE RNA Guide
agguccacccgcaccgcgcg

SEQ ID NO: 9680 - RNA, 20 nt, Artificial Sequence
  ELANE RNA Guide
agguuaugggcucccagguc

SEQ ID NO: 9681 - RNA, 20 nt, Artificial Sequence
  ELANE RNA Guide
augggcucccagguccaccc

SEQ ID NO: 9682 - RNA, 20 nt, Artificial Sequence
  ELANE RNA Guide
cagguccacccgcaccgcgc

SEQ ID NO: 9683 - RNA, 20 nt, Artificial Sequence
  ELANE RNA Guide
ccagguccacccgcaccgcg

SEQ ID NO: 9684 - RNA, 20 nt, Artificial Sequence
  ELANE RNA Guide
cccagguccacccgcaccgc

SEQ ID NO: 9685 - RNA, 20 nt, Artificial Sequence
  ELANE RNA Guide
cgagagguuaugggcuccca

SEQ ID NO: 9686 - RNA, 20 nt, Artificial Sequence
  ELANE RNA Guide
cgcgcggugcggguggaccu

SEQ ID NO: 9687 - RNA, 20 nt, Artificial Sequence
  ELANE RNA Guide
cgcggugcggguggaccugg

SEQ ID NO: 9688 - RNA, 20 nt, Artificial Sequence
  ELANE RNA Guide
cggguggaccugggagccca

SEQ ID NO: 9689 - RNA, 20 nt, Artificial Sequence
  ELANE RNA Guide
cggugcggguggaccuggga

SEQ ID NO: 9690 - RNA, 20 nt, Artificial Sequence
  ELANE RNA Guide
cucccagguccacccgcacc

SEQ ID NO: 9691 - RNA, 20 nt, Artificial Sequence
  ELANE RNA Guide
gaccugggagcccauaaccu

SEQ ID NO: 9692 - RNA, 20 nt, Artificial Sequence
  ELANE RNA Guide
gagagguuaugggcucccag

SEQ ID NO: 9693 - RNA, 20 nt, Artificial Sequence
  ELANE RNA Guide
gagguuaugggcucccaggu

SEQ ID NO: 9694 - RNA, 20 nt, Artificial Sequence
  ELANE RNA Guide
gcgagagguuaugggcuccc

SEQ ID NO: 9695 - RNA, 20 nt, Artificial Sequence
  ELANE RNA Guide
gcgcggugcggguggaccug

SEQ ID NO: 9696 - RNA, 20 nt, Artificial Sequence
  ELANE RNA Guide
gcggguggaccugggagccc

SEQ ID NO: 9697 - RNA, 20 nt, Artificial Sequence
  ELANE RNA Guide
gcggugcggguggaccuggg

SEQ ID NO: 9698 - RNA, 20 nt, Artificial Sequence
  ELANE RNA Guide
gcucccagguccacccgcac

SEQ ID NO: 9699 - RNA, 20 nt, Artificial Sequence
  ELANE RNA Guide
ggaccugggagcccauaacc

SEQ ID NO: 9700 - RNA, 20 nt, Artificial Sequence
  ELANE RNA Guide
ggcucccagguccacccgca

SEQ ID NO: 9701 - RNA, 20 nt, Artificial Sequence
  ELANE RNA Guide
gggcucccagguccacccgc

SEQ ID NO: 9702 - RNA, 20 nt, Artificial Sequence
  ELANE RNA Guide
ggguggaccugggagcccau

SEQ ID NO: 9703 - RNA, 20 nt, Artificial Sequence
  ELANE RNA Guide
ggugcggguggaccugggag

SEQ ID NO: 9704 - RNA, 20 nt, Artificial Sequence
  ELANE RNA Guide
gguggaccugggagcccaua

SEQ ID NO: 9705 - RNA, 20 nt, Artificial Sequence
  ELANE RNA Guide
gguuaugggcucccaggucc

SEQ ID NO: 9706 - RNA, 20 nt, Artificial Sequence
  ELANE RNA Guide
guccacccgcaccgcgcgga

SEQ ID NO: 9707 - RNA, 20 nt, Artificial Sequence
  ELANE RNA Guide
guccgcgcggugcgggugga

SEQ ID NO: 9708 - RNA, 20 nt, Artificial Sequence
  ELANE RNA Guide
gugcggguggaccugggagc

SEQ ID NO: 9709 - RNA, 20 nt, Artificial Sequence
  ELANE RNA Guide
guggaccugggagcccauaa

SEQ ID NO: 9710 - RNA, 20 nt, Artificial Sequence
  ELANE RNA Guide
guuaugggcucccaggucca

SEQ ID NO: 9711 - RNA, 20 nt, Artificial Sequence
  ELANE RNA Guide
uaugggcucccagguccacc

SEQ ID NO: 9712 - RNA, 20 nt, Artificial Sequence
  ELANE RNA Guide
ucccagguccacccgcaccg

SEQ ID NO: 9713 - RNA, 20 nt, Artificial Sequence
  ELANE RNA Guide
uccgcgcggugcggguggac

SEQ ID NO: 9714 - RNA, 20 nt, Artificial Sequence
  ELANE RNA Guide
ugcggguggaccugggagcc

SEQ ID NO: 9715 - RNA, 20 nt, Artificial Sequence
  ELANE RNA Guide
uggaccugggagcccauaac

SEQ ID NO: 9716 - RNA, 20 nt, Artificial Sequence
  ELANE RNA Guide
ugggcucccagguccacccg

SEQ ID NO: 9717 - RNA, 20 nt, Artificial Sequence
  ELANE RNA Guide
uuaugggcucccagguccac

SEQ ID NO: 9718 - RNA, 21 nt, Artificial Sequence
  ELANE RNA Guide
aaacguccgcgcggugcgggu

SEQ ID NO: 9719 - RNA, 21 nt, Artificial Sequence
  ELANE RNA Guide
aacguccgcgcggugcgggug

SEQ ID NO: 9720 - RNA, 21 nt, Artificial Sequence
  ELANE RNA Guide
agagguuaugggcucccaggu

SEQ ID NO: 9721 - RNA, 21 nt, Artificial Sequence
  ELANE RNA Guide
agguuaugggcucccaggucc

SEQ ID NO: 9722 - RNA, 21 nt, Artificial Sequence
  ELANE RNA Guide
augggcucccagguccacccg

SEQ ID NO: 9723 - RNA, 21 nt, Artificial Sequence
  ELANE RNA Guide
cgagagguuaugggcucccag

SEQ ID NO: 9724 - RNA, 21 nt, Artificial Sequence
  ELANE RNA Guide
cgcgagagguuaugggcuccc

SEQ ID NO: 9725 - RNA, 21 nt, Artificial Sequence
  ELANE RNA Guide
cggguggaccugggagcccau

SEQ ID NO: 9726 - RNA, 21 nt, Artificial Sequence
  ELANE RNA Guide
cggugcggguggaccugggag

SEQ ID NO: 9727 - RNA, 21 nt, Artificial Sequence
  ELANE RNA Guide
cucccagguccacccgcaccg

SEQ ID NO: 9728 - RNA, 21 nt, Artificial Sequence
  ELANE RNA Guide
gaaacguccgcgcggugcggg

SEQ ID NO: 9729 - RNA, 21 nt, Artificial Sequence
  ELANE RNA Guide
gaccugggagcccauaaccuc

SEQ ID NO: 9730 - RNA, 21 nt, Artificial Sequence
  ELANE RNA Guide
gagagguuaugggcucccagg

SEQ ID NO: 9731 - RNA, 21 nt, Artificial Sequence
  ELANE RNA Guide
gagguuaugggcucccagguc

SEQ ID NO: 9732 - RNA, 21 nt, Artificial Sequence
  ELANE RNA Guide
gcgagagguuaugggcuccca

SEQ ID NO: 9733 - RNA, 21 nt, Artificial Sequence
  ELANE RNA Guide
gcggguggaccugggagccca

SEQ ID NO: 9734 - RNA, 21 nt, Artificial Sequence
  ELANE RNA Guide
gcggugcggguggaccuggga

SEQ ID NO: 9735 - RNA, 21 nt, Artificial Sequence
  ELANE RNA Guide
gcucccagguccacccgcacc

SEQ ID NO: 9736 - RNA, 21 nt, Artificial Sequence
  ELANE RNA Guide
ggaccugggagcccauaaccu

SEQ ID NO: 9737 - RNA, 21 nt, Artificial Sequence
  ELANE RNA Guide
ggcucccagguccacccgcac

SEQ ID NO: 9738 - RNA, 21 nt, Artificial Sequence
  ELANE RNA Guide
gggcucccagguccacccgca

SEQ ID NO: 9739 - RNA, 21 nt, Artificial Sequence
  ELANE RNA Guide
ggguggaccugggagcccaua

SEQ ID NO: 9740 - RNA, 21 nt, Artificial Sequence
  ELANE RNA Guide
ggugcggguggaccugggagc

SEQ ID NO: 9741 - RNA, 21 nt, Artificial Sequence
  ELANE RNA Guide
gguggaccugggagcccauaa

SEQ ID NO: 9742 - RNA, 21 nt, Artificial Sequence
  ELANE RNA Guide
gguuaugggcucccaggucca

SEQ ID NO: 9743 - RNA, 21 nt, Artificial Sequence
  ELANE RNA Guide
gugcggguggaccugggagcc

SEQ ID NO: 9744 - RNA, 21 nt, Artificial Sequence
  ELANE RNA Guide
guggaccugggagcccauaac

SEQ ID NO: 9745 - RNA, 21 nt, Artificial Sequence
  ELANE RNA Guide
guuaugggcucccagguccac

SEQ ID NO: 9746 - RNA, 21 nt, Artificial Sequence
  ELANE RNA Guide
uaugggcucccagguccaccc

SEQ ID NO: 9747 - RNA, 21 nt, Artificial Sequence
  ELANE RNA Guide
ucccagguccacccgcaccgc

SEQ ID NO: 9748 - RNA, 21 nt, Artificial Sequence
  ELANE RNA Guide
ugcggguggaccugggagccc

SEQ ID NO: 9749 - RNA, 21 nt, Artificial Sequence
  ELANE RNA Guide
uggaccugggagcccauaacc

SEQ ID NO: 9750 - RNA, 21 nt, Artificial Sequence
  ELANE RNA Guide
ugggcucccagguccacccgc

SEQ ID NO: 9751 - RNA, 21 nt, Artificial Sequence
  ELANE RNA Guide
uuaugggcucccagguccacc

SEQ ID NO: 9752 - RNA, 22 nt, Artificial Sequence
  ELANE RNA Guide
aaacguccgcgcggugcgggug

SEQ ID NO: 9753 - RNA, 22 nt, Artificial Sequence
  ELANE RNA Guide
aacguccgcgcggugcgggugg

SEQ ID NO: 9754 - RNA, 22 nt, Artificial Sequence
  ELANE RNA Guide
acguccgcgcggugcgggugga

SEQ ID NO: 9755 - RNA, 22 nt, Artificial Sequence
  ELANE RNA Guide
agaaacguccgcgcggugcggg

SEQ ID NO: 9756 - RNA, 22 nt, Artificial Sequence
  ELANE RNA Guide
agagguuaugggcucccagguc

SEQ ID NO: 9757 - RNA, 22 nt, Artificial Sequence
  ELANE RNA Guide
agguccacccgcaccgcgcgga

SEQ ID NO: 9758 - RNA, 22 nt, Artificial Sequence
  ELANE RNA Guide
agguuaugggcucccaggucca

SEQ ID NO: 9759 - RNA, 22 nt, Artificial Sequence
  ELANE RNA Guide
augggcucccagguccacccgc

SEQ ID NO: 9760 - RNA, 22 nt, Artificial Sequence
  ELANE RNA Guide
ccgcgagagguuaugggcuccc

SEQ ID NO: 9761 - RNA, 22 nt, Artificial Sequence
  ELANE RNA Guide
cgagagguuaugggcucccagg

SEQ ID NO: 9762 - RNA, 22 nt, Artificial Sequence
  ELANE RNA Guide
cgcgagagguuaugggcuccca

SEQ ID NO: 9763 - RNA, 22 nt, Artificial Sequence
  ELANE RNA Guide
cgcggugcggguggaccuggga

SEQ ID NO: 9764 - RNA, 22 nt, Artificial Sequence
  ELANE RNA Guide
cggguggaccugggagcccaua

SEQ ID NO: 9765 - RNA, 22 nt, Artificial Sequence
  ELANE RNA Guide
cggugcggguggaccugggagc

SEQ ID NO: 9766 - RNA, 22 nt, Artificial Sequence
  ELANE RNA Guide
cucccagguccacccgcaccgc

SEQ ID NO: 9767 - RNA, 22 nt, Artificial Sequence
  ELANE RNA Guide
gaaacguccgcgcggugcgggu

SEQ ID NO: 9768 - RNA, 22 nt, Artificial Sequence
  ELANE RNA Guide
gaccugggagcccauaaccucu

SEQ ID NO: 9769 - RNA, 22 nt, Artificial Sequence
  ELANE RNA Guide
gagagguuaugggcucccaggu

SEQ ID NO: 9770 - RNA, 22 nt, Artificial Sequence
  ELANE RNA Guide
gagguuaugggcucccaggucc

SEQ ID NO: 9771 - RNA, 22 nt, Artificial Sequence
  ELANE RNA Guide
gcgagagguuaugggcucccag

SEQ ID NO: 9772 - RNA, 22 nt, Artificial Sequence
  ELANE RNA Guide
gcggguggaccugggagcccau

SEQ ID NO: 9773 - RNA, 22 nt, Artificial Sequence
  ELANE RNA Guide
gcggugcggguggaccugggag

SEQ ID NO: 9774 - RNA, 22 nt, Artificial Sequence
  ELANE RNA Guide
gcucccagguccacccgcaccg

SEQ ID NO: 9775 - RNA, 22 nt, Artificial Sequence
  ELANE RNA Guide
ggaccugggagcccauaaccuc

SEQ ID NO: 9776 - RNA, 22 nt, Artificial Sequence
  ELANE RNA Guide
ggcucccagguccacccgcacc

SEQ ID NO: 9777 - RNA, 22 nt, Artificial Sequence
  ELANE RNA Guide
gggcucccagguccacccgcac

SEQ ID NO: 9778 - RNA, 22 nt, Artificial Sequence
  ELANE RNA Guide
ggguggaccugggagcccauaa

SEQ ID NO: 9779 - RNA, 22 nt, Artificial Sequence
  ELANE RNA Guide
ggugcggguggaccugggagcc

SEQ ID NO: 9780 - RNA, 22 nt, Artificial Sequence
  ELANE RNA Guide
gguggaccugggagcccauaac

SEQ ID NO: 9781 - RNA, 22 nt, Artificial Sequence
  ELANE RNA Guide
gguuaugggcucccagguccac

SEQ ID NO: 9782 - RNA, 22 nt, Artificial Sequence
  ELANE RNA Guide
gugcggguggaccugggagccc

SEQ ID NO: 9783 - RNA, 22 nt, Artificial Sequence
  ELANE RNA Guide
guggaccugggagcccauaacc

SEQ ID NO: 9784 - RNA, 22 nt, Artificial Sequence
  ELANE RNA Guide
guuaugggcucccagguccacc

SEQ ID NO: 9785 - RNA, 22 nt, Artificial Sequence
  ELANE RNA Guide
uaugggcucccagguccacccg

SEQ ID NO: 9786 - RNA, 22 nt, Artificial Sequence
  ELANE RNA Guide
ucccagguccacccgcaccgcg

SEQ ID NO: 9787 - RNA, 22 nt, Artificial Sequence
  ELANE RNA Guide
uccgcgcggugcggguggaccu

SEQ ID NO: 9788 - RNA, 22 nt, Artificial Sequence
  ELANE RNA Guide
ugcggguggaccugggagccca

SEQ ID NO: 9789 - RNA, 22 nt, Artificial Sequence
  ELANE RNA Guide
uggaccugggagcccauaaccu

SEQ ID NO: 9790 - RNA, 22 nt, Artificial Sequence
  ELANE RNA Guide
ugggcucccagguccacccgca

SEQ ID NO: 9791 - RNA, 22 nt, Artificial Sequence
  ELANE RNA Guide
uuaugggcucccagguccaccc

SEQ ID NO: 9792 - RNA, 20 nt, Artificial Sequence
  ELANE RNA Guide
agagguuaugggcucccggg

SEQ ID NO: 9793 - RNA, 20 nt, Artificial Sequence
  ELANE RNA Guide
agguuaugggcucccgggac

SEQ ID NO: 9794 - RNA, 20 nt, Artificial Sequence
  ELANE RNA Guide
augggcucccgggaccaccc

SEQ ID NO: 9795 - RNA, 20 nt, Artificial Sequence
  ELANE RNA Guide
cccgggagcccauaaccucu

SEQ ID NO: 9796 - RNA, 20 nt, Artificial Sequence
  ELANE RNA Guide
ccgcgagagguuaugggcuc

SEQ ID NO: 9797 - RNA, 20 nt, Artificial Sequence
  ELANE RNA Guide
ccgggagcccauaaccucuc

SEQ ID NO: 9798 - RNA, 20 nt, Artificial Sequence
  ELANE RNA Guide
cgagagguuaugggcucccg

SEQ ID NO: 9799 - RNA, 20 nt, Artificial Sequence
  ELANE RNA Guide
cgcgagagguuaugggcucc

SEQ ID NO: 9800 - RNA, 20 nt, Artificial Sequence
  ELANE RNA Guide
cggguggucccgggagccca

SEQ ID NO: 9801 - RNA, 20 nt, Artificial Sequence
  ELANE RNA Guide
cggugcggguggucccggga

SEQ ID NO: 9802 - RNA, 20 nt, Artificial Sequence
  ELANE RNA Guide
cucccgggaccacccgcacc

SEQ ID NO: 9803 - RNA, 20 nt, Artificial Sequence
  ELANE RNA Guide
gagagguuaugggcucccgg

SEQ ID NO: 9804 - RNA, 20 nt, Artificial Sequence
  ELANE RNA Guide
gagguuaugggcucccggga

SEQ ID NO: 9805 - RNA, 20 nt, Artificial Sequence
  ELANE RNA Guide
gccgcgagagguuaugggcu

SEQ ID NO: 9806 - RNA, 20 nt, Artificial Sequence
  ELANE RNA Guide
gcucccgggaccacccgcac

SEQ ID NO: 9807 - RNA, 20 nt, Artificial Sequence
  ELANE RNA Guide
ggcucccgggaccacccgca

SEQ ID NO: 9808 - RNA, 20 nt, Artificial Sequence
  ELANE RNA Guide
ggguggucccgggagcccau

SEQ ID NO: 9809 - RNA, 20 nt, Artificial Sequence
  ELANE RNA Guide
ggucccgggagcccauaacc

SEQ ID NO: 9810 - RNA, 20 nt, Artificial Sequence
  ELANE RNA Guide
ggugcggguggucccgggag

SEQ ID NO: 9811 - RNA, 20 nt, Artificial Sequence
  ELANE RNA Guide
gguggucccgggagcccaua

SEQ ID NO: 9812 - RNA, 20 nt, Artificial Sequence
  ELANE RNA Guide
gguuaugggcucccgggacc

SEQ ID NO: 9813 - RNA, 20 nt, Artificial Sequence
  ELANE RNA Guide
gucccgggagcccauaaccu

SEQ ID NO: 9814 - RNA, 20 nt, Artificial Sequence
  ELANE RNA Guide
guccgcgcggugcggguggu

SEQ ID NO: 9815 - RNA, 20 nt, Artificial Sequence
  ELANE RNA Guide
gugcggguggucccgggagc

SEQ ID NO: 9816 - RNA, 20 nt, Artificial Sequence
  ELANE RNA Guide
guggucccgggagcccauaa

SEQ ID NO: 9817 - RNA, 20 nt, Artificial Sequence
  ELANE RNA Guide
guuaugggcucccgggacca

SEQ ID NO: 9818 - RNA, 20 nt, Artificial Sequence
  ELANE RNA Guide
uaugggcucccgggaccacc

SEQ ID NO: 9819 - RNA, 20 nt, Artificial Sequence
  ELANE RNA Guide
ucccgggaccacccgcaccg

SEQ ID NO: 9820 - RNA, 20 nt, Artificial Sequence
  ELANE RNA Guide
ucccgggagcccauaaccuc

SEQ ID NO: 9821 - RNA, 20 nt, Artificial Sequence
  ELANE RNA Guide
uccgcgcggugcgggugguc

SEQ ID NO: 9822 - RNA, 20 nt, Artificial Sequence
  ELANE RNA Guide
ugcggguggucccgggagcc

SEQ ID NO: 9823 - RNA, 20 nt, Artificial Sequence
  ELANE RNA Guide
ugggcucccgggaccacccg

SEQ ID NO: 9824 - RNA, 20 nt, Artificial Sequence
  ELANE RNA Guide
uggucccgggagcccauaac

SEQ ID NO: 9825 - RNA, 20 nt, Artificial Sequence
  ELANE RNA Guide
uuaugggcucccgggaccac

SEQ ID NO: 9826 - RNA, 21 nt, Artificial Sequence
  ELANE RNA Guide
agagguuaugggcucccggga

SEQ ID NO: 9827 - RNA, 21 nt, Artificial Sequence
  ELANE RNA Guide
agguuaugggcucccgggacc

SEQ ID NO: 9828 - RNA, 21 nt, Artificial Sequence
  ELANE RNA Guide
augggcucccgggaccacccg

SEQ ID NO: 9829 - RNA, 21 nt, Artificial Sequence
  ELANE RNA Guide
cccgggagcccauaaccucuc

SEQ ID NO: 9830 - RNA, 21 nt, Artificial Sequence
  ELANE RNA Guide
ccgcgagagguuaugggcucc

SEQ ID NO: 9831 - RNA, 21 nt, Artificial Sequence
  ELANE RNA Guide
ccgggagcccauaaccucucg

SEQ ID NO: 9832 - RNA, 21 nt, Artificial Sequence
  ELANE RNA Guide
cgagagguuaugggcucccgg

SEQ ID NO: 9833 - RNA, 21 nt, Artificial Sequence
  ELANE RNA Guide
cgccgcgagagguuaugggcu

SEQ ID NO: 9834 - RNA, 21 nt, Artificial Sequence
  ELANE RNA Guide
cggguggucccgggagcccau

SEQ ID NO: 9835 - RNA, 21 nt, Artificial Sequence
  ELANE RNA Guide
gagagguuaugggcucccggg

SEQ ID NO: 9836 - RNA, 21 nt, Artificial Sequence
  ELANE RNA Guide
gagguuaugggcucccgggac

SEQ ID NO: 9837 - RNA, 21 nt, Artificial Sequence
  ELANE RNA Guide
gccgcgagagguuaugggcuc

SEQ ID NO: 9838 - RNA, 21 nt, Artificial Sequence
  ELANE RNA Guide
gcgagagguuaugggcucccg

SEQ ID NO: 9839 - RNA, 21 nt, Artificial Sequence
  ELANE RNA Guide
ggguggucccgggagcccaua

SEQ ID NO: 9840 - RNA, 21 nt, Artificial Sequence
  ELANE RNA Guide
ggucccgggagcccauaaccu

SEQ ID NO: 9841 - RNA, 21 nt, Artificial Sequence
  ELANE RNA Guide
gguggucccgggagcccauaa

SEQ ID NO: 9842 - RNA, 21 nt, Artificial Sequence
  ELANE RNA Guide
gguuaugggcucccgggacca

SEQ ID NO: 9843 - RNA, 21 nt, Artificial Sequence
  ELANE RNA Guide
gucccgggagcccauaaccuc

SEQ ID NO: 9844 - RNA, 21 nt, Artificial Sequence
  ELANE RNA Guide
guggucccgggagcccauaac

SEQ ID NO: 9845 - RNA, 21 nt, Artificial Sequence
  ELANE RNA Guide
guuaugggcucccgggaccac

SEQ ID NO: 9846 - RNA, 21 nt, Artificial Sequence
  ELANE RNA Guide
uaugggcucccgggaccaccc

SEQ ID NO: 9847 - RNA, 21 nt, Artificial Sequence
  ELANE RNA Guide
ucccgggagcccauaaccucu

SEQ ID NO: 9848 - RNA, 21 nt, Artificial Sequence
  ELANE RNA Guide
uggucccgggagcccauaacc

SEQ ID NO: 9849 - RNA, 21 nt, Artificial Sequence
  ELANE RNA Guide
uuaugggcucccgggaccacc

SEQ ID NO: 9850 - RNA, 22 nt, Artificial Sequence
  ELANE RNA Guide
acguccgcgcggugcggguggu

SEQ ID NO: 9851 - RNA, 22 nt, Artificial Sequence
  ELANE RNA Guide
agagguuaugggcucccgggac

SEQ ID NO: 9852 - RNA, 22 nt, Artificial Sequence
  ELANE RNA Guide
agguuaugggcucccgggacca

SEQ ID NO: 9853 - RNA, 22 nt, Artificial Sequence
  ELANE RNA Guide
augggcucccgggaccacccgc

SEQ ID NO: 9854 - RNA, 22 nt, Artificial Sequence
  ELANE RNA Guide
cccgggagcccauaaccucucg

SEQ ID NO: 9855 - RNA, 22 nt, Artificial Sequence
  ELANE RNA Guide
ccgccgcgagagguuaugggcu

SEQ ID NO: 9856 - RNA, 22 nt, Artificial Sequence
  ELANE RNA Guide
ccgggagcccauaaccucucgc

SEQ ID NO: 9857 - RNA, 22 nt, Artificial Sequence
  ELANE RNA Guide
cgagagguuaugggcucccggg

SEQ ID NO: 9858 - RNA, 22 nt, Artificial Sequence
  ELANE RNA Guide
cgccgcgagagguuaugggcuc

SEQ ID NO: 9859 - RNA, 22 nt, Artificial Sequence
  ELANE RNA Guide
cgcgagagguuaugggcucccg

SEQ ID NO: 9860 - RNA, 22 nt, Artificial Sequence
  ELANE RNA Guide
cggguggucccgggagcccaua

SEQ ID NO: 9861 - RNA, 22 nt, Artificial Sequence
  ELANE RNA Guide
gagagguuaugggcucccggga

SEQ ID NO: 9862 - RNA, 22 nt, Artificial Sequence
  ELANE RNA Guide
gagguuaugggcucccgggacc

SEQ ID NO: 9863 - RNA, 22 nt, Artificial Sequence
  ELANE RNA Guide
gccgcgagagguuaugggcucc

SEQ ID NO: 9864 - RNA, 22 nt, Artificial Sequence
  ELANE RNA Guide
gcgagagguuaugggcucccgg

SEQ ID NO: 9865 - RNA, 22 nt, Artificial Sequence
  ELANE RNA Guide
gcggguggucccgggagcccau

SEQ ID NO: 9866 - RNA, 22 nt, Artificial Sequence
  ELANE RNA Guide
ggguggucccgggagcccauaa

SEQ ID NO: 9867 - RNA, 22 nt, Artificial Sequence
  ELANE RNA Guide
ggucccgggagcccauaaccuc

SEQ ID NO: 9868 - RNA, 22 nt, Artificial Sequence
  ELANE RNA Guide
gguggucccgggagcccauaac

SEQ ID NO: 9869 - RNA, 22 nt, Artificial Sequence
  ELANE RNA Guide
gguuaugggcucccgggaccac

SEQ ID NO: 9870 - RNA, 22 nt, Artificial Sequence
  ELANE RNA Guide
gucccgggagcccauaaccucu

SEQ ID NO: 9871 - RNA, 22 nt, Artificial Sequence
  ELANE RNA Guide
guggucccgggagcccauaacc

SEQ ID NO: 9872 - RNA, 22 nt, Artificial Sequence
  ELANE RNA Guide
guuaugggcucccgggaccacc

SEQ ID NO: 9873 - RNA, 22 nt, Artificial Sequence
  ELANE RNA Guide
uaugggcucccgggaccacccg

SEQ ID NO: 9874 - RNA, 22 nt, Artificial Sequence
  ELANE RNA Guide
ucccgggagcccauaaccucuc

SEQ ID NO: 9875 - RNA, 22 nt, Artificial Sequence
  ELANE RNA Guide
ugcggguggucccgggagccca

SEQ ID NO: 9876 - RNA, 22 nt, Artificial Sequence
  ELANE RNA Guide
ugggcucccgggaccacccgca

SEQ ID NO: 9877 - RNA, 22 nt, Artificial Sequence
  ELANE RNA Guide
uggucccgggagcccauaaccu

SEQ ID NO: 9878 - RNA, 22 nt, Artificial Sequence
  ELANE RNA Guide
uuaugggcucccgggaccaccc

SEQ ID NO: 9879 - RNA, 20 nt, Artificial Sequence
  ELANE RNA Guide
agagguuaugggcucucagg

SEQ ID NO: 9880 - RNA, 20 nt, Artificial Sequence
  ELANE RNA Guide
agguuaugggcucucaggac

SEQ ID NO: 9881 - RNA, 20 nt, Artificial Sequence
  ELANE RNA Guide
augggcucucaggaccaccc

SEQ ID NO: 9882 - RNA, 20 nt, Artificial Sequence
  ELANE RNA Guide
ccgccgcgagagguuauggg

SEQ ID NO: 9883 - RNA, 20 nt, Artificial Sequence
  ELANE RNA Guide
ccugagagcccauaaccucu

SEQ ID NO: 9884 - RNA, 20 nt, Artificial Sequence
  ELANE RNA Guide
cgagagguuaugggcucuca

SEQ ID NO: 9885 - RNA, 20 nt, Artificial Sequence
  ELANE RNA Guide
cgccgcgagagguuaugggc

SEQ ID NO: 9886 - RNA, 20 nt, Artificial Sequence
  ELANE RNA Guide
cgcgagagguuaugggcucu

SEQ ID NO: 9887 - RNA, 20 nt, Artificial Sequence
  ELANE RNA Guide
cgcgcggugcgggugguccu

SEQ ID NO: 9888 - RNA, 20 nt, Artificial Sequence
  ELANE RNA Guide
cgcggugcgggugguccuga

SEQ ID NO: 9889 - RNA, 20 nt, Artificial Sequence
  ELANE RNA Guide
cgggugguccugagagccca

SEQ ID NO: 9890 - RNA, 20 nt, Artificial Sequence
  ELANE RNA Guide
cggugcgggugguccugaga

SEQ ID NO: 9891 - RNA, 20 nt, Artificial Sequence
  ELANE RNA Guide
cucaggaccacccgcaccgc

SEQ ID NO: 9892 - RNA, 20 nt, Artificial Sequence
  ELANE RNA Guide
cucucaggaccacccgcacc

SEQ ID NO: 9893 - RNA, 20 nt, Artificial Sequence
  ELANE RNA Guide
cugagagcccauaaccucuc

SEQ ID NO: 9894 - RNA, 20 nt, Artificial Sequence
  ELANE RNA Guide
gagagcccauaaccucucgc

SEQ ID NO: 9895 - RNA, 20 nt, Artificial Sequence
  ELANE RNA Guide
gagagguuaugggcucucag

SEQ ID NO: 9896 - RNA, 20 nt, Artificial Sequence
  ELANE RNA Guide
gagguuaugggcucucagga

SEQ ID NO: 9897 - RNA, 20 nt, Artificial Sequence
  ELANE RNA Guide
gcgagagguuaugggcucuc

SEQ ID NO: 9898 - RNA, 20 nt, Artificial Sequence
  ELANE RNA Guide
gcgcggugcgggugguccug

SEQ ID NO: 9899 - RNA, 20 nt, Artificial Sequence
  ELANE RNA Guide
gcgggugguccugagagccc

SEQ ID NO: 9900 - RNA, 20 nt, Artificial Sequence
  ELANE RNA Guide
gcggugcgggugguccugag

SEQ ID NO: 9901 - RNA, 20 nt, Artificial Sequence
  ELANE RNA Guide
gcucucaggaccacccgcac

SEQ ID NO: 9902 - RNA, 20 nt, Artificial Sequence
  ELANE RNA Guide
ggcucucaggaccacccgca

SEQ ID NO: 9903 - RNA, 20 nt, Artificial Sequence
  ELANE RNA Guide
gggcucucaggaccacccgc

SEQ ID NO: 9904 - RNA, 20 nt, Artificial Sequence
  ELANE RNA Guide
gggugguccugagagcccau

SEQ ID NO: 9905 - RNA, 20 nt, Artificial Sequence
  ELANE RNA Guide
gguccugagagcccauaacc

SEQ ID NO: 9906 - RNA, 20 nt, Artificial Sequence
  ELANE RNA Guide
ggugcgggugguccugagag

SEQ ID NO: 9907 - RNA, 20 nt, Artificial Sequence
  ELANE RNA Guide
ggugguccugagagcccaua

SEQ ID NO: 9908 - RNA, 20 nt, Artificial Sequence
  ELANE RNA Guide
gguuaugggcucucaggacc

SEQ ID NO: 9909 - RNA, 20 nt, Artificial Sequence
  ELANE RNA Guide
guccugagagcccauaaccu

SEQ ID NO: 9910 - RNA, 20 nt, Artificial Sequence
  ELANE RNA Guide
gugcgggugguccugagagc

SEQ ID NO: 9911 - RNA, 20 nt, Artificial Sequence
  ELANE RNA Guide
gugguccugagagcccauaa

SEQ ID NO: 9912 - RNA, 20 nt, Artificial Sequence
  ELANE RNA Guide
guuaugggcucucaggacca

SEQ ID NO: 9913 - RNA, 20 nt, Artificial Sequence
  ELANE RNA Guide
uaugggcucucaggaccacc

SEQ ID NO: 9914 - RNA, 20 nt, Artificial Sequence
  ELANE RNA Guide
uccugagagcccauaaccuc

SEQ ID NO: 9915 - RNA, 20 nt, Artificial Sequence
  ELANE RNA Guide
ucucaggaccacccgcaccg

SEQ ID NO: 9916 - RNA, 20 nt, Artificial Sequence
  ELANE RNA Guide
ugagagcccauaaccucucg

SEQ ID NO: 9917 - RNA, 20 nt, Artificial Sequence
  ELANE RNA Guide
ugcgggugguccugagagcc

SEQ ID NO: 9918 - RNA, 20 nt, Artificial Sequence
  ELANE RNA Guide
ugggcucucaggaccacccg

SEQ ID NO: 9919 - RNA, 20 nt, Artificial Sequence
  ELANE RNA Guide
ugguccugagagcccauaac

SEQ ID NO: 9920 - RNA, 20 nt, Artificial Sequence
  ELANE RNA Guide
uuaugggcucucaggaccac

SEQ ID NO: 9921 - RNA, 21 nt, Artificial Sequence
  ELANE RNA Guide
agagguuaugggcucucagga

SEQ ID NO: 9922 - RNA, 21 nt, Artificial Sequence
  ELANE RNA Guide
agguuaugggcucucaggacc

SEQ ID NO: 9923 - RNA, 21 nt, Artificial Sequence
  ELANE RNA Guide
augggcucucaggaccacccg

SEQ ID NO: 9924 - RNA, 21 nt, Artificial Sequence
  ELANE RNA Guide
cccgccgcgagagguuauggg

SEQ ID NO: 9925 - RNA, 21 nt, Artificial Sequence
  ELANE RNA Guide
ccgccgcgagagguuaugggc

SEQ ID NO: 9926 - RNA, 21 nt, Artificial Sequence
  ELANE RNA Guide
ccgcgagagguuaugggcucu

SEQ ID NO: 9927 - RNA, 21 nt, Artificial Sequence
  ELANE RNA Guide
ccugagagcccauaaccucuc

SEQ ID NO: 9928 - RNA, 21 nt, Artificial Sequence
  ELANE RNA Guide
cgagagguuaugggcucucag

SEQ ID NO: 9929 - RNA, 21 nt, Artificial Sequence
  ELANE RNA Guide
cgcgagagguuaugggcucuc

SEQ ID NO: 9930 - RNA, 21 nt, Artificial Sequence
  ELANE RNA Guide
cgcggugcgggugguccugag

SEQ ID NO: 9931 - RNA, 21 nt, Artificial Sequence
  ELANE RNA Guide
cgggugguccugagagcccau

SEQ ID NO: 9932 - RNA, 21 nt, Artificial Sequence
  ELANE RNA Guide
cggugcgggugguccugagag

SEQ ID NO: 9933 - RNA, 21 nt, Artificial Sequence
  ELANE RNA Guide
cucaggaccacccgcaccgcg

SEQ ID NO: 9934 - RNA, 21 nt, Artificial Sequence
  ELANE RNA Guide
cucucaggaccacccgcaccg

SEQ ID NO: 9935 - RNA, 21 nt, Artificial Sequence
  ELANE RNA Guide
cugagagcccauaaccucucg

SEQ ID NO: 9936 - RNA, 21 nt, Artificial Sequence
  ELANE RNA Guide
gagagcccauaaccucucgcg

SEQ ID NO: 9937 - RNA, 21 nt, Artificial Sequence
  ELANE RNA Guide
gagagguuaugggcucucagg

SEQ ID NO: 9938 - RNA, 21 nt, Artificial Sequence
  ELANE RNA Guide
gagguuaugggcucucaggac

SEQ ID NO: 9939 - RNA, 21 nt, Artificial Sequence
  ELANE RNA Guide
gcgagagguuaugggcucuca

SEQ ID NO: 9940 - RNA, 21 nt, Artificial Sequence
  ELANE RNA Guide
gcgcggugcgggugguccuga

SEQ ID NO: 9941 - RNA, 21 nt, Artificial Sequence
  ELANE RNA Guide
gcgggugguccugagagccca

SEQ ID NO: 9942 - RNA, 21 nt, Artificial Sequence
  ELANE RNA Guide
gcggugcgggugguccugaga

SEQ ID NO: 9943 - RNA, 21 nt, Artificial Sequence
  ELANE RNA Guide
gcucucaggaccacccgcacc

SEQ ID NO: 9944 - RNA, 21 nt, Artificial Sequence
  ELANE RNA Guide
ggcucucaggaccacccgcac

SEQ ID NO: 9945 - RNA, 21 nt, Artificial Sequence
  ELANE RNA Guide
gggcucucaggaccacccgca

SEQ ID NO: 9946 - RNA, 21 nt, Artificial Sequence
  ELANE RNA Guide
gggugguccugagagcccaua

SEQ ID NO: 9947 - RNA, 21 nt, Artificial Sequence
  ELANE RNA Guide
gguccugagagcccauaaccu

SEQ ID NO: 9948 - RNA, 21 nt, Artificial Sequence
  ELANE RNA Guide
ggugcgggugguccugagagc

SEQ ID NO: 9949 - RNA, 21 nt, Artificial Sequence
  ELANE RNA Guide
ggugguccugagagcccauaa

SEQ ID NO: 9950 - RNA, 21 nt, Artificial Sequence
  ELANE RNA Guide
gguuaugggcucucaggacca

SEQ ID NO: 9951 - RNA, 21 nt, Artificial Sequence
  ELANE RNA Guide
guccugagagcccauaaccuc

SEQ ID NO: 9952 - RNA, 21 nt, Artificial Sequence
  ELANE RNA Guide
gugcgggugguccugagagcc

SEQ ID NO: 9953 - RNA, 21 nt, Artificial Sequence
  ELANE RNA Guide
gugguccugagagcccauaac

SEQ ID NO: 9954 - RNA, 21 nt, Artificial Sequence
  ELANE RNA Guide
guuaugggcucucaggaccac

SEQ ID NO: 9955 - RNA, 21 nt, Artificial Sequence
  ELANE RNA Guide
uaugggcucucaggaccaccc

SEQ ID NO: 9956 - RNA, 21 nt, Artificial Sequence
  ELANE RNA Guide
uccugagagcccauaaccucu

SEQ ID NO: 9957 - RNA, 21 nt, Artificial Sequence
  ELANE RNA Guide
ucucaggaccacccgcaccgc

SEQ ID NO: 9958 - RNA, 21 nt, Artificial Sequence
  ELANE RNA Guide
ugagagcccauaaccucucgc

SEQ ID NO: 9959 - RNA, 21 nt, Artificial Sequence
  ELANE RNA Guide
ugcgggugguccugagagccc

SEQ ID NO: 9960 - RNA, 21 nt, Artificial Sequence
  ELANE RNA Guide
ugggcucucaggaccacccgc

SEQ ID NO: 9961 - RNA, 21 nt, Artificial Sequence
  ELANE RNA Guide
ugguccugagagcccauaacc

SEQ ID NO: 9962 - RNA, 21 nt, Artificial Sequence
  ELANE RNA Guide
uuaugggcucucaggaccacc

SEQ ID NO: 9963 - RNA, 22 nt, Artificial Sequence
  ELANE RNA Guide
agagguuaugggcucucaggac

SEQ ID NO: 9964 - RNA, 22 nt, Artificial Sequence
  ELANE RNA Guide
agguuaugggcucucaggacca

SEQ ID NO: 9965 - RNA, 22 nt, Artificial Sequence
  ELANE RNA Guide
augggcucucaggaccacccgc

SEQ ID NO: 9966 - RNA, 22 nt, Artificial Sequence
  ELANE RNA Guide
cccgccgcgagagguuaugggc

SEQ ID NO: 9967 - RNA, 22 nt, Artificial Sequence
  ELANE RNA Guide
ccgcgagagguuaugggcucuc

SEQ ID NO: 9968 - RNA, 22 nt, Artificial Sequence
  ELANE RNA Guide
ccugagagcccauaaccucucg

SEQ ID NO: 9969 - RNA, 22 nt, Artificial Sequence
  ELANE RNA Guide
cgagagguuaugggcucucagg

SEQ ID NO: 9970 - RNA, 22 nt, Artificial Sequence
  ELANE RNA Guide
cgcgagagguuaugggcucuca

SEQ ID NO: 9971 - RNA, 22 nt, Artificial Sequence
  ELANE RNA Guide
cgcgcggugcgggugguccuga

SEQ ID NO: 9972 - RNA, 22 nt, Artificial Sequence
  ELANE RNA Guide
cgcggugcgggugguccugaga

SEQ ID NO: 9973 - RNA, 22 nt, Artificial Sequence
  ELANE RNA Guide
cgggugguccugagagcccaua

SEQ ID NO: 9974 - RNA, 22 nt, Artificial Sequence
  ELANE RNA Guide
cggugcgggugguccugagagc

SEQ ID NO: 9975 - RNA, 22 nt, Artificial Sequence
  ELANE RNA Guide
cucaggaccacccgcaccgcgc

SEQ ID NO: 9976 - RNA, 22 nt, Artificial Sequence
  ELANE RNA Guide
cucucaggaccacccgcaccgc

SEQ ID NO: 9977 - RNA, 22 nt, Artificial Sequence
  ELANE RNA Guide
cugagagcccauaaccucucgc

SEQ ID NO: 9978 - RNA, 22 nt, Artificial Sequence
  ELANE RNA Guide
gagagcccauaaccucucgcgg

SEQ ID NO: 9979 - RNA, 22 nt, Artificial Sequence
  ELANE RNA Guide
gagagguuaugggcucucagga

SEQ ID NO: 9980 - RNA, 22 nt, Artificial Sequence
  ELANE RNA Guide
gagguuaugggcucucaggacc

SEQ ID NO: 9981 - RNA, 22 nt, Artificial Sequence
  ELANE RNA Guide
gccgcgagagguuaugggcucu

SEQ ID NO: 9982 - RNA, 22 nt, Artificial Sequence
  ELANE RNA Guide
gcgagagguuaugggcucucag

SEQ ID NO: 9983 - RNA, 22 nt, Artificial Sequence
  ELANE RNA Guide
gcgcggugcgggugguccugag

SEQ ID NO: 9984 - RNA, 22 nt, Artificial Sequence
  ELANE RNA Guide
gcgggugguccugagagcccau

SEQ ID NO: 9985 - RNA, 22 nt, Artificial Sequence
  ELANE RNA Guide
gcggugcgggugguccugagag

SEQ ID NO: 9986 - RNA, 22 nt, Artificial Sequence
  ELANE RNA Guide
gcucucaggaccacccgcaccg

SEQ ID NO: 9987 - RNA, 22 nt, Artificial Sequence
  ELANE RNA Guide
ggcucucaggaccacccgcacc

SEQ ID NO: 9988 - RNA, 22 nt, Artificial Sequence
  ELANE RNA Guide
gggcucucaggaccacccgcac

SEQ ID NO: 9989 - RNA, 22 nt, Artificial Sequence
  ELANE RNA Guide
gggugguccugagagcccauaa

SEQ ID NO: 9990 - RNA, 22 nt, Artificial Sequence
  ELANE RNA Guide
gguccugagagcccauaaccuc

SEQ ID NO: 9991 - RNA, 22 nt, Artificial Sequence
  ELANE RNA Guide
ggugcgggugguccugagagcc

SEQ ID NO: 9992 - RNA, 22 nt, Artificial Sequence
  ELANE RNA Guide
ggugguccugagagcccauaac

SEQ ID NO: 9993 - RNA, 22 nt, Artificial Sequence
  ELANE RNA Guide
gguuaugggcucucaggaccac

SEQ ID NO: 9994 - RNA, 22 nt, Artificial Sequence
  ELANE RNA Guide
guccugagagcccauaaccucu

SEQ ID NO: 9995 - RNA, 22 nt, Artificial Sequence
  ELANE RNA Guide
gugcgggugguccugagagccc

SEQ ID NO: 9996 - RNA, 22 nt, Artificial Sequence
  ELANE RNA Guide
gugguccugagagcccauaacc

SEQ ID NO: 9997 - RNA, 22 nt, Artificial Sequence
  ELANE RNA Guide
guuaugggcucucaggaccacc

SEQ ID NO: 9998 - RNA, 22 nt, Artificial Sequence
  ELANE RNA Guide
uaugggcucucaggaccacccg

SEQ ID NO: 9999 - RNA, 22 nt, Artificial Sequence
  ELANE RNA Guide
ucccgccgcgagagguuauggg

SEQ ID NO: 10000 - RNA, 22 nt, Artificial Sequence
  ELANE RNA Guide
uccgcgcggugcgggugguccu

SEQ ID NO: 10001 - RNA, 22 nt, Artificial Sequence
  ELANE RNA Guide
uccugagagcccauaaccucuc

SEQ ID NO: 10002 - RNA, 22 nt, Artificial Sequence
  ELANE RNA Guide
ucucaggaccacccgcaccgcg

SEQ ID NO: 10003 - RNA, 22 nt, Artificial Sequence
  ELANE RNA Guide
ugagagcccauaaccucucgcg

SEQ ID NO: 10004 - RNA, 22 nt, Artificial Sequence
  ELANE RNA Guide
ugcgggugguccugagagccca

SEQ ID NO: 10005 - RNA, 22 nt, Artificial Sequence
  ELANE RNA Guide
ugggcucucaggaccacccgca

SEQ ID NO: 10006 - RNA, 22 nt, Artificial Sequence
  ELANE RNA Guide
ugguccugagagcccauaaccu

SEQ ID NO: 10007 - RNA, 22 nt, Artificial Sequence
  ELANE RNA Guide
uuaugggcucucaggaccaccc

SEQ ID NO: 10008 - RNA, 20 nt, Artificial Sequence
  ELANE RNA Guide
agagguuaugggcucgcagg

SEQ ID NO: 10009 - RNA, 20 nt, Artificial Sequence
  ELANE RNA Guide
agguuaugggcucgcaggac

SEQ ID NO: 10010 - RNA, 20 nt, Artificial Sequence
  ELANE RNA Guide
augggcucgcaggaccaccc

SEQ ID NO: 10011 - RNA, 20 nt, Artificial Sequence
  ELANE RNA Guide
ccugcgagcccauaaccucu

SEQ ID NO: 10012 - RNA, 20 nt, Artificial Sequence
  ELANE RNA Guide
cgagagguuaugggcucgca

SEQ ID NO: 10013 - RNA, 20 nt, Artificial Sequence
  ELANE RNA Guide
cgcaggaccacccgcaccgc

SEQ ID NO: 10014 - RNA, 20 nt, Artificial Sequence
  ELANE RNA Guide
cgcgagagguuaugggcucg

SEQ ID NO: 10015 - RNA, 20 nt, Artificial Sequence
  ELANE RNA Guide
cgcggugcgggugguccugc

SEQ ID NO: 10016 - RNA, 20 nt, Artificial Sequence
  ELANE RNA Guide
cgggugguccugcgagccca

SEQ ID NO: 10017 - RNA, 20 nt, Artificial Sequence
  ELANE RNA Guide
cggugcgggugguccugcga

SEQ ID NO: 10018 - RNA, 20 nt, Artificial Sequence
  ELANE RNA Guide
cucgcaggaccacccgcacc

SEQ ID NO: 10019 - RNA, 20 nt, Artificial Sequence
  ELANE RNA Guide
cugcgagcccauaaccucuc

SEQ ID NO: 10020 - RNA, 20 nt, Artificial Sequence
  ELANE RNA Guide
gagagguuaugggcucgcag

SEQ ID NO: 10021 - RNA, 20 nt, Artificial Sequence
  ELANE RNA Guide
gagguuaugggcucgcagga

SEQ ID NO: 10022 - RNA, 20 nt, Artificial Sequence
  ELANE RNA Guide
gcgagagguuaugggcucgc

SEQ ID NO: 10023 - RNA, 20 nt, Artificial Sequence
  ELANE RNA Guide
gcgagcccauaaccucucgc

SEQ ID NO: 10024 - RNA, 20 nt, Artificial Sequence
  ELANE RNA Guide
gcgggugguccugcgagccc

SEQ ID NO: 10025 - RNA, 20 nt, Artificial Sequence
  ELANE RNA Guide
gcggugcgggugguccugcg

SEQ ID NO: 10026 - RNA, 20 nt, Artificial Sequence
  ELANE RNA Guide
gcucgcaggaccacccgcac

SEQ ID NO: 10027 - RNA, 20 nt, Artificial Sequence
  ELANE RNA Guide
ggcucgcaggaccacccgca

SEQ ID NO: 10028 - RNA, 20 nt, Artificial Sequence
  ELANE RNA Guide
gggcucgcaggaccacccgc

SEQ ID NO: 10029 - RNA, 20 nt, Artificial Sequence
  ELANE RNA Guide
gggugguccugcgagcccau

SEQ ID NO: 10030 - RNA, 20 nt, Artificial Sequence
  ELANE RNA Guide
gguccugcgagcccauaacc

SEQ ID NO: 10031 - RNA, 20 nt, Artificial Sequence
  ELANE RNA Guide
ggugcgggugguccugcgag

SEQ ID NO: 10032 - RNA, 20 nt, Artificial Sequence
  ELANE RNA Guide
ggugguccugcgagcccaua

SEQ ID NO: 10033 - RNA, 20 nt, Artificial Sequence
  ELANE RNA Guide
gguuaugggcucgcaggacc

SEQ ID NO: 10034 - RNA, 20 nt, Artificial Sequence
  ELANE RNA Guide
guccugcgagcccauaaccu

SEQ ID NO: 10035 - RNA, 20 nt, Artificial Sequence
  ELANE RNA Guide
gugcgggugguccugcgagc

SEQ ID NO: 10036 - RNA, 20 nt, Artificial Sequence
  ELANE RNA Guide
gugguccugcgagcccauaa

SEQ ID NO: 10037 - RNA, 20 nt, Artificial Sequence
  ELANE RNA Guide
guuaugggcucgcaggacca

SEQ ID NO: 10038 - RNA, 20 nt, Artificial Sequence
  ELANE RNA Guide
uaugggcucgcaggaccacc

SEQ ID NO: 10039 - RNA, 20 nt, Artificial Sequence
  ELANE RNA Guide
uccugcgagcccauaaccuc

SEQ ID NO: 10040 - RNA, 20 nt, Artificial Sequence
  ELANE RNA Guide
ucgcaggaccacccgcaccg

SEQ ID NO: 10041 - RNA, 20 nt, Artificial Sequence
  ELANE RNA Guide
ugcgagcccauaaccucucg

SEQ ID NO: 10042 - RNA, 20 nt, Artificial Sequence
  ELANE RNA Guide
ugcgggugguccugcgagcc

SEQ ID NO: 10043 - RNA, 20 nt, Artificial Sequence
  ELANE RNA Guide
ugggcucgcaggaccacccg

SEQ ID NO: 10044 - RNA, 20 nt, Artificial Sequence
  ELANE RNA Guide
ugguccugcgagcccauaac

SEQ ID NO: 10045 - RNA, 20 nt, Artificial Sequence
  ELANE RNA Guide
uuaugggcucgcaggaccac

SEQ ID NO: 10046 - RNA, 21 nt, Artificial Sequence
  ELANE RNA Guide
agagguuaugggcucgcagga

SEQ ID NO: 10047 - RNA, 21 nt, Artificial Sequence
  ELANE RNA Guide
agguuaugggcucgcaggacc

SEQ ID NO: 10048 - RNA, 21 nt, Artificial Sequence
  ELANE RNA Guide
augggcucgcaggaccacccg

SEQ ID NO: 10049 - RNA, 21 nt, Artificial Sequence
  ELANE RNA Guide
ccgcgagagguuaugggcucg

SEQ ID NO: 10050 - RNA, 21 nt, Artificial Sequence
  ELANE RNA Guide
ccugcgagcccauaaccucuc

SEQ ID NO: 10051 - RNA, 21 nt, Artificial Sequence
  ELANE RNA Guide
cgagagguuaugggcucgcag

SEQ ID NO: 10052 - RNA, 21 nt, Artificial Sequence
  ELANE RNA Guide
cgcgagagguuaugggcucgc

SEQ ID NO: 10053 - RNA, 21 nt, Artificial Sequence
  ELANE RNA Guide
cgggugguccugcgagcccau

SEQ ID NO: 10054 - RNA, 21 nt, Artificial Sequence
  ELANE RNA Guide
cggugcgggugguccugcgag

SEQ ID NO: 10055 - RNA, 21 nt, Artificial Sequence
  ELANE RNA Guide
cucgcaggaccacccgcaccg

SEQ ID NO: 10056 - RNA, 21 nt, Artificial Sequence
  ELANE RNA Guide
cugcgagcccauaaccucucg

SEQ ID NO: 10057 - RNA, 21 nt, Artificial Sequence
  ELANE RNA Guide
gagagguuaugggcucgcagg

SEQ ID NO: 10058 - RNA, 21 nt, Artificial Sequence
  ELANE RNA Guide
gagguuaugggcucgcaggac

SEQ ID NO: 10059 - RNA, 21 nt, Artificial Sequence
  ELANE RNA Guide
gcgagagguuaugggcucgca

SEQ ID NO: 10060 - RNA, 21 nt, Artificial Sequence
  ELANE RNA Guide
gcgagcccauaaccucucgcg

SEQ ID NO: 10061 - RNA, 21 nt, Artificial Sequence
  ELANE RNA Guide
gcgggugguccugcgagccca

SEQ ID NO: 10062 - RNA, 21 nt, Artificial Sequence
  ELANE RNA Guide
gcggugcgggugguccugcga

SEQ ID NO: 10063 - RNA, 21 nt, Artificial Sequence
  ELANE RNA Guide
gcucgcaggaccacccgcacc

SEQ ID NO: 10064 - RNA, 21 nt, Artificial Sequence
  ELANE RNA Guide
ggcucgcaggaccacccgcac

SEQ ID NO: 10065 - RNA, 21 nt, Artificial Sequence
  ELANE RNA Guide
gggcucgcaggaccacccgca

SEQ ID NO: 10066 - RNA, 21 nt, Artificial Sequence
  ELANE RNA Guide
gggugguccugcgagcccaua

SEQ ID NO: 10067 - RNA, 21 nt, Artificial Sequence
  ELANE RNA Guide
gguccugcgagcccauaaccu

SEQ ID NO: 10068 - RNA, 21 nt, Artificial Sequence
  ELANE RNA Guide
ggugcgggugguccugcgagc

SEQ ID NO: 10069 - RNA, 21 nt, Artificial Sequence
  ELANE RNA Guide
ggugguccugcgagcccauaa

SEQ ID NO: 10070 - RNA, 21 nt, Artificial Sequence
  ELANE RNA Guide
gguuaugggcucgcaggacca

SEQ ID NO: 10071 - RNA, 21 nt, Artificial Sequence
  ELANE RNA Guide
guccugcgagcccauaaccuc

SEQ ID NO: 10072 - RNA, 21 nt, Artificial Sequence
  ELANE RNA Guide
gugcgggugguccugcgagcc

SEQ ID NO: 10073 - RNA, 21 nt, Artificial Sequence
  ELANE RNA Guide
gugguccugcgagcccauaac

SEQ ID NO: 10074 - RNA, 21 nt, Artificial Sequence
  ELANE RNA Guide
guuaugggcucgcaggaccac

SEQ ID NO: 10075 - RNA, 21 nt, Artificial Sequence
  ELANE RNA Guide
uaugggcucgcaggaccaccc

SEQ ID NO: 10076 - RNA, 21 nt, Artificial Sequence
  ELANE RNA Guide
uccugcgagcccauaaccucu

SEQ ID NO: 10077 - RNA, 21 nt, Artificial Sequence
  ELANE RNA Guide
ucgcaggaccacccgcaccgc

SEQ ID NO: 10078 - RNA, 21 nt, Artificial Sequence
  ELANE RNA Guide
ugcgagcccauaaccucucgc

SEQ ID NO: 10079 - RNA, 21 nt, Artificial Sequence
  ELANE RNA Guide
ugcgggugguccugcgagccc

SEQ ID NO: 10080 - RNA, 21 nt, Artificial Sequence
  ELANE RNA Guide
ugggcucgcaggaccacccgc

SEQ ID NO: 10081 - RNA, 21 nt, Artificial Sequence
  ELANE RNA Guide
ugguccugcgagcccauaacc

SEQ ID NO: 10082 - RNA, 21 nt, Artificial Sequence
  ELANE RNA Guide
uuaugggcucgcaggaccacc

SEQ ID NO: 10083 - RNA, 22 nt, Artificial Sequence
  ELANE RNA Guide
agagguuaugggcucgcaggac

SEQ ID NO: 10084 - RNA, 22 nt, Artificial Sequence
  ELANE RNA Guide
agguuaugggcucgcaggacca

SEQ ID NO: 10085 - RNA, 22 nt, Artificial Sequence
  ELANE RNA Guide
augggcucgcaggaccacccgc

SEQ ID NO: 10086 - RNA, 22 nt, Artificial Sequence
  ELANE RNA Guide
ccgcgagagguuaugggcucgc

SEQ ID NO: 10087 - RNA, 22 nt, Artificial Sequence
  ELANE RNA Guide
ccugcgagcccauaaccucucg

SEQ ID NO: 10088 - RNA, 22 nt, Artificial Sequence
  ELANE RNA Guide
cgagagguuaugggcucgcagg

SEQ ID NO: 10089 - RNA, 22 nt, Artificial Sequence
  ELANE RNA Guide
cgcgagagguuaugggcucgca

SEQ ID NO: 10090 - RNA, 22 nt, Artificial Sequence
  ELANE RNA Guide
cgcggugcgggugguccugcga

SEQ ID NO: 10091 - RNA, 22 nt, Artificial Sequence
  ELANE RNA Guide
cgggugguccugcgagcccaua

SEQ ID NO: 10092 - RNA, 22 nt, Artificial Sequence
  ELANE RNA Guide
cggugcgggugguccugcgagc

SEQ ID NO: 10093 - RNA, 22 nt, Artificial Sequence
  ELANE RNA Guide
cucgcaggaccacccgcaccgc

SEQ ID NO: 10094 - RNA, 22 nt, Artificial Sequence
  ELANE RNA Guide
cugcgagcccauaaccucucgc

SEQ ID NO: 10095 - RNA, 22 nt, Artificial Sequence
  ELANE RNA Guide
gagagguuaugggcucgcagga

SEQ ID NO: 10096 - RNA, 22 nt, Artificial Sequence
  ELANE RNA Guide
gagguuaugggcucgcaggacc

SEQ ID NO: 10097 - RNA, 22 nt, Artificial Sequence
  ELANE RNA Guide
gccgcgagagguuaugggcucg

SEQ ID NO: 10098 - RNA, 22 nt, Artificial Sequence
  ELANE RNA Guide
gcgagagguuaugggcucgcag

SEQ ID NO: 10099 - RNA, 22 nt, Artificial Sequence
  ELANE RNA Guide
gcgagcccauaaccucucgcgg

SEQ ID NO: 10100 - RNA, 22 nt, Artificial Sequence
  ELANE RNA Guide
gcgggugguccugcgagcccau

SEQ ID NO: 10101 - RNA, 22 nt, Artificial Sequence
  ELANE RNA Guide
gcggugcgggugguccugcgag

SEQ ID NO: 10102 - RNA, 22 nt, Artificial Sequence
  ELANE RNA Guide
gcucgcaggaccacccgcaccg

SEQ ID NO: 10103 - RNA, 22 nt, Artificial Sequence
  ELANE RNA Guide
ggcucgcaggaccacccgcacc

SEQ ID NO: 10104 - RNA, 22 nt, Artificial Sequence
  ELANE RNA Guide
gggcucgcaggaccacccgcac

SEQ ID NO: 10105 - RNA, 22 nt, Artificial Sequence
  ELANE RNA Guide
gggugguccugcgagcccauaa

SEQ ID NO: 10106 - RNA, 22 nt, Artificial Sequence
  ELANE RNA Guide
gguccugcgagcccauaaccuc

SEQ ID NO: 10107 - RNA, 22 nt, Artificial Sequence
  ELANE RNA Guide
ggugcgggugguccugcgagcc

SEQ ID NO: 10108 - RNA, 22 nt, Artificial Sequence
  ELANE RNA Guide
ggugguccugcgagcccauaac

SEQ ID NO: 10109 - RNA, 22 nt, Artificial Sequence
  ELANE RNA Guide
gguuaugggcucgcaggaccac

SEQ ID NO: 10110 - RNA, 22 nt, Artificial Sequence
  ELANE RNA Guide
guccugcgagcccauaaccucu

SEQ ID NO: 10111 - RNA, 22 nt, Artificial Sequence
  ELANE RNA Guide
gugcgggugguccugcgagccc

SEQ ID NO: 10112 - RNA, 22 nt, Artificial Sequence
  ELANE RNA Guide
gugguccugcgagcccauaacc

SEQ ID NO: 10113 - RNA, 22 nt, Artificial Sequence
  ELANE RNA Guide
guuaugggcucgcaggaccacc

SEQ ID NO: 10114 - RNA, 22 nt, Artificial Sequence
  ELANE RNA Guide
uaugggcucgcaggaccacccg

SEQ ID NO: 10115 - RNA, 22 nt, Artificial Sequence
  ELANE RNA Guide
uccugcgagcccauaaccucuc

SEQ ID NO: 10116 - RNA, 22 nt, Artificial Sequence
  ELANE RNA Guide
ucgcaggaccacccgcaccgcg

SEQ ID NO: 10117 - RNA, 22 nt, Artificial Sequence
  ELANE RNA Guide
ugcgagcccauaaccucucgcg

SEQ ID NO: 10118 - RNA, 22 nt, Artificial Sequence
  ELANE RNA Guide
ugcgggugguccugcgagccca

SEQ ID NO: 10119 - RNA, 22 nt, Artificial Sequence
  ELANE RNA Guide
ugggcucgcaggaccacccgca

SEQ ID NO: 10120 - RNA, 22 nt, Artificial Sequence
  ELANE RNA Guide
ugguccugcgagcccauaaccu

SEQ ID NO: 10121 - RNA, 22 nt, Artificial Sequence
  ELANE RNA Guide
uuaugggcucgcaggaccaccc

SEQ ID NO: 10122 - RNA, 20 nt, Artificial Sequence
  ELANE RNA Guide
agagguuaugggcuuccagg

SEQ ID NO: 10123 - RNA, 20 nt, Artificial Sequence
  ELANE RNA Guide
agguuaugggcuuccaggac

SEQ ID NO: 10124 - RNA, 20 nt, Artificial Sequence
  ELANE RNA Guide
augggcuuccaggaccaccc

SEQ ID NO: 10125 - RNA, 20 nt, Artificial Sequence
  ELANE RNA Guide
cccgccgcgagagguuaugg

SEQ ID NO: 10126 - RNA, 20 nt, Artificial Sequence
  ELANE RNA Guide
ccgcgagagguuaugggcuu

SEQ ID NO: 10127 - RNA, 20 nt, Artificial Sequence
  ELANE RNA Guide
ccuggaagcccauaaccucu

SEQ ID NO: 10128 - RNA, 20 nt, Artificial Sequence
  ELANE RNA Guide
cgagagguuaugggcuucca

SEQ ID NO: 10129 - RNA, 20 nt, Artificial Sequence
  ELANE RNA Guide
cgcgagagguuaugggcuuc

SEQ ID NO: 10130 - RNA, 20 nt, Artificial Sequence
  ELANE RNA Guide
cgcggugcgggugguccugg

SEQ ID NO: 10131 - RNA, 20 nt, Artificial Sequence
  ELANE RNA Guide
cgggugguccuggaagccca

SEQ ID NO: 10132 - RNA, 20 nt, Artificial Sequence
  ELANE RNA Guide
cggugcgggugguccuggaa

SEQ ID NO: 10133 - RNA, 20 nt, Artificial Sequence
  ELANE RNA Guide
cuggaagcccauaaccucuc

SEQ ID NO: 10134 - RNA, 20 nt, Artificial Sequence
  ELANE RNA Guide
cuuccaggaccacccgcacc

SEQ ID NO: 10135 - RNA, 20 nt, Artificial Sequence
  ELANE RNA Guide
gaagcccauaaccucucgcg

SEQ ID NO: 10136 - RNA, 20 nt, Artificial Sequence
  ELANE RNA Guide
gagagguuaugggcuuccag

SEQ ID NO: 10137 - RNA, 20 nt, Artificial Sequence
  ELANE RNA Guide
gagguuaugggcuuccagga

SEQ ID NO: 10138 - RNA, 20 nt, Artificial Sequence
  ELANE RNA Guide
gcgagagguuaugggcuucc

SEQ ID NO: 10139 - RNA, 20 nt, Artificial Sequence
  ELANE RNA Guide
gcgggugguccuggaagccc

SEQ ID NO: 10140 - RNA, 20 nt, Artificial Sequence
  ELANE RNA Guide
gcggugcgggugguccugga

SEQ ID NO: 10141 - RNA, 20 nt, Artificial Sequence
  ELANE RNA Guide
gcuuccaggaccacccgcac

SEQ ID NO: 10142 - RNA, 20 nt, Artificial Sequence
  ELANE RNA Guide
ggaagcccauaaccucucgc

SEQ ID NO: 10143 - RNA, 20 nt, Artificial Sequence
  ELANE RNA Guide
ggcuuccaggaccacccgca

SEQ ID NO: 10144 - RNA, 20 nt, Artificial Sequence
  ELANE RNA Guide
gggcuuccaggaccacccgc

SEQ ID NO: 10145 - RNA, 20 nt, Artificial Sequence
  ELANE RNA Guide
gggugguccuggaagcccau

SEQ ID NO: 10146 - RNA, 20 nt, Artificial Sequence
  ELANE RNA Guide
gguccuggaagcccauaacc

SEQ ID NO: 10147 - RNA, 20 nt, Artificial Sequence
  ELANE RNA Guide
ggugcgggugguccuggaag

SEQ ID NO: 10148 - RNA, 20 nt, Artificial Sequence
  ELANE RNA Guide
ggugguccuggaagcccaua

SEQ ID NO: 10149 - RNA, 20 nt, Artificial Sequence
  ELANE RNA Guide
gguuaugggcuuccaggacc

SEQ ID NO: 10150 - RNA, 20 nt, Artificial Sequence
  ELANE RNA Guide
guccuggaagcccauaaccu

SEQ ID NO: 10151 - RNA, 20 nt, Artificial Sequence
  ELANE RNA Guide
gugcgggugguccuggaagc

SEQ ID NO: 10152 - RNA, 20 nt, Artificial Sequence
  ELANE RNA Guide
gugguccuggaagcccauaa

SEQ ID NO: 10153 - RNA, 20 nt, Artificial Sequence
  ELANE RNA Guide
guuaugggcuuccaggacca

SEQ ID NO: 10154 - RNA, 20 nt, Artificial Sequence
  ELANE RNA Guide
uaugggcuuccaggaccacc

SEQ ID NO: 10155 - RNA, 20 nt, Artificial Sequence
  ELANE RNA Guide
uccuggaagcccauaaccuc

SEQ ID NO: 10156 - RNA, 20 nt, Artificial Sequence
  ELANE RNA Guide
ugcgggugguccuggaagcc

SEQ ID NO: 10157 - RNA, 20 nt, Artificial Sequence
  ELANE RNA Guide
uggaagcccauaaccucucg

SEQ ID NO: 10158 - RNA, 20 nt, Artificial Sequence
  ELANE RNA Guide
ugggcuuccaggaccacccg

SEQ ID NO: 10159 - RNA, 20 nt, Artificial Sequence
  ELANE RNA Guide
ugguccuggaagcccauaac

SEQ ID NO: 10160 - RNA, 20 nt, Artificial Sequence
  ELANE RNA Guide
uuaugggcuuccaggaccac

SEQ ID NO: 10161 - RNA, 20 nt, Artificial Sequence
  ELANE RNA Guide
uuccaggaccacccgcaccg

SEQ ID NO: 10162 - RNA, 21 nt, Artificial Sequence
  ELANE RNA Guide
agagguuaugggcuuccagga

SEQ ID NO: 10163 - RNA, 21 nt, Artificial Sequence
  ELANE RNA Guide
agguuaugggcuuccaggacc

SEQ ID NO: 10164 - RNA, 21 nt, Artificial Sequence
  ELANE RNA Guide
augggcuuccaggaccacccg

SEQ ID NO: 10165 - RNA, 21 nt, Artificial Sequence
  ELANE RNA Guide
ccgcgagagguuaugggcuuc

SEQ ID NO: 10166 - RNA, 21 nt, Artificial Sequence
  ELANE RNA Guide
ccuggaagcccauaaccucuc

SEQ ID NO: 10167 - RNA, 21 nt, Artificial Sequence
  ELANE RNA Guide
cgagagguuaugggcuuccag

SEQ ID NO: 10168 - RNA, 21 nt, Artificial Sequence
  ELANE RNA Guide
cgcgagagguuaugggcuucc

SEQ ID NO: 10169 - RNA, 21 nt, Artificial Sequence
  ELANE RNA Guide
cgcggugcgggugguccugga

SEQ ID NO: 10170 - RNA, 21 nt, Artificial Sequence
  ELANE RNA Guide
cgggugguccuggaagcccau

SEQ ID NO: 10171 - RNA, 21 nt, Artificial Sequence
  ELANE RNA Guide
cggugcgggugguccuggaag

SEQ ID NO: 10172 - RNA, 21 nt, Artificial Sequence
  ELANE RNA Guide
cuggaagcccauaaccucucg

SEQ ID NO: 10173 - RNA, 21 nt, Artificial Sequence
  ELANE RNA Guide
cuuccaggaccacccgcaccg

SEQ ID NO: 10174 - RNA, 21 nt, Artificial Sequence
  ELANE RNA Guide
gaagcccauaaccucucgcgg

SEQ ID NO: 10175 - RNA, 21 nt, Artificial Sequence
  ELANE RNA Guide
gagagguuaugggcuuccagg

SEQ ID NO: 10176 - RNA, 21 nt, Artificial Sequence
  ELANE RNA Guide
gagguuaugggcuuccaggac

SEQ ID NO: 10177 - RNA, 21 nt, Artificial Sequence
  ELANE RNA Guide
gccgcgagagguuaugggcuu

SEQ ID NO: 10178 - RNA, 21 nt, Artificial Sequence
  ELANE RNA Guide
gcgagagguuaugggcuucca

SEQ ID NO: 10179 - RNA, 21 nt, Artificial Sequence
  ELANE RNA Guide
gcgggugguccuggaagccca

SEQ ID NO: 10180 - RNA, 21 nt, Artificial Sequence
  ELANE RNA Guide
gcggugcgggugguccuggaa

SEQ ID NO: 10181 - RNA, 21 nt, Artificial Sequence
  ELANE RNA Guide
gcuuccaggaccacccgcacc

SEQ ID NO: 10182 - RNA, 21 nt, Artificial Sequence
  ELANE RNA Guide
ggaagcccauaaccucucgcg

SEQ ID NO: 10183 - RNA, 21 nt, Artificial Sequence
  ELANE RNA Guide
ggcuuccaggaccacccgcac

SEQ ID NO: 10184 - RNA, 21 nt, Artificial Sequence
  ELANE RNA Guide
gggcuuccaggaccacccgca

SEQ ID NO: 10185 - RNA, 21 nt, Artificial Sequence
  ELANE RNA Guide
gggugguccuggaagcccaua

SEQ ID NO: 10186 - RNA, 21 nt, Artificial Sequence
  ELANE RNA Guide
gguccuggaagcccauaaccu

SEQ ID NO: 10187 - RNA, 21 nt, Artificial Sequence
  ELANE RNA Guide
ggugcgggugguccuggaagc

SEQ ID NO: 10188 - RNA, 21 nt, Artificial Sequence
  ELANE RNA Guide
ggugguccuggaagcccauaa

SEQ ID NO: 10189 - RNA, 21 nt, Artificial Sequence
  ELANE RNA Guide
gguuaugggcuuccaggacca

SEQ ID NO: 10190 - RNA, 21 nt, Artificial Sequence
  ELANE RNA Guide
guccuggaagcccauaaccuc

SEQ ID NO: 10191 - RNA, 21 nt, Artificial Sequence
  ELANE RNA Guide
gugcgggugguccuggaagcc

SEQ ID NO: 10192 - RNA, 21 nt, Artificial Sequence
  ELANE RNA Guide
gugguccuggaagcccauaac

SEQ ID NO: 10193 - RNA, 21 nt, Artificial Sequence
  ELANE RNA Guide
guuaugggcuuccaggaccac

SEQ ID NO: 10194 - RNA, 21 nt, Artificial Sequence
  ELANE RNA Guide
uaugggcuuccaggaccaccc

SEQ ID NO: 10195 - RNA, 21 nt, Artificial Sequence
  ELANE RNA Guide
ucccgccgcgagagguuaugg

SEQ ID NO: 10196 - RNA, 21 nt, Artificial Sequence
  ELANE RNA Guide
uccuggaagcccauaaccucu

SEQ ID NO: 10197 - RNA, 21 nt, Artificial Sequence
  ELANE RNA Guide
ugcgggugguccuggaagccc

SEQ ID NO: 10198 - RNA, 21 nt, Artificial Sequence
  ELANE RNA Guide
uggaagcccauaaccucucgc

SEQ ID NO: 10199 - RNA, 21 nt, Artificial Sequence
  ELANE RNA Guide
ugggcuuccaggaccacccgc

SEQ ID NO: 10200 - RNA, 21 nt, Artificial Sequence
  ELANE RNA Guide
ugguccuggaagcccauaacc

SEQ ID NO: 10201 - RNA, 21 nt, Artificial Sequence
  ELANE RNA Guide
uuaugggcuuccaggaccacc

SEQ ID NO: 10202 - RNA, 21 nt, Artificial Sequence
  ELANE RNA Guide
uuccaggaccacccgcaccgc

SEQ ID NO: 10203 - RNA, 22 nt, Artificial Sequence
  ELANE RNA Guide
agagguuaugggcuuccaggac

SEQ ID NO: 10204 - RNA, 22 nt, Artificial Sequence
  ELANE RNA Guide
agguuaugggcuuccaggacca

SEQ ID NO: 10205 - RNA, 22 nt, Artificial Sequence
  ELANE RNA Guide
augggcuuccaggaccacccgc

SEQ ID NO: 10206 - RNA, 22 nt, Artificial Sequence
  ELANE RNA Guide
ccgcgagagguuaugggcuucc

SEQ ID NO: 10207 - RNA, 22 nt, Artificial Sequence
  ELANE RNA Guide
ccuggaagcccauaaccucucg

SEQ ID NO: 10208 - RNA, 22 nt, Artificial Sequence
  ELANE RNA Guide
cgagagguuaugggcuuccagg

SEQ ID NO: 10209 - RNA, 22 nt, Artificial Sequence
  ELANE RNA Guide
cgccgcgagagguuaugggcuu

SEQ ID NO: 10210 - RNA, 22 nt, Artificial Sequence
  ELANE RNA Guide
cgcgagagguuaugggcuucca

SEQ ID NO: 10211 - RNA, 22 nt, Artificial Sequence
  ELANE RNA Guide
cgcggugcgggugguccuggaa

SEQ ID NO: 10212 - RNA, 22 nt, Artificial Sequence
  ELANE RNA Guide
cgggugguccuggaagcccaua

SEQ ID NO: 10213 - RNA, 22 nt, Artificial Sequence
  ELANE RNA Guide
cggugcgggugguccuggaagc

SEQ ID NO: 10214 - RNA, 22 nt, Artificial Sequence
  ELANE RNA Guide
cucccgccgcgagagguuaugg

SEQ ID NO: 10215 - RNA, 22 nt, Artificial Sequence
  ELANE RNA Guide
cuggaagcccauaaccucucgc

SEQ ID NO: 10216 - RNA, 22 nt, Artificial Sequence
  ELANE RNA Guide
cuuccaggaccacccgcaccgc

SEQ ID NO: 10217 - RNA, 22 nt, Artificial Sequence
  ELANE RNA Guide
gaagcccauaaccucucgcggc

SEQ ID NO: 10218 - RNA, 22 nt, Artificial Sequence
  ELANE RNA Guide
gagagguuaugggcuuccagga

SEQ ID NO: 10219 - RNA, 22 nt, Artificial Sequence
  ELANE RNA Guide
gagguuaugggcuuccaggacc

SEQ ID NO: 10220 - RNA, 22 nt, Artificial Sequence
  ELANE RNA Guide
gccgcgagagguuaugggcuuc

SEQ ID NO: 10221 - RNA, 22 nt, Artificial Sequence
  ELANE RNA Guide
gcgagagguuaugggcuuccag

SEQ ID NO: 10222 - RNA, 22 nt, Artificial Sequence
  ELANE RNA Guide
gcgcggugcgggugguccugga

SEQ ID NO: 10223 - RNA, 22 nt, Artificial Sequence
  ELANE RNA Guide
gcgggugguccuggaagcccau

SEQ ID NO: 10224 - RNA, 22 nt, Artificial Sequence
  ELANE RNA Guide
gcggugcgggugguccuggaag

SEQ ID NO: 10225 - RNA, 22 nt, Artificial Sequence
  ELANE RNA Guide
gcuuccaggaccacccgcaccg

SEQ ID NO: 10226 - RNA, 22 nt, Artificial Sequence
  ELANE RNA Guide
ggaagcccauaaccucucgcgg

SEQ ID NO: 10227 - RNA, 22 nt, Artificial Sequence
  ELANE RNA Guide
ggcuuccaggaccacccgcacc

SEQ ID NO: 10228 - RNA, 22 nt, Artificial Sequence
  ELANE RNA Guide
gggcuuccaggaccacccgcac

SEQ ID NO: 10229 - RNA, 22 nt, Artificial Sequence
  ELANE RNA Guide
gggugguccuggaagcccauaa

SEQ ID NO: 10230 - RNA, 22 nt, Artificial Sequence
  ELANE RNA Guide
gguccuggaagcccauaaccuc

SEQ ID NO: 10231 - RNA, 22 nt, Artificial Sequence
  ELANE RNA Guide
ggugcgggugguccuggaagcc

SEQ ID NO: 10232 - RNA, 22 nt, Artificial Sequence
  ELANE RNA Guide
ggugguccuggaagcccauaac

SEQ ID NO: 10233 - RNA, 22 nt, Artificial Sequence
  ELANE RNA Guide
gguuaugggcuuccaggaccac

SEQ ID NO: 10234 - RNA, 22 nt, Artificial Sequence
  ELANE RNA Guide
guccuggaagcccauaaccucu

SEQ ID NO: 10235 - RNA, 22 nt, Artificial Sequence
  ELANE RNA Guide
gugcgggugguccuggaagccc

SEQ ID NO: 10236 - RNA, 22 nt, Artificial Sequence
  ELANE RNA Guide
gugguccuggaagcccauaacc

SEQ ID NO: 10237 - RNA, 22 nt, Artificial Sequence
  ELANE RNA Guide
guuaugggcuuccaggaccacc

SEQ ID NO: 10238 - RNA, 22 nt, Artificial Sequence
  ELANE RNA Guide
uaugggcuuccaggaccacccg

SEQ ID NO: 10239 - RNA, 22 nt, Artificial Sequence
  ELANE RNA Guide
uccuggaagcccauaaccucuc

SEQ ID NO: 10240 - RNA, 22 nt, Artificial Sequence
  ELANE RNA Guide
ugcgggugguccuggaagccca

SEQ ID NO: 10241 - RNA, 22 nt, Artificial Sequence
  ELANE RNA Guide
uggaagcccauaaccucucgcg

SEQ ID NO: 10242 - RNA, 22 nt, Artificial Sequence
  ELANE RNA Guide
ugggcuuccaggaccacccgca

SEQ ID NO: 10243 - RNA, 22 nt, Artificial Sequence
  ELANE RNA Guide
ugguccuggaagcccauaaccu

SEQ ID NO: 10244 - RNA, 22 nt, Artificial Sequence
  ELANE RNA Guide
uuaugggcuuccaggaccaccc

SEQ ID NO: 10245 - RNA, 22 nt, Artificial Sequence
  ELANE RNA Guide
uuccaggaccacccgcaccgcg

SEQ ID NO: 10246 - RNA, 20 nt, Artificial Sequence
  ELANE RNA Guide
agagguuaugggaucccagg

SEQ ID NO: 10247 - RNA, 20 nt, Artificial Sequence
  ELANE RNA Guide
agguuaugggaucccaggac

SEQ ID NO: 10248 - RNA, 20 nt, Artificial Sequence
  ELANE RNA Guide
aucccauaaccucucgcggc

SEQ ID NO: 10249 - RNA, 20 nt, Artificial Sequence
  ELANE RNA Guide
augggaucccaggaccaccc

SEQ ID NO: 10250 - RNA, 20 nt, Artificial Sequence
  ELANE RNA Guide
ccgcgagagguuaugggauc

SEQ ID NO: 10251 - RNA, 20 nt, Artificial Sequence
  ELANE RNA Guide
ccugggaucccauaaccucu

SEQ ID NO: 10252 - RNA, 20 nt, Artificial Sequence
  ELANE RNA Guide
cgagagguuaugggauccca

SEQ ID NO: 10253 - RNA, 20 nt, Artificial Sequence
  ELANE RNA Guide
cgccgcgagagguuauggga

SEQ ID NO: 10254 - RNA, 20 nt, Artificial Sequence
  ELANE RNA Guide
cgcgagagguuaugggaucc

SEQ ID NO: 10255 - RNA, 20 nt, Artificial Sequence
  ELANE RNA Guide
cgggugguccugggauccca

SEQ ID NO: 10256 - RNA, 20 nt, Artificial Sequence
  ELANE RNA Guide
cggugcgggugguccuggga

SEQ ID NO: 10257 - RNA, 20 nt, Artificial Sequence
  ELANE RNA Guide
cucccgccgcgagagguuau

SEQ ID NO: 10258 - RNA, 20 nt, Artificial Sequence
  ELANE RNA Guide
cugggaucccauaaccucuc

SEQ ID NO: 10259 - RNA, 20 nt, Artificial Sequence
  ELANE RNA Guide
gagagguuaugggaucccag

SEQ ID NO: 10260 - RNA, 20 nt, Artificial Sequence
  ELANE RNA Guide
gagguuaugggaucccagga

SEQ ID NO: 10261 - RNA, 20 nt, Artificial Sequence
  ELANE RNA Guide
gaucccaggaccacccgcac

SEQ ID NO: 10262 - RNA, 20 nt, Artificial Sequence
  ELANE RNA Guide
gaucccauaaccucucgcgg

SEQ ID NO: 10263 - RNA, 20 nt, Artificial Sequence
  ELANE RNA Guide
gccgcgagagguuaugggau

SEQ ID NO: 10264 - RNA, 20 nt, Artificial Sequence
  ELANE RNA Guide
gcgagagguuaugggauccc

SEQ ID NO: 10265 - RNA, 20 nt, Artificial Sequence
  ELANE RNA Guide
gcgggugguccugggauccc

SEQ ID NO: 10266 - RNA, 20 nt, Artificial Sequence
  ELANE RNA Guide
gcggugcgggugguccuggg

SEQ ID NO: 10267 - RNA, 20 nt, Artificial Sequence
  ELANE RNA Guide
ggaucccaggaccacccgca

SEQ ID NO: 10268 - RNA, 20 nt, Artificial Sequence
  ELANE RNA Guide
ggaucccauaaccucucgcg

SEQ ID NO: 10269 - RNA, 20 nt, Artificial Sequence
  ELANE RNA Guide
gggaucccaggaccacccgc

SEQ ID NO: 10270 - RNA, 20 nt, Artificial Sequence
  ELANE RNA Guide
gggaucccauaaccucucgc

SEQ ID NO: 10271 - RNA, 20 nt, Artificial Sequence
  ELANE RNA Guide
gggugguccugggaucccau

SEQ ID NO: 10272 - RNA, 20 nt, Artificial Sequence
  ELANE RNA Guide
gguccugggaucccauaacc

SEQ ID NO: 10273 - RNA, 20 nt, Artificial Sequence
  ELANE RNA Guide
ggugcgggugguccugggau

SEQ ID NO: 10274 - RNA, 20 nt, Artificial Sequence
  ELANE RNA Guide
ggugguccugggaucccaua

SEQ ID NO: 10275 - RNA, 20 nt, Artificial Sequence
  ELANE RNA Guide
gguuaugggaucccaggacc

SEQ ID NO: 10276 - RNA, 20 nt, Artificial Sequence
  ELANE RNA Guide
guccugggaucccauaaccu

SEQ ID NO: 10277 - RNA, 20 nt, Artificial Sequence
  ELANE RNA Guide
gugcgggugguccugggauc

SEQ ID NO: 10278 - RNA, 20 nt, Artificial Sequence
  ELANE RNA Guide
gugguccugggaucccauaa

SEQ ID NO: 10279 - RNA, 20 nt, Artificial Sequence
  ELANE RNA Guide
guuaugggaucccaggacca

SEQ ID NO: 10280 - RNA, 20 nt, Artificial Sequence
  ELANE RNA Guide
uaugggaucccaggaccacc

SEQ ID NO: 10281 - RNA, 20 nt, Artificial Sequence
  ELANE RNA Guide
ucccgccgcgagagguuaug

SEQ ID NO: 10282 - RNA, 20 nt, Artificial Sequence
  ELANE RNA Guide
uccugggaucccauaaccuc

SEQ ID NO: 10283 - RNA, 20 nt, Artificial Sequence
  ELANE RNA Guide
ugcgggugguccugggaucc

SEQ ID NO: 10284 - RNA, 20 nt, Artificial Sequence
  ELANE RNA Guide
ugggaucccaggaccacccg

SEQ ID NO: 10285 - RNA, 20 nt, Artificial Sequence
  ELANE RNA Guide
ugggaucccauaaccucucg

SEQ ID NO: 10286 - RNA, 20 nt, Artificial Sequence
  ELANE RNA Guide
ugguccugggaucccauaac

SEQ ID NO: 10287 - RNA, 20 nt, Artificial Sequence
  ELANE RNA Guide
uuaugggaucccaggaccac

SEQ ID NO: 10288 - RNA, 21 nt, Artificial Sequence
  ELANE RNA Guide
agagguuaugggaucccagga

SEQ ID NO: 10289 - RNA, 21 nt, Artificial Sequence
  ELANE RNA Guide
agguuaugggaucccaggacc

SEQ ID NO: 10290 - RNA, 21 nt, Artificial Sequence
  ELANE RNA Guide
aucccauaaccucucgcggcg

SEQ ID NO: 10291 - RNA, 21 nt, Artificial Sequence
  ELANE RNA Guide
augggaucccaggaccacccg

SEQ ID NO: 10292 - RNA, 21 nt, Artificial Sequence
  ELANE RNA Guide
ccgccgcgagagguuauggga

SEQ ID NO: 10293 - RNA, 21 nt, Artificial Sequence
  ELANE RNA Guide
ccgcgagagguuaugggaucc

SEQ ID NO: 10294 - RNA, 21 nt, Artificial Sequence
  ELANE RNA Guide
ccugggaucccauaaccucuc

SEQ ID NO: 10295 - RNA, 21 nt, Artificial Sequence
  ELANE RNA Guide
cgagagguuaugggaucccag

SEQ ID NO: 10296 - RNA, 21 nt, Artificial Sequence
  ELANE RNA Guide
cgccgcgagagguuaugggau

SEQ ID NO: 10297 - RNA, 21 nt, Artificial Sequence
  ELANE RNA Guide
cgcgagagguuaugggauccc

SEQ ID NO: 10298 - RNA, 21 nt, Artificial Sequence
  ELANE RNA Guide
cgggugguccugggaucccau

SEQ ID NO: 10299 - RNA, 21 nt, Artificial Sequence
  ELANE RNA Guide
cggugcgggugguccugggau

SEQ ID NO: 10300 - RNA, 21 nt, Artificial Sequence
  ELANE RNA Guide
cucccgccgcgagagguuaug

SEQ ID NO: 10301 - RNA, 21 nt, Artificial Sequence
  ELANE RNA Guide
cugggaucccauaaccucucg

SEQ ID NO: 10302 - RNA, 21 nt, Artificial Sequence
  ELANE RNA Guide
gagagguuaugggaucccagg

SEQ ID NO: 10303 - RNA, 21 nt, Artificial Sequence
  ELANE RNA Guide
gagguuaugggaucccaggac

SEQ ID NO: 10304 - RNA, 21 nt, Artificial Sequence
  ELANE RNA Guide
gaucccaggaccacccgcacc

SEQ ID NO: 10305 - RNA, 21 nt, Artificial Sequence
  ELANE RNA Guide
gaucccauaaccucucgcggc

SEQ ID NO: 10306 - RNA, 21 nt, Artificial Sequence
  ELANE RNA Guide
gccgcgagagguuaugggauc

SEQ ID NO: 10307 - RNA, 21 nt, Artificial Sequence
  ELANE RNA Guide
gcgagagguuaugggauccca

SEQ ID NO: 10308 - RNA, 21 nt, Artificial Sequence
  ELANE RNA Guide
gcgggugguccugggauccca

SEQ ID NO: 10309 - RNA, 21 nt, Artificial Sequence
  ELANE RNA Guide
gcggugcgggugguccuggga

SEQ ID NO: 10310 - RNA, 21 nt, Artificial Sequence
  ELANE RNA Guide
gcucccgccgcgagagguuau

SEQ ID NO: 10311 - RNA, 21 nt, Artificial Sequence
  ELANE RNA Guide
ggaucccaggaccacccgcac

SEQ ID NO: 10312 - RNA, 21 nt, Artificial Sequence
  ELANE RNA Guide
ggaucccauaaccucucgcgg

SEQ ID NO: 10313 - RNA, 21 nt, Artificial Sequence
  ELANE RNA Guide
gggaucccaggaccacccgca

SEQ ID NO: 10314 - RNA, 21 nt, Artificial Sequence
  ELANE RNA Guide
gggaucccauaaccucucgcg

SEQ ID NO: 10315 - RNA, 21 nt, Artificial Sequence
  ELANE RNA Guide
gggugguccugggaucccaua

SEQ ID NO: 10316 - RNA, 21 nt, Artificial Sequence
  ELANE RNA Guide
gguccugggaucccauaaccu

SEQ ID NO: 10317 - RNA, 21 nt, Artificial Sequence
  ELANE RNA Guide
ggugcgggugguccugggauc

SEQ ID NO: 10318 - RNA, 21 nt, Artificial Sequence
  ELANE RNA Guide
ggugguccugggaucccauaa

SEQ ID NO: 10319 - RNA, 21 nt, Artificial Sequence
  ELANE RNA Guide
gguuaugggaucccaggacca

SEQ ID NO: 10320 - RNA, 21 nt, Artificial Sequence
  ELANE RNA Guide
guccugggaucccauaaccuc

SEQ ID NO: 10321 - RNA, 21 nt, Artificial Sequence
  ELANE RNA Guide
gugcgggugguccugggaucc

SEQ ID NO: 10322 - RNA, 21 nt, Artificial Sequence
  ELANE RNA Guide
gugguccugggaucccauaac

SEQ ID NO: 10323 - RNA, 21 nt, Artificial Sequence
  ELANE RNA Guide
guuaugggaucccaggaccac

SEQ ID NO: 10324 - RNA, 21 nt, Artificial Sequence
  ELANE RNA Guide
uaugggaucccaggaccaccc

SEQ ID NO: 10325 - RNA, 21 nt, Artificial Sequence
  ELANE RNA Guide
uccugggaucccauaaccucu

SEQ ID NO: 10326 - RNA, 21 nt, Artificial Sequence
  ELANE RNA Guide
ugcgggugguccugggauccc

SEQ ID NO: 10327 - RNA, 21 nt, Artificial Sequence
  ELANE RNA Guide
ugggaucccaggaccacccgc

SEQ ID NO: 10328 - RNA, 21 nt, Artificial Sequence
  ELANE RNA Guide
ugggaucccauaaccucucgc

SEQ ID NO: 10329 - RNA, 21 nt, Artificial Sequence
  ELANE RNA Guide
ugguccugggaucccauaacc

SEQ ID NO: 10330 - RNA, 21 nt, Artificial Sequence
  ELANE RNA Guide
uuaugggaucccaggaccacc

SEQ ID NO: 10331 - RNA, 22 nt, Artificial Sequence
  ELANE RNA Guide
agagguuaugggaucccaggac

SEQ ID NO: 10332 - RNA, 22 nt, Artificial Sequence
  ELANE RNA Guide
agguuaugggaucccaggacca

SEQ ID NO: 10333 - RNA, 22 nt, Artificial Sequence
  ELANE RNA Guide
aucccauaaccucucgcggcgg

SEQ ID NO: 10334 - RNA, 22 nt, Artificial Sequence
  ELANE RNA Guide
augggaucccaggaccacccgc

SEQ ID NO: 10335 - RNA, 22 nt, Artificial Sequence
  ELANE RNA Guide
cccgccgcgagagguuauggga

SEQ ID NO: 10336 - RNA, 22 nt, Artificial Sequence
  ELANE RNA Guide
ccgccgcgagagguuaugggau

SEQ ID NO: 10337 - RNA, 22 nt, Artificial Sequence
  ELANE RNA Guide
ccgcgagagguuaugggauccc

SEQ ID NO: 10338 - RNA, 22 nt, Artificial Sequence
  ELANE RNA Guide
ccugggaucccauaaccucucg

SEQ ID NO: 10339 - RNA, 22 nt, Artificial Sequence
  ELANE RNA Guide
cgagagguuaugggaucccagg

SEQ ID NO: 10340 - RNA, 22 nt, Artificial Sequence
  ELANE RNA Guide
cgccgcgagagguuaugggauc

SEQ ID NO: 10341 - RNA, 22 nt, Artificial Sequence
  ELANE RNA Guide
cgcgagagguuaugggauccca

SEQ ID NO: 10342 - RNA, 22 nt, Artificial Sequence
  ELANE RNA Guide
cgcggugcgggugguccuggga

SEQ ID NO: 10343 - RNA, 22 nt, Artificial Sequence
  ELANE RNA Guide
cgggugguccugggaucccaua

SEQ ID NO: 10344 - RNA, 22 nt, Artificial Sequence
  ELANE RNA Guide
cggugcgggugguccugggauc

SEQ ID NO: 10345 - RNA, 22 nt, Artificial Sequence
  ELANE RNA Guide
cugggaucccauaaccucucgc

SEQ ID NO: 10346 - RNA, 22 nt, Artificial Sequence
  ELANE RNA Guide
gagagguuaugggaucccagga

SEQ ID NO: 10347 - RNA, 22 nt, Artificial Sequence
  ELANE RNA Guide
gagguuaugggaucccaggacc

SEQ ID NO: 10348 - RNA, 22 nt, Artificial Sequence
  ELANE RNA Guide
gaucccaggaccacccgcaccg

SEQ ID NO: 10349 - RNA, 22 nt, Artificial Sequence
  ELANE RNA Guide
gaucccauaaccucucgcggcg

SEQ ID NO: 10350 - RNA, 22 nt, Artificial Sequence
  ELANE RNA Guide
gccgcgagagguuaugggaucc

SEQ ID NO: 10351 - RNA, 22 nt, Artificial Sequence
  ELANE RNA Guide
gcgagagguuaugggaucccag

SEQ ID NO: 10352 - RNA, 22 nt, Artificial Sequence
  ELANE RNA Guide
gcgggugguccugggaucccau

SEQ ID NO: 10353 - RNA, 22 nt, Artificial Sequence
  ELANE RNA Guide
gcggugcgggugguccugggau

SEQ ID NO: 10354 - RNA, 22 nt, Artificial Sequence
  ELANE RNA Guide
gcucccgccgcgagagguuaug

SEQ ID NO: 10355 - RNA, 22 nt, Artificial Sequence
  ELANE RNA Guide
ggaucccaggaccacccgcacc

SEQ ID NO: 10356 - RNA, 22 nt, Artificial Sequence
  ELANE RNA Guide
ggaucccauaaccucucgcggc

SEQ ID NO: 10357 - RNA, 22 nt, Artificial Sequence
  ELANE RNA Guide
ggcucccgccgcgagagguuau

SEQ ID NO: 10358 - RNA, 22 nt, Artificial Sequence
  ELANE RNA Guide
gggaucccaggaccacccgcac

SEQ ID NO: 10359 - RNA, 22 nt, Artificial Sequence
  ELANE RNA Guide
gggaucccauaaccucucgcgg

SEQ ID NO: 10360 - RNA, 22 nt, Artificial Sequence
  ELANE RNA Guide
gggugguccugggaucccauaa

SEQ ID NO: 10361 - RNA, 22 nt, Artificial Sequence
  ELANE RNA Guide
gguccugggaucccauaaccuc

SEQ ID NO: 10362 - RNA, 22 nt, Artificial Sequence
  ELANE RNA Guide
ggugcgggugguccugggaucc

SEQ ID NO: 10363 - RNA, 22 nt, Artificial Sequence
  ELANE RNA Guide
ggugguccugggaucccauaac

SEQ ID NO: 10364 - RNA, 22 nt, Artificial Sequence
  ELANE RNA Guide
gguuaugggaucccaggaccac

SEQ ID NO: 10365 - RNA, 22 nt, Artificial Sequence
  ELANE RNA Guide
guccugggaucccauaaccucu

SEQ ID NO: 10366 - RNA, 22 nt, Artificial Sequence
  ELANE RNA Guide
gugcgggugguccugggauccc

SEQ ID NO: 10367 - RNA, 22 nt, Artificial Sequence
  ELANE RNA Guide
gugguccugggaucccauaacc

SEQ ID NO: 10368 - RNA, 22 nt, Artificial Sequence
  ELANE RNA Guide
guuaugggaucccaggaccacc

SEQ ID NO: 10369 - RNA, 22 nt, Artificial Sequence
  ELANE RNA Guide
uaugggaucccaggaccacccg

SEQ ID NO: 10370 - RNA, 22 nt, Artificial Sequence
  ELANE RNA Guide
uccugggaucccauaaccucuc

SEQ ID NO: 10371 - RNA, 22 nt, Artificial Sequence
  ELANE RNA Guide
ugcgggugguccugggauccca

SEQ ID NO: 10372 - RNA, 22 nt, Artificial Sequence
  ELANE RNA Guide
ugggaucccaggaccacccgca

SEQ ID NO: 10373 - RNA, 22 nt, Artificial Sequence
  ELANE RNA Guide
ugggaucccauaaccucucgcg

SEQ ID NO: 10374 - RNA, 22 nt, Artificial Sequence
  ELANE RNA Guide
ugguccugggaucccauaaccu

SEQ ID NO: 10375 - RNA, 22 nt, Artificial Sequence
  ELANE RNA Guide
uuaugggaucccaggaccaccc

SEQ ID NO: 10376 - RNA, 20 nt, Artificial Sequence
  ELANE RNA Guide
agagguuaugggagagguua

SEQ ID NO: 10377 - RNA, 20 nt, Artificial Sequence
  ELANE RNA Guide
agcccauaaccucucccaua

SEQ ID NO: 10378 - RNA, 20 nt, Artificial Sequence
  ELANE RNA Guide
agguuaugggagagguuaug

SEQ ID NO: 10379 - RNA, 20 nt, Artificial Sequence
  ELANE RNA Guide
augggagagguuaugggcuc

SEQ ID NO: 10380 - RNA, 20 nt, Artificial Sequence
  ELANE RNA Guide
cccauaaccucucccauaac

SEQ ID NO: 10381 - RNA, 20 nt, Artificial Sequence
  ELANE RNA Guide
ccugggagcccauaaccucu

SEQ ID NO: 10382 - RNA, 20 nt, Artificial Sequence
  ELANE RNA Guide
cugggagcccauaaccucuc

SEQ ID NO: 10383 - RNA, 20 nt, Artificial Sequence
  ELANE RNA Guide
gagagguuaugggagagguu

SEQ ID NO: 10384 - RNA, 20 nt, Artificial Sequence
  ELANE RNA Guide
gagcccauaaccucucccau

SEQ ID NO: 10385 - RNA, 20 nt, Artificial Sequence
  ELANE RNA Guide
gagguuaugggagagguuau

SEQ ID NO: 10386 - RNA, 20 nt, Artificial Sequence
  ELANE RNA Guide
gcccauaaccucucccauaa

SEQ ID NO: 10387 - RNA, 20 nt, Artificial Sequence
  ELANE RNA Guide
ggagagguuaugggcuccca

SEQ ID NO: 10388 - RNA, 20 nt, Artificial Sequence
  ELANE RNA Guide
ggagcccauaaccucuccca

SEQ ID NO: 10389 - RNA, 20 nt, Artificial Sequence
  ELANE RNA Guide
gggagagguuaugggcuccc

SEQ ID NO: 10390 - RNA, 20 nt, Artificial Sequence
  ELANE RNA Guide
gggagcccauaaccucuccc

SEQ ID NO: 10391 - RNA, 20 nt, Artificial Sequence
  ELANE RNA Guide
gguuaugggagagguuaugg

SEQ ID NO: 10392 - RNA, 20 nt, Artificial Sequence
  ELANE RNA Guide
guccugggagcccauaaccu

SEQ ID NO: 10393 - RNA, 20 nt, Artificial Sequence
  ELANE RNA Guide
guuaugggagagguuauggg

SEQ ID NO: 10394 - RNA, 20 nt, Artificial Sequence
  ELANE RNA Guide
uaugggagagguuaugggcu

SEQ ID NO: 10395 - RNA, 20 nt, Artificial Sequence
  ELANE RNA Guide
uccugggagcccauaaccuc

SEQ ID NO: 10396 - RNA, 20 nt, Artificial Sequence
  ELANE RNA Guide
ugggagagguuaugggcucc

SEQ ID NO: 10397 - RNA, 20 nt, Artificial Sequence
  ELANE RNA Guide
ugggagcccauaaccucucc

SEQ ID NO: 10398 - RNA, 20 nt, Artificial Sequence
  ELANE RNA Guide
uuaugggagagguuaugggc

SEQ ID NO: 10399 - RNA, 21 nt, Artificial Sequence
  ELANE RNA Guide
agagguuaugggagagguuau

SEQ ID NO: 10400 - RNA, 21 nt, Artificial Sequence
  ELANE RNA Guide
agcccauaaccucucccauaa

SEQ ID NO: 10401 - RNA, 21 nt, Artificial Sequence
  ELANE RNA Guide
agguuaugggagagguuaugg

SEQ ID NO: 10402 - RNA, 21 nt, Artificial Sequence
  ELANE RNA Guide
augggagagguuaugggcucc

SEQ ID NO: 10403 - RNA, 21 nt, Artificial Sequence
  ELANE RNA Guide
cccauaaccucucccauaacc

SEQ ID NO: 10404 - RNA, 21 nt, Artificial Sequence
  ELANE RNA Guide
ccugggagcccauaaccucuc

SEQ ID NO: 10405 - RNA, 21 nt, Artificial Sequence
  ELANE RNA Guide
cgagagguuaugggagagguu

SEQ ID NO: 10406 - RNA, 21 nt, Artificial Sequence
  ELANE RNA Guide
cugggagcccauaaccucucc

SEQ ID NO: 10407 - RNA, 21 nt, Artificial Sequence
  ELANE RNA Guide
gagagguuaugggagagguua

SEQ ID NO: 10408 - RNA, 21 nt, Artificial Sequence
  ELANE RNA Guide
gagcccauaaccucucccaua

SEQ ID NO: 10409 - RNA, 21 nt, Artificial Sequence
  ELANE RNA Guide
gagguuaugggagagguuaug

SEQ ID NO: 10410 - RNA, 21 nt, Artificial Sequence
  ELANE RNA Guide
gcccauaaccucucccauaac

SEQ ID NO: 10411 - RNA, 21 nt, Artificial Sequence
  ELANE RNA Guide
ggagagguuaugggcucccag

SEQ ID NO: 10412 - RNA, 21 nt, Artificial Sequence
  ELANE RNA Guide
ggagcccauaaccucucccau

SEQ ID NO: 10413 - RNA, 21 nt, Artificial Sequence
  ELANE RNA Guide
gggagagguuaugggcuccca

SEQ ID NO: 10414 - RNA, 21 nt, Artificial Sequence
  ELANE RNA Guide
gggagcccauaaccucuccca

SEQ ID NO: 10415 - RNA, 21 nt, Artificial Sequence
  ELANE RNA Guide
gguccugggagcccauaaccu

SEQ ID NO: 10416 - RNA, 21 nt, Artificial Sequence
  ELANE RNA Guide
gguuaugggagagguuauggg

SEQ ID NO: 10417 - RNA, 21 nt, Artificial Sequence
  ELANE RNA Guide
guccugggagcccauaaccuc

SEQ ID NO: 10418 - RNA, 21 nt, Artificial Sequence
  ELANE RNA Guide
guuaugggagagguuaugggc

SEQ ID NO: 10419 - RNA, 21 nt, Artificial Sequence
  ELANE RNA Guide
uaugggagagguuaugggcuc

SEQ ID NO: 10420 - RNA, 21 nt, Artificial Sequence
  ELANE RNA Guide
uccugggagcccauaaccucu

SEQ ID NO: 10421 - RNA, 21 nt, Artificial Sequence
  ELANE RNA Guide
ugggagagguuaugggcuccc

SEQ ID NO: 10422 - RNA, 21 nt, Artificial Sequence
  ELANE RNA Guide
ugggagcccauaaccucuccc

SEQ ID NO: 10423 - RNA, 21 nt, Artificial Sequence
  ELANE RNA Guide
uuaugggagagguuaugggcu

SEQ ID NO: 10424 - RNA, 22 nt, Artificial Sequence
  ELANE RNA Guide
agagguuaugggagagguuaug

SEQ ID NO: 10425 - RNA, 22 nt, Artificial Sequence
  ELANE RNA Guide
agcccauaaccucucccauaac

SEQ ID NO: 10426 - RNA, 22 nt, Artificial Sequence
  ELANE RNA Guide
agguuaugggagagguuauggg

SEQ ID NO: 10427 - RNA, 22 nt, Artificial Sequence
  ELANE RNA Guide
augggagagguuaugggcuccc

SEQ ID NO: 10428 - RNA, 22 nt, Artificial Sequence
  ELANE RNA Guide
cccauaaccucucccauaaccu

SEQ ID NO: 10429 - RNA, 22 nt, Artificial Sequence
  ELANE RNA Guide
ccugggagcccauaaccucucc

SEQ ID NO: 10430 - RNA, 22 nt, Artificial Sequence
  ELANE RNA Guide
cgagagguuaugggagagguua

SEQ ID NO: 10431 - RNA, 22 nt, Artificial Sequence
  ELANE RNA Guide
cugggagcccauaaccucuccc

SEQ ID NO: 10432 - RNA, 22 nt, Artificial Sequence
  ELANE RNA Guide
gagagguuaugggagagguuau

SEQ ID NO: 10433 - RNA, 22 nt, Artificial Sequence
  ELANE RNA Guide
gagcccauaaccucucccauaa

SEQ ID NO: 10434 - RNA, 22 nt, Artificial Sequence
  ELANE RNA Guide
gagguuaugggagagguuaugg

SEQ ID NO: 10435 - RNA, 22 nt, Artificial Sequence
  ELANE RNA Guide
gcccauaaccucucccauaacc

SEQ ID NO: 10436 - RNA, 22 nt, Artificial Sequence
  ELANE RNA Guide
gcgagagguuaugggagagguu

SEQ ID NO: 10437 - RNA, 22 nt, Artificial Sequence
  ELANE RNA Guide
ggagagguuaugggcucccagg

SEQ ID NO: 10438 - RNA, 22 nt, Artificial Sequence
  ELANE RNA Guide
ggagcccauaaccucucccaua

SEQ ID NO: 10439 - RNA, 22 nt, Artificial Sequence
  ELANE RNA Guide
gggagagguuaugggcucccag

SEQ ID NO: 10440 - RNA, 22 nt, Artificial Sequence
  ELANE RNA Guide
gggagcccauaaccucucccau

SEQ ID NO: 10441 - RNA, 22 nt, Artificial Sequence
  ELANE RNA Guide
gguccugggagcccauaaccuc

SEQ ID NO: 10442 - RNA, 22 nt, Artificial Sequence
  ELANE RNA Guide
gguuaugggagagguuaugggc

SEQ ID NO: 10443 - RNA, 22 nt, Artificial Sequence
  ELANE RNA Guide
guccugggagcccauaaccucu

SEQ ID NO: 10444 - RNA, 22 nt, Artificial Sequence
  ELANE RNA Guide
guuaugggagagguuaugggcu

SEQ ID NO: 10445 - RNA, 22 nt, Artificial Sequence
  ELANE RNA Guide
uaugggagagguuaugggcucc

SEQ ID NO: 10446 - RNA, 22 nt, Artificial Sequence
  ELANE RNA Guide
uccugggagcccauaaccucuc

SEQ ID NO: 10447 - RNA, 22 nt, Artificial Sequence
  ELANE RNA Guide
ugggagagguuaugggcuccca

SEQ ID NO: 10448 - RNA, 22 nt, Artificial Sequence
  ELANE RNA Guide
ugggagcccauaaccucuccca

SEQ ID NO: 10449 - RNA, 22 nt, Artificial Sequence
  ELANE RNA Guide
ugguccugggagcccauaaccu

SEQ ID NO: 10450 - RNA, 22 nt, Artificial Sequence
  ELANE RNA Guide
uuaugggagagguuaugggcuc

SEQ ID NO: 10451 - RNA, 20 nt, Artificial Sequence
  ELANE RNA Guide
agagguuggcucccaggacc

SEQ ID NO: 10452 - RNA, 20 nt, Artificial Sequence
  ELANE RNA Guide
agccaaccucucgcggcggg

SEQ ID NO: 10453 - RNA, 20 nt, Artificial Sequence
  ELANE RNA Guide
agguuggcucccaggaccac

SEQ ID NO: 10454 - RNA, 20 nt, Artificial Sequence
  ELANE RNA Guide
ccaaccucucgcggcgggag

SEQ ID NO: 10455 - RNA, 20 nt, Artificial Sequence
  ELANE RNA Guide
cccgccgcgagagguuggcu

SEQ ID NO: 10456 - RNA, 20 nt, Artificial Sequence
  ELANE RNA Guide
ccgccgcgagagguuggcuc

SEQ ID NO: 10457 - RNA, 20 nt, Artificial Sequence
  ELANE RNA Guide
ccgcgagagguuggcuccca

SEQ ID NO: 10458 - RNA, 20 nt, Artificial Sequence
  ELANE RNA Guide
ccugggagccaaccucucgc

SEQ ID NO: 10459 - RNA, 20 nt, Artificial Sequence
  ELANE RNA Guide
cgagagguuggcucccagga

SEQ ID NO: 10460 - RNA, 20 nt, Artificial Sequence
  ELANE RNA Guide
cgccgcgagagguuggcucc

SEQ ID NO: 10461 - RNA, 20 nt, Artificial Sequence
  ELANE RNA Guide
cgcgagagguuggcucccag

SEQ ID NO: 10462 - RNA, 20 nt, Artificial Sequence
  ELANE RNA Guide
cgggugguccugggagccaa

SEQ ID NO: 10463 - RNA, 20 nt, Artificial Sequence
  ELANE RNA Guide
cucccgccgcgagagguugg

SEQ ID NO: 10464 - RNA, 20 nt, Artificial Sequence
  ELANE RNA Guide
cugggagccaaccucucgcg

SEQ ID NO: 10465 - RNA, 20 nt, Artificial Sequence
  ELANE RNA Guide
gagagguuggcucccaggac

SEQ ID NO: 10466 - RNA, 20 nt, Artificial Sequence
  ELANE RNA Guide
gagccaaccucucgcggcgg

SEQ ID NO: 10467 - RNA, 20 nt, Artificial Sequence
  ELANE RNA Guide
gagguuggcucccaggacca

SEQ ID NO: 10468 - RNA, 20 nt, Artificial Sequence
  ELANE RNA Guide
gccaaccucucgcggcggga

SEQ ID NO: 10469 - RNA, 20 nt, Artificial Sequence
  ELANE RNA Guide
gccgcgagagguuggcuccc

SEQ ID NO: 10470 - RNA, 20 nt, Artificial Sequence
  ELANE RNA Guide
gcgagagguuggcucccagg

SEQ ID NO: 10471 - RNA, 20 nt, Artificial Sequence
  ELANE RNA Guide
gcgggugguccugggagcca

SEQ ID NO: 10472 - RNA, 20 nt, Artificial Sequence
  ELANE RNA Guide
gcucccgccgcgagagguug

SEQ ID NO: 10473 - RNA, 20 nt, Artificial Sequence
  ELANE RNA Guide
ggagccaaccucucgcggcg

SEQ ID NO: 10474 - RNA, 20 nt, Artificial Sequence
  ELANE RNA Guide
ggcucccgccgcgagagguu

SEQ ID NO: 10475 - RNA, 20 nt, Artificial Sequence
  ELANE RNA Guide
gggagccaaccucucgcggc

SEQ ID NO: 10476 - RNA, 20 nt, Artificial Sequence
  ELANE RNA Guide
gggcucccgccgcgagaggu

SEQ ID NO: 10477 - RNA, 20 nt, Artificial Sequence
  ELANE RNA Guide
gggugguccugggagccaac

SEQ ID NO: 10478 - RNA, 20 nt, Artificial Sequence
  ELANE RNA Guide
gguccugggagccaaccucu

SEQ ID NO: 10479 - RNA, 20 nt, Artificial Sequence
  ELANE RNA Guide
ggugcgggugguccugggag

SEQ ID NO: 10480 - RNA, 20 nt, Artificial Sequence
  ELANE RNA Guide
ggugguccugggagccaacc

SEQ ID NO: 10481 - RNA, 20 nt, Artificial Sequence
  ELANE RNA Guide
gguuggcucccaggaccacc

SEQ ID NO: 10482 - RNA, 20 nt, Artificial Sequence
  ELANE RNA Guide
guccugggagccaaccucuc

SEQ ID NO: 10483 - RNA, 20 nt, Artificial Sequence
  ELANE RNA Guide
gugcgggugguccugggagc

SEQ ID NO: 10484 - RNA, 20 nt, Artificial Sequence
  ELANE RNA Guide
gugggcucccgccgcgagag

SEQ ID NO: 10485 - RNA, 20 nt, Artificial Sequence
  ELANE RNA Guide
gugguccugggagccaaccu

SEQ ID NO: 10486 - RNA, 20 nt, Artificial Sequence
  ELANE RNA Guide
guuggcucccaggaccaccc

SEQ ID NO: 10487 - RNA, 20 nt, Artificial Sequence
  ELANE RNA Guide
ucccgccgcgagagguuggc

SEQ ID NO: 10488 - RNA, 20 nt, Artificial Sequence
  ELANE RNA Guide
uccugggagccaaccucucg

SEQ ID NO: 10489 - RNA, 20 nt, Artificial Sequence
  ELANE RNA Guide
ugcgggugguccugggagcc

SEQ ID NO: 10490 - RNA, 20 nt, Artificial Sequence
  ELANE RNA Guide
uggcucccaggaccacccgc

SEQ ID NO: 10491 - RNA, 20 nt, Artificial Sequence
  ELANE RNA Guide
ugggagccaaccucucgcgg

SEQ ID NO: 10492 - RNA, 20 nt, Artificial Sequence
  ELANE RNA Guide
ugggcucccgccgcgagagg

SEQ ID NO: 10493 - RNA, 20 nt, Artificial Sequence
  ELANE RNA Guide
ugguccugggagccaaccuc

SEQ ID NO: 10494 - RNA, 20 nt, Artificial Sequence
  ELANE RNA Guide
uuggcucccaggaccacccg

SEQ ID NO: 10495 - RNA, 21 nt, Artificial Sequence
  ELANE RNA Guide
agagguuggcucccaggacca

SEQ ID NO: 10496 - RNA, 21 nt, Artificial Sequence
  ELANE RNA Guide
agccaaccucucgcggcggga

SEQ ID NO: 10497 - RNA, 21 nt, Artificial Sequence
  ELANE RNA Guide
agguuggcucccaggaccacc

SEQ ID NO: 10498 - RNA, 21 nt, Artificial Sequence
  ELANE RNA Guide
ccaaccucucgcggcgggagc

SEQ ID NO: 10499 - RNA, 21 nt, Artificial Sequence
  ELANE RNA Guide
cccgccgcgagagguuggcuc

SEQ ID NO: 10500 - RNA, 21 nt, Artificial Sequence
  ELANE RNA Guide
ccgccgcgagagguuggcucc

SEQ ID NO: 10501 - RNA, 21 nt, Artificial Sequence
  ELANE RNA Guide
ccgcgagagguuggcucccag

SEQ ID NO: 10502 - RNA, 21 nt, Artificial Sequence
  ELANE RNA Guide
ccugggagccaaccucucgcg

SEQ ID NO: 10503 - RNA, 21 nt, Artificial Sequence
  ELANE RNA Guide
cgagagguuggcucccaggac

SEQ ID NO: 10504 - RNA, 21 nt, Artificial Sequence
  ELANE RNA Guide
cgccgcgagagguuggcuccc

SEQ ID NO: 10505 - RNA, 21 nt, Artificial Sequence
  ELANE RNA Guide
cgcgagagguuggcucccagg

SEQ ID NO: 10506 - RNA, 21 nt, Artificial Sequence
  ELANE RNA Guide
cgggugguccugggagccaac

SEQ ID NO: 10507 - RNA, 21 nt, Artificial Sequence
  ELANE RNA Guide
cggugcgggugguccugggag

SEQ ID NO: 10508 - RNA, 21 nt, Artificial Sequence
  ELANE RNA Guide
cucccgccgcgagagguuggc

SEQ ID NO: 10509 - RNA, 21 nt, Artificial Sequence
  ELANE RNA Guide
cugggagccaaccucucgcgg

SEQ ID NO: 10510 - RNA, 21 nt, Artificial Sequence
  ELANE RNA Guide
gagagguuggcucccaggacc

SEQ ID NO: 10511 - RNA, 21 nt, Artificial Sequence
  ELANE RNA Guide
gagccaaccucucgcggcggg

SEQ ID NO: 10512 - RNA, 21 nt, Artificial Sequence
  ELANE RNA Guide
gagguuggcucccaggaccac

SEQ ID NO: 10513 - RNA, 21 nt, Artificial Sequence
  ELANE RNA Guide
gccaaccucucgcggcgggag

SEQ ID NO: 10514 - RNA, 21 nt, Artificial Sequence
  ELANE RNA Guide
gccgcgagagguuggcuccca

SEQ ID NO: 10515 - RNA, 21 nt, Artificial Sequence
  ELANE RNA Guide
gcgagagguuggcucccagga

SEQ ID NO: 10516 - RNA, 21 nt, Artificial Sequence
  ELANE RNA Guide
gcgggugguccugggagccaa

SEQ ID NO: 10517 - RNA, 21 nt, Artificial Sequence
  ELANE RNA Guide
gcucccgccgcgagagguugg

SEQ ID NO: 10518 - RNA, 21 nt, Artificial Sequence
  ELANE RNA Guide
ggagccaaccucucgcggcgg

SEQ ID NO: 10519 - RNA, 21 nt, Artificial Sequence
  ELANE RNA Guide
ggcucccgccgcgagagguug

SEQ ID NO: 10520 - RNA, 21 nt, Artificial Sequence
  ELANE RNA Guide
gggagccaaccucucgcggcg

SEQ ID NO: 10521 - RNA, 21 nt, Artificial Sequence
  ELANE RNA Guide
gggcucccgccgcgagagguu

SEQ ID NO: 10522 - RNA, 21 nt, Artificial Sequence
  ELANE RNA Guide
gggugguccugggagccaacc

SEQ ID NO: 10523 - RNA, 21 nt, Artificial Sequence
  ELANE RNA Guide
gguccugggagccaaccucuc

SEQ ID NO: 10524 - RNA, 21 nt, Artificial Sequence
  ELANE RNA Guide
ggugcgggugguccugggagc

SEQ ID NO: 10525 - RNA, 21 nt, Artificial Sequence
  ELANE RNA Guide
ggugguccugggagccaaccu

SEQ ID NO: 10526 - RNA, 21 nt, Artificial Sequence
  ELANE RNA Guide
gguuggcucccaggaccaccc

SEQ ID NO: 10527 - RNA, 21 nt, Artificial Sequence
  ELANE RNA Guide
guccugggagccaaccucucg

SEQ ID NO: 10528 - RNA, 21 nt, Artificial Sequence
  ELANE RNA Guide
gugcgggugguccugggagcc

SEQ ID NO: 10529 - RNA, 21 nt, Artificial Sequence
  ELANE RNA Guide
gugguccugggagccaaccuc

SEQ ID NO: 10530 - RNA, 21 nt, Artificial Sequence
  ELANE RNA Guide
guuggcucccaggaccacccg

SEQ ID NO: 10531 - RNA, 21 nt, Artificial Sequence
  ELANE RNA Guide
ucccgccgcgagagguuggcu

SEQ ID NO: 10532 - RNA, 21 nt, Artificial Sequence
  ELANE RNA Guide
uccugggagccaaccucucgc

SEQ ID NO: 10533 - RNA, 21 nt, Artificial Sequence
  ELANE RNA Guide
ugcgggugguccugggagcca

SEQ ID NO: 10534 - RNA, 21 nt, Artificial Sequence
  ELANE RNA Guide
uggcucccaggaccacccgca

SEQ ID NO: 10535 - RNA, 21 nt, Artificial Sequence
  ELANE RNA Guide
ugggagccaaccucucgcggc

SEQ ID NO: 10536 - RNA, 21 nt, Artificial Sequence
  ELANE RNA Guide
ugggcucccgccgcgagaggu

SEQ ID NO: 10537 - RNA, 21 nt, Artificial Sequence
  ELANE RNA Guide
ugguccugggagccaaccucu

SEQ ID NO: 10538 - RNA, 21 nt, Artificial Sequence
  ELANE RNA Guide
uuggcucccaggaccacccgc

SEQ ID NO: 10539 - RNA, 22 nt, Artificial Sequence
  ELANE RNA Guide
agagguuggcucccaggaccac

SEQ ID NO: 10540 - RNA, 22 nt, Artificial Sequence
  ELANE RNA Guide
agccaaccucucgcggcgggag

SEQ ID NO: 10541 - RNA, 22 nt, Artificial Sequence
  ELANE RNA Guide
agguuggcucccaggaccaccc

SEQ ID NO: 10542 - RNA, 22 nt, Artificial Sequence
  ELANE RNA Guide
ccaaccucucgcggcgggagcc

SEQ ID NO: 10543 - RNA, 22 nt, Artificial Sequence
  ELANE RNA Guide
cccgccgcgagagguuggcucc

SEQ ID NO: 10544 - RNA, 22 nt, Artificial Sequence
  ELANE RNA Guide
ccgccgcgagagguuggcuccc

SEQ ID NO: 10545 - RNA, 22 nt, Artificial Sequence
  ELANE RNA Guide
ccgcgagagguuggcucccagg

SEQ ID NO: 10546 - RNA, 22 nt, Artificial Sequence
  ELANE RNA Guide
ccugggagccaaccucucgcgg

SEQ ID NO: 10547 - RNA, 22 nt, Artificial Sequence
  ELANE RNA Guide
cgagagguuggcucccaggacc

SEQ ID NO: 10548 - RNA, 22 nt, Artificial Sequence
  ELANE RNA Guide
cgccgcgagagguuggcuccca

SEQ ID NO: 10549 - RNA, 22 nt, Artificial Sequence
  ELANE RNA Guide
cgcgagagguuggcucccagga

SEQ ID NO: 10550 - RNA, 22 nt, Artificial Sequence
  ELANE RNA Guide
cgggugguccugggagccaacc

SEQ ID NO: 10551 - RNA, 22 nt, Artificial Sequence
  ELANE RNA Guide
cggugcgggugguccugggagc

SEQ ID NO: 10552 - RNA, 22 nt, Artificial Sequence
  ELANE RNA Guide
cucccgccgcgagagguuggcu

SEQ ID NO: 10553 - RNA, 22 nt, Artificial Sequence
  ELANE RNA Guide
cugggagccaaccucucgcggc

SEQ ID NO: 10554 - RNA, 22 nt, Artificial Sequence
  ELANE RNA Guide
gagagguuggcucccaggacca

SEQ ID NO: 10555 - RNA, 22 nt, Artificial Sequence
  ELANE RNA Guide
gagccaaccucucgcggcggga

SEQ ID NO: 10556 - RNA, 22 nt, Artificial Sequence
  ELANE RNA Guide
gagguuggcucccaggaccacc

SEQ ID NO: 10557 - RNA, 22 nt, Artificial Sequence
  ELANE RNA Guide
gccaaccucucgcggcgggagc

SEQ ID NO: 10558 - RNA, 22 nt, Artificial Sequence
  ELANE RNA Guide
gccgcgagagguuggcucccag

SEQ ID NO: 10559 - RNA, 22 nt, Artificial Sequence
  ELANE RNA Guide
gcgagagguuggcucccaggac

SEQ ID NO: 10560 - RNA, 22 nt, Artificial Sequence
  ELANE RNA Guide
gcgggugguccugggagccaac

SEQ ID NO: 10561 - RNA, 22 nt, Artificial Sequence
  ELANE RNA Guide
gcggugcgggugguccugggag

SEQ ID NO: 10562 - RNA, 22 nt, Artificial Sequence
  ELANE RNA Guide
gcucccgccgcgagagguuggc

SEQ ID NO: 10563 - RNA, 22 nt, Artificial Sequence
  ELANE RNA Guide
ggagccaaccucucgcggcggg

SEQ ID NO: 10564 - RNA, 22 nt, Artificial Sequence
  ELANE RNA Guide
ggcucccgccgcgagagguugg

SEQ ID NO: 10565 - RNA, 22 nt, Artificial Sequence
  ELANE RNA Guide
gggagccaaccucucgcggcgg

SEQ ID NO: 10566 - RNA, 22 nt, Artificial Sequence
  ELANE RNA Guide
gggcucccgccgcgagagguug

SEQ ID NO: 10567 - RNA, 22 nt, Artificial Sequence
  ELANE RNA Guide
gggugguccugggagccaaccu

SEQ ID NO: 10568 - RNA, 22 nt, Artificial Sequence
  ELANE RNA Guide
gguccugggagccaaccucucg

SEQ ID NO: 10569 - RNA, 22 nt, Artificial Sequence
  ELANE RNA Guide
ggugcgggugguccugggagcc

SEQ ID NO: 10570 - RNA, 22 nt, Artificial Sequence
  ELANE RNA Guide
ggugguccugggagccaaccuc

SEQ ID NO: 10571 - RNA, 22 nt, Artificial Sequence
  ELANE RNA Guide
gguuggcucccaggaccacccg

SEQ ID NO: 10572 - RNA, 22 nt, Artificial Sequence
  ELANE RNA Guide
guccugggagccaaccucucgc

SEQ ID NO: 10573 - RNA, 22 nt, Artificial Sequence
  ELANE RNA Guide
gugcgggugguccugggagcca

SEQ ID NO: 10574 - RNA, 22 nt, Artificial Sequence
  ELANE RNA Guide
gugggcucccgccgcgagaggu

SEQ ID NO: 10575 - RNA, 22 nt, Artificial Sequence
  ELANE RNA Guide
gugguccugggagccaaccucu

SEQ ID NO: 10576 - RNA, 22 nt, Artificial Sequence
  ELANE RNA Guide
guuggcucccaggaccacccgc

SEQ ID NO: 10577 - RNA, 22 nt, Artificial Sequence
  ELANE RNA Guide
ucccgccgcgagagguuggcuc

SEQ ID NO: 10578 - RNA, 22 nt, Artificial Sequence
  ELANE RNA Guide
uccugggagccaaccucucgcg

SEQ ID NO: 10579 - RNA, 22 nt, Artificial Sequence
  ELANE RNA Guide
ugcgggugguccugggagccaa

SEQ ID NO: 10580 - RNA, 22 nt, Artificial Sequence
  ELANE RNA Guide
uggcucccaggaccacccgcac

SEQ ID NO: 10581 - RNA, 22 nt, Artificial Sequence
  ELANE RNA Guide
ugggagccaaccucucgcggcg

SEQ ID NO: 10582 - RNA, 22 nt, Artificial Sequence
  ELANE RNA Guide
ugggcucccgccgcgagagguu

SEQ ID NO: 10583 - RNA, 22 nt, Artificial Sequence
  ELANE RNA Guide
ugguccugggagccaaccucuc

SEQ ID NO: 10584 - RNA, 22 nt, Artificial Sequence
  ELANE RNA Guide
uuggcucccaggaccacccgca

SEQ ID NO: 10585 - RNA, 20 nt, Artificial Sequence
  ELANE RNA Guide
aacuucucgcggcgggagcc

SEQ ID NO: 10586 - RNA, 20 nt, Artificial Sequence
  ELANE RNA Guide
aaguuaugggcucccaggac

SEQ ID NO: 10587 - RNA, 20 nt, Artificial Sequence
  ELANE RNA Guide
acuucucgcggcgggagccc

SEQ ID NO: 10588 - RNA, 20 nt, Artificial Sequence
  ELANE RNA Guide
agaaguuaugggcucccagg

SEQ ID NO: 10589 - RNA, 20 nt, Artificial Sequence
  ELANE RNA Guide
agcccauaacuucucgcggc

SEQ ID NO: 10590 - RNA, 20 nt, Artificial Sequence
  ELANE RNA Guide
auaacuucucgcggcgggag

SEQ ID NO: 10591 - RNA, 20 nt, Artificial Sequence
  ELANE RNA Guide
cauaacuucucgcggcggga

SEQ ID NO: 10592 - RNA, 20 nt, Artificial Sequence
  ELANE RNA Guide
ccauaacuucucgcggcggg

SEQ ID NO: 10593 - RNA, 20 nt, Artificial Sequence
  ELANE RNA Guide
cccauaacuucucgcggcgg

SEQ ID NO: 10594 - RNA, 20 nt, Artificial Sequence
  ELANE RNA Guide
cccgccgcgagaaguuaugg

SEQ ID NO: 10595 - RNA, 20 nt, Artificial Sequence
  ELANE RNA Guide
ccgccgcgagaaguuauggg

SEQ ID NO: 10596 - RNA, 20 nt, Artificial Sequence
  ELANE RNA Guide
ccgcgagaaguuaugggcuc

SEQ ID NO: 10597 - RNA, 20 nt, Artificial Sequence
  ELANE RNA Guide
ccugggagcccauaacuucu

SEQ ID NO: 10598 - RNA, 20 nt, Artificial Sequence
  ELANE RNA Guide
cgagaaguuaugggcuccca

SEQ ID NO: 10599 - RNA, 20 nt, Artificial Sequence
  ELANE RNA Guide
cgccgcgagaaguuaugggc

SEQ ID NO: 10600 - RNA, 20 nt, Artificial Sequence
  ELANE RNA Guide
cgcgagaaguuaugggcucc

SEQ ID NO: 10601 - RNA, 20 nt, Artificial Sequence
  ELANE RNA Guide
cucccgccgcgagaaguuau

SEQ ID NO: 10602 - RNA, 20 nt, Artificial Sequence
  ELANE RNA Guide
cugggagcccauaacuucuc

SEQ ID NO: 10603 - RNA, 20 nt, Artificial Sequence
  ELANE RNA Guide
cuucucgcggcgggagccca

SEQ ID NO: 10604 - RNA, 20 nt, Artificial Sequence
  ELANE RNA Guide
gaaguuaugggcucccagga

SEQ ID NO: 10605 - RNA, 20 nt, Artificial Sequence
  ELANE RNA Guide
gagaaguuaugggcucccag

SEQ ID NO: 10606 - RNA, 20 nt, Artificial Sequence
  ELANE RNA Guide
gagcccauaacuucucgcgg

SEQ ID NO: 10607 - RNA, 20 nt, Artificial Sequence
  ELANE RNA Guide
gcccauaacuucucgcggcg

SEQ ID NO: 10608 - RNA, 20 nt, Artificial Sequence
  ELANE RNA Guide
gccgcgagaaguuaugggcu

SEQ ID NO: 10609 - RNA, 20 nt, Artificial Sequence
  ELANE RNA Guide
gcgagaaguuaugggcuccc

SEQ ID NO: 10610 - RNA, 20 nt, Artificial Sequence
  ELANE RNA Guide
gcucccgccgcgagaaguua

SEQ ID NO: 10611 - RNA, 20 nt, Artificial Sequence
  ELANE RNA Guide
ggagcccauaacuucucgcg

SEQ ID NO: 10612 - RNA, 20 nt, Artificial Sequence
  ELANE RNA Guide
ggcucccgccgcgagaaguu

SEQ ID NO: 10613 - RNA, 20 nt, Artificial Sequence
  ELANE RNA Guide
gggagcccauaacuucucgc

SEQ ID NO: 10614 - RNA, 20 nt, Artificial Sequence
  ELANE RNA Guide
gggcucccgccgcgagaagu

SEQ ID NO: 10615 - RNA, 20 nt, Artificial Sequence
  ELANE RNA Guide
gggugguccugggagcccau

SEQ ID NO: 10616 - RNA, 20 nt, Artificial Sequence
  ELANE RNA Guide
gguccugggagcccauaacu

SEQ ID NO: 10617 - RNA, 20 nt, Artificial Sequence
  ELANE RNA Guide
ggugggcucccgccgcgaga

SEQ ID NO: 10618 - RNA, 20 nt, Artificial Sequence
  ELANE RNA Guide
ggugguccugggagcccaua

SEQ ID NO: 10619 - RNA, 20 nt, Artificial Sequence
  ELANE RNA Guide
guccugggagcccauaacuu

SEQ ID NO: 10620 - RNA, 20 nt, Artificial Sequence
  ELANE RNA Guide
gugggcucccgccgcgagaa

SEQ ID NO: 10621 - RNA, 20 nt, Artificial Sequence
  ELANE RNA Guide
gugguccugggagcccauaa

SEQ ID NO: 10622 - RNA, 20 nt, Artificial Sequence
  ELANE RNA Guide
uaacuucucgcggcgggagc

SEQ ID NO: 10623 - RNA, 20 nt, Artificial Sequence
  ELANE RNA Guide
ucccgccgcgagaaguuaug

SEQ ID NO: 10624 - RNA, 20 nt, Artificial Sequence
  ELANE RNA Guide
uccugggagcccauaacuuc

SEQ ID NO: 10625 - RNA, 20 nt, Artificial Sequence
  ELANE RNA Guide
ugggagcccauaacuucucg

SEQ ID NO: 10626 - RNA, 20 nt, Artificial Sequence
  ELANE RNA Guide
ugggcucccgccgcgagaag

SEQ ID NO: 10627 - RNA, 20 nt, Artificial Sequence
  ELANE RNA Guide
ugguccugggagcccauaac

SEQ ID NO: 10628 - RNA, 21 nt, Artificial Sequence
  ELANE RNA Guide
aacuucucgcggcgggagccc

SEQ ID NO: 10629 - RNA, 21 nt, Artificial Sequence
  ELANE RNA Guide
aaguuaugggcucccaggacc

SEQ ID NO: 10630 - RNA, 21 nt, Artificial Sequence
  ELANE RNA Guide
acuucucgcggcgggagccca

SEQ ID NO: 10631 - RNA, 21 nt, Artificial Sequence
  ELANE RNA Guide
agaaguuaugggcucccagga

SEQ ID NO: 10632 - RNA, 21 nt, Artificial Sequence
  ELANE RNA Guide
agcccauaacuucucgcggcg

SEQ ID NO: 10633 - RNA, 21 nt, Artificial Sequence
  ELANE RNA Guide
auaacuucucgcggcgggagc

SEQ ID NO: 10634 - RNA, 21 nt, Artificial Sequence
  ELANE RNA Guide
cauaacuucucgcggcgggag

SEQ ID NO: 10635 - RNA, 21 nt, Artificial Sequence
  ELANE RNA Guide
ccauaacuucucgcggcggga

SEQ ID NO: 10636 - RNA, 21 nt, Artificial Sequence
  ELANE RNA Guide
cccauaacuucucgcggcggg

SEQ ID NO: 10637 - RNA, 21 nt, Artificial Sequence
  ELANE RNA Guide
cccgccgcgagaaguuauggg

SEQ ID NO: 10638 - RNA, 21 nt, Artificial Sequence
  ELANE RNA Guide
ccgccgcgagaaguuaugggc

SEQ ID NO: 10639 - RNA, 21 nt, Artificial Sequence
  ELANE RNA Guide
ccgcgagaaguuaugggcucc

SEQ ID NO: 10640 - RNA, 21 nt, Artificial Sequence
  ELANE RNA Guide
ccugggagcccauaacuucuc

SEQ ID NO: 10641 - RNA, 21 nt, Artificial Sequence
  ELANE RNA Guide
cgagaaguuaugggcucccag

SEQ ID NO: 10642 - RNA, 21 nt, Artificial Sequence
  ELANE RNA Guide
cgccgcgagaaguuaugggcu

SEQ ID NO: 10643 - RNA, 21 nt, Artificial Sequence
  ELANE RNA Guide
cgcgagaaguuaugggcuccc

SEQ ID NO: 10644 - RNA, 21 nt, Artificial Sequence
  ELANE RNA Guide
cgggugguccugggagcccau

SEQ ID NO: 10645 - RNA, 21 nt, Artificial Sequence
  ELANE RNA Guide
cucccgccgcgagaaguuaug

SEQ ID NO: 10646 - RNA, 21 nt, Artificial Sequence
  ELANE RNA Guide
cugggagcccauaacuucucg

SEQ ID NO: 10647 - RNA, 21 nt, Artificial Sequence
  ELANE RNA Guide
cuucucgcggcgggagcccac

SEQ ID NO: 10648 - RNA, 21 nt, Artificial Sequence
  ELANE RNA Guide
gaaguuaugggcucccaggac

SEQ ID NO: 10649 - RNA, 21 nt, Artificial Sequence
  ELANE RNA Guide
gagaaguuaugggcucccagg

SEQ ID NO: 10650 - RNA, 21 nt, Artificial Sequence
  ELANE RNA Guide
gagcccauaacuucucgcggc

SEQ ID NO: 10651 - RNA, 21 nt, Artificial Sequence
  ELANE RNA Guide
gcccauaacuucucgcggcgg

SEQ ID NO: 10652 - RNA, 21 nt, Artificial Sequence
  ELANE RNA Guide
gccgcgagaaguuaugggcuc

SEQ ID NO: 10653 - RNA, 21 nt, Artificial Sequence
  ELANE RNA Guide
gcgagaaguuaugggcuccca

SEQ ID NO: 10654 - RNA, 21 nt, Artificial Sequence
  ELANE RNA Guide
gcucccgccgcgagaaguuau

SEQ ID NO: 10655 - RNA, 21 nt, Artificial Sequence
  ELANE RNA Guide
ggagcccauaacuucucgcgg

SEQ ID NO: 10656 - RNA, 21 nt, Artificial Sequence
  ELANE RNA Guide
ggcucccgccgcgagaaguua

SEQ ID NO: 10657 - RNA, 21 nt, Artificial Sequence
  ELANE RNA Guide
gggagcccauaacuucucgcg

SEQ ID NO: 10658 - RNA, 21 nt, Artificial Sequence
  ELANE RNA Guide
gggcucccgccgcgagaaguu

SEQ ID NO: 10659 - RNA, 21 nt, Artificial Sequence
  ELANE RNA Guide
gggugguccugggagcccaua

SEQ ID NO: 10660 - RNA, 21 nt, Artificial Sequence
  ELANE RNA Guide
gguccugggagcccauaacuu

SEQ ID NO: 10661 - RNA, 21 nt, Artificial Sequence
  ELANE RNA Guide
ggugggcucccgccgcgagaa

SEQ ID NO: 10662 - RNA, 21 nt, Artificial Sequence
  ELANE RNA Guide
ggugguccugggagcccauaa

SEQ ID NO: 10663 - RNA, 21 nt, Artificial Sequence
  ELANE RNA Guide
guccugggagcccauaacuuc

SEQ ID NO: 10664 - RNA, 21 nt, Artificial Sequence
  ELANE RNA Guide
gugggcucccgccgcgagaag

SEQ ID NO: 10665 - RNA, 21 nt, Artificial Sequence
  ELANE RNA Guide
gugguccugggagcccauaac

SEQ ID NO: 10666 - RNA, 21 nt, Artificial Sequence
  ELANE RNA Guide
uaacuucucgcggcgggagcc

SEQ ID NO: 10667 - RNA, 21 nt, Artificial Sequence
  ELANE RNA Guide
ucccgccgcgagaaguuaugg

SEQ ID NO: 10668 - RNA, 21 nt, Artificial Sequence
  ELANE RNA Guide
uccugggagcccauaacuucu

SEQ ID NO: 10669 - RNA, 21 nt, Artificial Sequence
  ELANE RNA Guide
ugggagcccauaacuucucgc

SEQ ID NO: 10670 - RNA, 21 nt, Artificial Sequence
  ELANE RNA Guide
ugggcucccgccgcgagaagu

SEQ ID NO: 10671 - RNA, 21 nt, Artificial Sequence
  ELANE RNA Guide
ugguccugggagcccauaacu

SEQ ID NO: 10672 - RNA, 22 nt, Artificial Sequence
  ELANE RNA Guide
aacuucucgcggcgggagccca

SEQ ID NO: 10673 - RNA, 22 nt, Artificial Sequence
  ELANE RNA Guide
aaguuaugggcucccaggacca

SEQ ID NO: 10674 - RNA, 22 nt, Artificial Sequence
  ELANE RNA Guide
acuucucgcggcgggagcccac

SEQ ID NO: 10675 - RNA, 22 nt, Artificial Sequence
  ELANE RNA Guide
agaaguuaugggcucccaggac

SEQ ID NO: 10676 - RNA, 22 nt, Artificial Sequence
  ELANE RNA Guide
agcccauaacuucucgcggcgg

SEQ ID NO: 10677 - RNA, 22 nt, Artificial Sequence
  ELANE RNA Guide
auaacuucucgcggcgggagcc

SEQ ID NO: 10678 - RNA, 22 nt, Artificial Sequence
  ELANE RNA Guide
cauaacuucucgcggcgggagc

SEQ ID NO: 10679 - RNA, 22 nt, Artificial Sequence
  ELANE RNA Guide
ccauaacuucucgcggcgggag

SEQ ID NO: 10680 - RNA, 22 nt, Artificial Sequence
  ELANE RNA Guide
cccauaacuucucgcggcggga

SEQ ID NO: 10681 - RNA, 22 nt, Artificial Sequence
  ELANE RNA Guide
cccgccgcgagaaguuaugggc

SEQ ID NO: 10682 - RNA, 22 nt, Artificial Sequence
  ELANE RNA Guide
ccgccgcgagaaguuaugggcu

SEQ ID NO: 10683 - RNA, 22 nt, Artificial Sequence
  ELANE RNA Guide
ccgcgagaaguuaugggcuccc

SEQ ID NO: 10684 - RNA, 22 nt, Artificial Sequence
  ELANE RNA Guide
ccugggagcccauaacuucucg

SEQ ID NO: 10685 - RNA, 22 nt, Artificial Sequence
  ELANE RNA Guide
cgagaaguuaugggcucccagg

SEQ ID NO: 10686 - RNA, 22 nt, Artificial Sequence
  ELANE RNA Guide
cgccgcgagaaguuaugggcuc

SEQ ID NO: 10687 - RNA, 22 nt, Artificial Sequence
  ELANE RNA Guide
cgcgagaaguuaugggcuccca

SEQ ID NO: 10688 - RNA, 22 nt, Artificial Sequence
  ELANE RNA Guide
cgggugguccugggagcccaua

SEQ ID NO: 10689 - RNA, 22 nt, Artificial Sequence
  ELANE RNA Guide
cucccgccgcgagaaguuaugg

SEQ ID NO: 10690 - RNA, 22 nt, Artificial Sequence
  ELANE RNA Guide
cugggagcccauaacuucucgc

SEQ ID NO: 10691 - RNA, 22 nt, Artificial Sequence
  ELANE RNA Guide
cuucucgcggcgggagcccacc

SEQ ID NO: 10692 - RNA, 22 nt, Artificial Sequence
  ELANE RNA Guide
gaaguuaugggcucccaggacc

SEQ ID NO: 10693 - RNA, 22 nt, Artificial Sequence
  ELANE RNA Guide
gagaaguuaugggcucccagga

SEQ ID NO: 10694 - RNA, 22 nt, Artificial Sequence
  ELANE RNA Guide
gagcccauaacuucucgcggcg

SEQ ID NO: 10695 - RNA, 22 nt, Artificial Sequence
  ELANE RNA Guide
gcccauaacuucucgcggcggg

SEQ ID NO: 10696 - RNA, 22 nt, Artificial Sequence
  ELANE RNA Guide
gccgcgagaaguuaugggcucc

SEQ ID NO: 10697 - RNA, 22 nt, Artificial Sequence
  ELANE RNA Guide
gcgagaaguuaugggcucccag

SEQ ID NO: 10698 - RNA, 22 nt, Artificial Sequence
  ELANE RNA Guide
gcgggugguccugggagcccau

SEQ ID NO: 10699 - RNA, 22 nt, Artificial Sequence
  ELANE RNA Guide
gcucccgccgcgagaaguuaug

SEQ ID NO: 10700 - RNA, 22 nt, Artificial Sequence
  ELANE RNA Guide
ggagcccauaacuucucgcggc

SEQ ID NO: 10701 - RNA, 22 nt, Artificial Sequence
  ELANE RNA Guide
ggcucccgccgcgagaaguuau

SEQ ID NO: 10702 - RNA, 22 nt, Artificial Sequence
  ELANE RNA Guide
gggagcccauaacuucucgcgg

SEQ ID NO: 10703 - RNA, 22 nt, Artificial Sequence
  ELANE RNA Guide
gggcucccgccgcgagaaguua

SEQ ID NO: 10704 - RNA, 22 nt, Artificial Sequence
  ELANE RNA Guide
gggugggcucccgccgcgagaa

SEQ ID NO: 10705 - RNA, 22 nt, Artificial Sequence
  ELANE RNA Guide
gggugguccugggagcccauaa

SEQ ID NO: 10706 - RNA, 22 nt, Artificial Sequence
  ELANE RNA Guide
gguccugggagcccauaacuuc

SEQ ID NO: 10707 - RNA, 22 nt, Artificial Sequence
  ELANE RNA Guide
ggugggcucccgccgcgagaag

SEQ ID NO: 10708 - RNA, 22 nt, Artificial Sequence
  ELANE RNA Guide
ggugguccugggagcccauaac

SEQ ID NO: 10709 - RNA, 22 nt, Artificial Sequence
  ELANE RNA Guide
guccugggagcccauaacuucu

SEQ ID NO: 10710 - RNA, 22 nt, Artificial Sequence
  ELANE RNA Guide
gugggcucccgccgcgagaagu

SEQ ID NO: 10711 - RNA, 22 nt, Artificial Sequence
  ELANE RNA Guide
gugguccugggagcccauaacu

SEQ ID NO: 10712 - RNA, 22 nt, Artificial Sequence
  ELANE RNA Guide
uaacuucucgcggcgggagccc

SEQ ID NO: 10713 - RNA, 22 nt, Artificial Sequence
  ELANE RNA Guide
ucccgccgcgagaaguuauggg

SEQ ID NO: 10714 - RNA, 22 nt, Artificial Sequence
  ELANE RNA Guide
uccugggagcccauaacuucuc

SEQ ID NO: 10715 - RNA, 22 nt, Artificial Sequence
  ELANE RNA Guide
ugggagcccauaacuucucgcg

SEQ ID NO: 10716 - RNA, 22 nt, Artificial Sequence
  ELANE RNA Guide
ugggcucccgccgcgagaaguu

SEQ ID NO: 10717 - RNA, 22 nt, Artificial Sequence
  ELANE RNA Guide
ugguccugggagcccauaacuu

SEQ ID NO: 10718 - RNA, 20 nt, Artificial Sequence
  ELANE RNA Guide
aacaccugccgggugggcuc

SEQ ID NO: 10719 - RNA, 20 nt, Artificial Sequence
  ELANE RNA Guide
aaccucucgcggcaggagcc

SEQ ID NO: 10720 - RNA, 20 nt, Artificial Sequence
  ELANE RNA Guide
acaccugccgggugggcucc

SEQ ID NO: 10721 - RNA, 20 nt, Artificial Sequence
  ELANE RNA Guide
accucucgcggcaggagccc

SEQ ID NO: 10722 - RNA, 20 nt, Artificial Sequence
  ELANE RNA Guide
accugccgggugggcuccug

SEQ ID NO: 10723 - RNA, 20 nt, Artificial Sequence
  ELANE RNA Guide
agcccauaaccucucgcggc

SEQ ID NO: 10724 - RNA, 20 nt, Artificial Sequence
  ELANE RNA Guide
auaaccucucgcggcaggag

SEQ ID NO: 10725 - RNA, 20 nt, Artificial Sequence
  ELANE RNA Guide
caccugccgggugggcuccu

SEQ ID NO: 10726 - RNA, 20 nt, Artificial Sequence
  ELANE RNA Guide
caggagcccacccggcaggu

SEQ ID NO: 10727 - RNA, 20 nt, Artificial Sequence
  ELANE RNA Guide
cauaaccucucgcggcagga

SEQ ID NO: 10728 - RNA, 20 nt, Artificial Sequence
  ELANE RNA Guide
ccauaaccucucgcggcagg

SEQ ID NO: 10729 - RNA, 20 nt, Artificial Sequence
  ELANE RNA Guide
cccauaaccucucgcggcag

SEQ ID NO: 10730 - RNA, 20 nt, Artificial Sequence
  ELANE RNA Guide
ccucucgcggcaggagccca

SEQ ID NO: 10731 - RNA, 20 nt, Artificial Sequence
  ELANE RNA Guide
ccugccgcgagagguuaugg

SEQ ID NO: 10732 - RNA, 20 nt, Artificial Sequence
  ELANE RNA Guide
ccugccgggugggcuccugc

SEQ ID NO: 10733 - RNA, 20 nt, Artificial Sequence
  ELANE RNA Guide
cgaacaccugccgggugggc

SEQ ID NO: 10734 - RNA, 20 nt, Artificial Sequence
  ELANE RNA Guide
cggcaggagcccacccggca

SEQ ID NO: 10735 - RNA, 20 nt, Artificial Sequence
  ELANE RNA Guide
cgggugggcuccugccgcga

SEQ ID NO: 10736 - RNA, 20 nt, Artificial Sequence
  ELANE RNA Guide
cuccugccgcgagagguuau

SEQ ID NO: 10737 - RNA, 20 nt, Artificial Sequence
  ELANE RNA Guide
cucgcggcaggagcccaccc

SEQ ID NO: 10738 - RNA, 20 nt, Artificial Sequence
  ELANE RNA Guide
cucucgcggcaggagcccac

SEQ ID NO: 10739 - RNA, 20 nt, Artificial Sequence
  ELANE RNA Guide
cugccgcgagagguuauggg

SEQ ID NO: 10740 - RNA, 20 nt, Artificial Sequence
  ELANE RNA Guide
cugccgggugggcuccugcc

SEQ ID NO: 10741 - RNA, 20 nt, Artificial Sequence
  ELANE RNA Guide
gaacaccugccgggugggcu

SEQ ID NO: 10742 - RNA, 20 nt, Artificial Sequence
  ELANE RNA Guide
gagcccauaaccucucgcgg

SEQ ID NO: 10743 - RNA, 20 nt, Artificial Sequence
  ELANE RNA Guide
gcaggagcccacccggcagg

SEQ ID NO: 10744 - RNA, 20 nt, Artificial Sequence
  ELANE RNA Guide
gcccauaaccucucgcggca

SEQ ID NO: 10745 - RNA, 20 nt, Artificial Sequence
  ELANE RNA Guide
gcuccugccgcgagagguua

SEQ ID NO: 10746 - RNA, 20 nt, Artificial Sequence
  ELANE RNA Guide
ggagcccauaaccucucgcg

SEQ ID NO: 10747 - RNA, 20 nt, Artificial Sequence
  ELANE RNA Guide
ggcaggagcccacccggcag

SEQ ID NO: 10748 - RNA, 20 nt, Artificial Sequence
  ELANE RNA Guide
ggcuccugccgcgagagguu

SEQ ID NO: 10749 - RNA, 20 nt, Artificial Sequence
  ELANE RNA Guide
gggagcccauaaccucucgc

SEQ ID NO: 10750 - RNA, 20 nt, Artificial Sequence
  ELANE RNA Guide
gggcuccugccgcgagaggu

SEQ ID NO: 10751 - RNA, 20 nt, Artificial Sequence
  ELANE RNA Guide
gggugggcuccugccgcgag

SEQ ID NO: 10752 - RNA, 20 nt, Artificial Sequence
  ELANE RNA Guide
ggugggcuccugccgcgaga

SEQ ID NO: 10753 - RNA, 20 nt, Artificial Sequence
  ELANE RNA Guide
gugggcuccugccgcgagag

SEQ ID NO: 10754 - RNA, 20 nt, Artificial Sequence
  ELANE RNA Guide
uaaccucucgcggcaggagc

SEQ ID NO: 10755 - RNA, 20 nt, Artificial Sequence
  ELANE RNA Guide
uccugccgcgagagguuaug

SEQ ID NO: 10756 - RNA, 20 nt, Artificial Sequence
  ELANE RNA Guide
ucgcggcaggagcccacccg

SEQ ID NO: 10757 - RNA, 20 nt, Artificial Sequence
  ELANE RNA Guide
ucucgcggcaggagcccacc

SEQ ID NO: 10758 - RNA, 20 nt, Artificial Sequence
  ELANE RNA Guide
ugccgggugggcuccugccg

SEQ ID NO: 10759 - RNA, 20 nt, Artificial Sequence
  ELANE RNA Guide
ugggcuccugccgcgagagg

SEQ ID NO: 10760 - RNA, 21 nt, Artificial Sequence
  ELANE RNA Guide
aacaccugccgggugggcucc

SEQ ID NO: 10761 - RNA, 21 nt, Artificial Sequence
  ELANE RNA Guide
aaccucucgcggcaggagccc

SEQ ID NO: 10762 - RNA, 21 nt, Artificial Sequence
  ELANE RNA Guide
acaccugccgggugggcuccu

SEQ ID NO: 10763 - RNA, 21 nt, Artificial Sequence
  ELANE RNA Guide
accucucgcggcaggagccca

SEQ ID NO: 10764 - RNA, 21 nt, Artificial Sequence
  ELANE RNA Guide
accugccgggugggcuccugc

SEQ ID NO: 10765 - RNA, 21 nt, Artificial Sequence
  ELANE RNA Guide
agcccauaaccucucgcggca

SEQ ID NO: 10766 - RNA, 21 nt, Artificial Sequence
  ELANE RNA Guide
auaaccucucgcggcaggagc

SEQ ID NO: 10767 - RNA, 21 nt, Artificial Sequence
  ELANE RNA Guide
caccugccgggugggcuccug

SEQ ID NO: 10768 - RNA, 21 nt, Artificial Sequence
  ELANE RNA Guide
caggagcccacccggcaggug

SEQ ID NO: 10769 - RNA, 21 nt, Artificial Sequence
  ELANE RNA Guide
cauaaccucucgcggcaggag

SEQ ID NO: 10770 - RNA, 21 nt, Artificial Sequence
  ELANE RNA Guide
ccauaaccucucgcggcagga

SEQ ID NO: 10771 - RNA, 21 nt, Artificial Sequence
  ELANE RNA Guide
cccauaaccucucgcggcagg

SEQ ID NO: 10772 - RNA, 21 nt, Artificial Sequence
  ELANE RNA Guide
ccucucgcggcaggagcccac

SEQ ID NO: 10773 - RNA, 21 nt, Artificial Sequence
  ELANE RNA Guide
ccugccgcgagagguuauggg

SEQ ID NO: 10774 - RNA, 21 nt, Artificial Sequence
  ELANE RNA Guide
cgaacaccugccgggugggcu

SEQ ID NO: 10775 - RNA, 21 nt, Artificial Sequence
  ELANE RNA Guide
cuccugccgcgagagguuaug

SEQ ID NO: 10776 - RNA, 21 nt, Artificial Sequence
  ELANE RNA Guide
cucucgcggcaggagcccacc

SEQ ID NO: 10777 - RNA, 21 nt, Artificial Sequence
  ELANE RNA Guide
cugccgcgagagguuaugggc

SEQ ID NO: 10778 - RNA, 21 nt, Artificial Sequence
  ELANE RNA Guide
gaacaccugccgggugggcuc

SEQ ID NO: 10779 - RNA, 21 nt, Artificial Sequence
  ELANE RNA Guide
gagcccauaaccucucgcggc

SEQ ID NO: 10780 - RNA, 21 nt, Artificial Sequence
  ELANE RNA Guide
gcaggagcccacccggcaggu

SEQ ID NO: 10781 - RNA, 21 nt, Artificial Sequence
  ELANE RNA Guide
gcccauaaccucucgcggcag

SEQ ID NO: 10782 - RNA, 21 nt, Artificial Sequence
  ELANE RNA Guide
gcgaacaccugccgggugggc

SEQ ID NO: 10783 - RNA, 21 nt, Artificial Sequence
  ELANE RNA Guide
gcuccugccgcgagagguuau

SEQ ID NO: 10784 - RNA, 21 nt, Artificial Sequence
  ELANE RNA Guide
ggagcccauaaccucucgcgg

SEQ ID NO: 10785 - RNA, 21 nt, Artificial Sequence
  ELANE RNA Guide
ggcuccugccgcgagagguua

SEQ ID NO: 10786 - RNA, 21 nt, Artificial Sequence
  ELANE RNA Guide
gggagcccauaaccucucgcg

SEQ ID NO: 10787 - RNA, 21 nt, Artificial Sequence
  ELANE RNA Guide
gggcuccugccgcgagagguu

SEQ ID NO: 10788 - RNA, 21 nt, Artificial Sequence
  ELANE RNA Guide
gggugggcuccugccgcgaga

SEQ ID NO: 10789 - RNA, 21 nt, Artificial Sequence
  ELANE RNA Guide
ggugggcuccugccgcgagag

SEQ ID NO: 10790 - RNA, 21 nt, Artificial Sequence
  ELANE RNA Guide
gugggcuccugccgcgagagg

SEQ ID NO: 10791 - RNA, 21 nt, Artificial Sequence
  ELANE RNA Guide
uaaccucucgcggcaggagcc

SEQ ID NO: 10792 - RNA, 21 nt, Artificial Sequence
  ELANE RNA Guide
uccugccgcgagagguuaugg

SEQ ID NO: 10793 - RNA, 21 nt, Artificial Sequence
  ELANE RNA Guide
ucucgcggcaggagcccaccc

SEQ ID NO: 10794 - RNA, 21 nt, Artificial Sequence
  ELANE RNA Guide
ugggagcccauaaccucucgc

SEQ ID NO: 10795 - RNA, 21 nt, Artificial Sequence
  ELANE RNA Guide
ugggcuccugccgcgagaggu

SEQ ID NO: 10796 - RNA, 22 nt, Artificial Sequence
  ELANE RNA Guide
aacaccugccgggugggcuccu

SEQ ID NO: 10797 - RNA, 22 nt, Artificial Sequence
  ELANE RNA Guide
aaccucucgcggcaggagccca

SEQ ID NO: 10798 - RNA, 22 nt, Artificial Sequence
  ELANE RNA Guide
acaccugccgggugggcuccug

SEQ ID NO: 10799 - RNA, 22 nt, Artificial Sequence
  ELANE RNA Guide
accucucgcggcaggagcccac

SEQ ID NO: 10800 - RNA, 22 nt, Artificial Sequence
  ELANE RNA Guide
accugccgggugggcuccugcc

SEQ ID NO: 10801 - RNA, 22 nt, Artificial Sequence
  ELANE RNA Guide
agcccauaaccucucgcggcag

SEQ ID NO: 10802 - RNA, 22 nt, Artificial Sequence
  ELANE RNA Guide
auaaccucucgcggcaggagcc

SEQ ID NO: 10803 - RNA, 22 nt, Artificial Sequence
  ELANE RNA Guide
caccugccgggugggcuccugc

SEQ ID NO: 10804 - RNA, 22 nt, Artificial Sequence
  ELANE RNA Guide
caggagcccacccggcaggugu

SEQ ID NO: 10805 - RNA, 22 nt, Artificial Sequence
  ELANE RNA Guide
cauaaccucucgcggcaggagc

SEQ ID NO: 10806 - RNA, 22 nt, Artificial Sequence
  ELANE RNA Guide
ccauaaccucucgcggcaggag

SEQ ID NO: 10807 - RNA, 22 nt, Artificial Sequence
  ELANE RNA Guide
cccauaaccucucgcggcagga

SEQ ID NO: 10808 - RNA, 22 nt, Artificial Sequence
  ELANE RNA Guide
ccucucgcggcaggagcccacc

SEQ ID NO: 10809 - RNA, 22 nt, Artificial Sequence
  ELANE RNA Guide
ccugccgcgagagguuaugggc

SEQ ID NO: 10810 - RNA, 22 nt, Artificial Sequence
  ELANE RNA Guide
cgaacaccugccgggugggcuc

SEQ ID NO: 10811 - RNA, 22 nt, Artificial Sequence
  ELANE RNA Guide
cgggugggcuccugccgcgaga

SEQ ID NO: 10812 - RNA, 22 nt, Artificial Sequence
  ELANE RNA Guide
cuccugccgcgagagguuaugg

SEQ ID NO: 10813 - RNA, 22 nt, Artificial Sequence
  ELANE RNA Guide
cucucgcggcaggagcccaccc

SEQ ID NO: 10814 - RNA, 22 nt, Artificial Sequence
  ELANE RNA Guide
cugccgcgagagguuaugggcu

SEQ ID NO: 10815 - RNA, 22 nt, Artificial Sequence
  ELANE RNA Guide
cugggagcccauaaccucucgc

SEQ ID NO: 10816 - RNA, 22 nt, Artificial Sequence
  ELANE RNA Guide
gaacaccugccgggugggcucc

SEQ ID NO: 10817 - RNA, 22 nt, Artificial Sequence
  ELANE RNA Guide
gagcccauaaccucucgcggca

SEQ ID NO: 10818 - RNA, 22 nt, Artificial Sequence
  ELANE RNA Guide
gcaggagcccacccggcaggug

SEQ ID NO: 10819 - RNA, 22 nt, Artificial Sequence
  ELANE RNA Guide
gcccauaaccucucgcggcagg

SEQ ID NO: 10820 - RNA, 22 nt, Artificial Sequence
  ELANE RNA Guide
gcgaacaccugccgggugggcu

SEQ ID NO: 10821 - RNA, 22 nt, Artificial Sequence
  ELANE RNA Guide
gcuccugccgcgagagguuaug

SEQ ID NO: 10822 - RNA, 22 nt, Artificial Sequence
  ELANE RNA Guide
ggagcccauaaccucucgcggc

SEQ ID NO: 10823 - RNA, 22 nt, Artificial Sequence
  ELANE RNA Guide
ggcaggagcccacccggcaggu

SEQ ID NO: 10824 - RNA, 22 nt, Artificial Sequence
  ELANE RNA Guide
ggcgaacaccugccgggugggc

SEQ ID NO: 10825 - RNA, 22 nt, Artificial Sequence
  ELANE RNA Guide
ggcuccugccgcgagagguuau

SEQ ID NO: 10826 - RNA, 22 nt, Artificial Sequence
  ELANE RNA Guide
gggagcccauaaccucucgcgg

SEQ ID NO: 10827 - RNA, 22 nt, Artificial Sequence
  ELANE RNA Guide
gggcuccugccgcgagagguua

SEQ ID NO: 10828 - RNA, 22 nt, Artificial Sequence
  ELANE RNA Guide
gggugggcuccugccgcgagag

SEQ ID NO: 10829 - RNA, 22 nt, Artificial Sequence
  ELANE RNA Guide
ggugggcuccugccgcgagagg

SEQ ID NO: 10830 - RNA, 22 nt, Artificial Sequence
  ELANE RNA Guide
gugggcuccugccgcgagaggu

SEQ ID NO: 10831 - RNA, 22 nt, Artificial Sequence
  ELANE RNA Guide
uaaccucucgcggcaggagccc

SEQ ID NO: 10832 - RNA, 22 nt, Artificial Sequence
  ELANE RNA Guide
uccugccgcgagagguuauggg

SEQ ID NO: 10833 - RNA, 22 nt, Artificial Sequence
  ELANE RNA Guide
ucucgcggcaggagcccacccg

SEQ ID NO: 10834 - RNA, 22 nt, Artificial Sequence
  ELANE RNA Guide
ugggagcccauaaccucucgcg

SEQ ID NO: 10835 - RNA, 22 nt, Artificial Sequence
  ELANE RNA Guide
ugggcuccugccgcgagagguu

SEQ ID NO: 10836 - RNA, 20 nt, Artificial Sequence
  ELANE RNA Guide
aacaccggccgggugggcuc

SEQ ID NO: 10837 - RNA, 20 nt, Artificial Sequence
  ELANE RNA Guide
acaccggccgggugggcucc

SEQ ID NO: 10838 - RNA, 20 nt, Artificial Sequence
  ELANE RNA Guide
acccggccgguguucgccgu

SEQ ID NO: 10839 - RNA, 20 nt, Artificial Sequence
  ELANE RNA Guide
acggcgaacaccggccgggu

SEQ ID NO: 10840 - RNA, 20 nt, Artificial Sequence
  ELANE RNA Guide
agaugcgcugcacggcgaac

SEQ ID NO: 10841 - RNA, 20 nt, Artificial Sequence
  ELANE RNA Guide
agcccacccggccgguguuc

SEQ ID NO: 10842 - RNA, 20 nt, Artificial Sequence
  ELANE RNA Guide
augcgcugcacggcgaacac

SEQ ID NO: 10843 - RNA, 20 nt, Artificial Sequence
  ELANE RNA Guide
cacccggccgguguucgccg

SEQ ID NO: 10844 - RNA, 20 nt, Artificial Sequence
  ELANE RNA Guide
cacggcgaacaccggccggg

SEQ ID NO: 10845 - RNA, 20 nt, Artificial Sequence
  ELANE RNA Guide
ccacccggccgguguucgcc

SEQ ID NO: 10846 - RNA, 20 nt, Artificial Sequence
  ELANE RNA Guide
cccacccggccgguguucgc

SEQ ID NO: 10847 - RNA, 20 nt, Artificial Sequence
  ELANE RNA Guide
cccggccgguguucgccgug

SEQ ID NO: 10848 - RNA, 20 nt, Artificial Sequence
  ELANE RNA Guide
ccggccgguguucgccgugc

SEQ ID NO: 10849 - RNA, 20 nt, Artificial Sequence
  ELANE RNA Guide
ccgguguucgccgugcagcg

SEQ ID NO: 10850 - RNA, 20 nt, Artificial Sequence
  ELANE RNA Guide
cgaacaccggccgggugggc

SEQ ID NO: 10851 - RNA, 20 nt, Artificial Sequence
  ELANE RNA Guide
cgcugcacggcgaacaccgg

SEQ ID NO: 10852 - RNA, 20 nt, Artificial Sequence
  ELANE RNA Guide
cggccgguguucgccgugca

SEQ ID NO: 10853 - RNA, 20 nt, Artificial Sequence
  ELANE RNA Guide
cggcgaacaccggccgggug

SEQ ID NO: 10854 - RNA, 20 nt, Artificial Sequence
  ELANE RNA Guide
cugcacggcgaacaccggcc

SEQ ID NO: 10855 - RNA, 20 nt, Artificial Sequence
  ELANE RNA Guide
gaacaccggccgggugggcu

SEQ ID NO: 10856 - RNA, 20 nt, Artificial Sequence
  ELANE RNA Guide
gagcccacccggccgguguu

SEQ ID NO: 10857 - RNA, 20 nt, Artificial Sequence
  ELANE RNA Guide
gaugcgcugcacggcgaaca

SEQ ID NO: 10858 - RNA, 20 nt, Artificial Sequence
  ELANE RNA Guide
gcacggcgaacaccggccgg

SEQ ID NO: 10859 - RNA, 20 nt, Artificial Sequence
  ELANE RNA Guide
gcccacccggccgguguucg

SEQ ID NO: 10860 - RNA, 20 nt, Artificial Sequence
  ELANE RNA Guide
gccgguguucgccgugcagc

SEQ ID NO: 10861 - RNA, 20 nt, Artificial Sequence
  ELANE RNA Guide
gcgaacaccggccggguggg

SEQ ID NO: 10862 - RNA, 20 nt, Artificial Sequence
  ELANE RNA Guide
gcgcugcacggcgaacaccg

SEQ ID NO: 10863 - RNA, 20 nt, Artificial Sequence
  ELANE RNA Guide
gcugcacggcgaacaccggc

SEQ ID NO: 10864 - RNA, 20 nt, Artificial Sequence
  ELANE RNA Guide
ggagcccacccggccggugu

SEQ ID NO: 10865 - RNA, 20 nt, Artificial Sequence
  ELANE RNA Guide
ggccgguguucgccgugcag

SEQ ID NO: 10866 - RNA, 20 nt, Artificial Sequence
  ELANE RNA Guide
ggcgaacaccggccgggugg

SEQ ID NO: 10867 - RNA, 20 nt, Artificial Sequence
  ELANE RNA Guide
ugcacggcgaacaccggccg

SEQ ID NO: 10868 - RNA, 20 nt, Artificial Sequence
  ELANE RNA Guide
ugcgcugcacggcgaacacc

SEQ ID NO: 10869 - RNA, 21 nt, Artificial Sequence
  ELANE RNA Guide
aacaccggccgggugggcucc

SEQ ID NO: 10870 - RNA, 21 nt, Artificial Sequence
  ELANE RNA Guide
aagaugcgcugcacggcgaac

SEQ ID NO: 10871 - RNA, 21 nt, Artificial Sequence
  ELANE RNA Guide
acccggccgguguucgccgug

SEQ ID NO: 10872 - RNA, 21 nt, Artificial Sequence
  ELANE RNA Guide
acggcgaacaccggccgggug

SEQ ID NO: 10873 - RNA, 21 nt, Artificial Sequence
  ELANE RNA Guide
agaugcgcugcacggcgaaca

SEQ ID NO: 10874 - RNA, 21 nt, Artificial Sequence
  ELANE RNA Guide
agcccacccggccgguguucg

SEQ ID NO: 10875 - RNA, 21 nt, Artificial Sequence
  ELANE RNA Guide
augcgcugcacggcgaacacc

SEQ ID NO: 10876 - RNA, 21 nt, Artificial Sequence
  ELANE RNA Guide
cacccggccgguguucgccgu

SEQ ID NO: 10877 - RNA, 21 nt, Artificial Sequence
  ELANE RNA Guide
cacggcgaacaccggccgggu

SEQ ID NO: 10878 - RNA, 21 nt, Artificial Sequence
  ELANE RNA Guide
ccggccgguguucgccgugca

SEQ ID NO: 10879 - RNA, 21 nt, Artificial Sequence
  ELANE RNA Guide
ccgguguucgccgugcagcgc

SEQ ID NO: 10880 - RNA, 21 nt, Artificial Sequence
  ELANE RNA Guide
cgaacaccggccgggugggcu

SEQ ID NO: 10881 - RNA, 21 nt, Artificial Sequence
  ELANE RNA Guide
cgcugcacggcgaacaccggc

SEQ ID NO: 10882 - RNA, 21 nt, Artificial Sequence
  ELANE RNA Guide
cggccgguguucgccgugcag

SEQ ID NO: 10883 - RNA, 21 nt, Artificial Sequence
  ELANE RNA Guide
cugcacggcgaacaccggccg

SEQ ID NO: 10884 - RNA, 21 nt, Artificial Sequence
  ELANE RNA Guide
gaacaccggccgggugggcuc

SEQ ID NO: 10885 - RNA, 21 nt, Artificial Sequence
  ELANE RNA Guide
gagcccacccggccgguguuc

SEQ ID NO: 10886 - RNA, 21 nt, Artificial Sequence
  ELANE RNA Guide
gaugcgcugcacggcgaacac

SEQ ID NO: 10887 - RNA, 21 nt, Artificial Sequence
  ELANE RNA Guide
gccgguguucgccgugcagcg

SEQ ID NO: 10888 - RNA, 21 nt, Artificial Sequence
  ELANE RNA Guide
gcgcugcacggcgaacaccgg

SEQ ID NO: 10889 - RNA, 21 nt, Artificial Sequence
  ELANE RNA Guide
gcugcacggcgaacaccggcc

SEQ ID NO: 10890 - RNA, 21 nt, Artificial Sequence
  ELANE RNA Guide
ggagcccacccggccgguguu

SEQ ID NO: 10891 - RNA, 21 nt, Artificial Sequence
  ELANE RNA Guide
ggccgguguucgccgugcagc

SEQ ID NO: 10892 - RNA, 21 nt, Artificial Sequence
  ELANE RNA Guide
ugcacggcgaacaccggccgg

SEQ ID NO: 10893 - RNA, 21 nt, Artificial Sequence
  ELANE RNA Guide
ugcgcugcacggcgaacaccg

SEQ ID NO: 10894 - RNA, 22 nt, Artificial Sequence
  ELANE RNA Guide
aacaccggccgggugggcuccc

SEQ ID NO: 10895 - RNA, 22 nt, Artificial Sequence
  ELANE RNA Guide
aagaugcgcugcacggcgaaca

SEQ ID NO: 10896 - RNA, 22 nt, Artificial Sequence
  ELANE RNA Guide
acccggccgguguucgccgugc

SEQ ID NO: 10897 - RNA, 22 nt, Artificial Sequence
  ELANE RNA Guide
acggcgaacaccggccgggugg

SEQ ID NO: 10898 - RNA, 22 nt, Artificial Sequence
  ELANE RNA Guide
agaugcgcugcacggcgaacac

SEQ ID NO: 10899 - RNA, 22 nt, Artificial Sequence
  ELANE RNA Guide
agcccacccggccgguguucgc

SEQ ID NO: 10900 - RNA, 22 nt, Artificial Sequence
  ELANE RNA Guide
augcgcugcacggcgaacaccg

SEQ ID NO: 10901 - RNA, 22 nt, Artificial Sequence
  ELANE RNA Guide
cacccggccgguguucgccgug

SEQ ID NO: 10902 - RNA, 22 nt, Artificial Sequence
  ELANE RNA Guide
cacggcgaacaccggccgggug

SEQ ID NO: 10903 - RNA, 22 nt, Artificial Sequence
  ELANE RNA Guide
ccacccggccgguguucgccgu

SEQ ID NO: 10904 - RNA, 22 nt, Artificial Sequence
  ELANE RNA Guide
cccggccgguguucgccgugca

SEQ ID NO: 10905 - RNA, 22 nt, Artificial Sequence
  ELANE RNA Guide
ccggccgguguucgccgugcag

SEQ ID NO: 10906 - RNA, 22 nt, Artificial Sequence
  ELANE RNA Guide
ccgguguucgccgugcagcgca

SEQ ID NO: 10907 - RNA, 22 nt, Artificial Sequence
  ELANE RNA Guide
cgaacaccggccgggugggcuc

SEQ ID NO: 10908 - RNA, 22 nt, Artificial Sequence
  ELANE RNA Guide
cgcugcacggcgaacaccggcc

SEQ ID NO: 10909 - RNA, 22 nt, Artificial Sequence
  ELANE RNA Guide
cggccgguguucgccgugcagc

SEQ ID NO: 10910 - RNA, 22 nt, Artificial Sequence
  ELANE RNA Guide
cugcacggcgaacaccggccgg

SEQ ID NO: 10911 - RNA, 22 nt, Artificial Sequence
  ELANE RNA Guide
gaacaccggccgggugggcucc

SEQ ID NO: 10912 - RNA, 22 nt, Artificial Sequence
  ELANE RNA Guide
gaagaugcgcugcacggcgaac

SEQ ID NO: 10913 - RNA, 22 nt, Artificial Sequence
  ELANE RNA Guide
gagcccacccggccgguguucg

SEQ ID NO: 10914 - RNA, 22 nt, Artificial Sequence
  ELANE RNA Guide
gaugcgcugcacggcgaacacc

SEQ ID NO: 10915 - RNA, 22 nt, Artificial Sequence
  ELANE RNA Guide
gcacggcgaacaccggccgggu

SEQ ID NO: 10916 - RNA, 22 nt, Artificial Sequence
  ELANE RNA Guide
gccgguguucgccgugcagcgc

SEQ ID NO: 10917 - RNA, 22 nt, Artificial Sequence
  ELANE RNA Guide
gcgaacaccggccgggugggcu

SEQ ID NO: 10918 - RNA, 22 nt, Artificial Sequence
  ELANE RNA Guide
gcgcugcacggcgaacaccggc

SEQ ID NO: 10919 - RNA, 22 nt, Artificial Sequence
  ELANE RNA Guide
gcugcacggcgaacaccggccg

SEQ ID NO: 10920 - RNA, 22 nt, Artificial Sequence
  ELANE RNA Guide
ggagcccacccggccgguguuc

SEQ ID NO: 10921 - RNA, 22 nt, Artificial Sequence
  ELANE RNA Guide
ggccgguguucgccgugcagcg

SEQ ID NO: 10922 - RNA, 22 nt, Artificial Sequence
  ELANE RNA Guide
gggagcccacccggccgguguu

SEQ ID NO: 10923 - RNA, 22 nt, Artificial Sequence
  ELANE RNA Guide
ugcacggcgaacaccggccggg

SEQ ID NO: 10924 - RNA, 22 nt, Artificial Sequence
  ELANE RNA Guide
ugcgcugcacggcgaacaccgg

SEQ ID NO: 10925 - RNA, 20 nt, Artificial Sequence
  ELANE RNA Guide
aacaccagccgggugggcuc

SEQ ID NO: 10926 - RNA, 20 nt, Artificial Sequence
  ELANE RNA Guide
acaccagccgggugggcucc

SEQ ID NO: 10927 - RNA, 20 nt, Artificial Sequence
  ELANE RNA Guide
accagccgggugggcucccg

SEQ ID NO: 10928 - RNA, 20 nt, Artificial Sequence
  ELANE RNA Guide
acccggcugguguucgccgu

SEQ ID NO: 10929 - RNA, 20 nt, Artificial Sequence
  ELANE RNA Guide
acggcgaacaccagccgggu

SEQ ID NO: 10930 - RNA, 20 nt, Artificial Sequence
  ELANE RNA Guide
agcccacccggcugguguuc

SEQ ID NO: 10931 - RNA, 20 nt, Artificial Sequence
  ELANE RNA Guide
caccagccgggugggcuccc

SEQ ID NO: 10932 - RNA, 20 nt, Artificial Sequence
  ELANE RNA Guide
cacccggcugguguucgccg

SEQ ID NO: 10933 - RNA, 20 nt, Artificial Sequence
  ELANE RNA Guide
cacggcgaacaccagccggg

SEQ ID NO: 10934 - RNA, 20 nt, Artificial Sequence
  ELANE RNA Guide
ccacccggcugguguucgcc

SEQ ID NO: 10935 - RNA, 20 nt, Artificial Sequence
  ELANE RNA Guide
cccacccggcugguguucgc

SEQ ID NO: 10936 - RNA, 20 nt, Artificial Sequence
  ELANE RNA Guide
cccggcugguguucgccgug

SEQ ID NO: 10937 - RNA, 20 nt, Artificial Sequence
  ELANE RNA Guide
ccggcugguguucgccgugc

SEQ ID NO: 10938 - RNA, 20 nt, Artificial Sequence
  ELANE RNA Guide
cgaacaccagccgggugggc

SEQ ID NO: 10939 - RNA, 20 nt, Artificial Sequence
  ELANE RNA Guide
cgcugcacggcgaacaccag

SEQ ID NO: 10940 - RNA, 20 nt, Artificial Sequence
  ELANE RNA Guide
cggcgaacaccagccgggug

SEQ ID NO: 10941 - RNA, 20 nt, Artificial Sequence
  ELANE RNA Guide
cggcugguguucgccgugca

SEQ ID NO: 10942 - RNA, 20 nt, Artificial Sequence
  ELANE RNA Guide
cgggagcccacccggcuggu

SEQ ID NO: 10943 - RNA, 20 nt, Artificial Sequence
  ELANE RNA Guide
cugcacggcgaacaccagcc

SEQ ID NO: 10944 - RNA, 20 nt, Artificial Sequence
  ELANE RNA Guide
cugguguucgccgugcagcg

SEQ ID NO: 10945 - RNA, 20 nt, Artificial Sequence
  ELANE RNA Guide
gaacaccagccgggugggcu

SEQ ID NO: 10946 - RNA, 20 nt, Artificial Sequence
  ELANE RNA Guide
gagcccacccggcugguguu

SEQ ID NO: 10947 - RNA, 20 nt, Artificial Sequence
  ELANE RNA Guide
gcacggcgaacaccagccgg

SEQ ID NO: 10948 - RNA, 20 nt, Artificial Sequence
  ELANE RNA Guide
gcccacccggcugguguucg

SEQ ID NO: 10949 - RNA, 20 nt, Artificial Sequence
  ELANE RNA Guide
gcgaacaccagccggguggg

SEQ ID NO: 10950 - RNA, 20 nt, Artificial Sequence
  ELANE RNA Guide
gcgcugcacggcgaacacca

SEQ ID NO: 10951 - RNA, 20 nt, Artificial Sequence
  ELANE RNA Guide
gcugcacggcgaacaccagc

SEQ ID NO: 10952 - RNA, 20 nt, Artificial Sequence
  ELANE RNA Guide
gcugguguucgccgugcagc

SEQ ID NO: 10953 - RNA, 20 nt, Artificial Sequence
  ELANE RNA Guide
ggagcccacccggcuggugu

SEQ ID NO: 10954 - RNA, 20 nt, Artificial Sequence
  ELANE RNA Guide
ggcgaacaccagccgggugg

SEQ ID NO: 10955 - RNA, 20 nt, Artificial Sequence
  ELANE RNA Guide
ggcugguguucgccgugcag

SEQ ID NO: 10956 - RNA, 20 nt, Artificial Sequence
  ELANE RNA Guide
gggagcccacccggcuggug

SEQ ID NO: 10957 - RNA, 20 nt, Artificial Sequence
  ELANE RNA Guide
ugcacggcgaacaccagccg

SEQ ID NO: 10958 - RNA, 21 nt, Artificial Sequence
  ELANE RNA Guide
aacaccagccgggugggcucc

SEQ ID NO: 10959 - RNA, 21 nt, Artificial Sequence
  ELANE RNA Guide
acaccagccgggugggcuccc

SEQ ID NO: 10960 - RNA, 21 nt, Artificial Sequence
  ELANE RNA Guide
acccggcugguguucgccgug

SEQ ID NO: 10961 - RNA, 21 nt, Artificial Sequence
  ELANE RNA Guide
acggcgaacaccagccgggug

SEQ ID NO: 10962 - RNA, 21 nt, Artificial Sequence
  ELANE RNA Guide
agcccacccggcugguguucg

SEQ ID NO: 10963 - RNA, 21 nt, Artificial Sequence
  ELANE RNA Guide
cacccggcugguguucgccgu

SEQ ID NO: 10964 - RNA, 21 nt, Artificial Sequence
  ELANE RNA Guide
cacggcgaacaccagccgggu

SEQ ID NO: 10965 - RNA, 21 nt, Artificial Sequence
  ELANE RNA Guide
ccacccggcugguguucgccg

SEQ ID NO: 10966 - RNA, 21 nt, Artificial Sequence
  ELANE RNA Guide
cccacccggcugguguucgcc

SEQ ID NO: 10967 - RNA, 21 nt, Artificial Sequence
  ELANE RNA Guide
cccggcugguguucgccgugc

SEQ ID NO: 10968 - RNA, 21 nt, Artificial Sequence
  ELANE RNA Guide
ccggcugguguucgccgugca

SEQ ID NO: 10969 - RNA, 21 nt, Artificial Sequence
  ELANE RNA Guide
cgaacaccagccgggugggcu

SEQ ID NO: 10970 - RNA, 21 nt, Artificial Sequence
  ELANE RNA Guide
cgcugcacggcgaacaccagc

SEQ ID NO: 10971 - RNA, 21 nt, Artificial Sequence
  ELANE RNA Guide
cggcgaacaccagccgggugg

SEQ ID NO: 10972 - RNA, 21 nt, Artificial Sequence
  ELANE RNA Guide
cggcugguguucgccgugcag

SEQ ID NO: 10973 - RNA, 21 nt, Artificial Sequence
  ELANE RNA Guide
cugcacggcgaacaccagccg

SEQ ID NO: 10974 - RNA, 21 nt, Artificial Sequence
  ELANE RNA Guide
cugguguucgccgugcagcgc

SEQ ID NO: 10975 - RNA, 21 nt, Artificial Sequence
  ELANE RNA Guide
gaacaccagccgggugggcuc

SEQ ID NO: 10976 - RNA, 21 nt, Artificial Sequence
  ELANE RNA Guide
gagcccacccggcugguguuc

SEQ ID NO: 10977 - RNA, 21 nt, Artificial Sequence
  ELANE RNA Guide
gcacggcgaacaccagccggg

SEQ ID NO: 10978 - RNA, 21 nt, Artificial Sequence
  ELANE RNA Guide
gcccacccggcugguguucgc

SEQ ID NO: 10979 - RNA, 21 nt, Artificial Sequence
  ELANE RNA Guide
gcgaacaccagccgggugggc

SEQ ID NO: 10980 - RNA, 21 nt, Artificial Sequence
  ELANE RNA Guide
gcgcugcacggcgaacaccag

SEQ ID NO: 10981 - RNA, 21 nt, Artificial Sequence
  ELANE RNA Guide
gcugcacggcgaacaccagcc

SEQ ID NO: 10982 - RNA, 21 nt, Artificial Sequence
  ELANE RNA Guide
gcugguguucgccgugcagcg

SEQ ID NO: 10983 - RNA, 21 nt, Artificial Sequence
  ELANE RNA Guide
ggagcccacccggcugguguu

SEQ ID NO: 10984 - RNA, 21 nt, Artificial Sequence
  ELANE RNA Guide
ggcgaacaccagccggguggg

SEQ ID NO: 10985 - RNA, 21 nt, Artificial Sequence
  ELANE RNA Guide
ggcugguguucgccgugcagc

SEQ ID NO: 10986 - RNA, 21 nt, Artificial Sequence
  ELANE RNA Guide
gggagcccacccggcuggugu

SEQ ID NO: 10987 - RNA, 21 nt, Artificial Sequence
  ELANE RNA Guide
ugcacggcgaacaccagccgg

SEQ ID NO: 10988 - RNA, 21 nt, Artificial Sequence
  ELANE RNA Guide
ugcgcugcacggcgaacacca

SEQ ID NO: 10989 - RNA, 22 nt, Artificial Sequence
  ELANE RNA Guide
aacaccagccgggugggcuccc

SEQ ID NO: 10990 - RNA, 22 nt, Artificial Sequence
  ELANE RNA Guide
acaccagccgggugggcucccg

SEQ ID NO: 10991 - RNA, 22 nt, Artificial Sequence
  ELANE RNA Guide
acccggcugguguucgccgugc

SEQ ID NO: 10992 - RNA, 22 nt, Artificial Sequence
  ELANE RNA Guide
acggcgaacaccagccgggugg

SEQ ID NO: 10993 - RNA, 22 nt, Artificial Sequence
  ELANE RNA Guide
agcccacccggcugguguucgc

SEQ ID NO: 10994 - RNA, 22 nt, Artificial Sequence
  ELANE RNA Guide
augcgcugcacggcgaacacca

SEQ ID NO: 10995 - RNA, 22 nt, Artificial Sequence
  ELANE RNA Guide
cacccggcugguguucgccgug

SEQ ID NO: 10996 - RNA, 22 nt, Artificial Sequence
  ELANE RNA Guide
cacggcgaacaccagccgggug

SEQ ID NO: 10997 - RNA, 22 nt, Artificial Sequence
  ELANE RNA Guide
ccacccggcugguguucgccgu

SEQ ID NO: 10998 - RNA, 22 nt, Artificial Sequence
  ELANE RNA Guide
cccacccggcugguguucgccg

SEQ ID NO: 10999 - RNA, 22 nt, Artificial Sequence
  ELANE RNA Guide
cccggcugguguucgccgugca

SEQ ID NO: 11000 - RNA, 22 nt, Artificial Sequence
  ELANE RNA Guide
ccggcugguguucgccgugcag

SEQ ID NO: 11001 - RNA, 22 nt, Artificial Sequence
  ELANE RNA Guide
cgaacaccagccgggugggcuc

SEQ ID NO: 11002 - RNA, 22 nt, Artificial Sequence
  ELANE RNA Guide
cgcugcacggcgaacaccagcc

SEQ ID NO: 11003 - RNA, 22 nt, Artificial Sequence
  ELANE RNA Guide
cggcgaacaccagccggguggg

SEQ ID NO: 11004 - RNA, 22 nt, Artificial Sequence
  ELANE RNA Guide
cggcugguguucgccgugcagc

SEQ ID NO: 11005 - RNA, 22 nt, Artificial Sequence
  ELANE RNA Guide
cgggagcccacccggcuggugu

SEQ ID NO: 11006 - RNA, 22 nt, Artificial Sequence
  ELANE RNA Guide
cugcacggcgaacaccagccgg

SEQ ID NO: 11007 - RNA, 22 nt, Artificial Sequence
  ELANE RNA Guide
cugguguucgccgugcagcgca

SEQ ID NO: 11008 - RNA, 22 nt, Artificial Sequence
  ELANE RNA Guide
gaacaccagccgggugggcucc

SEQ ID NO: 11009 - RNA, 22 nt, Artificial Sequence
  ELANE RNA Guide
gagcccacccggcugguguucg

SEQ ID NO: 11010 - RNA, 22 nt, Artificial Sequence
  ELANE RNA Guide
gcacggcgaacaccagccgggu

SEQ ID NO: 11011 - RNA, 22 nt, Artificial Sequence
  ELANE RNA Guide
gcccacccggcugguguucgcc

SEQ ID NO: 11012 - RNA, 22 nt, Artificial Sequence
  ELANE RNA Guide
gcgaacaccagccgggugggcu

SEQ ID NO: 11013 - RNA, 22 nt, Artificial Sequence
  ELANE RNA Guide
gcgcugcacggcgaacaccagc

SEQ ID NO: 11014 - RNA, 22 nt, Artificial Sequence
  ELANE RNA Guide
gcugcacggcgaacaccagccg

SEQ ID NO: 11015 - RNA, 22 nt, Artificial Sequence
  ELANE RNA Guide
gcugguguucgccgugcagcgc

SEQ ID NO: 11016 - RNA, 22 nt, Artificial Sequence
  ELANE RNA Guide
ggagcccacccggcugguguuc

SEQ ID NO: 11017 - RNA, 22 nt, Artificial Sequence
  ELANE RNA Guide
ggcgaacaccagccgggugggc

SEQ ID NO: 11018 - RNA, 22 nt, Artificial Sequence
  ELANE RNA Guide
ggcugguguucgccgugcagcg

SEQ ID NO: 11019 - RNA, 22 nt, Artificial Sequence
  ELANE RNA Guide
gggagcccacccggcugguguu

SEQ ID NO: 11020 - RNA, 22 nt, Artificial Sequence
  ELANE RNA Guide
ugcacggcgaacaccagccggg

SEQ ID NO: 11021 - RNA, 22 nt, Artificial Sequence
  ELANE RNA Guide
ugcgcugcacggcgaacaccag

SEQ ID NO: 11022 - RNA, 20 nt, Artificial Sequence
  ELANE RNA Guide
aacaucugccgggugggcuc

SEQ ID NO: 11023 - RNA, 20 nt, Artificial Sequence
  ELANE RNA Guide
aagaugcgcugcacggcgaa

SEQ ID NO: 11024 - RNA, 20 nt, Artificial Sequence
  ELANE RNA Guide
acaucugccgggugggcucc

SEQ ID NO: 11025 - RNA, 20 nt, Artificial Sequence
  ELANE RNA Guide
acccggcagauguucgccgu

SEQ ID NO: 11026 - RNA, 20 nt, Artificial Sequence
  ELANE RNA Guide
acggcgaacaucugccgggu

SEQ ID NO: 11027 - RNA, 20 nt, Artificial Sequence
  ELANE RNA Guide
agauguucgccgugcagcgc

SEQ ID NO: 11028 - RNA, 20 nt, Artificial Sequence
  ELANE RNA Guide
agcccacccggcagauguuc

SEQ ID NO: 11029 - RNA, 20 nt, Artificial Sequence
  ELANE RNA Guide
aucugccgggugggcucccg

SEQ ID NO: 11030 - RNA, 20 nt, Artificial Sequence
  ELANE RNA Guide
augcgcugcacggcgaacau

SEQ ID NO: 11031 - RNA, 20 nt, Artificial Sequence
  ELANE RNA Guide
cacccggcagauguucgccg

SEQ ID NO: 11032 - RNA, 20 nt, Artificial Sequence
  ELANE RNA Guide
cacggcgaacaucugccggg

SEQ ID NO: 11033 - RNA, 20 nt, Artificial Sequence
  ELANE RNA Guide
cagauguucgccgugcagcg

SEQ ID NO: 11034 - RNA, 20 nt, Artificial Sequence
  ELANE RNA Guide
caucugccgggugggcuccc

SEQ ID NO: 11035 - RNA, 20 nt, Artificial Sequence
  ELANE RNA Guide
ccacccggcagauguucgcc

SEQ ID NO: 11036 - RNA, 20 nt, Artificial Sequence
  ELANE RNA Guide
cccacccggcagauguucgc

SEQ ID NO: 11037 - RNA, 20 nt, Artificial Sequence
  ELANE RNA Guide
cccggcagauguucgccgug

SEQ ID NO: 11038 - RNA, 20 nt, Artificial Sequence
  ELANE RNA Guide
ccggcagauguucgccgugc

SEQ ID NO: 11039 - RNA, 20 nt, Artificial Sequence
  ELANE RNA Guide
cgaacaucugccgggugggc

SEQ ID NO: 11040 - RNA, 20 nt, Artificial Sequence
  ELANE RNA Guide
cgcugcacggcgaacaucug

SEQ ID NO: 11041 - RNA, 20 nt, Artificial Sequence
  ELANE RNA Guide
cggcagauguucgccgugca

SEQ ID NO: 11042 - RNA, 20 nt, Artificial Sequence
  ELANE RNA Guide
cggcgaacaucugccgggug

SEQ ID NO: 11043 - RNA, 20 nt, Artificial Sequence
  ELANE RNA Guide
cgggagcccacccggcagau

SEQ ID NO: 11044 - RNA, 20 nt, Artificial Sequence
  ELANE RNA Guide
cugcacggcgaacaucugcc

SEQ ID NO: 11045 - RNA, 20 nt, Artificial Sequence
  ELANE RNA Guide
gaacaucugccgggugggcu

SEQ ID NO: 11046 - RNA, 20 nt, Artificial Sequence
  ELANE RNA Guide
gaagaugcgcugcacggcga

SEQ ID NO: 11047 - RNA, 20 nt, Artificial Sequence
  ELANE RNA Guide
gagcccacccggcagauguu

SEQ ID NO: 11048 - RNA, 20 nt, Artificial Sequence
  ELANE RNA Guide
gauguucgccgugcagcgca

SEQ ID NO: 11049 - RNA, 20 nt, Artificial Sequence
  ELANE RNA Guide
gcacggcgaacaucugccgg

SEQ ID NO: 11050 - RNA, 20 nt, Artificial Sequence
  ELANE RNA Guide
gcagauguucgccgugcagc

SEQ ID NO: 11051 - RNA, 20 nt, Artificial Sequence
  ELANE RNA Guide
gcccacccggcagauguucg

SEQ ID NO: 11052 - RNA, 20 nt, Artificial Sequence
  ELANE RNA Guide
gcgaacaucugccggguggg

SEQ ID NO: 11053 - RNA, 20 nt, Artificial Sequence
  ELANE RNA Guide
gcgcugcacggcgaacaucu

SEQ ID NO: 11054 - RNA, 20 nt, Artificial Sequence
  ELANE RNA Guide
gcgggagcccacccggcaga

SEQ ID NO: 11055 - RNA, 20 nt, Artificial Sequence
  ELANE RNA Guide
gcugcacggcgaacaucugc

SEQ ID NO: 11056 - RNA, 20 nt, Artificial Sequence
  ELANE RNA Guide
ggagcccacccggcagaugu

SEQ ID NO: 11057 - RNA, 20 nt, Artificial Sequence
  ELANE RNA Guide
ggcagauguucgccgugcag

SEQ ID NO: 11058 - RNA, 20 nt, Artificial Sequence
  ELANE RNA Guide
ggcgaacaucugccgggugg

SEQ ID NO: 11059 - RNA, 20 nt, Artificial Sequence
  ELANE RNA Guide
gggagcccacccggcagaug

SEQ ID NO: 11060 - RNA, 20 nt, Artificial Sequence
  ELANE RNA Guide
ugcacggcgaacaucugccg

SEQ ID NO: 11061 - RNA, 20 nt, Artificial Sequence
  ELANE RNA Guide
ugcgcugcacggcgaacauc

SEQ ID NO: 11062 - RNA, 21 nt, Artificial Sequence
  ELANE RNA Guide
aacaucugccgggugggcucc

SEQ ID NO: 11063 - RNA, 21 nt, Artificial Sequence
  ELANE RNA Guide
acaucugccgggugggcuccc

SEQ ID NO: 11064 - RNA, 21 nt, Artificial Sequence
  ELANE RNA Guide
acccggcagauguucgccgug

SEQ ID NO: 11065 - RNA, 21 nt, Artificial Sequence
  ELANE RNA Guide
acggcgaacaucugccgggug

SEQ ID NO: 11066 - RNA, 21 nt, Artificial Sequence
  ELANE RNA Guide
agauguucgccgugcagcgca

SEQ ID NO: 11067 - RNA, 21 nt, Artificial Sequence
  ELANE RNA Guide
agcccacccggcagauguucg

SEQ ID NO: 11068 - RNA, 21 nt, Artificial Sequence
  ELANE RNA Guide
aucugccgggugggcucccgc

SEQ ID NO: 11069 - RNA, 21 nt, Artificial Sequence
  ELANE RNA Guide
augcgcugcacggcgaacauc

SEQ ID NO: 11070 - RNA, 21 nt, Artificial Sequence
  ELANE RNA Guide
cacccggcagauguucgccgu

SEQ ID NO: 11071 - RNA, 21 nt, Artificial Sequence
  ELANE RNA Guide
cacggcgaacaucugccgggu

SEQ ID NO: 11072 - RNA, 21 nt, Artificial Sequence
  ELANE RNA Guide
cagauguucgccgugcagcgc

SEQ ID NO: 11073 - RNA, 21 nt, Artificial Sequence
  ELANE RNA Guide
caucugccgggugggcucccg

SEQ ID NO: 11074 - RNA, 21 nt, Artificial Sequence
  ELANE RNA Guide
ccacccggcagauguucgccg

SEQ ID NO: 11075 - RNA, 21 nt, Artificial Sequence
  ELANE RNA Guide
cccacccggcagauguucgcc

SEQ ID NO: 11076 - RNA, 21 nt, Artificial Sequence
  ELANE RNA Guide
cccggcagauguucgccgugc

SEQ ID NO: 11077 - RNA, 21 nt, Artificial Sequence
  ELANE RNA Guide
ccggcagauguucgccgugca

SEQ ID NO: 11078 - RNA, 21 nt, Artificial Sequence
  ELANE RNA Guide
cgaacaucugccgggugggcu

SEQ ID NO: 11079 - RNA, 21 nt, Artificial Sequence
  ELANE RNA Guide
cgaagaugcgcugcacggcga

SEQ ID NO: 11080 - RNA, 21 nt, Artificial Sequence
  ELANE RNA Guide
cgcugcacggcgaacaucugc

SEQ ID NO: 11081 - RNA, 21 nt, Artificial Sequence
  ELANE RNA Guide
cggcagauguucgccgugcag

SEQ ID NO: 11082 - RNA, 21 nt, Artificial Sequence
  ELANE RNA Guide
cggcgaacaucugccgggugg

SEQ ID NO: 11083 - RNA, 21 nt, Artificial Sequence
  ELANE RNA Guide
cgggagcccacccggcagaug

SEQ ID NO: 11084 - RNA, 21 nt, Artificial Sequence
  ELANE RNA Guide
cugcacggcgaacaucugccg

SEQ ID NO: 11085 - RNA, 21 nt, Artificial Sequence
  ELANE RNA Guide
gaacaucugccgggugggcuc

SEQ ID NO: 11086 - RNA, 21 nt, Artificial Sequence
  ELANE RNA Guide
gaagaugcgcugcacggcgaa

SEQ ID NO: 11087 - RNA, 21 nt, Artificial Sequence
  ELANE RNA Guide
gagcccacccggcagauguuc

SEQ ID NO: 11088 - RNA, 21 nt, Artificial Sequence
  ELANE RNA Guide
gaugcgcugcacggcgaacau

SEQ ID NO: 11089 - RNA, 21 nt, Artificial Sequence
  ELANE RNA Guide
gauguucgccgugcagcgcau

SEQ ID NO: 11090 - RNA, 21 nt, Artificial Sequence
  ELANE RNA Guide
gcacggcgaacaucugccggg

SEQ ID NO: 11091 - RNA, 21 nt, Artificial Sequence
  ELANE RNA Guide
gcagauguucgccgugcagcg

SEQ ID NO: 11092 - RNA, 21 nt, Artificial Sequence
  ELANE RNA Guide
gcccacccggcagauguucgc

SEQ ID NO: 11093 - RNA, 21 nt, Artificial Sequence
  ELANE RNA Guide
gcgaacaucugccgggugggc

SEQ ID NO: 11094 - RNA, 21 nt, Artificial Sequence
  ELANE RNA Guide
gcgcugcacggcgaacaucug

SEQ ID NO: 11095 - RNA, 21 nt, Artificial Sequence
  ELANE RNA Guide
gcgggagcccacccggcagau

SEQ ID NO: 11096 - RNA, 21 nt, Artificial Sequence
  ELANE RNA Guide
gcugcacggcgaacaucugcc

SEQ ID NO: 11097 - RNA, 21 nt, Artificial Sequence
  ELANE RNA Guide
ggagcccacccggcagauguu

SEQ ID NO: 11098 - RNA, 21 nt, Artificial Sequence
  ELANE RNA Guide
ggcagauguucgccgugcagc

SEQ ID NO: 11099 - RNA, 21 nt, Artificial Sequence
  ELANE RNA Guide
ggcgaacaucugccggguggg

SEQ ID NO: 11100 - RNA, 21 nt, Artificial Sequence
  ELANE RNA Guide
gggagcccacccggcagaugu

SEQ ID NO: 11101 - RNA, 21 nt, Artificial Sequence
  ELANE RNA Guide
ugcacggcgaacaucugccgg

SEQ ID NO: 11102 - RNA, 21 nt, Artificial Sequence
  ELANE RNA Guide
ugcgcugcacggcgaacaucu

SEQ ID NO: 11103 - RNA, 22 nt, Artificial Sequence
  ELANE RNA Guide
aacaucugccgggugggcuccc

SEQ ID NO: 11104 - RNA, 22 nt, Artificial Sequence
  ELANE RNA Guide
acaucugccgggugggcucccg

SEQ ID NO: 11105 - RNA, 22 nt, Artificial Sequence
  ELANE RNA Guide
acccggcagauguucgccgugc

SEQ ID NO: 11106 - RNA, 22 nt, Artificial Sequence
  ELANE RNA Guide
acggcgaacaucugccgggugg

SEQ ID NO: 11107 - RNA, 22 nt, Artificial Sequence
  ELANE RNA Guide
agaugcgcugcacggcgaacau

SEQ ID NO: 11108 - RNA, 22 nt, Artificial Sequence
  ELANE RNA Guide
agauguucgccgugcagcgcau

SEQ ID NO: 11109 - RNA, 22 nt, Artificial Sequence
  ELANE RNA Guide
agcccacccggcagauguucgc

SEQ ID NO: 11110 - RNA, 22 nt, Artificial Sequence
  ELANE RNA Guide
aucugccgggugggcucccgcc

SEQ ID NO: 11111 - RNA, 22 nt, Artificial Sequence
  ELANE RNA Guide
augcgcugcacggcgaacaucu

SEQ ID NO: 11112 - RNA, 22 nt, Artificial Sequence
  ELANE RNA Guide
cacccggcagauguucgccgug

SEQ ID NO: 11113 - RNA, 22 nt, Artificial Sequence
  ELANE RNA Guide
cacggcgaacaucugccgggug

SEQ ID NO: 11114 - RNA, 22 nt, Artificial Sequence
  ELANE RNA Guide
cagauguucgccgugcagcgca

SEQ ID NO: 11115 - RNA, 22 nt, Artificial Sequence
  ELANE RNA Guide
caucugccgggugggcucccgc

SEQ ID NO: 11116 - RNA, 22 nt, Artificial Sequence
  ELANE RNA Guide
ccacccggcagauguucgccgu

SEQ ID NO: 11117 - RNA, 22 nt, Artificial Sequence
  ELANE RNA Guide
cccacccggcagauguucgccg

SEQ ID NO: 11118 - RNA, 22 nt, Artificial Sequence
  ELANE RNA Guide
cccggcagauguucgccgugca

SEQ ID NO: 11119 - RNA, 22 nt, Artificial Sequence
  ELANE RNA Guide
ccggcagauguucgccgugcag

SEQ ID NO: 11120 - RNA, 22 nt, Artificial Sequence
  ELANE RNA Guide
cgaacaucugccgggugggcuc

SEQ ID NO: 11121 - RNA, 22 nt, Artificial Sequence
  ELANE RNA Guide
cgaagaugcgcugcacggcgaa

SEQ ID NO: 11122 - RNA, 22 nt, Artificial Sequence
  ELANE RNA Guide
cgcugcacggcgaacaucugcc

SEQ ID NO: 11123 - RNA, 22 nt, Artificial Sequence
  ELANE RNA Guide
cggcagauguucgccgugcagc

SEQ ID NO: 11124 - RNA, 22 nt, Artificial Sequence
  ELANE RNA Guide
cggcgaacaucugccggguggg

SEQ ID NO: 11125 - RNA, 22 nt, Artificial Sequence
  ELANE RNA Guide
cgggagcccacccggcagaugu

SEQ ID NO: 11126 - RNA, 22 nt, Artificial Sequence
  ELANE RNA Guide
cugcacggcgaacaucugccgg

SEQ ID NO: 11127 - RNA, 22 nt, Artificial Sequence
  ELANE RNA Guide
gaacaucugccgggugggcucc

SEQ ID NO: 11128 - RNA, 22 nt, Artificial Sequence
  ELANE RNA Guide
gagcccacccggcagauguucg

SEQ ID NO: 11129 - RNA, 22 nt, Artificial Sequence
  ELANE RNA Guide
gaugcgcugcacggcgaacauc

SEQ ID NO: 11130 - RNA, 22 nt, Artificial Sequence
  ELANE RNA Guide
gauguucgccgugcagcgcauc

SEQ ID NO: 11131 - RNA, 22 nt, Artificial Sequence
  ELANE RNA Guide
gcacggcgaacaucugccgggu

SEQ ID NO: 11132 - RNA, 22 nt, Artificial Sequence
  ELANE RNA Guide
gcagauguucgccgugcagcgc

SEQ ID NO: 11133 - RNA, 22 nt, Artificial Sequence
  ELANE RNA Guide
gcccacccggcagauguucgcc

SEQ ID NO: 11134 - RNA, 22 nt, Artificial Sequence
  ELANE RNA Guide
gcgaacaucugccgggugggcu

SEQ ID NO: 11135 - RNA, 22 nt, Artificial Sequence
  ELANE RNA Guide
gcgcugcacggcgaacaucugc

SEQ ID NO: 11136 - RNA, 22 nt, Artificial Sequence
  ELANE RNA Guide
gcgggagcccacccggcagaug

SEQ ID NO: 11137 - RNA, 22 nt, Artificial Sequence
  ELANE RNA Guide
gcugcacggcgaacaucugccg

SEQ ID NO: 11138 - RNA, 22 nt, Artificial Sequence
  ELANE RNA Guide
ggagcccacccggcagauguuc

SEQ ID NO: 11139 - RNA, 22 nt, Artificial Sequence
  ELANE RNA Guide
ggcagauguucgccgugcagcg

SEQ ID NO: 11140 - RNA, 22 nt, Artificial Sequence
  ELANE RNA Guide
ggcgaacaucugccgggugggc

SEQ ID NO: 11141 - RNA, 22 nt, Artificial Sequence
  ELANE RNA Guide
ggcgggagcccacccggcagau

SEQ ID NO: 11142 - RNA, 22 nt, Artificial Sequence
  ELANE RNA Guide
gggagcccacccggcagauguu

SEQ ID NO: 11143 - RNA, 22 nt, Artificial Sequence
  ELANE RNA Guide
ucgaagaugcgcugcacggcga

SEQ ID NO: 11144 - RNA, 22 nt, Artificial Sequence
  ELANE RNA Guide
ugcacggcgaacaucugccggg

SEQ ID NO: 11145 - RNA, 22 nt, Artificial Sequence
  ELANE RNA Guide
ugcgcugcacggcgaacaucug

SEQ ID NO: 11146 - RNA, 20 nt, Artificial Sequence
  ELANE RNA Guide
aacaacugccgggugggcuc

SEQ ID NO: 11147 - RNA, 20 nt, Artificial Sequence
  ELANE RNA Guide
aacugccgggugggcucccg

SEQ ID NO: 11148 - RNA, 20 nt, Artificial Sequence
  ELANE RNA Guide
acaacugccgggugggcucc

SEQ ID NO: 11149 - RNA, 20 nt, Artificial Sequence
  ELANE RNA Guide
acccggcaguuguucgccgu

SEQ ID NO: 11150 - RNA, 20 nt, Artificial Sequence
  ELANE RNA Guide
acggcgaacaacugccgggu

SEQ ID NO: 11151 - RNA, 20 nt, Artificial Sequence
  ELANE RNA Guide
agcccacccggcaguuguuc

SEQ ID NO: 11152 - RNA, 20 nt, Artificial Sequence
  ELANE RNA Guide
aguuguucgccgugcagcgc

SEQ ID NO: 11153 - RNA, 20 nt, Artificial Sequence
  ELANE RNA Guide
augcgcugcacggcgaacaa

SEQ ID NO: 11154 - RNA, 20 nt, Artificial Sequence
  ELANE RNA Guide
caacugccgggugggcuccc

SEQ ID NO: 11155 - RNA, 20 nt, Artificial Sequence
  ELANE RNA Guide
cacccggcaguuguucgccg

SEQ ID NO: 11156 - RNA, 20 nt, Artificial Sequence
  ELANE RNA Guide
cacggcgaacaacugccggg

SEQ ID NO: 11157 - RNA, 20 nt, Artificial Sequence
  ELANE RNA Guide
caguuguucgccgugcagcg

SEQ ID NO: 11158 - RNA, 20 nt, Artificial Sequence
  ELANE RNA Guide
ccacccggcaguuguucgcc

SEQ ID NO: 11159 - RNA, 20 nt, Artificial Sequence
  ELANE RNA Guide
cccacccggcaguuguucgc

SEQ ID NO: 11160 - RNA, 20 nt, Artificial Sequence
  ELANE RNA Guide
cccggcaguuguucgccgug

SEQ ID NO: 11161 - RNA, 20 nt, Artificial Sequence
  ELANE RNA Guide
ccggcaguuguucgccgugc

SEQ ID NO: 11162 - RNA, 20 nt, Artificial Sequence
  ELANE RNA Guide
cgaacaacugccgggugggc

SEQ ID NO: 11163 - RNA, 20 nt, Artificial Sequence
  ELANE RNA Guide
cgcugcacggcgaacaacug

SEQ ID NO: 11164 - RNA, 20 nt, Artificial Sequence
  ELANE RNA Guide
cggcaguuguucgccgugca

SEQ ID NO: 11165 - RNA, 20 nt, Artificial Sequence
  ELANE RNA Guide
cggcgaacaacugccgggug

SEQ ID NO: 11166 - RNA, 20 nt, Artificial Sequence
  ELANE RNA Guide
cgggagcccacccggcaguu

SEQ ID NO: 11167 - RNA, 20 nt, Artificial Sequence
  ELANE RNA Guide
cugcacggcgaacaacugcc

SEQ ID NO: 11168 - RNA, 20 nt, Artificial Sequence
  ELANE RNA Guide
gaacaacugccgggugggcu

SEQ ID NO: 11169 - RNA, 20 nt, Artificial Sequence
  ELANE RNA Guide
gagcccacccggcaguuguu

SEQ ID NO: 11170 - RNA, 20 nt, Artificial Sequence
  ELANE RNA Guide
gcacggcgaacaacugccgg

SEQ ID NO: 11171 - RNA, 20 nt, Artificial Sequence
  ELANE RNA Guide
gcaguuguucgccgugcagc

SEQ ID NO: 11172 - RNA, 20 nt, Artificial Sequence
  ELANE RNA Guide
gcccacccggcaguuguucg

SEQ ID NO: 11173 - RNA, 20 nt, Artificial Sequence
  ELANE RNA Guide
gcgaacaacugccggguggg

SEQ ID NO: 11174 - RNA, 20 nt, Artificial Sequence
  ELANE RNA Guide
gcgcugcacggcgaacaacu

SEQ ID NO: 11175 - RNA, 20 nt, Artificial Sequence
  ELANE RNA Guide
gcgggagcccacccggcagu

SEQ ID NO: 11176 - RNA, 20 nt, Artificial Sequence
  ELANE RNA Guide
gcugcacggcgaacaacugc

SEQ ID NO: 11177 - RNA, 20 nt, Artificial Sequence
  ELANE RNA Guide
ggagcccacccggcaguugu

SEQ ID NO: 11178 - RNA, 20 nt, Artificial Sequence
  ELANE RNA Guide
ggcaguuguucgccgugcag

SEQ ID NO: 11179 - RNA, 20 nt, Artificial Sequence
  ELANE RNA Guide
ggcgaacaacugccgggugg

SEQ ID NO: 11180 - RNA, 20 nt, Artificial Sequence
  ELANE RNA Guide
gggagcccacccggcaguug

SEQ ID NO: 11181 - RNA, 20 nt, Artificial Sequence
  ELANE RNA Guide
guuguucgccgugcagcgca

SEQ ID NO: 11182 - RNA, 20 nt, Artificial Sequence
  ELANE RNA Guide
ugcacggcgaacaacugccg

SEQ ID NO: 11183 - RNA, 20 nt, Artificial Sequence
  ELANE RNA Guide
ugcgcugcacggcgaacaac

SEQ ID NO: 11184 - RNA, 21 nt, Artificial Sequence
  ELANE RNA Guide
aacaacugccgggugggcucc

SEQ ID NO: 11185 - RNA, 21 nt, Artificial Sequence
  ELANE RNA Guide
aacugccgggugggcucccgc

SEQ ID NO: 11186 - RNA, 21 nt, Artificial Sequence
  ELANE RNA Guide
acaacugccgggugggcuccc

SEQ ID NO: 11187 - RNA, 21 nt, Artificial Sequence
  ELANE RNA Guide
acccggcaguuguucgccgug

SEQ ID NO: 11188 - RNA, 21 nt, Artificial Sequence
  ELANE RNA Guide
acggcgaacaacugccgggug

SEQ ID NO: 11189 - RNA, 21 nt, Artificial Sequence
  ELANE RNA Guide
agcccacccggcaguuguucg

SEQ ID NO: 11190 - RNA, 21 nt, Artificial Sequence
  ELANE RNA Guide
aguuguucgccgugcagcgca

SEQ ID NO: 11191 - RNA, 21 nt, Artificial Sequence
  ELANE RNA Guide
augcgcugcacggcgaacaac

SEQ ID NO: 11192 - RNA, 21 nt, Artificial Sequence
  ELANE RNA Guide
caacugccgggugggcucccg

SEQ ID NO: 11193 - RNA, 21 nt, Artificial Sequence
  ELANE RNA Guide
cacccggcaguuguucgccgu

SEQ ID NO: 11194 - RNA, 21 nt, Artificial Sequence
  ELANE RNA Guide
cacggcgaacaacugccgggu

SEQ ID NO: 11195 - RNA, 21 nt, Artificial Sequence
  ELANE RNA Guide
caguuguucgccgugcagcgc

SEQ ID NO: 11196 - RNA, 21 nt, Artificial Sequence
  ELANE RNA Guide
ccacccggcaguuguucgccg

SEQ ID NO: 11197 - RNA, 21 nt, Artificial Sequence
  ELANE RNA Guide
cccacccggcaguuguucgcc

SEQ ID NO: 11198 - RNA, 21 nt, Artificial Sequence
  ELANE RNA Guide
cccggcaguuguucgccgugc

SEQ ID NO: 11199 - RNA, 21 nt, Artificial Sequence
  ELANE RNA Guide
ccggcaguuguucgccgugca

SEQ ID NO: 11200 - RNA, 21 nt, Artificial Sequence
  ELANE RNA Guide
cgaacaacugccgggugggcu

SEQ ID NO: 11201 - RNA, 21 nt, Artificial Sequence
  ELANE RNA Guide
cgcugcacggcgaacaacugc

SEQ ID NO: 11202 - RNA, 21 nt, Artificial Sequence
  ELANE RNA Guide
cggcaguuguucgccgugcag

SEQ ID NO: 11203 - RNA, 21 nt, Artificial Sequence
  ELANE RNA Guide
cggcgaacaacugccgggugg

SEQ ID NO: 11204 - RNA, 21 nt, Artificial Sequence
  ELANE RNA Guide
cgggagcccacccggcaguug

SEQ ID NO: 11205 - RNA, 21 nt, Artificial Sequence
  ELANE RNA Guide
cugcacggcgaacaacugccg

SEQ ID NO: 11206 - RNA, 21 nt, Artificial Sequence
  ELANE RNA Guide
gaacaacugccgggugggcuc

SEQ ID NO: 11207 - RNA, 21 nt, Artificial Sequence
  ELANE RNA Guide
gagcccacccggcaguuguuc

SEQ ID NO: 11208 - RNA, 21 nt, Artificial Sequence
  ELANE RNA Guide
gaugcgcugcacggcgaacaa

SEQ ID NO: 11209 - RNA, 21 nt, Artificial Sequence
  ELANE RNA Guide
gcacggcgaacaacugccggg

SEQ ID NO: 11210 - RNA, 21 nt, Artificial Sequence
  ELANE RNA Guide
gcaguuguucgccgugcagcg

SEQ ID NO: 11211 - RNA, 21 nt, Artificial Sequence
  ELANE RNA Guide
gcccacccggcaguuguucgc

SEQ ID NO: 11212 - RNA, 21 nt, Artificial Sequence
  ELANE RNA Guide
gcgaacaacugccgggugggc

SEQ ID NO: 11213 - RNA, 21 nt, Artificial Sequence
  ELANE RNA Guide
gcgcugcacggcgaacaacug

SEQ ID NO: 11214 - RNA, 21 nt, Artificial Sequence
  ELANE RNA Guide
gcgggagcccacccggcaguu

SEQ ID NO: 11215 - RNA, 21 nt, Artificial Sequence
  ELANE RNA Guide
gcugcacggcgaacaacugcc

SEQ ID NO: 11216 - RNA, 21 nt, Artificial Sequence
  ELANE RNA Guide
ggagcccacccggcaguuguu

SEQ ID NO: 11217 - RNA, 21 nt, Artificial Sequence
  ELANE RNA Guide
ggcaguuguucgccgugcagc

SEQ ID NO: 11218 - RNA, 21 nt, Artificial Sequence
  ELANE RNA Guide
ggcgaacaacugccggguggg

SEQ ID NO: 11219 - RNA, 21 nt, Artificial Sequence
  ELANE RNA Guide
gggagcccacccggcaguugu

SEQ ID NO: 11220 - RNA, 21 nt, Artificial Sequence
  ELANE RNA Guide
guuguucgccgugcagcgcau

SEQ ID NO: 11221 - RNA, 21 nt, Artificial Sequence
  ELANE RNA Guide
ugcacggcgaacaacugccgg

SEQ ID NO: 11222 - RNA, 21 nt, Artificial Sequence
  ELANE RNA Guide
ugcgcugcacggcgaacaacu

SEQ ID NO: 11223 - RNA, 22 nt, Artificial Sequence
  ELANE RNA Guide
aacaacugccgggugggcuccc

SEQ ID NO: 11224 - RNA, 22 nt, Artificial Sequence
  ELANE RNA Guide
aacugccgggugggcucccgcc

SEQ ID NO: 11225 - RNA, 22 nt, Artificial Sequence
  ELANE RNA Guide
acaacugccgggugggcucccg

SEQ ID NO: 11226 - RNA, 22 nt, Artificial Sequence
  ELANE RNA Guide
acccggcaguuguucgccgugc

SEQ ID NO: 11227 - RNA, 22 nt, Artificial Sequence
  ELANE RNA Guide
acggcgaacaacugccgggugg

SEQ ID NO: 11228 - RNA, 22 nt, Artificial Sequence
  ELANE RNA Guide
agaugcgcugcacggcgaacaa

SEQ ID NO: 11229 - RNA, 22 nt, Artificial Sequence
  ELANE RNA Guide
agcccacccggcaguuguucgc

SEQ ID NO: 11230 - RNA, 22 nt, Artificial Sequence
  ELANE RNA Guide
aguuguucgccgugcagcgcau

SEQ ID NO: 11231 - RNA, 22 nt, Artificial Sequence
  ELANE RNA Guide
augcgcugcacggcgaacaacu

SEQ ID NO: 11232 - RNA, 22 nt, Artificial Sequence
  ELANE RNA Guide
caacugccgggugggcucccgc

SEQ ID NO: 11233 - RNA, 22 nt, Artificial Sequence
  ELANE RNA Guide
cacccggcaguuguucgccgug

SEQ ID NO: 11234 - RNA, 22 nt, Artificial Sequence
  ELANE RNA Guide
cacggcgaacaacugccgggug

SEQ ID NO: 11235 - RNA, 22 nt, Artificial Sequence
  ELANE RNA Guide
caguuguucgccgugcagcgca

SEQ ID NO: 11236 - RNA, 22 nt, Artificial Sequence
  ELANE RNA Guide
ccacccggcaguuguucgccgu

SEQ ID NO: 11237 - RNA, 22 nt, Artificial Sequence
  ELANE RNA Guide
cccacccggcaguuguucgccg

SEQ ID NO: 11238 - RNA, 22 nt, Artificial Sequence
  ELANE RNA Guide
cccggcaguuguucgccgugca

SEQ ID NO: 11239 - RNA, 22 nt, Artificial Sequence
  ELANE RNA Guide
ccggcaguuguucgccgugcag

SEQ ID NO: 11240 - RNA, 22 nt, Artificial Sequence
  ELANE RNA Guide
cgaacaacugccgggugggcuc

SEQ ID NO: 11241 - RNA, 22 nt, Artificial Sequence
  ELANE RNA Guide
cgcugcacggcgaacaacugcc

SEQ ID NO: 11242 - RNA, 22 nt, Artificial Sequence
  ELANE RNA Guide
cggcaguuguucgccgugcagc

SEQ ID NO: 11243 - RNA, 22 nt, Artificial Sequence
  ELANE RNA Guide
cggcgaacaacugccggguggg

SEQ ID NO: 11244 - RNA, 22 nt, Artificial Sequence
  ELANE RNA Guide
cgggagcccacccggcaguugu

SEQ ID NO: 11245 - RNA, 22 nt, Artificial Sequence
  ELANE RNA Guide
cugcacggcgaacaacugccgg

SEQ ID NO: 11246 - RNA, 22 nt, Artificial Sequence
  ELANE RNA Guide
gaacaacugccgggugggcucc

SEQ ID NO: 11247 - RNA, 22 nt, Artificial Sequence
  ELANE RNA Guide
gagcccacccggcaguuguucg

SEQ ID NO: 11248 - RNA, 22 nt, Artificial Sequence
  ELANE RNA Guide
gaugcgcugcacggcgaacaac

SEQ ID NO: 11249 - RNA, 22 nt, Artificial Sequence
  ELANE RNA Guide
gcacggcgaacaacugccgggu

SEQ ID NO: 11250 - RNA, 22 nt, Artificial Sequence
  ELANE RNA Guide
gcaguuguucgccgugcagcgc

SEQ ID NO: 11251 - RNA, 22 nt, Artificial Sequence
  ELANE RNA Guide
gcccacccggcaguuguucgcc

SEQ ID NO: 11252 - RNA, 22 nt, Artificial Sequence
  ELANE RNA Guide
gcgaacaacugccgggugggcu

SEQ ID NO: 11253 - RNA, 22 nt, Artificial Sequence
  ELANE RNA Guide
gcgcugcacggcgaacaacugc

SEQ ID NO: 11254 - RNA, 22 nt, Artificial Sequence
  ELANE RNA Guide
gcgggagcccacccggcaguug

SEQ ID NO: 11255 - RNA, 22 nt, Artificial Sequence
  ELANE RNA Guide
gcugcacggcgaacaacugccg

SEQ ID NO: 11256 - RNA, 22 nt, Artificial Sequence
  ELANE RNA Guide
ggagcccacccggcaguuguuc

SEQ ID NO: 11257 - RNA, 22 nt, Artificial Sequence
  ELANE RNA Guide
ggcaguuguucgccgugcagcg

SEQ ID NO: 11258 - RNA, 22 nt, Artificial Sequence
  ELANE RNA Guide
ggcgaacaacugccgggugggc

SEQ ID NO: 11259 - RNA, 22 nt, Artificial Sequence
  ELANE RNA Guide
ggcgggagcccacccggcaguu

SEQ ID NO: 11260 - RNA, 22 nt, Artificial Sequence
  ELANE RNA Guide
gggagcccacccggcaguuguu

SEQ ID NO: 11261 - RNA, 22 nt, Artificial Sequence
  ELANE RNA Guide
guuguucgccgugcagcgcauc

SEQ ID NO: 11262 - RNA, 22 nt, Artificial Sequence
  ELANE RNA Guide
ugcacggcgaacaacugccggg

SEQ ID NO: 11263 - RNA, 22 nt, Artificial Sequence
  ELANE RNA Guide
ugcgcugcacggcgaacaacug

SEQ ID NO: 11264 - RNA, 20 nt, Artificial Sequence
  ELANE RNA Guide
aagaugcgcugcacggcgga

SEQ ID NO: 11265 - RNA, 20 nt, Artificial Sequence
  ELANE RNA Guide
acccggcagguguccgccgu

SEQ ID NO: 11266 - RNA, 20 nt, Artificial Sequence
  ELANE RNA Guide
acggcggacaccugccgggu

SEQ ID NO: 11267 - RNA, 20 nt, Artificial Sequence
  ELANE RNA Guide
agaugcgcugcacggcggac

SEQ ID NO: 11268 - RNA, 20 nt, Artificial Sequence
  ELANE RNA Guide
agcccacccggcaggugucc

SEQ ID NO: 11269 - RNA, 20 nt, Artificial Sequence
  ELANE RNA Guide
agguguccgccgugcagcgc

SEQ ID NO: 11270 - RNA, 20 nt, Artificial Sequence
  ELANE RNA Guide
augcgcugcacggcggacac

SEQ ID NO: 11271 - RNA, 20 nt, Artificial Sequence
  ELANE RNA Guide
cacccggcagguguccgccg

SEQ ID NO: 11272 - RNA, 20 nt, Artificial Sequence
  ELANE RNA Guide
cacggcggacaccugccggg

SEQ ID NO: 11273 - RNA, 20 nt, Artificial Sequence
  ELANE RNA Guide
cagguguccgccgugcagcg

SEQ ID NO: 11274 - RNA, 20 nt, Artificial Sequence
  ELANE RNA Guide
ccacccggcagguguccgcc

SEQ ID NO: 11275 - RNA, 20 nt, Artificial Sequence
  ELANE RNA Guide
cccacccggcagguguccgc

SEQ ID NO: 11276 - RNA, 20 nt, Artificial Sequence
  ELANE RNA Guide
cccggcagguguccgccgug

SEQ ID NO: 11277 - RNA, 20 nt, Artificial Sequence
  ELANE RNA Guide
ccggcagguguccgccgugc

SEQ ID NO: 11278 - RNA, 20 nt, Artificial Sequence
  ELANE RNA Guide
cgaagaugcgcugcacggcg

SEQ ID NO: 11279 - RNA, 20 nt, Artificial Sequence
  ELANE RNA Guide
cgcugcacggcggacaccug

SEQ ID NO: 11280 - RNA, 20 nt, Artificial Sequence
  ELANE RNA Guide
cggacaccugccgggugggc

SEQ ID NO: 11281 - RNA, 20 nt, Artificial Sequence
  ELANE RNA Guide
cggcagguguccgccgugca

SEQ ID NO: 11282 - RNA, 20 nt, Artificial Sequence
  ELANE RNA Guide
cggcggacaccugccgggug

SEQ ID NO: 11283 - RNA, 20 nt, Artificial Sequence
  ELANE RNA Guide
cgggagcccacccggcaggu

SEQ ID NO: 11284 - RNA, 20 nt, Artificial Sequence
  ELANE RNA Guide
cugcacggcggacaccugcc

SEQ ID NO: 11285 - RNA, 20 nt, Artificial Sequence
  ELANE RNA Guide
gaagaugcgcugcacggcgg

SEQ ID NO: 11286 - RNA, 20 nt, Artificial Sequence
  ELANE RNA Guide
gagcccacccggcagguguc

SEQ ID NO: 11287 - RNA, 20 nt, Artificial Sequence
  ELANE RNA Guide
gaugcgcugcacggcggaca

SEQ ID NO: 11288 - RNA, 20 nt, Artificial Sequence
  ELANE RNA Guide
gcacggcggacaccugccgg

SEQ ID NO: 11289 - RNA, 20 nt, Artificial Sequence
  ELANE RNA Guide
gcagguguccgccgugcagc

SEQ ID NO: 11290 - RNA, 20 nt, Artificial Sequence
  ELANE RNA Guide
gcccacccggcagguguccg

SEQ ID NO: 11291 - RNA, 20 nt, Artificial Sequence
  ELANE RNA Guide
gcgcugcacggcggacaccu

SEQ ID NO: 11292 - RNA, 20 nt, Artificial Sequence
  ELANE RNA Guide
gcggacaccugccggguggg

SEQ ID NO: 11293 - RNA, 20 nt, Artificial Sequence
  ELANE RNA Guide
gcugcacggcggacaccugc

SEQ ID NO: 11294 - RNA, 20 nt, Artificial Sequence
  ELANE RNA Guide
ggacaccugccgggugggcu

SEQ ID NO: 11295 - RNA, 20 nt, Artificial Sequence
  ELANE RNA Guide
ggagcccacccggcaggugu

SEQ ID NO: 11296 - RNA, 20 nt, Artificial Sequence
  ELANE RNA Guide
ggcagguguccgccgugcag

SEQ ID NO: 11297 - RNA, 20 nt, Artificial Sequence
  ELANE RNA Guide
ggcggacaccugccgggugg

SEQ ID NO: 11298 - RNA, 20 nt, Artificial Sequence
  ELANE RNA Guide
gggagcccacccggcaggug

SEQ ID NO: 11299 - RNA, 20 nt, Artificial Sequence
  ELANE RNA Guide
gguguccgccgugcagcgca

SEQ ID NO: 11300 - RNA, 20 nt, Artificial Sequence
  ELANE RNA Guide
guccgccgugcagcgcaucu

SEQ ID NO: 11301 - RNA, 20 nt, Artificial Sequence
  ELANE RNA Guide
guguccgccgugcagcgcau

SEQ ID NO: 11302 - RNA, 20 nt, Artificial Sequence
  ELANE RNA Guide
uccgccgugcagcgcaucuu

SEQ ID NO: 11303 - RNA, 20 nt, Artificial Sequence
  ELANE RNA Guide
ucgaagaugcgcugcacggc

SEQ ID NO: 11304 - RNA, 20 nt, Artificial Sequence
  ELANE RNA Guide
ugcacggcggacaccugccg

SEQ ID NO: 11305 - RNA, 20 nt, Artificial Sequence
  ELANE RNA Guide
ugcgcugcacggcggacacc

SEQ ID NO: 11306 - RNA, 20 nt, Artificial Sequence
  ELANE RNA Guide
uguccgccgugcagcgcauc

SEQ ID NO: 11307 - RNA, 20 nt, Artificial Sequence
  ELANE RNA Guide
uucgaagaugcgcugcacgg

SEQ ID NO: 11308 - RNA, 20 nt, Artificial Sequence
  ELANE RNA Guide
uuucgaagaugcgcugcacg

SEQ ID NO: 11309 - RNA, 21 nt, Artificial Sequence
  ELANE RNA Guide
aagaugcgcugcacggcggac

SEQ ID NO: 11310 - RNA, 21 nt, Artificial Sequence
  ELANE RNA Guide
acccggcagguguccgccgug

SEQ ID NO: 11311 - RNA, 21 nt, Artificial Sequence
  ELANE RNA Guide
acggcggacaccugccgggug

SEQ ID NO: 11312 - RNA, 21 nt, Artificial Sequence
  ELANE RNA Guide
agaugcgcugcacggcggaca

SEQ ID NO: 11313 - RNA, 21 nt, Artificial Sequence
  ELANE RNA Guide
agcccacccggcagguguccg

SEQ ID NO: 11314 - RNA, 21 nt, Artificial Sequence
  ELANE RNA Guide
agguguccgccgugcagcgca

SEQ ID NO: 11315 - RNA, 21 nt, Artificial Sequence
  ELANE RNA Guide
augcgcugcacggcggacacc

SEQ ID NO: 11316 - RNA, 21 nt, Artificial Sequence
  ELANE RNA Guide
cacccggcagguguccgccgu

SEQ ID NO: 11317 - RNA, 21 nt, Artificial Sequence
  ELANE RNA Guide
cacggcggacaccugccgggu

SEQ ID NO: 11318 - RNA, 21 nt, Artificial Sequence
  ELANE RNA Guide
cagguguccgccgugcagcgc

SEQ ID NO: 11319 - RNA, 21 nt, Artificial Sequence
  ELANE RNA Guide
ccggcagguguccgccgugca

SEQ ID NO: 11320 - RNA, 21 nt, Artificial Sequence
  ELANE RNA Guide
cgaagaugcgcugcacggcgg

SEQ ID NO: 11321 - RNA, 21 nt, Artificial Sequence
  ELANE RNA Guide
cgcugcacggcggacaccugc

SEQ ID NO: 11322 - RNA, 21 nt, Artificial Sequence
  ELANE RNA Guide
cggacaccugccgggugggcu

SEQ ID NO: 11323 - RNA, 21 nt, Artificial Sequence
  ELANE RNA Guide
cggcagguguccgccgugcag

SEQ ID NO: 11324 - RNA, 21 nt, Artificial Sequence
  ELANE RNA Guide
cugcacggcggacaccugccg

SEQ ID NO: 11325 - RNA, 21 nt, Artificial Sequence
  ELANE RNA Guide
gaagaugcgcugcacggcgga

SEQ ID NO: 11326 - RNA, 21 nt, Artificial Sequence
  ELANE RNA Guide
gagcccacccggcaggugucc

SEQ ID NO: 11327 - RNA, 21 nt, Artificial Sequence
  ELANE RNA Guide
gaugcgcugcacggcggacac

SEQ ID NO: 11328 - RNA, 21 nt, Artificial Sequence
  ELANE RNA Guide
gcagguguccgccgugcagcg

SEQ ID NO: 11329 - RNA, 21 nt, Artificial Sequence
  ELANE RNA Guide
gcgcugcacggcggacaccug

SEQ ID NO: 11330 - RNA, 21 nt, Artificial Sequence
  ELANE RNA Guide
gcugcacggcggacaccugcc

SEQ ID NO: 11331 - RNA, 21 nt, Artificial Sequence
  ELANE RNA Guide
ggacaccugccgggugggcuc

SEQ ID NO: 11332 - RNA, 21 nt, Artificial Sequence
  ELANE RNA Guide
ggagcccacccggcagguguc

SEQ ID NO: 11333 - RNA, 21 nt, Artificial Sequence
  ELANE RNA Guide
ggcagguguccgccgugcagc

SEQ ID NO: 11334 - RNA, 21 nt, Artificial Sequence
  ELANE RNA Guide
gggagcccacccggcaggugu

SEQ ID NO: 11335 - RNA, 21 nt, Artificial Sequence
  ELANE RNA Guide
gguguccgccgugcagcgcau

SEQ ID NO: 11336 - RNA, 21 nt, Artificial Sequence
  ELANE RNA Guide
guccgccgugcagcgcaucuu

SEQ ID NO: 11337 - RNA, 21 nt, Artificial Sequence
  ELANE RNA Guide
guguccgccgugcagcgcauc

SEQ ID NO: 11338 - RNA, 21 nt, Artificial Sequence
  ELANE RNA Guide
uccgccgugcagcgcaucuuc

SEQ ID NO: 11339 - RNA, 21 nt, Artificial Sequence
  ELANE RNA Guide
ucgaagaugcgcugcacggcg

SEQ ID NO: 11340 - RNA, 21 nt, Artificial Sequence
  ELANE RNA Guide
ugcacggcggacaccugccgg

SEQ ID NO: 11341 - RNA, 21 nt, Artificial Sequence
  ELANE RNA Guide
ugcgcugcacggcggacaccu

SEQ ID NO: 11342 - RNA, 21 nt, Artificial Sequence
  ELANE RNA Guide
uguccgccgugcagcgcaucu

SEQ ID NO: 11343 - RNA, 21 nt, Artificial Sequence
  ELANE RNA Guide
uucgaagaugcgcugcacggc

SEQ ID NO: 11344 - RNA, 21 nt, Artificial Sequence
  ELANE RNA Guide
uuucgaagaugcgcugcacgg

SEQ ID NO: 11345 - RNA, 21 nt, Artificial Sequence
  ELANE RNA Guide
uuuucgaagaugcgcugcacg

SEQ ID NO: 11346 - RNA, 22 nt, Artificial Sequence
  ELANE RNA Guide
aagaugcgcugcacggcggaca

SEQ ID NO: 11347 - RNA, 22 nt, Artificial Sequence
  ELANE RNA Guide
acccggcagguguccgccgugc

SEQ ID NO: 11348 - RNA, 22 nt, Artificial Sequence
  ELANE RNA Guide
acggcggacaccugccgggugg

SEQ ID NO: 11349 - RNA, 22 nt, Artificial Sequence
  ELANE RNA Guide
agaugcgcugcacggcggacac

SEQ ID NO: 11350 - RNA, 22 nt, Artificial Sequence
  ELANE RNA Guide
agcccacccggcagguguccgc

SEQ ID NO: 11351 - RNA, 22 nt, Artificial Sequence
  ELANE RNA Guide
agguguccgccgugcagcgcau

SEQ ID NO: 11352 - RNA, 22 nt, Artificial Sequence
  ELANE RNA Guide
augcgcugcacggcggacaccu

SEQ ID NO: 11353 - RNA, 22 nt, Artificial Sequence
  ELANE RNA Guide
cacccggcagguguccgccgug

SEQ ID NO: 11354 - RNA, 22 nt, Artificial Sequence
  ELANE RNA Guide
cacggcggacaccugccgggug

SEQ ID NO: 11355 - RNA, 22 nt, Artificial Sequence
  ELANE RNA Guide
cagguguccgccgugcagcgca

SEQ ID NO: 11356 - RNA, 22 nt, Artificial Sequence
  ELANE RNA Guide
ccacccggcagguguccgccgu

SEQ ID NO: 11357 - RNA, 22 nt, Artificial Sequence
  ELANE RNA Guide
cccggcagguguccgccgugca

SEQ ID NO: 11358 - RNA, 22 nt, Artificial Sequence
  ELANE RNA Guide
ccggcagguguccgccgugcag

SEQ ID NO: 11359 - RNA, 22 nt, Artificial Sequence
  ELANE RNA Guide
cgaagaugcgcugcacggcgga

SEQ ID NO: 11360 - RNA, 22 nt, Artificial Sequence
  ELANE RNA Guide
cgcugcacggcggacaccugcc

SEQ ID NO: 11361 - RNA, 22 nt, Artificial Sequence
  ELANE RNA Guide
cggacaccugccgggugggcuc

SEQ ID NO: 11362 - RNA, 22 nt, Artificial Sequence
  ELANE RNA Guide
cggcagguguccgccgugcagc

SEQ ID NO: 11363 - RNA, 22 nt, Artificial Sequence
  ELANE RNA Guide
cgggagcccacccggcaggugu

SEQ ID NO: 11364 - RNA, 22 nt, Artificial Sequence
  ELANE RNA Guide
cugcacggcggacaccugccgg

SEQ ID NO: 11365 - RNA, 22 nt, Artificial Sequence
  ELANE RNA Guide
gaagaugcgcugcacggcggac

SEQ ID NO: 11366 - RNA, 22 nt, Artificial Sequence
  ELANE RNA Guide
gagcccacccggcagguguccg

SEQ ID NO: 11367 - RNA, 22 nt, Artificial Sequence
  ELANE RNA Guide
gaugcgcugcacggcggacacc

SEQ ID NO: 11368 - RNA, 22 nt, Artificial Sequence
  ELANE RNA Guide
gcacggcggacaccugccgggu

SEQ ID NO: 11369 - RNA, 22 nt, Artificial Sequence
  ELANE RNA Guide
gcagguguccgccgugcagcgc

SEQ ID NO: 11370 - RNA, 22 nt, Artificial Sequence
  ELANE RNA Guide
gcgcugcacggcggacaccugc

SEQ ID NO: 11371 - RNA, 22 nt, Artificial Sequence
  ELANE RNA Guide
gcggacaccugccgggugggcu

SEQ ID NO: 11372 - RNA, 22 nt, Artificial Sequence
  ELANE RNA Guide
gcugcacggcggacaccugccg

SEQ ID NO: 11373 - RNA, 22 nt, Artificial Sequence
  ELANE RNA Guide
ggacaccugccgggugggcucc

SEQ ID NO: 11374 - RNA, 22 nt, Artificial Sequence
  ELANE RNA Guide
ggagcccacccggcaggugucc

SEQ ID NO: 11375 - RNA, 22 nt, Artificial Sequence
  ELANE RNA Guide
ggcagguguccgccgugcagcg

SEQ ID NO: 11376 - RNA, 22 nt, Artificial Sequence
  ELANE RNA Guide
gggagcccacccggcagguguc

SEQ ID NO: 11377 - RNA, 22 nt, Artificial Sequence
  ELANE RNA Guide
gguguccgccgugcagcgcauc

SEQ ID NO: 11378 - RNA, 22 nt, Artificial Sequence
  ELANE RNA Guide
guccgccgugcagcgcaucuuc

SEQ ID NO: 11379 - RNA, 22 nt, Artificial Sequence
  ELANE RNA Guide
guguccgccgugcagcgcaucu

SEQ ID NO: 11380 - RNA, 22 nt, Artificial Sequence
  ELANE RNA Guide
guuuucgaagaugcgcugcacg

SEQ ID NO: 11381 - RNA, 22 nt, Artificial Sequence
  ELANE RNA Guide
uccgccgugcagcgcaucuucg

SEQ ID NO: 11382 - RNA, 22 nt, Artificial Sequence
  ELANE RNA Guide
ucgaagaugcgcugcacggcgg

SEQ ID NO: 11383 - RNA, 22 nt, Artificial Sequence
  ELANE RNA Guide
ugcacggcggacaccugccggg

SEQ ID NO: 11384 - RNA, 22 nt, Artificial Sequence
  ELANE RNA Guide
ugcgcugcacggcggacaccug

SEQ ID NO: 11385 - RNA, 22 nt, Artificial Sequence
  ELANE RNA Guide
uguccgccgugcagcgcaucuu

SEQ ID NO: 11386 - RNA, 22 nt, Artificial Sequence
  ELANE RNA Guide
uucgaagaugcgcugcacggcg

SEQ ID NO: 11387 - RNA, 22 nt, Artificial Sequence
  ELANE RNA Guide
uuucgaagaugcgcugcacggc

SEQ ID NO: 11388 - RNA, 22 nt, Artificial Sequence
  ELANE RNA Guide
uuuucgaagaugcgcugcacgg

SEQ ID NO: 11389 - RNA, 20 nt, Artificial Sequence
  ELANE RNA Guide
aagaugcgcugcacggugaa

SEQ ID NO: 11390 - RNA, 20 nt, Artificial Sequence
  ELANE RNA Guide
acccggcagguguucaccgu

SEQ ID NO: 11391 - RNA, 20 nt, Artificial Sequence
  ELANE RNA Guide
acggugaacaccugccgggu

SEQ ID NO: 11392 - RNA, 20 nt, Artificial Sequence
  ELANE RNA Guide
agaugcgcugcacggugaac

SEQ ID NO: 11393 - RNA, 20 nt, Artificial Sequence
  ELANE RNA Guide
agcccacccggcagguguuc

SEQ ID NO: 11394 - RNA, 20 nt, Artificial Sequence
  ELANE RNA Guide
agguguucaccgugcagcgc

SEQ ID NO: 11395 - RNA, 20 nt, Artificial Sequence
  ELANE RNA Guide
augcgcugcacggugaacac

SEQ ID NO: 11396 - RNA, 20 nt, Artificial Sequence
  ELANE RNA Guide
cacccggcagguguucaccg

SEQ ID NO: 11397 - RNA, 20 nt, Artificial Sequence
  ELANE RNA Guide
caccgugcagcgcaucuucg

SEQ ID NO: 11398 - RNA, 20 nt, Artificial Sequence
  ELANE RNA Guide
cacggugaacaccugccggg

SEQ ID NO: 11399 - RNA, 20 nt, Artificial Sequence
  ELANE RNA Guide
cagguguucaccgugcagcg

SEQ ID NO: 11400 - RNA, 20 nt, Artificial Sequence
  ELANE RNA Guide
ccacccggcagguguucacc

SEQ ID NO: 11401 - RNA, 20 nt, Artificial Sequence
  ELANE RNA Guide
cccacccggcagguguucac

SEQ ID NO: 11402 - RNA, 20 nt, Artificial Sequence
  ELANE RNA Guide
cccggcagguguucaccgug

SEQ ID NO: 11403 - RNA, 20 nt, Artificial Sequence
  ELANE RNA Guide
ccggcagguguucaccgugc

SEQ ID NO: 11404 - RNA, 20 nt, Artificial Sequence
  ELANE RNA Guide
cgaagaugcgcugcacggug

SEQ ID NO: 11405 - RNA, 20 nt, Artificial Sequence
  ELANE RNA Guide
cgcugcacggugaacaccug

SEQ ID NO: 11406 - RNA, 20 nt, Artificial Sequence
  ELANE RNA Guide
cggcagguguucaccgugca

SEQ ID NO: 11407 - RNA, 20 nt, Artificial Sequence
  ELANE RNA Guide
cggugaacaccugccgggug

SEQ ID NO: 11408 - RNA, 20 nt, Artificial Sequence
  ELANE RNA Guide
cugcacggugaacaccugcc

SEQ ID NO: 11409 - RNA, 20 nt, Artificial Sequence
  ELANE RNA Guide
gaagaugcgcugcacgguga

SEQ ID NO: 11410 - RNA, 20 nt, Artificial Sequence
  ELANE RNA Guide
gagcccacccggcagguguu

SEQ ID NO: 11411 - RNA, 20 nt, Artificial Sequence
  ELANE RNA Guide
gaugcgcugcacggugaaca

SEQ ID NO: 11412 - RNA, 20 nt, Artificial Sequence
  ELANE RNA Guide
gcacggugaacaccugccgg

SEQ ID NO: 11413 - RNA, 20 nt, Artificial Sequence
  ELANE RNA Guide
gcagguguucaccgugcagc

SEQ ID NO: 11414 - RNA, 20 nt, Artificial Sequence
  ELANE RNA Guide
gcccacccggcagguguuca

SEQ ID NO: 11415 - RNA, 20 nt, Artificial Sequence
  ELANE RNA Guide
gcgcugcacggugaacaccu

SEQ ID NO: 11416 - RNA, 20 nt, Artificial Sequence
  ELANE RNA Guide
gcugcacggugaacaccugc

SEQ ID NO: 11417 - RNA, 20 nt, Artificial Sequence
  ELANE RNA Guide
ggcagguguucaccgugcag

SEQ ID NO: 11418 - RNA, 20 nt, Artificial Sequence
  ELANE RNA Guide
ggugaacaccugccgggugg

SEQ ID NO: 11419 - RNA, 20 nt, Artificial Sequence
  ELANE RNA Guide
gguguucaccgugcagcgca

SEQ ID NO: 11420 - RNA, 20 nt, Artificial Sequence
  ELANE RNA Guide
gugaacaccugccggguggg

SEQ ID NO: 11421 - RNA, 20 nt, Artificial Sequence
  ELANE RNA Guide
guguucaccgugcagcgcau

SEQ ID NO: 11422 - RNA, 20 nt, Artificial Sequence
  ELANE RNA Guide
guucaccgugcagcgcaucu

SEQ ID NO: 11423 - RNA, 20 nt, Artificial Sequence
  ELANE RNA Guide
guuuucgaagaugcgcugca

SEQ ID NO: 11424 - RNA, 20 nt, Artificial Sequence
  ELANE RNA Guide
ucaccgugcagcgcaucuuc

SEQ ID NO: 11425 - RNA, 20 nt, Artificial Sequence
  ELANE RNA Guide
ucgaagaugcgcugcacggu

SEQ ID NO: 11426 - RNA, 20 nt, Artificial Sequence
  ELANE RNA Guide
ugcacggugaacaccugccg

SEQ ID NO: 11427 - RNA, 20 nt, Artificial Sequence
  ELANE RNA Guide
ugcgcugcacggugaacacc

SEQ ID NO: 11428 - RNA, 20 nt, Artificial Sequence
  ELANE RNA Guide
uguucaccgugcagcgcauc

SEQ ID NO: 11429 - RNA, 20 nt, Artificial Sequence
  ELANE RNA Guide
uucaccgugcagcgcaucuu

SEQ ID NO: 11430 - RNA, 20 nt, Artificial Sequence
  ELANE RNA Guide
uuuucgaagaugcgcugcac

SEQ ID NO: 11431 - RNA, 21 nt, Artificial Sequence
  ELANE RNA Guide
aagaugcgcugcacggugaac

SEQ ID NO: 11432 - RNA, 21 nt, Artificial Sequence
  ELANE RNA Guide
acccggcagguguucaccgug

SEQ ID NO: 11433 - RNA, 21 nt, Artificial Sequence
  ELANE RNA Guide
acggugaacaccugccgggug

SEQ ID NO: 11434 - RNA, 21 nt, Artificial Sequence
  ELANE RNA Guide
agaugcgcugcacggugaaca

SEQ ID NO: 11435 - RNA, 21 nt, Artificial Sequence
  ELANE RNA Guide
agcccacccggcagguguuca

SEQ ID NO: 11436 - RNA, 21 nt, Artificial Sequence
  ELANE RNA Guide
agguguucaccgugcagcgca

SEQ ID NO: 11437 - RNA, 21 nt, Artificial Sequence
  ELANE RNA Guide
augcgcugcacggugaacacc

SEQ ID NO: 11438 - RNA, 21 nt, Artificial Sequence
  ELANE RNA Guide
cacccggcagguguucaccgu

SEQ ID NO: 11439 - RNA, 21 nt, Artificial Sequence
  ELANE RNA Guide
caccgugcagcgcaucuucga

SEQ ID NO: 11440 - RNA, 21 nt, Artificial Sequence
  ELANE RNA Guide
cacggugaacaccugccgggu

SEQ ID NO: 11441 - RNA, 21 nt, Artificial Sequence
  ELANE RNA Guide
cagguguucaccgugcagcgc

SEQ ID NO: 11442 - RNA, 21 nt, Artificial Sequence
  ELANE RNA Guide
ccacccggcagguguucaccg

SEQ ID NO: 11443 - RNA, 21 nt, Artificial Sequence
  ELANE RNA Guide
cccacccggcagguguucacc

SEQ ID NO: 11444 - RNA, 21 nt, Artificial Sequence
  ELANE RNA Guide
cccggcagguguucaccgugc

SEQ ID NO: 11445 - RNA, 21 nt, Artificial Sequence
  ELANE RNA Guide
ccggcagguguucaccgugca

SEQ ID NO: 11446 - RNA, 21 nt, Artificial Sequence
  ELANE RNA Guide
cgaagaugcgcugcacgguga

SEQ ID NO: 11447 - RNA, 21 nt, Artificial Sequence
  ELANE RNA Guide
cgcugcacggugaacaccugc

SEQ ID NO: 11448 - RNA, 21 nt, Artificial Sequence
  ELANE RNA Guide
cggcagguguucaccgugcag

SEQ ID NO: 11449 - RNA, 21 nt, Artificial Sequence
  ELANE RNA Guide
cggugaacaccugccgggugg

SEQ ID NO: 11450 - RNA, 21 nt, Artificial Sequence
  ELANE RNA Guide
cguuuucgaagaugcgcugca

SEQ ID NO: 11451 - RNA, 21 nt, Artificial Sequence
  ELANE RNA Guide
cugcacggugaacaccugccg

SEQ ID NO: 11452 - RNA, 21 nt, Artificial Sequence
  ELANE RNA Guide
gaagaugcgcugcacggugaa

SEQ ID NO: 11453 - RNA, 21 nt, Artificial Sequence
  ELANE RNA Guide
gagcccacccggcagguguuc

SEQ ID NO: 11454 - RNA, 21 nt, Artificial Sequence
  ELANE RNA Guide
gaugcgcugcacggugaacac

SEQ ID NO: 11455 - RNA, 21 nt, Artificial Sequence
  ELANE RNA Guide
gcacggugaacaccugccggg

SEQ ID NO: 11456 - RNA, 21 nt, Artificial Sequence
  ELANE RNA Guide
gcagguguucaccgugcagcg

SEQ ID NO: 11457 - RNA, 21 nt, Artificial Sequence
  ELANE RNA Guide
gcccacccggcagguguucac

SEQ ID NO: 11458 - RNA, 21 nt, Artificial Sequence
  ELANE RNA Guide
gcgcugcacggugaacaccug

SEQ ID NO: 11459 - RNA, 21 nt, Artificial Sequence
  ELANE RNA Guide
gcugcacggugaacaccugcc

SEQ ID NO: 11460 - RNA, 21 nt, Artificial Sequence
  ELANE RNA Guide
ggagcccacccggcagguguu

SEQ ID NO: 11461 - RNA, 21 nt, Artificial Sequence
  ELANE RNA Guide
ggcagguguucaccgugcagc

SEQ ID NO: 11462 - RNA, 21 nt, Artificial Sequence
  ELANE RNA Guide
ggugaacaccugccggguggg

SEQ ID NO: 11463 - RNA, 21 nt, Artificial Sequence
  ELANE RNA Guide
gguguucaccgugcagcgcau

SEQ ID NO: 11464 - RNA, 21 nt, Artificial Sequence
  ELANE RNA Guide
gugaacaccugccgggugggc

SEQ ID NO: 11465 - RNA, 21 nt, Artificial Sequence
  ELANE RNA Guide
guguucaccgugcagcgcauc

SEQ ID NO: 11466 - RNA, 21 nt, Artificial Sequence
  ELANE RNA Guide
guucaccgugcagcgcaucuu

SEQ ID NO: 11467 - RNA, 21 nt, Artificial Sequence
  ELANE RNA Guide
guuuucgaagaugcgcugcac

SEQ ID NO: 11468 - RNA, 21 nt, Artificial Sequence
  ELANE RNA Guide
ucaccgugcagcgcaucuucg

SEQ ID NO: 11469 - RNA, 21 nt, Artificial Sequence
  ELANE RNA Guide
ucgaagaugcgcugcacggug

SEQ ID NO: 11470 - RNA, 21 nt, Artificial Sequence
  ELANE RNA Guide
ugcacggugaacaccugccgg

SEQ ID NO: 11471 - RNA, 21 nt, Artificial Sequence
  ELANE RNA Guide
ugcgcugcacggugaacaccu

SEQ ID NO: 11472 - RNA, 21 nt, Artificial Sequence
  ELANE RNA Guide
uguucaccgugcagcgcaucu

SEQ ID NO: 11473 - RNA, 21 nt, Artificial Sequence
  ELANE RNA Guide
uucaccgugcagcgcaucuuc

SEQ ID NO: 11474 - RNA, 21 nt, Artificial Sequence
  ELANE RNA Guide
uucgaagaugcgcugcacggu

SEQ ID NO: 11475 - RNA, 22 nt, Artificial Sequence
  ELANE RNA Guide
aagaugcgcugcacggugaaca

SEQ ID NO: 11476 - RNA, 22 nt, Artificial Sequence
  ELANE RNA Guide
acccggcagguguucaccgugc

SEQ ID NO: 11477 - RNA, 22 nt, Artificial Sequence
  ELANE RNA Guide
acggugaacaccugccgggugg

SEQ ID NO: 11478 - RNA, 22 nt, Artificial Sequence
  ELANE RNA Guide
agaugcgcugcacggugaacac

SEQ ID NO: 11479 - RNA, 22 nt, Artificial Sequence
  ELANE RNA Guide
agcccacccggcagguguucac

SEQ ID NO: 11480 - RNA, 22 nt, Artificial Sequence
  ELANE RNA Guide
agguguucaccgugcagcgcau

SEQ ID NO: 11481 - RNA, 22 nt, Artificial Sequence
  ELANE RNA Guide
augcgcugcacggugaacaccu

SEQ ID NO: 11482 - RNA, 22 nt, Artificial Sequence
  ELANE RNA Guide
cacccggcagguguucaccgug

SEQ ID NO: 11483 - RNA, 22 nt, Artificial Sequence
  ELANE RNA Guide
caccgugcagcgcaucuucgaa

SEQ ID NO: 11484 - RNA, 22 nt, Artificial Sequence
  ELANE RNA Guide
cacggugaacaccugccgggug

SEQ ID NO: 11485 - RNA, 22 nt, Artificial Sequence
  ELANE RNA Guide
cagguguucaccgugcagcgca

SEQ ID NO: 11486 - RNA, 22 nt, Artificial Sequence
  ELANE RNA Guide
ccacccggcagguguucaccgu

SEQ ID NO: 11487 - RNA, 22 nt, Artificial Sequence
  ELANE RNA Guide
cccacccggcagguguucaccg

SEQ ID NO: 11488 - RNA, 22 nt, Artificial Sequence
  ELANE RNA Guide
cccggcagguguucaccgugca

SEQ ID NO: 11489 - RNA, 22 nt, Artificial Sequence
  ELANE RNA Guide
ccggcagguguucaccgugcag

SEQ ID NO: 11490 - RNA, 22 nt, Artificial Sequence
  ELANE RNA Guide
ccguuuucgaagaugcgcugca

SEQ ID NO: 11491 - RNA, 22 nt, Artificial Sequence
  ELANE RNA Guide
cgaagaugcgcugcacggugaa

SEQ ID NO: 11492 - RNA, 22 nt, Artificial Sequence
  ELANE RNA Guide
cgcugcacggugaacaccugcc

SEQ ID NO: 11493 - RNA, 22 nt, Artificial Sequence
  ELANE RNA Guide
cggcagguguucaccgugcagc

SEQ ID NO: 11494 - RNA, 22 nt, Artificial Sequence
  ELANE RNA Guide
cggugaacaccugccggguggg

SEQ ID NO: 11495 - RNA, 22 nt, Artificial Sequence
  ELANE RNA Guide
cguuuucgaagaugcgcugcac

SEQ ID NO: 11496 - RNA, 22 nt, Artificial Sequence
  ELANE RNA Guide
cugcacggugaacaccugccgg

SEQ ID NO: 11497 - RNA, 22 nt, Artificial Sequence
  ELANE RNA Guide
gaagaugcgcugcacggugaac

SEQ ID NO: 11498 - RNA, 22 nt, Artificial Sequence
  ELANE RNA Guide
gagcccacccggcagguguuca

SEQ ID NO: 11499 - RNA, 22 nt, Artificial Sequence
  ELANE RNA Guide
gaugcgcugcacggugaacacc

SEQ ID NO: 11500 - RNA, 22 nt, Artificial Sequence
  ELANE RNA Guide
gcacggugaacaccugccgggu

SEQ ID NO: 11501 - RNA, 22 nt, Artificial Sequence
  ELANE RNA Guide
gcagguguucaccgugcagcgc

SEQ ID NO: 11502 - RNA, 22 nt, Artificial Sequence
  ELANE RNA Guide
gcccacccggcagguguucacc

SEQ ID NO: 11503 - RNA, 22 nt, Artificial Sequence
  ELANE RNA Guide
gcgcugcacggugaacaccugc

SEQ ID NO: 11504 - RNA, 22 nt, Artificial Sequence
  ELANE RNA Guide
gcugcacggugaacaccugccg

SEQ ID NO: 11505 - RNA, 22 nt, Artificial Sequence
  ELANE RNA Guide
ggagcccacccggcagguguuc

SEQ ID NO: 11506 - RNA, 22 nt, Artificial Sequence
  ELANE RNA Guide
ggcagguguucaccgugcagcg

SEQ ID NO: 11507 - RNA, 22 nt, Artificial Sequence
  ELANE RNA Guide
gggagcccacccggcagguguu

SEQ ID NO: 11508 - RNA, 22 nt, Artificial Sequence
  ELANE RNA Guide
ggugaacaccugccgggugggc

SEQ ID NO: 11509 - RNA, 22 nt, Artificial Sequence
  ELANE RNA Guide
gguguucaccgugcagcgcauc

SEQ ID NO: 11510 - RNA, 22 nt, Artificial Sequence
  ELANE RNA Guide
gugaacaccugccgggugggcu

SEQ ID NO: 11511 - RNA, 22 nt, Artificial Sequence
  ELANE RNA Guide
guguucaccgugcagcgcaucu

SEQ ID NO: 11512 - RNA, 22 nt, Artificial Sequence
  ELANE RNA Guide
guucaccgugcagcgcaucuuc

SEQ ID NO: 11513 - RNA, 22 nt, Artificial Sequence
  ELANE RNA Guide
ucaccgugcagcgcaucuucga

SEQ ID NO: 11514 - RNA, 22 nt, Artificial Sequence
  ELANE RNA Guide
ucgaagaugcgcugcacgguga

SEQ ID NO: 11515 - RNA, 22 nt, Artificial Sequence
  ELANE RNA Guide
ugcacggugaacaccugccggg

SEQ ID NO: 11516 - RNA, 22 nt, Artificial Sequence
  ELANE RNA Guide
ugcgcugcacggugaacaccug

SEQ ID NO: 11517 - RNA, 22 nt, Artificial Sequence
  ELANE RNA Guide
uguucaccgugcagcgcaucuu

SEQ ID NO: 11518 - RNA, 22 nt, Artificial Sequence
  ELANE RNA Guide
uucaccgugcagcgcaucuucg

SEQ ID NO: 11519 - RNA, 22 nt, Artificial Sequence
  ELANE RNA Guide
uucgaagaugcgcugcacggug

SEQ ID NO: 11520 - RNA, 22 nt, Artificial Sequence
  ELANE RNA Guide
uuucgaagaugcgcugcacggu

SEQ ID NO: 11521 - RNA, 20 nt, Artificial Sequence
  ELANE RNA Guide
aagaugcgcugcauggcgaa

SEQ ID NO: 11522 - RNA, 20 nt, Artificial Sequence
  ELANE RNA Guide
acccggcagguguucgccau

SEQ ID NO: 11523 - RNA, 20 nt, Artificial Sequence
  ELANE RNA Guide
agaugcgcugcauggcgaac

SEQ ID NO: 11524 - RNA, 20 nt, Artificial Sequence
  ELANE RNA Guide
agguguucgccaugcagcgc

SEQ ID NO: 11525 - RNA, 20 nt, Artificial Sequence
  ELANE RNA Guide
augcgcugcauggcgaacac

SEQ ID NO: 11526 - RNA, 20 nt, Artificial Sequence
  ELANE RNA Guide
auggcgaacaccugccgggu

SEQ ID NO: 11527 - RNA, 20 nt, Artificial Sequence
  ELANE RNA Guide
cacccggcagguguucgcca

SEQ ID NO: 11528 - RNA, 20 nt, Artificial Sequence
  ELANE RNA Guide
cagguguucgccaugcagcg

SEQ ID NO: 11529 - RNA, 20 nt, Artificial Sequence
  ELANE RNA Guide
caugcagcgcaucuucgaaa

SEQ ID NO: 11530 - RNA, 20 nt, Artificial Sequence
  ELANE RNA Guide
cauggcgaacaccugccggg

SEQ ID NO: 11531 - RNA, 20 nt, Artificial Sequence
  ELANE RNA Guide
ccacccggcagguguucgcc

SEQ ID NO: 11532 - RNA, 20 nt, Artificial Sequence
  ELANE RNA Guide
ccaugcagcgcaucuucgaa

SEQ ID NO: 11533 - RNA, 20 nt, Artificial Sequence
  ELANE RNA Guide
cccacccggcagguguucgc

SEQ ID NO: 11534 - RNA, 20 nt, Artificial Sequence
  ELANE RNA Guide
cccggcagguguucgccaug

SEQ ID NO: 11535 - RNA, 20 nt, Artificial Sequence
  ELANE RNA Guide
ccggcagguguucgccaugc

SEQ ID NO: 11536 - RNA, 20 nt, Artificial Sequence
  ELANE RNA Guide
ccguuuucgaagaugcgcug

SEQ ID NO: 11537 - RNA, 20 nt, Artificial Sequence
  ELANE RNA Guide
cgaagaugcgcugcauggcg

SEQ ID NO: 11538 - RNA, 20 nt, Artificial Sequence
  ELANE RNA Guide
cgccaugcagcgcaucuucg

SEQ ID NO: 11539 - RNA, 20 nt, Artificial Sequence
  ELANE RNA Guide
cgcugcauggcgaacaccug

SEQ ID NO: 11540 - RNA, 20 nt, Artificial Sequence
  ELANE RNA Guide
cggcagguguucgccaugca

SEQ ID NO: 11541 - RNA, 20 nt, Artificial Sequence
  ELANE RNA Guide
cguuuucgaagaugcgcugc

SEQ ID NO: 11542 - RNA, 20 nt, Artificial Sequence
  ELANE RNA Guide
cugcauggcgaacaccugcc

SEQ ID NO: 11543 - RNA, 20 nt, Artificial Sequence
  ELANE RNA Guide
gaagaugcgcugcauggcga

SEQ ID NO: 11544 - RNA, 20 nt, Artificial Sequence
  ELANE RNA Guide
gaugcgcugcauggcgaaca

SEQ ID NO: 11545 - RNA, 20 nt, Artificial Sequence
  ELANE RNA Guide
gcagguguucgccaugcagc

SEQ ID NO: 11546 - RNA, 20 nt, Artificial Sequence
  ELANE RNA Guide
gcauggcgaacaccugccgg

SEQ ID NO: 11547 - RNA, 20 nt, Artificial Sequence
  ELANE RNA Guide
gccaugcagcgcaucuucga

SEQ ID NO: 11548 - RNA, 20 nt, Artificial Sequence
  ELANE RNA Guide
gcccacccggcagguguucg

SEQ ID NO: 11549 - RNA, 20 nt, Artificial Sequence
  ELANE RNA Guide
gccguuuucgaagaugcgcu

SEQ ID NO: 11550 - RNA, 20 nt, Artificial Sequence
  ELANE RNA Guide
gcgcugcauggcgaacaccu

SEQ ID NO: 11551 - RNA, 20 nt, Artificial Sequence
  ELANE RNA Guide
gcugcauggcgaacaccugc

SEQ ID NO: 11552 - RNA, 20 nt, Artificial Sequence
  ELANE RNA Guide
ggcagguguucgccaugcag

SEQ ID NO: 11553 - RNA, 20 nt, Artificial Sequence
  ELANE RNA Guide
gguguucgccaugcagcgca

SEQ ID NO: 11554 - RNA, 20 nt, Artificial Sequence
  ELANE RNA Guide
guguucgccaugcagcgcau

SEQ ID NO: 11555 - RNA, 20 nt, Artificial Sequence
  ELANE RNA Guide
guucgccaugcagcgcaucu

SEQ ID NO: 11556 - RNA, 20 nt, Artificial Sequence
  ELANE RNA Guide
ucgaagaugcgcugcauggc

SEQ ID NO: 11557 - RNA, 20 nt, Artificial Sequence
  ELANE RNA Guide
ucgccaugcagcgcaucuuc

SEQ ID NO: 11558 - RNA, 20 nt, Artificial Sequence
  ELANE RNA Guide
ugcauggcgaacaccugccg

SEQ ID NO: 11559 - RNA, 20 nt, Artificial Sequence
  ELANE RNA Guide
ugcgcugcauggcgaacacc

SEQ ID NO: 11560 - RNA, 20 nt, Artificial Sequence
  ELANE RNA Guide
uguucgccaugcagcgcauc

SEQ ID NO: 11561 - RNA, 20 nt, Artificial Sequence
  ELANE RNA Guide
uucgaagaugcgcugcaugg

SEQ ID NO: 11562 - RNA, 20 nt, Artificial Sequence
  ELANE RNA Guide
uucgccaugcagcgcaucuu

SEQ ID NO: 11563 - RNA, 20 nt, Artificial Sequence
  ELANE RNA Guide
uuucgaagaugcgcugcaug

SEQ ID NO: 11564 - RNA, 20 nt, Artificial Sequence
  ELANE RNA Guide
uuuucgaagaugcgcugcau

SEQ ID NO: 11565 - RNA, 21 nt, Artificial Sequence
  ELANE RNA Guide
aagaugcgcugcauggcgaac

SEQ ID NO: 11566 - RNA, 21 nt, Artificial Sequence
  ELANE RNA Guide
acccggcagguguucgccaug

SEQ ID NO: 11567 - RNA, 21 nt, Artificial Sequence
  ELANE RNA Guide
agaugcgcugcauggcgaaca

SEQ ID NO: 11568 - RNA, 21 nt, Artificial Sequence
  ELANE RNA Guide
agcccacccggcagguguucg

SEQ ID NO: 11569 - RNA, 21 nt, Artificial Sequence
  ELANE RNA Guide
agccguuuucgaagaugcgcu

SEQ ID NO: 11570 - RNA, 21 nt, Artificial Sequence
  ELANE RNA Guide
agguguucgccaugcagcgca

SEQ ID NO: 11571 - RNA, 21 nt, Artificial Sequence
  ELANE RNA Guide
augcgcugcauggcgaacacc

SEQ ID NO: 11572 - RNA, 21 nt, Artificial Sequence
  ELANE RNA Guide
auggcgaacaccugccgggug

SEQ ID NO: 11573 - RNA, 21 nt, Artificial Sequence
  ELANE RNA Guide
cacccggcagguguucgccau

SEQ ID NO: 11574 - RNA, 21 nt, Artificial Sequence
  ELANE RNA Guide
cagguguucgccaugcagcgc

SEQ ID NO: 11575 - RNA, 21 nt, Artificial Sequence
  ELANE RNA Guide
caugcagcgcaucuucgaaaa

SEQ ID NO: 11576 - RNA, 21 nt, Artificial Sequence
  ELANE RNA Guide
cauggcgaacaccugccgggu

SEQ ID NO: 11577 - RNA, 21 nt, Artificial Sequence
  ELANE RNA Guide
ccacccggcagguguucgcca

SEQ ID NO: 11578 - RNA, 21 nt, Artificial Sequence
  ELANE RNA Guide
ccaugcagcgcaucuucgaaa

SEQ ID NO: 11579 - RNA, 21 nt, Artificial Sequence
  ELANE RNA Guide
cccacccggcagguguucgcc

SEQ ID NO: 11580 - RNA, 21 nt, Artificial Sequence
  ELANE RNA Guide
cccggcagguguucgccaugc

SEQ ID NO: 11581 - RNA, 21 nt, Artificial Sequence
  ELANE RNA Guide
ccggcagguguucgccaugca

SEQ ID NO: 11582 - RNA, 21 nt, Artificial Sequence
  ELANE RNA Guide
ccguuuucgaagaugcgcugc

SEQ ID NO: 11583 - RNA, 21 nt, Artificial Sequence
  ELANE RNA Guide
cgaagaugcgcugcauggcga

SEQ ID NO: 11584 - RNA, 21 nt, Artificial Sequence
  ELANE RNA Guide
cgccaugcagcgcaucuucga

SEQ ID NO: 11585 - RNA, 21 nt, Artificial Sequence
  ELANE RNA Guide
cgcugcauggcgaacaccugc

SEQ ID NO: 11586 - RNA, 21 nt, Artificial Sequence
  ELANE RNA Guide
cggcagguguucgccaugcag

SEQ ID NO: 11587 - RNA, 21 nt, Artificial Sequence
  ELANE RNA Guide
cugcauggcgaacaccugccg

SEQ ID NO: 11588 - RNA, 21 nt, Artificial Sequence
  ELANE RNA Guide
gaagaugcgcugcauggcgaa

SEQ ID NO: 11589 - RNA, 21 nt, Artificial Sequence
  ELANE RNA Guide
gaugcgcugcauggcgaacac

SEQ ID NO: 11590 - RNA, 21 nt, Artificial Sequence
  ELANE RNA Guide
gcagguguucgccaugcagcg

SEQ ID NO: 11591 - RNA, 21 nt, Artificial Sequence
  ELANE RNA Guide
gcauggcgaacaccugccggg

SEQ ID NO: 11592 - RNA, 21 nt, Artificial Sequence
  ELANE RNA Guide
gccaugcagcgcaucuucgaa

SEQ ID NO: 11593 - RNA, 21 nt, Artificial Sequence
  ELANE RNA Guide
gcccacccggcagguguucgc

SEQ ID NO: 11594 - RNA, 21 nt, Artificial Sequence
  ELANE RNA Guide
gccguuuucgaagaugcgcug

SEQ ID NO: 11595 - RNA, 21 nt, Artificial Sequence
  ELANE RNA Guide
gcgcugcauggcgaacaccug

SEQ ID NO: 11596 - RNA, 21 nt, Artificial Sequence
  ELANE RNA Guide
gcugcauggcgaacaccugcc

SEQ ID NO: 11597 - RNA, 21 nt, Artificial Sequence
  ELANE RNA Guide
ggcagguguucgccaugcagc

SEQ ID NO: 11598 - RNA, 21 nt, Artificial Sequence
  ELANE RNA Guide
gguguucgccaugcagcgcau

SEQ ID NO: 11599 - RNA, 21 nt, Artificial Sequence
  ELANE RNA Guide
guguucgccaugcagcgcauc

SEQ ID NO: 11600 - RNA, 21 nt, Artificial Sequence
  ELANE RNA Guide
guucgccaugcagcgcaucuu

SEQ ID NO: 11601 - RNA, 21 nt, Artificial Sequence
  ELANE RNA Guide
guuuucgaagaugcgcugcau

SEQ ID NO: 11602 - RNA, 21 nt, Artificial Sequence
  ELANE RNA Guide
ucgaagaugcgcugcauggcg

SEQ ID NO: 11603 - RNA, 21 nt, Artificial Sequence
  ELANE RNA Guide
ucgccaugcagcgcaucuucg

SEQ ID NO: 11604 - RNA, 21 nt, Artificial Sequence
  ELANE RNA Guide
ugcauggcgaacaccugccgg

SEQ ID NO: 11605 - RNA, 21 nt, Artificial Sequence
  ELANE RNA Guide
ugcgcugcauggcgaacaccu

SEQ ID NO: 11606 - RNA, 21 nt, Artificial Sequence
  ELANE RNA Guide
uguucgccaugcagcgcaucu

SEQ ID NO: 11607 - RNA, 21 nt, Artificial Sequence
  ELANE RNA Guide
uucgaagaugcgcugcauggc

SEQ ID NO: 11608 - RNA, 21 nt, Artificial Sequence
  ELANE RNA Guide
uucgccaugcagcgcaucuuc

SEQ ID NO: 11609 - RNA, 21 nt, Artificial Sequence
  ELANE RNA Guide
uuucgaagaugcgcugcaugg

SEQ ID NO: 11610 - RNA, 21 nt, Artificial Sequence
  ELANE RNA Guide
uuuucgaagaugcgcugcaug

SEQ ID NO: 11611 - RNA, 22 nt, Artificial Sequence
  ELANE RNA Guide
aagaugcgcugcauggcgaaca

SEQ ID NO: 11612 - RNA, 22 nt, Artificial Sequence
  ELANE RNA Guide
acccggcagguguucgccaugc

SEQ ID NO: 11613 - RNA, 22 nt, Artificial Sequence
  ELANE RNA Guide
agaugcgcugcauggcgaacac

SEQ ID NO: 11614 - RNA, 22 nt, Artificial Sequence
  ELANE RNA Guide
agcccacccggcagguguucgc

SEQ ID NO: 11615 - RNA, 22 nt, Artificial Sequence
  ELANE RNA Guide
agccguuuucgaagaugcgcug

SEQ ID NO: 11616 - RNA, 22 nt, Artificial Sequence
  ELANE RNA Guide
agguguucgccaugcagcgcau

SEQ ID NO: 11617 - RNA, 22 nt, Artificial Sequence
  ELANE RNA Guide
augcgcugcauggcgaacaccu

SEQ ID NO: 11618 - RNA, 22 nt, Artificial Sequence
  ELANE RNA Guide
auggcgaacaccugccgggugg

SEQ ID NO: 11619 - RNA, 22 nt, Artificial Sequence
  ELANE RNA Guide
cacccggcagguguucgccaug

SEQ ID NO: 11620 - RNA, 22 nt, Artificial Sequence
  ELANE RNA Guide
cagguguucgccaugcagcgca

SEQ ID NO: 11621 - RNA, 22 nt, Artificial Sequence
  ELANE RNA Guide
caugcagcgcaucuucgaaaac

SEQ ID NO: 11622 - RNA, 22 nt, Artificial Sequence
  ELANE RNA Guide
cauggcgaacaccugccgggug

SEQ ID NO: 11623 - RNA, 22 nt, Artificial Sequence
  ELANE RNA Guide
ccacccggcagguguucgccau

SEQ ID NO: 11624 - RNA, 22 nt, Artificial Sequence
  ELANE RNA Guide
ccaugcagcgcaucuucgaaaa

SEQ ID NO: 11625 - RNA, 22 nt, Artificial Sequence
  ELANE RNA Guide
cccacccggcagguguucgcca

SEQ ID NO: 11626 - RNA, 22 nt, Artificial Sequence
  ELANE RNA Guide
cccggcagguguucgccaugca

SEQ ID NO: 11627 - RNA, 22 nt, Artificial Sequence
  ELANE RNA Guide
ccggcagguguucgccaugcag

SEQ ID NO: 11628 - RNA, 22 nt, Artificial Sequence
  ELANE RNA Guide
cgaagaugcgcugcauggcgaa

SEQ ID NO: 11629 - RNA, 22 nt, Artificial Sequence
  ELANE RNA Guide
cgccaugcagcgcaucuucgaa

SEQ ID NO: 11630 - RNA, 22 nt, Artificial Sequence
  ELANE RNA Guide
cgcugcauggcgaacaccugcc

SEQ ID NO: 11631 - RNA, 22 nt, Artificial Sequence
  ELANE RNA Guide
cggcagguguucgccaugcagc

SEQ ID NO: 11632 - RNA, 22 nt, Artificial Sequence
  ELANE RNA Guide
cguuuucgaagaugcgcugcau

SEQ ID NO: 11633 - RNA, 22 nt, Artificial Sequence
  ELANE RNA Guide
cugcauggcgaacaccugccgg

SEQ ID NO: 11634 - RNA, 22 nt, Artificial Sequence
  ELANE RNA Guide
gaagaugcgcugcauggcgaac

SEQ ID NO: 11635 - RNA, 22 nt, Artificial Sequence
  ELANE RNA Guide
gagcccacccggcagguguucg

SEQ ID NO: 11636 - RNA, 22 nt, Artificial Sequence
  ELANE RNA Guide
gaugcgcugcauggcgaacacc

SEQ ID NO: 11637 - RNA, 22 nt, Artificial Sequence
  ELANE RNA Guide
gcagguguucgccaugcagcgc

SEQ ID NO: 11638 - RNA, 22 nt, Artificial Sequence
  ELANE RNA Guide
gcauggcgaacaccugccgggu

SEQ ID NO: 11639 - RNA, 22 nt, Artificial Sequence
  ELANE RNA Guide
gccaugcagcgcaucuucgaaa

SEQ ID NO: 11640 - RNA, 22 nt, Artificial Sequence
  ELANE RNA Guide
gcccacccggcagguguucgcc

SEQ ID NO: 11641 - RNA, 22 nt, Artificial Sequence
  ELANE RNA Guide
gccguuuucgaagaugcgcugc

SEQ ID NO: 11642 - RNA, 22 nt, Artificial Sequence
  ELANE RNA Guide
gcgcugcauggcgaacaccugc

SEQ ID NO: 11643 - RNA, 22 nt, Artificial Sequence
  ELANE RNA Guide
gcugcauggcgaacaccugccg

SEQ ID NO: 11644 - RNA, 22 nt, Artificial Sequence
  ELANE RNA Guide
ggcagguguucgccaugcagcg

SEQ ID NO: 11645 - RNA, 22 nt, Artificial Sequence
  ELANE RNA Guide
gguguucgccaugcagcgcauc

SEQ ID NO: 11646 - RNA, 22 nt, Artificial Sequence
  ELANE RNA Guide
guguucgccaugcagcgcaucu

SEQ ID NO: 11647 - RNA, 22 nt, Artificial Sequence
  ELANE RNA Guide
guucgccaugcagcgcaucuuc

SEQ ID NO: 11648 - RNA, 22 nt, Artificial Sequence
  ELANE RNA Guide
guuuucgaagaugcgcugcaug

SEQ ID NO: 11649 - RNA, 22 nt, Artificial Sequence
  ELANE RNA Guide
uagccguuuucgaagaugcgcu

SEQ ID NO: 11650 - RNA, 22 nt, Artificial Sequence
  ELANE RNA Guide
ucgaagaugcgcugcauggcga

SEQ ID NO: 11651 - RNA, 22 nt, Artificial Sequence
  ELANE RNA Guide
ucgccaugcagcgcaucuucga

SEQ ID NO: 11652 - RNA, 22 nt, Artificial Sequence
  ELANE RNA Guide
ugcauggcgaacaccugccggg

SEQ ID NO: 11653 - RNA, 22 nt, Artificial Sequence
  ELANE RNA Guide
ugcgcugcauggcgaacaccug

SEQ ID NO: 11654 - RNA, 22 nt, Artificial Sequence
  ELANE RNA Guide
uguucgccaugcagcgcaucuu

SEQ ID NO: 11655 - RNA, 22 nt, Artificial Sequence
  ELANE RNA Guide
uucgaagaugcgcugcauggcg

SEQ ID NO: 11656 - RNA, 22 nt, Artificial Sequence
  ELANE RNA Guide
uucgccaugcagcgcaucuucg

SEQ ID NO: 11657 - RNA, 22 nt, Artificial Sequence
  ELANE RNA Guide
uuucgaagaugcgcugcauggc

SEQ ID NO: 11658 - RNA, 22 nt, Artificial Sequence
  ELANE RNA Guide
uuuucgaagaugcgcugcaugg

SEQ ID NO: 11659 - RNA, 20 nt, Artificial Sequence
  ELANE RNA Guide
aagaugcgcugcaaggcgaa

SEQ ID NO: 11660 - RNA, 20 nt, Artificial Sequence
  ELANE RNA Guide
aaggcgaacaccugccgggu

SEQ ID NO: 11661 - RNA, 20 nt, Artificial Sequence
  ELANE RNA Guide
acccggcagguguucgccuu

SEQ ID NO: 11662 - RNA, 20 nt, Artificial Sequence
  ELANE RNA Guide
agaugcgcugcaaggcgaac

SEQ ID NO: 11663 - RNA, 20 nt, Artificial Sequence
  ELANE RNA Guide
agguguucgccuugcagcgc

SEQ ID NO: 11664 - RNA, 20 nt, Artificial Sequence
  ELANE RNA Guide
augcgcugcaaggcgaacac

SEQ ID NO: 11665 - RNA, 20 nt, Artificial Sequence
  ELANE RNA Guide
caaggcgaacaccugccggg

SEQ ID NO: 11666 - RNA, 20 nt, Artificial Sequence
  ELANE RNA Guide
cacccggcagguguucgccu

SEQ ID NO: 11667 - RNA, 20 nt, Artificial Sequence
  ELANE RNA Guide
cagguguucgccuugcagcg

SEQ ID NO: 11668 - RNA, 20 nt, Artificial Sequence
  ELANE RNA Guide
cccggcagguguucgccuug

SEQ ID NO: 11669 - RNA, 20 nt, Artificial Sequence
  ELANE RNA Guide
ccggcagguguucgccuugc

SEQ ID NO: 11670 - RNA, 20 nt, Artificial Sequence
  ELANE RNA Guide
ccuugcagcgcaucuucgaa

SEQ ID NO: 11671 - RNA, 20 nt, Artificial Sequence
  ELANE RNA Guide
cgaagaugcgcugcaaggcg

SEQ ID NO: 11672 - RNA, 20 nt, Artificial Sequence
  ELANE RNA Guide
cgccuugcagcgcaucuucg

SEQ ID NO: 11673 - RNA, 20 nt, Artificial Sequence
  ELANE RNA Guide
cgcugcaaggcgaacaccug

SEQ ID NO: 11674 - RNA, 20 nt, Artificial Sequence
  ELANE RNA Guide
cggcagguguucgccuugca

SEQ ID NO: 11675 - RNA, 20 nt, Artificial Sequence
  ELANE RNA Guide
cugcaaggcgaacaccugcc

SEQ ID NO: 11676 - RNA, 20 nt, Artificial Sequence
  ELANE RNA Guide
cuugcagcgcaucuucgaaa

SEQ ID NO: 11677 - RNA, 20 nt, Artificial Sequence
  ELANE RNA Guide
gaagaugcgcugcaaggcga

SEQ ID NO: 11678 - RNA, 20 nt, Artificial Sequence
  ELANE RNA Guide
gaugcgcugcaaggcgaaca

SEQ ID NO: 11679 - RNA, 20 nt, Artificial Sequence
  ELANE RNA Guide
gcaaggcgaacaccugccgg

SEQ ID NO: 11680 - RNA, 20 nt, Artificial Sequence
  ELANE RNA Guide
gcagguguucgccuugcagc

SEQ ID NO: 11681 - RNA, 20 nt, Artificial Sequence
  ELANE RNA Guide
gccuugcagcgcaucuucga

SEQ ID NO: 11682 - RNA, 20 nt, Artificial Sequence
  ELANE RNA Guide
gcgcugcaaggcgaacaccu

SEQ ID NO: 11683 - RNA, 20 nt, Artificial Sequence
  ELANE RNA Guide
gcugcaaggcgaacaccugc

SEQ ID NO: 11684 - RNA, 20 nt, Artificial Sequence
  ELANE RNA Guide
ggcagguguucgccuugcag

SEQ ID NO: 11685 - RNA, 20 nt, Artificial Sequence
  ELANE RNA Guide
gguguucgccuugcagcgca

SEQ ID NO: 11686 - RNA, 20 nt, Artificial Sequence
  ELANE RNA Guide
guguucgccuugcagcgcau

SEQ ID NO: 11687 - RNA, 20 nt, Artificial Sequence
  ELANE RNA Guide
guucgccuugcagcgcaucu

SEQ ID NO: 11688 - RNA, 20 nt, Artificial Sequence
  ELANE RNA Guide
ucgaagaugcgcugcaaggc

SEQ ID NO: 11689 - RNA, 20 nt, Artificial Sequence
  ELANE RNA Guide
ucgccuugcagcgcaucuuc

SEQ ID NO: 11690 - RNA, 20 nt, Artificial Sequence
  ELANE RNA Guide
ugcaaggcgaacaccugccg

SEQ ID NO: 11691 - RNA, 20 nt, Artificial Sequence
  ELANE RNA Guide
ugcgcugcaaggcgaacacc

SEQ ID NO: 11692 - RNA, 20 nt, Artificial Sequence
  ELANE RNA Guide
uguucgccuugcagcgcauc

SEQ ID NO: 11693 - RNA, 20 nt, Artificial Sequence
  ELANE RNA Guide
uucgaagaugcgcugcaagg

SEQ ID NO: 11694 - RNA, 20 nt, Artificial Sequence
  ELANE RNA Guide
uucgccuugcagcgcaucuu

SEQ ID NO: 11695 - RNA, 20 nt, Artificial Sequence
  ELANE RNA Guide
uuucgaagaugcgcugcaag

SEQ ID NO: 11696 - RNA, 20 nt, Artificial Sequence
  ELANE RNA Guide
uuuucgaagaugcgcugcaa

SEQ ID NO: 11697 - RNA, 21 nt, Artificial Sequence
  ELANE RNA Guide
aagaugcgcugcaaggcgaac

SEQ ID NO: 11698 - RNA, 21 nt, Artificial Sequence
  ELANE RNA Guide
aaggcgaacaccugccgggug

SEQ ID NO: 11699 - RNA, 21 nt, Artificial Sequence
  ELANE RNA Guide
acccggcagguguucgccuug

SEQ ID NO: 11700 - RNA, 21 nt, Artificial Sequence
  ELANE RNA Guide
agaugcgcugcaaggcgaaca

SEQ ID NO: 11701 - RNA, 21 nt, Artificial Sequence
  ELANE RNA Guide
agguguucgccuugcagcgca

SEQ ID NO: 11702 - RNA, 21 nt, Artificial Sequence
  ELANE RNA Guide
augcgcugcaaggcgaacacc

SEQ ID NO: 11703 - RNA, 21 nt, Artificial Sequence
  ELANE RNA Guide
caaggcgaacaccugccgggu

SEQ ID NO: 11704 - RNA, 21 nt, Artificial Sequence
  ELANE RNA Guide
cacccggcagguguucgccuu

SEQ ID NO: 11705 - RNA, 21 nt, Artificial Sequence
  ELANE RNA Guide
cagguguucgccuugcagcgc

SEQ ID NO: 11706 - RNA, 21 nt, Artificial Sequence
  ELANE RNA Guide
ccacccggcagguguucgccu

SEQ ID NO: 11707 - RNA, 21 nt, Artificial Sequence
  ELANE RNA Guide
cccggcagguguucgccuugc

SEQ ID NO: 11708 - RNA, 21 nt, Artificial Sequence
  ELANE RNA Guide
ccggcagguguucgccuugca

SEQ ID NO: 11709 - RNA, 21 nt, Artificial Sequence
  ELANE RNA Guide
ccuugcagcgcaucuucgaaa

SEQ ID NO: 11710 - RNA, 21 nt, Artificial Sequence
  ELANE RNA Guide
cgaagaugcgcugcaaggcga

SEQ ID NO: 11711 - RNA, 21 nt, Artificial Sequence
  ELANE RNA Guide
cgccuugcagcgcaucuucga

SEQ ID NO: 11712 - RNA, 21 nt, Artificial Sequence
  ELANE RNA Guide
cgcugcaaggcgaacaccugc

SEQ ID NO: 11713 - RNA, 21 nt, Artificial Sequence
  ELANE RNA Guide
cggcagguguucgccuugcag

SEQ ID NO: 11714 - RNA, 21 nt, Artificial Sequence
  ELANE RNA Guide
cugcaaggcgaacaccugccg

SEQ ID NO: 11715 - RNA, 21 nt, Artificial Sequence
  ELANE RNA Guide
cuugcagcgcaucuucgaaaa

SEQ ID NO: 11716 - RNA, 21 nt, Artificial Sequence
  ELANE RNA Guide
gaagaugcgcugcaaggcgaa

SEQ ID NO: 11717 - RNA, 21 nt, Artificial Sequence
  ELANE RNA Guide
gaugcgcugcaaggcgaacac

SEQ ID NO: 11718 - RNA, 21 nt, Artificial Sequence
  ELANE RNA Guide
gcaaggcgaacaccugccggg

SEQ ID NO: 11719 - RNA, 21 nt, Artificial Sequence
  ELANE RNA Guide
gcagguguucgccuugcagcg

SEQ ID NO: 11720 - RNA, 21 nt, Artificial Sequence
  ELANE RNA Guide
gccuugcagcgcaucuucgaa

SEQ ID NO: 11721 - RNA, 21 nt, Artificial Sequence
  ELANE RNA Guide
gcgcugcaaggcgaacaccug

SEQ ID NO: 11722 - RNA, 21 nt, Artificial Sequence
  ELANE RNA Guide
gcugcaaggcgaacaccugcc

SEQ ID NO: 11723 - RNA, 21 nt, Artificial Sequence
  ELANE RNA Guide
ggcagguguucgccuugcagc

SEQ ID NO: 11724 - RNA, 21 nt, Artificial Sequence
  ELANE RNA Guide
gguguucgccuugcagcgcau

SEQ ID NO: 11725 - RNA, 21 nt, Artificial Sequence
  ELANE RNA Guide
guguucgccuugcagcgcauc

SEQ ID NO: 11726 - RNA, 21 nt, Artificial Sequence
  ELANE RNA Guide
guucgccuugcagcgcaucuu

SEQ ID NO: 11727 - RNA, 21 nt, Artificial Sequence
  ELANE RNA Guide
guuuucgaagaugcgcugcaa

SEQ ID NO: 11728 - RNA, 21 nt, Artificial Sequence
  ELANE RNA Guide
ucgaagaugcgcugcaaggcg

SEQ ID NO: 11729 - RNA, 21 nt, Artificial Sequence
  ELANE RNA Guide
ucgccuugcagcgcaucuucg

SEQ ID NO: 11730 - RNA, 21 nt, Artificial Sequence
  ELANE RNA Guide
ugcaaggcgaacaccugccgg

SEQ ID NO: 11731 - RNA, 21 nt, Artificial Sequence
  ELANE RNA Guide
ugcgcugcaaggcgaacaccu

SEQ ID NO: 11732 - RNA, 21 nt, Artificial Sequence
  ELANE RNA Guide
uguucgccuugcagcgcaucu

SEQ ID NO: 11733 - RNA, 21 nt, Artificial Sequence
  ELANE RNA Guide
uucgaagaugcgcugcaaggc

SEQ ID NO: 11734 - RNA, 21 nt, Artificial Sequence
  ELANE RNA Guide
uucgccuugcagcgcaucuuc

SEQ ID NO: 11735 - RNA, 21 nt, Artificial Sequence
  ELANE RNA Guide
uuucgaagaugcgcugcaagg

SEQ ID NO: 11736 - RNA, 21 nt, Artificial Sequence
  ELANE RNA Guide
uuuucgaagaugcgcugcaag

SEQ ID NO: 11737 - RNA, 22 nt, Artificial Sequence
  ELANE RNA Guide
aagaugcgcugcaaggcgaaca

SEQ ID NO: 11738 - RNA, 22 nt, Artificial Sequence
  ELANE RNA Guide
aaggcgaacaccugccgggugg

SEQ ID NO: 11739 - RNA, 22 nt, Artificial Sequence
  ELANE RNA Guide
acccggcagguguucgccuugc

SEQ ID NO: 11740 - RNA, 22 nt, Artificial Sequence
  ELANE RNA Guide
agaugcgcugcaaggcgaacac

SEQ ID NO: 11741 - RNA, 22 nt, Artificial Sequence
  ELANE RNA Guide
agguguucgccuugcagcgcau

SEQ ID NO: 11742 - RNA, 22 nt, Artificial Sequence
  ELANE RNA Guide
augcgcugcaaggcgaacaccu

SEQ ID NO: 11743 - RNA, 22 nt, Artificial Sequence
  ELANE RNA Guide
caaggcgaacaccugccgggug

SEQ ID NO: 11744 - RNA, 22 nt, Artificial Sequence
  ELANE RNA Guide
cacccggcagguguucgccuug

SEQ ID NO: 11745 - RNA, 22 nt, Artificial Sequence
  ELANE RNA Guide
cagguguucgccuugcagcgca

SEQ ID NO: 11746 - RNA, 22 nt, Artificial Sequence
  ELANE RNA Guide
ccacccggcagguguucgccuu

SEQ ID NO: 11747 - RNA, 22 nt, Artificial Sequence
  ELANE RNA Guide
cccacccggcagguguucgccu

SEQ ID NO: 11748 - RNA, 22 nt, Artificial Sequence
  ELANE RNA Guide
cccggcagguguucgccuugca

SEQ ID NO: 11749 - RNA, 22 nt, Artificial Sequence
  ELANE RNA Guide
ccggcagguguucgccuugcag

SEQ ID NO: 11750 - RNA, 22 nt, Artificial Sequence
  ELANE RNA Guide
ccuugcagcgcaucuucgaaaa

SEQ ID NO: 11751 - RNA, 22 nt, Artificial Sequence
  ELANE RNA Guide
cgaagaugcgcugcaaggcgaa

SEQ ID NO: 11752 - RNA, 22 nt, Artificial Sequence
  ELANE RNA Guide
cgccuugcagcgcaucuucgaa

SEQ ID NO: 11753 - RNA, 22 nt, Artificial Sequence
  ELANE RNA Guide
cgcugcaaggcgaacaccugcc

SEQ ID NO: 11754 - RNA, 22 nt, Artificial Sequence
  ELANE RNA Guide
cggcagguguucgccuugcagc

SEQ ID NO: 11755 - RNA, 22 nt, Artificial Sequence
  ELANE RNA Guide
cguuuucgaagaugcgcugcaa

SEQ ID NO: 11756 - RNA, 22 nt, Artificial Sequence
  ELANE RNA Guide
cugcaaggcgaacaccugccgg

SEQ ID NO: 11757 - RNA, 22 nt, Artificial Sequence
  ELANE RNA Guide
cuugcagcgcaucuucgaaaac

SEQ ID NO: 11758 - RNA, 22 nt, Artificial Sequence
  ELANE RNA Guide
gaagaugcgcugcaaggcgaac

SEQ ID NO: 11759 - RNA, 22 nt, Artificial Sequence
  ELANE RNA Guide
gaugcgcugcaaggcgaacacc

SEQ ID NO: 11760 - RNA, 22 nt, Artificial Sequence
  ELANE RNA Guide
gcaaggcgaacaccugccgggu

SEQ ID NO: 11761 - RNA, 22 nt, Artificial Sequence
  ELANE RNA Guide
gcagguguucgccuugcagcgc

SEQ ID NO: 11762 - RNA, 22 nt, Artificial Sequence
  ELANE RNA Guide
gccuugcagcgcaucuucgaaa

SEQ ID NO: 11763 - RNA, 22 nt, Artificial Sequence
  ELANE RNA Guide
gcgcugcaaggcgaacaccugc

SEQ ID NO: 11764 - RNA, 22 nt, Artificial Sequence
  ELANE RNA Guide
gcugcaaggcgaacaccugccg

SEQ ID NO: 11765 - RNA, 22 nt, Artificial Sequence
  ELANE RNA Guide
ggcagguguucgccuugcagcg

SEQ ID NO: 11766 - RNA, 22 nt, Artificial Sequence
  ELANE RNA Guide
gguguucgccuugcagcgcauc

SEQ ID NO: 11767 - RNA, 22 nt, Artificial Sequence
  ELANE RNA Guide
guguucgccuugcagcgcaucu

SEQ ID NO: 11768 - RNA, 22 nt, Artificial Sequence
  ELANE RNA Guide
guucgccuugcagcgcaucuuc

SEQ ID NO: 11769 - RNA, 22 nt, Artificial Sequence
  ELANE RNA Guide
guuuucgaagaugcgcugcaag

SEQ ID NO: 11770 - RNA, 22 nt, Artificial Sequence
  ELANE RNA Guide
ucgaagaugcgcugcaaggcga

SEQ ID NO: 11771 - RNA, 22 nt, Artificial Sequence
  ELANE RNA Guide
ucgccuugcagcgcaucuucga

SEQ ID NO: 11772 - RNA, 22 nt, Artificial Sequence
  ELANE RNA Guide
ugcaaggcgaacaccugccggg

SEQ ID NO: 11773 - RNA, 22 nt, Artificial Sequence
  ELANE RNA Guide
ugcgcugcaaggcgaacaccug

SEQ ID NO: 11774 - RNA, 22 nt, Artificial Sequence
  ELANE RNA Guide
uguucgccuugcagcgcaucuu

SEQ ID NO: 11775 - RNA, 22 nt, Artificial Sequence
  ELANE RNA Guide
uucgaagaugcgcugcaaggcg

SEQ ID NO: 11776 - RNA, 22 nt, Artificial Sequence
  ELANE RNA Guide
uucgccuugcagcgcaucuucg

SEQ ID NO: 11777 - RNA, 22 nt, Artificial Sequence
  ELANE RNA Guide
uuucgaagaugcgcugcaaggc

SEQ ID NO: 11778 - RNA, 22 nt, Artificial Sequence
  ELANE RNA Guide
uuuucgaagaugcgcugcaagg

SEQ ID NO: 11779 - RNA, 20 nt, Artificial Sequence
  ELANE RNA Guide
aagaugcgcggcacggcgaa

SEQ ID NO: 11780 - RNA, 20 nt, Artificial Sequence
  ELANE RNA Guide
acccggcagguguucgccgu

SEQ ID NO: 11781 - RNA, 20 nt, Artificial Sequence
  ELANE RNA Guide
agaugcgcggcacggcgaac

SEQ ID NO: 11782 - RNA, 20 nt, Artificial Sequence
  ELANE RNA Guide
agccguuuucgaagaugcgc

SEQ ID NO: 11783 - RNA, 20 nt, Artificial Sequence
  ELANE RNA Guide
agguguucgccgugccgcgc

SEQ ID NO: 11784 - RNA, 20 nt, Artificial Sequence
  ELANE RNA Guide
augcgcggcacggcgaacac

SEQ ID NO: 11785 - RNA, 20 nt, Artificial Sequence
  ELANE RNA Guide
cacccggcagguguucgccg

SEQ ID NO: 11786 - RNA, 20 nt, Artificial Sequence
  ELANE RNA Guide
cagguguucgccgugccgcg

SEQ ID NO: 11787 - RNA, 20 nt, Artificial Sequence
  ELANE RNA Guide
cccggcagguguucgccgug

SEQ ID NO: 11788 - RNA, 20 nt, Artificial Sequence
  ELANE RNA Guide
ccgcgcaucuucgaaaacgg

SEQ ID NO: 11789 - RNA, 20 nt, Artificial Sequence
  ELANE RNA Guide
ccggcagguguucgccgugc

SEQ ID NO: 11790 - RNA, 20 nt, Artificial Sequence
  ELANE RNA Guide
ccgugccgcgcaucuucgaa

SEQ ID NO: 11791 - RNA, 20 nt, Artificial Sequence
  ELANE RNA Guide
ccguuuucgaagaugcgcgg

SEQ ID NO: 11792 - RNA, 20 nt, Artificial Sequence
  ELANE RNA Guide
cgaagaugcgcggcacggcg

SEQ ID NO: 11793 - RNA, 20 nt, Artificial Sequence
  ELANE RNA Guide
cgccgugccgcgcaucuucg

SEQ ID NO: 11794 - RNA, 20 nt, Artificial Sequence
  ELANE RNA Guide
cgcggcacggcgaacaccug

SEQ ID NO: 11795 - RNA, 20 nt, Artificial Sequence
  ELANE RNA Guide
cggcacggcgaacaccugcc

SEQ ID NO: 11796 - RNA, 20 nt, Artificial Sequence
  ELANE RNA Guide
cggcagguguucgccgugcc

SEQ ID NO: 11797 - RNA, 20 nt, Artificial Sequence
  ELANE RNA Guide
cguagccguuuucgaagaug

SEQ ID NO: 11798 - RNA, 20 nt, Artificial Sequence
  ELANE RNA Guide
cgugccgcgcaucuucgaaa

SEQ ID NO: 11799 - RNA, 20 nt, Artificial Sequence
  ELANE RNA Guide
cguuuucgaagaugcgcggc

SEQ ID NO: 11800 - RNA, 20 nt, Artificial Sequence
  ELANE RNA Guide
gaagaugcgcggcacggcga

SEQ ID NO: 11801 - RNA, 20 nt, Artificial Sequence
  ELANE RNA Guide
gaugcgcggcacggcgaaca

SEQ ID NO: 11802 - RNA, 20 nt, Artificial Sequence
  ELANE RNA Guide
gcagguguucgccgugccgc

SEQ ID NO: 11803 - RNA, 20 nt, Artificial Sequence
  ELANE RNA Guide
gccgcgcaucuucgaaaacg

SEQ ID NO: 11804 - RNA, 20 nt, Artificial Sequence
  ELANE RNA Guide
gccgugccgcgcaucuucga

SEQ ID NO: 11805 - RNA, 20 nt, Artificial Sequence
  ELANE RNA Guide
gccguuuucgaagaugcgcg

SEQ ID NO: 11806 - RNA, 20 nt, Artificial Sequence
  ELANE RNA Guide
gcgcggcacggcgaacaccu

SEQ ID NO: 11807 - RNA, 20 nt, Artificial Sequence
  ELANE RNA Guide
gcggcacggcgaacaccugc

SEQ ID NO: 11808 - RNA, 20 nt, Artificial Sequence
  ELANE RNA Guide
ggcagguguucgccgugccg

SEQ ID NO: 11809 - RNA, 20 nt, Artificial Sequence
  ELANE RNA Guide
gguguucgccgugccgcgca

SEQ ID NO: 11810 - RNA, 20 nt, Artificial Sequence
  ELANE RNA Guide
guagccguuuucgaagaugc

SEQ ID NO: 11811 - RNA, 20 nt, Artificial Sequence
  ELANE RNA Guide
gugccgcgcaucuucgaaaa

SEQ ID NO: 11812 - RNA, 20 nt, Artificial Sequence
  ELANE RNA Guide
guguucgccgugccgcgcau

SEQ ID NO: 11813 - RNA, 20 nt, Artificial Sequence
  ELANE RNA Guide
guucgccgugccgcgcaucu

SEQ ID NO: 11814 - RNA, 20 nt, Artificial Sequence
  ELANE RNA Guide
guuuucgaagaugcgcggca

SEQ ID NO: 11815 - RNA, 20 nt, Artificial Sequence
  ELANE RNA Guide
uagccguuuucgaagaugcg

SEQ ID NO: 11816 - RNA, 20 nt, Artificial Sequence
  ELANE RNA Guide
ucgaagaugcgcggcacggc

SEQ ID NO: 11817 - RNA, 20 nt, Artificial Sequence
  ELANE RNA Guide
ucgccgugccgcgcaucuuc

SEQ ID NO: 11818 - RNA, 20 nt, Artificial Sequence
  ELANE RNA Guide
ugccgcgcaucuucgaaaac

SEQ ID NO: 11819 - RNA, 20 nt, Artificial Sequence
  ELANE RNA Guide
ugcgcggcacggcgaacacc

SEQ ID NO: 11820 - RNA, 20 nt, Artificial Sequence
  ELANE RNA Guide
uguucgccgugccgcgcauc

SEQ ID NO: 11821 - RNA, 20 nt, Artificial Sequence
  ELANE RNA Guide
uucgaagaugcgcggcacgg

SEQ ID NO: 11822 - RNA, 20 nt, Artificial Sequence
  ELANE RNA Guide
uucgccgugccgcgcaucuu

SEQ ID NO: 11823 - RNA, 20 nt, Artificial Sequence
  ELANE RNA Guide
uuucgaagaugcgcggcacg

SEQ ID NO: 11824 - RNA, 20 nt, Artificial Sequence
  ELANE RNA Guide
uuuucgaagaugcgcggcac

SEQ ID NO: 11825 - RNA, 21 nt, Artificial Sequence
  ELANE RNA Guide
aagaugcgcggcacggcgaac

SEQ ID NO: 11826 - RNA, 21 nt, Artificial Sequence
  ELANE RNA Guide
acccggcagguguucgccgug

SEQ ID NO: 11827 - RNA, 21 nt, Artificial Sequence
  ELANE RNA Guide
agaugcgcggcacggcgaaca

SEQ ID NO: 11828 - RNA, 21 nt, Artificial Sequence
  ELANE RNA Guide
agccguuuucgaagaugcgcg

SEQ ID NO: 11829 - RNA, 21 nt, Artificial Sequence
  ELANE RNA Guide
agguguucgccgugccgcgca

SEQ ID NO: 11830 - RNA, 21 nt, Artificial Sequence
  ELANE RNA Guide
augcgcggcacggcgaacacc

SEQ ID NO: 11831 - RNA, 21 nt, Artificial Sequence
  ELANE RNA Guide
cacccggcagguguucgccgu

SEQ ID NO: 11832 - RNA, 21 nt, Artificial Sequence
  ELANE RNA Guide
cagguguucgccgugccgcgc

SEQ ID NO: 11833 - RNA, 21 nt, Artificial Sequence
  ELANE RNA Guide
ccacccggcagguguucgccg

SEQ ID NO: 11834 - RNA, 21 nt, Artificial Sequence
  ELANE RNA Guide
cccggcagguguucgccgugc

SEQ ID NO: 11835 - RNA, 21 nt, Artificial Sequence
  ELANE RNA Guide
ccgcgcaucuucgaaaacggc

SEQ ID NO: 11836 - RNA, 21 nt, Artificial Sequence
  ELANE RNA Guide
ccggcagguguucgccgugcc

SEQ ID NO: 11837 - RNA, 21 nt, Artificial Sequence
  ELANE RNA Guide
ccgugccgcgcaucuucgaaa

SEQ ID NO: 11838 - RNA, 21 nt, Artificial Sequence
  ELANE RNA Guide
ccguuuucgaagaugcgcggc

SEQ ID NO: 11839 - RNA, 21 nt, Artificial Sequence
  ELANE RNA Guide
cgaagaugcgcggcacggcga

SEQ ID NO: 11840 - RNA, 21 nt, Artificial Sequence
  ELANE RNA Guide
cgccgugccgcgcaucuucga

SEQ ID NO: 11841 - RNA, 21 nt, Artificial Sequence
  ELANE RNA Guide
cgcggcacggcgaacaccugc

SEQ ID NO: 11842 - RNA, 21 nt, Artificial Sequence
  ELANE RNA Guide
cggcacggcgaacaccugccg

SEQ ID NO: 11843 - RNA, 21 nt, Artificial Sequence
  ELANE RNA Guide
cggcagguguucgccgugccg

SEQ ID NO: 11844 - RNA, 21 nt, Artificial Sequence
  ELANE RNA Guide
cguagccguuuucgaagaugc

SEQ ID NO: 11845 - RNA, 21 nt, Artificial Sequence
  ELANE RNA Guide
cgugccgcgcaucuucgaaaa

SEQ ID NO: 11846 - RNA, 21 nt, Artificial Sequence
  ELANE RNA Guide
cguuuucgaagaugcgcggca

SEQ ID NO: 11847 - RNA, 21 nt, Artificial Sequence
  ELANE RNA Guide
gaagaugcgcggcacggcgaa

SEQ ID NO: 11848 - RNA, 21 nt, Artificial Sequence
  ELANE RNA Guide
gaugcgcggcacggcgaacac

SEQ ID NO: 11849 - RNA, 21 nt, Artificial Sequence
  ELANE RNA Guide
gcagguguucgccgugccgcg

SEQ ID NO: 11850 - RNA, 21 nt, Artificial Sequence
  ELANE RNA Guide
gccgcgcaucuucgaaaacgg

SEQ ID NO: 11851 - RNA, 21 nt, Artificial Sequence
  ELANE RNA Guide
gccgugccgcgcaucuucgaa

SEQ ID NO: 11852 - RNA, 21 nt, Artificial Sequence
  ELANE RNA Guide
gccguuuucgaagaugcgcgg

SEQ ID NO: 11853 - RNA, 21 nt, Artificial Sequence
  ELANE RNA Guide
gcgcggcacggcgaacaccug

SEQ ID NO: 11854 - RNA, 21 nt, Artificial Sequence
  ELANE RNA Guide
gcggcacggcgaacaccugcc

SEQ ID NO: 11855 - RNA, 21 nt, Artificial Sequence
  ELANE RNA Guide
ggcagguguucgccgugccgc

SEQ ID NO: 11856 - RNA, 21 nt, Artificial Sequence
  ELANE RNA Guide
gguguucgccgugccgcgcau

SEQ ID NO: 11857 - RNA, 21 nt, Artificial Sequence
  ELANE RNA Guide
guagccguuuucgaagaugcg

SEQ ID NO: 11858 - RNA, 21 nt, Artificial Sequence
  ELANE RNA Guide
gugccgcgcaucuucgaaaac

SEQ ID NO: 11859 - RNA, 21 nt, Artificial Sequence
  ELANE RNA Guide
guguucgccgugccgcgcauc

SEQ ID NO: 11860 - RNA, 21 nt, Artificial Sequence
  ELANE RNA Guide
guucgccgugccgcgcaucuu

SEQ ID NO: 11861 - RNA, 21 nt, Artificial Sequence
  ELANE RNA Guide
guuuucgaagaugcgcggcac

SEQ ID NO: 11862 - RNA, 21 nt, Artificial Sequence
  ELANE RNA Guide
uagccguuuucgaagaugcgc

SEQ ID NO: 11863 - RNA, 21 nt, Artificial Sequence
  ELANE RNA Guide
ucgaagaugcgcggcacggcg

SEQ ID NO: 11864 - RNA, 21 nt, Artificial Sequence
  ELANE RNA Guide
ucgccgugccgcgcaucuucg

SEQ ID NO: 11865 - RNA, 21 nt, Artificial Sequence
  ELANE RNA Guide
ucguagccguuuucgaagaug

SEQ ID NO: 11866 - RNA, 21 nt, Artificial Sequence
  ELANE RNA Guide
ugccgcgcaucuucgaaaacg

SEQ ID NO: 11867 - RNA, 21 nt, Artificial Sequence
  ELANE RNA Guide
ugcgcggcacggcgaacaccu

SEQ ID NO: 11868 - RNA, 21 nt, Artificial Sequence
  ELANE RNA Guide
uguucgccgugccgcgcaucu

SEQ ID NO: 11869 - RNA, 21 nt, Artificial Sequence
  ELANE RNA Guide
uucgaagaugcgcggcacggc

SEQ ID NO: 11870 - RNA, 21 nt, Artificial Sequence
  ELANE RNA Guide
uucgccgugccgcgcaucuuc

SEQ ID NO: 11871 - RNA, 21 nt, Artificial Sequence
  ELANE RNA Guide
uuucgaagaugcgcggcacgg

SEQ ID NO: 11872 - RNA, 21 nt, Artificial Sequence
  ELANE RNA Guide
uuuucgaagaugcgcggcacg

SEQ ID NO: 11873 - RNA, 22 nt, Artificial Sequence
  ELANE RNA Guide
aagaugcgcggcacggcgaaca

SEQ ID NO: 11874 - RNA, 22 nt, Artificial Sequence
  ELANE RNA Guide
acccggcagguguucgccgugc

SEQ ID NO: 11875 - RNA, 22 nt, Artificial Sequence
  ELANE RNA Guide
agaugcgcggcacggcgaacac

SEQ ID NO: 11876 - RNA, 22 nt, Artificial Sequence
  ELANE RNA Guide
agccguuuucgaagaugcgcgg

SEQ ID NO: 11877 - RNA, 22 nt, Artificial Sequence
  ELANE RNA Guide
agguguucgccgugccgcgcau

SEQ ID NO: 11878 - RNA, 22 nt, Artificial Sequence
  ELANE RNA Guide
augcgcggcacggcgaacaccu

SEQ ID NO: 11879 - RNA, 22 nt, Artificial Sequence
  ELANE RNA Guide
cacccggcagguguucgccgug

SEQ ID NO: 11880 - RNA, 22 nt, Artificial Sequence
  ELANE RNA Guide
cagguguucgccgugccgcgca

SEQ ID NO: 11881 - RNA, 22 nt, Artificial Sequence
  ELANE RNA Guide
ccacccggcagguguucgccgu

SEQ ID NO: 11882 - RNA, 22 nt, Artificial Sequence
  ELANE RNA Guide
cccacccggcagguguucgccg

SEQ ID NO: 11883 - RNA, 22 nt, Artificial Sequence
  ELANE RNA Guide
cccggcagguguucgccgugcc

SEQ ID NO: 11884 - RNA, 22 nt, Artificial Sequence
  ELANE RNA Guide
ccgcgcaucuucgaaaacggcu

SEQ ID NO: 11885 - RNA, 22 nt, Artificial Sequence
  ELANE RNA Guide
ccggcagguguucgccgugccg

SEQ ID NO: 11886 - RNA, 22 nt, Artificial Sequence
  ELANE RNA Guide
ccgugccgcgcaucuucgaaaa

SEQ ID NO: 11887 - RNA, 22 nt, Artificial Sequence
  ELANE RNA Guide
ccguuuucgaagaugcgcggca

SEQ ID NO: 11888 - RNA, 22 nt, Artificial Sequence
  ELANE RNA Guide
cgaagaugcgcggcacggcgaa

SEQ ID NO: 11889 - RNA, 22 nt, Artificial Sequence
  ELANE RNA Guide
cgccgugccgcgcaucuucgaa

SEQ ID NO: 11890 - RNA, 22 nt, Artificial Sequence
  ELANE RNA Guide
cgcggcacggcgaacaccugcc

SEQ ID NO: 11891 - RNA, 22 nt, Artificial Sequence
  ELANE RNA Guide
cggcacggcgaacaccugccgg

SEQ ID NO: 11892 - RNA, 22 nt, Artificial Sequence
  ELANE RNA Guide
cggcagguguucgccgugccgc

SEQ ID NO: 11893 - RNA, 22 nt, Artificial Sequence
  ELANE RNA Guide
cguagccguuuucgaagaugcg

SEQ ID NO: 11894 - RNA, 22 nt, Artificial Sequence
  ELANE RNA Guide
cgugccgcgcaucuucgaaaac

SEQ ID NO: 11895 - RNA, 22 nt, Artificial Sequence
  ELANE RNA Guide
cguuuucgaagaugcgcggcac

SEQ ID NO: 11896 - RNA, 22 nt, Artificial Sequence
  ELANE RNA Guide
gaagaugcgcggcacggcgaac

SEQ ID NO: 11897 - RNA, 22 nt, Artificial Sequence
  ELANE RNA Guide
gaugcgcggcacggcgaacacc

SEQ ID NO: 11898 - RNA, 22 nt, Artificial Sequence
  ELANE RNA Guide
gcagguguucgccgugccgcgc

SEQ ID NO: 11899 - RNA, 22 nt, Artificial Sequence
  ELANE RNA Guide
gccgcgcaucuucgaaaacggc

SEQ ID NO: 11900 - RNA, 22 nt, Artificial Sequence
  ELANE RNA Guide
gccgugccgcgcaucuucgaaa

SEQ ID NO: 11901 - RNA, 22 nt, Artificial Sequence
  ELANE RNA Guide
gccguuuucgaagaugcgcggc

SEQ ID NO: 11902 - RNA, 22 nt, Artificial Sequence
  ELANE RNA Guide
gcgcggcacggcgaacaccugc

SEQ ID NO: 11903 - RNA, 22 nt, Artificial Sequence
  ELANE RNA Guide
gcggcacggcgaacaccugccg

SEQ ID NO: 11904 - RNA, 22 nt, Artificial Sequence
  ELANE RNA Guide
ggcagguguucgccgugccgcg

SEQ ID NO: 11905 - RNA, 22 nt, Artificial Sequence
  ELANE RNA Guide
gguguucgccgugccgcgcauc

SEQ ID NO: 11906 - RNA, 22 nt, Artificial Sequence
  ELANE RNA Guide
guagccguuuucgaagaugcgc

SEQ ID NO: 11907 - RNA, 22 nt, Artificial Sequence
  ELANE RNA Guide
gucguagccguuuucgaagaug

SEQ ID NO: 11908 - RNA, 22 nt, Artificial Sequence
  ELANE RNA Guide
gugccgcgcaucuucgaaaacg

SEQ ID NO: 11909 - RNA, 22 nt, Artificial Sequence
  ELANE RNA Guide
guguucgccgugccgcgcaucu

SEQ ID NO: 11910 - RNA, 22 nt, Artificial Sequence
  ELANE RNA Guide
guucgccgugccgcgcaucuuc

SEQ ID NO: 11911 - RNA, 22 nt, Artificial Sequence
  ELANE RNA Guide
guuuucgaagaugcgcggcacg

SEQ ID NO: 11912 - RNA, 22 nt, Artificial Sequence
  ELANE RNA Guide
uagccguuuucgaagaugcgcg

SEQ ID NO: 11913 - RNA, 22 nt, Artificial Sequence
  ELANE RNA Guide
ucgaagaugcgcggcacggcga

SEQ ID NO: 11914 - RNA, 22 nt, Artificial Sequence
  ELANE RNA Guide
ucgccgugccgcgcaucuucga

SEQ ID NO: 11915 - RNA, 22 nt, Artificial Sequence
  ELANE RNA Guide
ucguagccguuuucgaagaugc

SEQ ID NO: 11916 - RNA, 22 nt, Artificial Sequence
  ELANE RNA Guide
ugccgcgcaucuucgaaaacgg

SEQ ID NO: 11917 - RNA, 22 nt, Artificial Sequence
  ELANE RNA Guide
ugcgcggcacggcgaacaccug

SEQ ID NO: 11918 - RNA, 22 nt, Artificial Sequence
  ELANE RNA Guide
uguucgccgugccgcgcaucuu

SEQ ID NO: 11919 - RNA, 22 nt, Artificial Sequence
  ELANE RNA Guide
uucgaagaugcgcggcacggcg

SEQ ID NO: 11920 - RNA, 22 nt, Artificial Sequence
  ELANE RNA Guide
uucgccgugccgcgcaucuucg

SEQ ID NO: 11921 - RNA, 22 nt, Artificial Sequence
  ELANE RNA Guide
uuucgaagaugcgcggcacggc

SEQ ID NO: 11922 - RNA, 22 nt, Artificial Sequence
  ELANE RNA Guide
uuuucgaagaugcgcggcacgg

SEQ ID NO: 11923 - RNA, 20 nt, Artificial Sequence
  ELANE RNA Guide
aagaugggcugcacggcgaa

SEQ ID NO: 11924 - RNA, 20 nt, Artificial Sequence
  ELANE RNA Guide
agaugggcugcacggcgaac

SEQ ID NO: 11925 - RNA, 20 nt, Artificial Sequence
  ELANE RNA Guide
agcccaucuucgaaaacggc

SEQ ID NO: 11926 - RNA, 20 nt, Artificial Sequence
  ELANE RNA Guide
agccguuuucgaagaugggc

SEQ ID NO: 11927 - RNA, 20 nt, Artificial Sequence
  ELANE RNA Guide
agguguucgccgugcagccc

SEQ ID NO: 11928 - RNA, 20 nt, Artificial Sequence
  ELANE RNA Guide
augggcugcacggcgaacac

SEQ ID NO: 11929 - RNA, 20 nt, Artificial Sequence
  ELANE RNA Guide
cagcccaucuucgaaaacgg

SEQ ID NO: 11930 - RNA, 20 nt, Artificial Sequence
  ELANE RNA Guide
cagguguucgccgugcagcc

SEQ ID NO: 11931 - RNA, 20 nt, Artificial Sequence
  ELANE RNA Guide
cccaucuucgaaaacggcua

SEQ ID NO: 11932 - RNA, 20 nt, Artificial Sequence
  ELANE RNA Guide
ccgugcagcccaucuucgaa

SEQ ID NO: 11933 - RNA, 20 nt, Artificial Sequence
  ELANE RNA Guide
ccguuuucgaagaugggcug

SEQ ID NO: 11934 - RNA, 20 nt, Artificial Sequence
  ELANE RNA Guide
cgaagaugggcugcacggcg

SEQ ID NO: 11935 - RNA, 20 nt, Artificial Sequence
  ELANE RNA Guide
cgccgugcagcccaucuucg

SEQ ID NO: 11936 - RNA, 20 nt, Artificial Sequence
  ELANE RNA Guide
cggcagguguucgccgugca

SEQ ID NO: 11937 - RNA, 20 nt, Artificial Sequence
  ELANE RNA Guide
cgugcagcccaucuucgaaa

SEQ ID NO: 11938 - RNA, 20 nt, Artificial Sequence
  ELANE RNA Guide
cguuuucgaagaugggcugc

SEQ ID NO: 11939 - RNA, 20 nt, Artificial Sequence
  ELANE RNA Guide
gaagaugggcugcacggcga

SEQ ID NO: 11940 - RNA, 20 nt, Artificial Sequence
  ELANE RNA Guide
gaugggcugcacggcgaaca

SEQ ID NO: 11941 - RNA, 20 nt, Artificial Sequence
  ELANE RNA Guide
gcagcccaucuucgaaaacg

SEQ ID NO: 11942 - RNA, 20 nt, Artificial Sequence
  ELANE RNA Guide
gcagguguucgccgugcagc

SEQ ID NO: 11943 - RNA, 20 nt, Artificial Sequence
  ELANE RNA Guide
gcccaucuucgaaaacggcu

SEQ ID NO: 11944 - RNA, 20 nt, Artificial Sequence
  ELANE RNA Guide
gccgugcagcccaucuucga

SEQ ID NO: 11945 - RNA, 20 nt, Artificial Sequence
  ELANE RNA Guide
gccguuuucgaagaugggcu

SEQ ID NO: 11946 - RNA, 20 nt, Artificial Sequence
  ELANE RNA Guide
ggcagguguucgccgugcag

SEQ ID NO: 11947 - RNA, 20 nt, Artificial Sequence
  ELANE RNA Guide
gggcugcacggcgaacaccu

SEQ ID NO: 11948 - RNA, 20 nt, Artificial Sequence
  ELANE RNA Guide
ggucguagccguuuucgaag

SEQ ID NO: 11949 - RNA, 20 nt, Artificial Sequence
  ELANE RNA Guide
gguguucgccgugcagccca

SEQ ID NO: 11950 - RNA, 20 nt, Artificial Sequence
  ELANE RNA Guide
guagccguuuucgaagaugg

SEQ ID NO: 11951 - RNA, 20 nt, Artificial Sequence
  ELANE RNA Guide
gucguagccguuuucgaaga

SEQ ID NO: 11952 - RNA, 20 nt, Artificial Sequence
  ELANE RNA Guide
gugcagcccaucuucgaaaa

SEQ ID NO: 11953 - RNA, 20 nt, Artificial Sequence
  ELANE RNA Guide
guguucgccgugcagcccau

SEQ ID NO: 11954 - RNA, 20 nt, Artificial Sequence
  ELANE RNA Guide
guucgccgugcagcccaucu

SEQ ID NO: 11955 - RNA, 20 nt, Artificial Sequence
  ELANE RNA Guide
guuuucgaagaugggcugca

SEQ ID NO: 11956 - RNA, 20 nt, Artificial Sequence
  ELANE RNA Guide
uagccguuuucgaagauggg

SEQ ID NO: 11957 - RNA, 20 nt, Artificial Sequence
  ELANE RNA Guide
ucgaagaugggcugcacggc

SEQ ID NO: 11958 - RNA, 20 nt, Artificial Sequence
  ELANE RNA Guide
ucgccgugcagcccaucuuc

SEQ ID NO: 11959 - RNA, 20 nt, Artificial Sequence
  ELANE RNA Guide
ucguagccguuuucgaagau

SEQ ID NO: 11960 - RNA, 20 nt, Artificial Sequence
  ELANE RNA Guide
ugcagcccaucuucgaaaac

SEQ ID NO: 11961 - RNA, 20 nt, Artificial Sequence
  ELANE RNA Guide
ugggcugcacggcgaacacc

SEQ ID NO: 11962 - RNA, 20 nt, Artificial Sequence
  ELANE RNA Guide
uguucgccgugcagcccauc

SEQ ID NO: 11963 - RNA, 20 nt, Artificial Sequence
  ELANE RNA Guide
uucgaagaugggcugcacgg

SEQ ID NO: 11964 - RNA, 20 nt, Artificial Sequence
  ELANE RNA Guide
uucgccgugcagcccaucuu

SEQ ID NO: 11965 - RNA, 20 nt, Artificial Sequence
  ELANE RNA Guide
uuucgaagaugggcugcacg

SEQ ID NO: 11966 - RNA, 20 nt, Artificial Sequence
  ELANE RNA Guide
uuuucgaagaugggcugcac

SEQ ID NO: 11967 - RNA, 21 nt, Artificial Sequence
  ELANE RNA Guide
aagaugggcugcacggcgaac

SEQ ID NO: 11968 - RNA, 21 nt, Artificial Sequence
  ELANE RNA Guide
agaugggcugcacggcgaaca

SEQ ID NO: 11969 - RNA, 21 nt, Artificial Sequence
  ELANE RNA Guide
agcccaucuucgaaaacggcu

SEQ ID NO: 11970 - RNA, 21 nt, Artificial Sequence
  ELANE RNA Guide
agccguuuucgaagaugggcu

SEQ ID NO: 11971 - RNA, 21 nt, Artificial Sequence
  ELANE RNA Guide
agguguucgccgugcagccca

SEQ ID NO: 11972 - RNA, 21 nt, Artificial Sequence
  ELANE RNA Guide
augggcugcacggcgaacacc

SEQ ID NO: 11973 - RNA, 21 nt, Artificial Sequence
  ELANE RNA Guide
cagcccaucuucgaaaacggc

SEQ ID NO: 11974 - RNA, 21 nt, Artificial Sequence
  ELANE RNA Guide
cagguguucgccgugcagccc

SEQ ID NO: 11975 - RNA, 21 nt, Artificial Sequence
  ELANE RNA Guide
cccaucuucgaaaacggcuac

SEQ ID NO: 11976 - RNA, 21 nt, Artificial Sequence
  ELANE RNA Guide
ccggcagguguucgccgugca

SEQ ID NO: 11977 - RNA, 21 nt, Artificial Sequence
  ELANE RNA Guide
ccgugcagcccaucuucgaaa

SEQ ID NO: 11978 - RNA, 21 nt, Artificial Sequence
  ELANE RNA Guide
ccguuuucgaagaugggcugc

SEQ ID NO: 11979 - RNA, 21 nt, Artificial Sequence
  ELANE RNA Guide
cgaagaugggcugcacggcga

SEQ ID NO: 11980 - RNA, 21 nt, Artificial Sequence
  ELANE RNA Guide
cgccgugcagcccaucuucga

SEQ ID NO: 11981 - RNA, 21 nt, Artificial Sequence
  ELANE RNA Guide
cggcagguguucgccgugcag

SEQ ID NO: 11982 - RNA, 21 nt, Artificial Sequence
  ELANE RNA Guide
cguagccguuuucgaagaugg

SEQ ID NO: 11983 - RNA, 21 nt, Artificial Sequence
  ELANE RNA Guide
cgugcagcccaucuucgaaaa

SEQ ID NO: 11984 - RNA, 21 nt, Artificial Sequence
  ELANE RNA Guide
cguuuucgaagaugggcugca

SEQ ID NO: 11985 - RNA, 21 nt, Artificial Sequence
  ELANE RNA Guide
gaagaugggcugcacggcgaa

SEQ ID NO: 11986 - RNA, 21 nt, Artificial Sequence
  ELANE RNA Guide
gaugggcugcacggcgaacac

SEQ ID NO: 11987 - RNA, 21 nt, Artificial Sequence
  ELANE RNA Guide
gcagcccaucuucgaaaacgg

SEQ ID NO: 11988 - RNA, 21 nt, Artificial Sequence
  ELANE RNA Guide
gcagguguucgccgugcagcc

SEQ ID NO: 11989 - RNA, 21 nt, Artificial Sequence
  ELANE RNA Guide
gcccaucuucgaaaacggcua

SEQ ID NO: 11990 - RNA, 21 nt, Artificial Sequence
  ELANE RNA Guide
gccgugcagcccaucuucgaa

SEQ ID NO: 11991 - RNA, 21 nt, Artificial Sequence
  ELANE RNA Guide
gccguuuucgaagaugggcug

SEQ ID NO: 11992 - RNA, 21 nt, Artificial Sequence
  ELANE RNA Guide
ggcagguguucgccgugcagc

SEQ ID NO: 11993 - RNA, 21 nt, Artificial Sequence
  ELANE RNA Guide
gggcugcacggcgaacaccug

SEQ ID NO: 11994 - RNA, 21 nt, Artificial Sequence
  ELANE RNA Guide
gggucguagccguuuucgaag

SEQ ID NO: 11995 - RNA, 21 nt, Artificial Sequence
  ELANE RNA Guide
ggucguagccguuuucgaaga

SEQ ID NO: 11996 - RNA, 21 nt, Artificial Sequence
  ELANE RNA Guide
gguguucgccgugcagcccau

SEQ ID NO: 11997 - RNA, 21 nt, Artificial Sequence
  ELANE RNA Guide
guagccguuuucgaagauggg

SEQ ID NO: 11998 - RNA, 21 nt, Artificial Sequence
  ELANE RNA Guide
gucguagccguuuucgaagau

SEQ ID NO: 11999 - RNA, 21 nt, Artificial Sequence
  ELANE RNA Guide
gugcagcccaucuucgaaaac

SEQ ID NO: 12000 - RNA, 21 nt, Artificial Sequence
  ELANE RNA Guide
guguucgccgugcagcccauc

SEQ ID NO: 12001 - RNA, 21 nt, Artificial Sequence
  ELANE RNA Guide
guucgccgugcagcccaucuu

SEQ ID NO: 12002 - RNA, 21 nt, Artificial Sequence
  ELANE RNA Guide
guuuucgaagaugggcugcac

SEQ ID NO: 12003 - RNA, 21 nt, Artificial Sequence
  ELANE RNA Guide
uagccguuuucgaagaugggc

SEQ ID NO: 12004 - RNA, 21 nt, Artificial Sequence
  ELANE RNA Guide
ucgaagaugggcugcacggcg

SEQ ID NO: 12005 - RNA, 21 nt, Artificial Sequence
  ELANE RNA Guide
ucgccgugcagcccaucuucg

SEQ ID NO: 12006 - RNA, 21 nt, Artificial Sequence
  ELANE RNA Guide
ugcagcccaucuucgaaaacg

SEQ ID NO: 12007 - RNA, 21 nt, Artificial Sequence
  ELANE RNA Guide
ugggcugcacggcgaacaccu

SEQ ID NO: 12008 - RNA, 21 nt, Artificial Sequence
  ELANE RNA Guide
uguucgccgugcagcccaucu

SEQ ID NO: 12009 - RNA, 21 nt, Artificial Sequence
  ELANE RNA Guide
uucgaagaugggcugcacggc

SEQ ID NO: 12010 - RNA, 21 nt, Artificial Sequence
  ELANE RNA Guide
uucgccgugcagcccaucuuc

SEQ ID NO: 12011 - RNA, 21 nt, Artificial Sequence
  ELANE RNA Guide
uuucgaagaugggcugcacgg

SEQ ID NO: 12012 - RNA, 21 nt, Artificial Sequence
  ELANE RNA Guide
uuuucgaagaugggcugcacg

SEQ ID NO: 12013 - RNA, 22 nt, Artificial Sequence
  ELANE RNA Guide
aagaugggcugcacggcgaaca

SEQ ID NO: 12014 - RNA, 22 nt, Artificial Sequence
  ELANE RNA Guide
agaugggcugcacggcgaacac

SEQ ID NO: 12015 - RNA, 22 nt, Artificial Sequence
  ELANE RNA Guide
agcccaucuucgaaaacggcua

SEQ ID NO: 12016 - RNA, 22 nt, Artificial Sequence
  ELANE RNA Guide
agccguuuucgaagaugggcug

SEQ ID NO: 12017 - RNA, 22 nt, Artificial Sequence
  ELANE RNA Guide
agguguucgccgugcagcccau

SEQ ID NO: 12018 - RNA, 22 nt, Artificial Sequence
  ELANE RNA Guide
augggcugcacggcgaacaccu

SEQ ID NO: 12019 - RNA, 22 nt, Artificial Sequence
  ELANE RNA Guide
cagcccaucuucgaaaacggcu

SEQ ID NO: 12020 - RNA, 22 nt, Artificial Sequence
  ELANE RNA Guide
cagguguucgccgugcagccca

SEQ ID NO: 12021 - RNA, 22 nt, Artificial Sequence
  ELANE RNA Guide
cccaucuucgaaaacggcuacg

SEQ ID NO: 12022 - RNA, 22 nt, Artificial Sequence
  ELANE RNA Guide
cccggcagguguucgccgugca

SEQ ID NO: 12023 - RNA, 22 nt, Artificial Sequence
  ELANE RNA Guide
ccggcagguguucgccgugcag

SEQ ID NO: 12024 - RNA, 22 nt, Artificial Sequence
  ELANE RNA Guide
ccgugcagcccaucuucgaaaa

SEQ ID NO: 12025 - RNA, 22 nt, Artificial Sequence
  ELANE RNA Guide
ccguuuucgaagaugggcugca

SEQ ID NO: 12026 - RNA, 22 nt, Artificial Sequence
  ELANE RNA Guide
cgaagaugggcugcacggcgaa

SEQ ID NO: 12027 - RNA, 22 nt, Artificial Sequence
  ELANE RNA Guide
cgccgugcagcccaucuucgaa

SEQ ID NO: 12028 - RNA, 22 nt, Artificial Sequence
  ELANE RNA Guide
cggcagguguucgccgugcagc

SEQ ID NO: 12029 - RNA, 22 nt, Artificial Sequence
  ELANE RNA Guide
cguagccguuuucgaagauggg

SEQ ID NO: 12030 - RNA, 22 nt, Artificial Sequence
  ELANE RNA Guide
cgugcagcccaucuucgaaaac

SEQ ID NO: 12031 - RNA, 22 nt, Artificial Sequence
  ELANE RNA Guide
cguuuucgaagaugggcugcac

SEQ ID NO: 12032 - RNA, 22 nt, Artificial Sequence
  ELANE RNA Guide
gaagaugggcugcacggcgaac

SEQ ID NO: 12033 - RNA, 22 nt, Artificial Sequence
  ELANE RNA Guide
gaugggcugcacggcgaacacc

SEQ ID NO: 12034 - RNA, 22 nt, Artificial Sequence
  ELANE RNA Guide
gcagcccaucuucgaaaacggc

SEQ ID NO: 12035 - RNA, 22 nt, Artificial Sequence
  ELANE RNA Guide
gcagguguucgccgugcagccc

SEQ ID NO: 12036 - RNA, 22 nt, Artificial Sequence
  ELANE RNA Guide
gcccaucuucgaaaacggcuac

SEQ ID NO: 12037 - RNA, 22 nt, Artificial Sequence
  ELANE RNA Guide
gccgugcagcccaucuucgaaa

SEQ ID NO: 12038 - RNA, 22 nt, Artificial Sequence
  ELANE RNA Guide
gccguuuucgaagaugggcugc

SEQ ID NO: 12039 - RNA, 22 nt, Artificial Sequence
  ELANE RNA Guide
ggcagguguucgccgugcagcc

SEQ ID NO: 12040 - RNA, 22 nt, Artificial Sequence
  ELANE RNA Guide
gggcugcacggcgaacaccugc

SEQ ID NO: 12041 - RNA, 22 nt, Artificial Sequence
  ELANE RNA Guide
ggggucguagccguuuucgaag

SEQ ID NO: 12042 - RNA, 22 nt, Artificial Sequence
  ELANE RNA Guide
gggucguagccguuuucgaaga

SEQ ID NO: 12043 - RNA, 22 nt, Artificial Sequence
  ELANE RNA Guide
ggucguagccguuuucgaagau

SEQ ID NO: 12044 - RNA, 22 nt, Artificial Sequence
  ELANE RNA Guide
gguguucgccgugcagcccauc

SEQ ID NO: 12045 - RNA, 22 nt, Artificial Sequence
  ELANE RNA Guide
guagccguuuucgaagaugggc

SEQ ID NO: 12046 - RNA, 22 nt, Artificial Sequence
  ELANE RNA Guide
gugcagcccaucuucgaaaacg

SEQ ID NO: 12047 - RNA, 22 nt, Artificial Sequence
  ELANE RNA Guide
guguucgccgugcagcccaucu

SEQ ID NO: 12048 - RNA, 22 nt, Artificial Sequence
  ELANE RNA Guide
guucgccgugcagcccaucuuc

SEQ ID NO: 12049 - RNA, 22 nt, Artificial Sequence
  ELANE RNA Guide
guuuucgaagaugggcugcacg

SEQ ID NO: 12050 - RNA, 22 nt, Artificial Sequence
  ELANE RNA Guide
uagccguuuucgaagaugggcu

SEQ ID NO: 12051 - RNA, 22 nt, Artificial Sequence
  ELANE RNA Guide
ucgaagaugggcugcacggcga

SEQ ID NO: 12052 - RNA, 22 nt, Artificial Sequence
  ELANE RNA Guide
ucgccgugcagcccaucuucga

SEQ ID NO: 12053 - RNA, 22 nt, Artificial Sequence
  ELANE RNA Guide
ucguagccguuuucgaagaugg

SEQ ID NO: 12054 - RNA, 22 nt, Artificial Sequence
  ELANE RNA Guide
ugcagcccaucuucgaaaacgg

SEQ ID NO: 12055 - RNA, 22 nt, Artificial Sequence
  ELANE RNA Guide
ugggcugcacggcgaacaccug

SEQ ID NO: 12056 - RNA, 22 nt, Artificial Sequence
  ELANE RNA Guide
uguucgccgugcagcccaucuu

SEQ ID NO: 12057 - RNA, 22 nt, Artificial Sequence
  ELANE RNA Guide
uucgaagaugggcugcacggcg

SEQ ID NO: 12058 - RNA, 22 nt, Artificial Sequence
  ELANE RNA Guide
uucgccgugcagcccaucuucg

SEQ ID NO: 12059 - RNA, 22 nt, Artificial Sequence
  ELANE RNA Guide
uuucgaagaugggcugcacggc

SEQ ID NO: 12060 - RNA, 22 nt, Artificial Sequence
  ELANE RNA Guide
uuuucgaagaugggcugcacgg

SEQ ID NO: 12061 - RNA, 20 nt, Artificial Sequence
  ELANE RNA Guide
aagaugagcugcacggcgaa

SEQ ID NO: 12062 - RNA, 20 nt, Artificial Sequence
  ELANE RNA Guide
agaugagcugcacggcgaac

SEQ ID NO: 12063 - RNA, 20 nt, Artificial Sequence
  ELANE RNA Guide
agccguuuucgaagaugagc

SEQ ID NO: 12064 - RNA, 20 nt, Artificial Sequence
  ELANE RNA Guide
agcucaucuucgaaaacggc

SEQ ID NO: 12065 - RNA, 20 nt, Artificial Sequence
  ELANE RNA Guide
agguguucgccgugcagcuc

SEQ ID NO: 12066 - RNA, 20 nt, Artificial Sequence
  ELANE RNA Guide
augagcugcacggcgaacac

SEQ ID NO: 12067 - RNA, 20 nt, Artificial Sequence
  ELANE RNA Guide
cagcucaucuucgaaaacgg

SEQ ID NO: 12068 - RNA, 20 nt, Artificial Sequence
  ELANE RNA Guide
cagguguucgccgugcagcu

SEQ ID NO: 12069 - RNA, 20 nt, Artificial Sequence
  ELANE RNA Guide
ccgugcagcucaucuucgaa

SEQ ID NO: 12070 - RNA, 20 nt, Artificial Sequence
  ELANE RNA Guide
ccguuuucgaagaugagcug

SEQ ID NO: 12071 - RNA, 20 nt, Artificial Sequence
  ELANE RNA Guide
cgaagaugagcugcacggcg

SEQ ID NO: 12072 - RNA, 20 nt, Artificial Sequence
  ELANE RNA Guide
cgccgugcagcucaucuucg

SEQ ID NO: 12073 - RNA, 20 nt, Artificial Sequence
  ELANE RNA Guide
cgugcagcucaucuucgaaa

SEQ ID NO: 12074 - RNA, 20 nt, Artificial Sequence
  ELANE RNA Guide
cguuuucgaagaugagcugc

SEQ ID NO: 12075 - RNA, 20 nt, Artificial Sequence
  ELANE RNA Guide
cucaucuucgaaaacggcua

SEQ ID NO: 12076 - RNA, 20 nt, Artificial Sequence
  ELANE RNA Guide
gaagaugagcugcacggcga

SEQ ID NO: 12077 - RNA, 20 nt, Artificial Sequence
  ELANE RNA Guide
gagcugcacggcgaacaccu

SEQ ID NO: 12078 - RNA, 20 nt, Artificial Sequence
  ELANE RNA Guide
gaugagcugcacggcgaaca

SEQ ID NO: 12079 - RNA, 20 nt, Artificial Sequence
  ELANE RNA Guide
gcagcucaucuucgaaaacg

SEQ ID NO: 12080 - RNA, 20 nt, Artificial Sequence
  ELANE RNA Guide
gccgugcagcucaucuucga

SEQ ID NO: 12081 - RNA, 20 nt, Artificial Sequence
  ELANE RNA Guide
gccguuuucgaagaugagcu

SEQ ID NO: 12082 - RNA, 20 nt, Artificial Sequence
  ELANE RNA Guide
gcucaucuucgaaaacggcu

SEQ ID NO: 12083 - RNA, 20 nt, Artificial Sequence
  ELANE RNA Guide
gguguucgccgugcagcuca

SEQ ID NO: 12084 - RNA, 20 nt, Artificial Sequence
  ELANE RNA Guide
guagccguuuucgaagauga

SEQ ID NO: 12085 - RNA, 20 nt, Artificial Sequence
  ELANE RNA Guide
gugcagcucaucuucgaaaa

SEQ ID NO: 12086 - RNA, 20 nt, Artificial Sequence
  ELANE RNA Guide
guguucgccgugcagcucau

SEQ ID NO: 12087 - RNA, 20 nt, Artificial Sequence
  ELANE RNA Guide
guucgccgugcagcucaucu

SEQ ID NO: 12088 - RNA, 20 nt, Artificial Sequence
  ELANE RNA Guide
guuuucgaagaugagcugca

SEQ ID NO: 12089 - RNA, 20 nt, Artificial Sequence
  ELANE RNA Guide
uagccguuuucgaagaugag

SEQ ID NO: 12090 - RNA, 20 nt, Artificial Sequence
  ELANE RNA Guide
ucgaagaugagcugcacggc

SEQ ID NO: 12091 - RNA, 20 nt, Artificial Sequence
  ELANE RNA Guide
ucgccgugcagcucaucuuc

SEQ ID NO: 12092 - RNA, 20 nt, Artificial Sequence
  ELANE RNA Guide
ugagcugcacggcgaacacc

SEQ ID NO: 12093 - RNA, 20 nt, Artificial Sequence
  ELANE RNA Guide
ugcagcucaucuucgaaaac

SEQ ID NO: 12094 - RNA, 20 nt, Artificial Sequence
  ELANE RNA Guide
uguucgccgugcagcucauc

SEQ ID NO: 12095 - RNA, 20 nt, Artificial Sequence
  ELANE RNA Guide
uucgaagaugagcugcacgg

SEQ ID NO: 12096 - RNA, 20 nt, Artificial Sequence
  ELANE RNA Guide
uucgccgugcagcucaucuu

SEQ ID NO: 12097 - RNA, 20 nt, Artificial Sequence
  ELANE RNA Guide
uuucgaagaugagcugcacg

SEQ ID NO: 12098 - RNA, 20 nt, Artificial Sequence
  ELANE RNA Guide
uuuucgaagaugagcugcac

SEQ ID NO: 12099 - RNA, 21 nt, Artificial Sequence
  ELANE RNA Guide
aagaugagcugcacggcgaac

SEQ ID NO: 12100 - RNA, 21 nt, Artificial Sequence
  ELANE RNA Guide
agaugagcugcacggcgaaca

SEQ ID NO: 12101 - RNA, 21 nt, Artificial Sequence
  ELANE RNA Guide
agccguuuucgaagaugagcu

SEQ ID NO: 12102 - RNA, 21 nt, Artificial Sequence
  ELANE RNA Guide
agcucaucuucgaaaacggcu

SEQ ID NO: 12103 - RNA, 21 nt, Artificial Sequence
  ELANE RNA Guide
agguguucgccgugcagcuca

SEQ ID NO: 12104 - RNA, 21 nt, Artificial Sequence
  ELANE RNA Guide
augagcugcacggcgaacacc

SEQ ID NO: 12105 - RNA, 21 nt, Artificial Sequence
  ELANE RNA Guide
cagcucaucuucgaaaacggc

SEQ ID NO: 12106 - RNA, 21 nt, Artificial Sequence
  ELANE RNA Guide
cagguguucgccgugcagcuc

SEQ ID NO: 12107 - RNA, 21 nt, Artificial Sequence
  ELANE RNA Guide
ccgugcagcucaucuucgaaa

SEQ ID NO: 12108 - RNA, 21 nt, Artificial Sequence
  ELANE RNA Guide
ccguuuucgaagaugagcugc

SEQ ID NO: 12109 - RNA, 21 nt, Artificial Sequence
  ELANE RNA Guide
cgaagaugagcugcacggcga

SEQ ID NO: 12110 - RNA, 21 nt, Artificial Sequence
  ELANE RNA Guide
cgccgugcagcucaucuucga

SEQ ID NO: 12111 - RNA, 21 nt, Artificial Sequence
  ELANE RNA Guide
cguagccguuuucgaagauga

SEQ ID NO: 12112 - RNA, 21 nt, Artificial Sequence
  ELANE RNA Guide
cgugcagcucaucuucgaaaa

SEQ ID NO: 12113 - RNA, 21 nt, Artificial Sequence
  ELANE RNA Guide
cguuuucgaagaugagcugca

SEQ ID NO: 12114 - RNA, 21 nt, Artificial Sequence
  ELANE RNA Guide
cucaucuucgaaaacggcuac

SEQ ID NO: 12115 - RNA, 21 nt, Artificial Sequence
  ELANE RNA Guide
gaagaugagcugcacggcgaa

SEQ ID NO: 12116 - RNA, 21 nt, Artificial Sequence
  ELANE RNA Guide
gagcugcacggcgaacaccug

SEQ ID NO: 12117 - RNA, 21 nt, Artificial Sequence
  ELANE RNA Guide
gaugagcugcacggcgaacac

SEQ ID NO: 12118 - RNA, 21 nt, Artificial Sequence
  ELANE RNA Guide
gcagcucaucuucgaaaacgg

SEQ ID NO: 12119 - RNA, 21 nt, Artificial Sequence
  ELANE RNA Guide
gcagguguucgccgugcagcu

SEQ ID NO: 12120 - RNA, 21 nt, Artificial Sequence
  ELANE RNA Guide
gccgugcagcucaucuucgaa

SEQ ID NO: 12121 - RNA, 21 nt, Artificial Sequence
  ELANE RNA Guide
gccguuuucgaagaugagcug

SEQ ID NO: 12122 - RNA, 21 nt, Artificial Sequence
  ELANE RNA Guide
gcucaucuucgaaaacggcua

SEQ ID NO: 12123 - RNA, 21 nt, Artificial Sequence
  ELANE RNA Guide
gguguucgccgugcagcucau

SEQ ID NO: 12124 - RNA, 21 nt, Artificial Sequence
  ELANE RNA Guide
guagccguuuucgaagaugag

SEQ ID NO: 12125 - RNA, 21 nt, Artificial Sequence
  ELANE RNA Guide
gugcagcucaucuucgaaaac

SEQ ID NO: 12126 - RNA, 21 nt, Artificial Sequence
  ELANE RNA Guide
guguucgccgugcagcucauc

SEQ ID NO: 12127 - RNA, 21 nt, Artificial Sequence
  ELANE RNA Guide
guucgccgugcagcucaucuu

SEQ ID NO: 12128 - RNA, 21 nt, Artificial Sequence
  ELANE RNA Guide
guuuucgaagaugagcugcac

SEQ ID NO: 12129 - RNA, 21 nt, Artificial Sequence
  ELANE RNA Guide
uagccguuuucgaagaugagc

SEQ ID NO: 12130 - RNA, 21 nt, Artificial Sequence
  ELANE RNA Guide
ucgaagaugagcugcacggcg

SEQ ID NO: 12131 - RNA, 21 nt, Artificial Sequence
  ELANE RNA Guide
ucgccgugcagcucaucuucg

SEQ ID NO: 12132 - RNA, 21 nt, Artificial Sequence
  ELANE RNA Guide
ugagcugcacggcgaacaccu

SEQ ID NO: 12133 - RNA, 21 nt, Artificial Sequence
  ELANE RNA Guide
ugcagcucaucuucgaaaacg

SEQ ID NO: 12134 - RNA, 21 nt, Artificial Sequence
  ELANE RNA Guide
uguucgccgugcagcucaucu

SEQ ID NO: 12135 - RNA, 21 nt, Artificial Sequence
  ELANE RNA Guide
uucgaagaugagcugcacggc

SEQ ID NO: 12136 - RNA, 21 nt, Artificial Sequence
  ELANE RNA Guide
uucgccgugcagcucaucuuc

SEQ ID NO: 12137 - RNA, 21 nt, Artificial Sequence
  ELANE RNA Guide
uuucgaagaugagcugcacgg

SEQ ID NO: 12138 - RNA, 21 nt, Artificial Sequence
  ELANE RNA Guide
uuuucgaagaugagcugcacg

SEQ ID NO: 12139 - RNA, 22 nt, Artificial Sequence
  ELANE RNA Guide
aagaugagcugcacggcgaaca

SEQ ID NO: 12140 - RNA, 22 nt, Artificial Sequence
  ELANE RNA Guide
agaugagcugcacggcgaacac

SEQ ID NO: 12141 - RNA, 22 nt, Artificial Sequence
  ELANE RNA Guide
agccguuuucgaagaugagcug

SEQ ID NO: 12142 - RNA, 22 nt, Artificial Sequence
  ELANE RNA Guide
agcucaucuucgaaaacggcua

SEQ ID NO: 12143 - RNA, 22 nt, Artificial Sequence
  ELANE RNA Guide
agguguucgccgugcagcucau

SEQ ID NO: 12144 - RNA, 22 nt, Artificial Sequence
  ELANE RNA Guide
augagcugcacggcgaacaccu

SEQ ID NO: 12145 - RNA, 22 nt, Artificial Sequence
  ELANE RNA Guide
cagcucaucuucgaaaacggcu

SEQ ID NO: 12146 - RNA, 22 nt, Artificial Sequence
  ELANE RNA Guide
cagguguucgccgugcagcuca

SEQ ID NO: 12147 - RNA, 22 nt, Artificial Sequence
  ELANE RNA Guide
ccgugcagcucaucuucgaaaa

SEQ ID NO: 12148 - RNA, 22 nt, Artificial Sequence
  ELANE RNA Guide
ccguuuucgaagaugagcugca

SEQ ID NO: 12149 - RNA, 22 nt, Artificial Sequence
  ELANE RNA Guide
cgaagaugagcugcacggcgaa

SEQ ID NO: 12150 - RNA, 22 nt, Artificial Sequence
  ELANE RNA Guide
cgccgugcagcucaucuucgaa

SEQ ID NO: 12151 - RNA, 22 nt, Artificial Sequence
  ELANE RNA Guide
cguagccguuuucgaagaugag

SEQ ID NO: 12152 - RNA, 22 nt, Artificial Sequence
  ELANE RNA Guide
cgugcagcucaucuucgaaaac

SEQ ID NO: 12153 - RNA, 22 nt, Artificial Sequence
  ELANE RNA Guide
cguuuucgaagaugagcugcac

SEQ ID NO: 12154 - RNA, 22 nt, Artificial Sequence
  ELANE RNA Guide
cucaucuucgaaaacggcuacg

SEQ ID NO: 12155 - RNA, 22 nt, Artificial Sequence
  ELANE RNA Guide
gaagaugagcugcacggcgaac

SEQ ID NO: 12156 - RNA, 22 nt, Artificial Sequence
  ELANE RNA Guide
gagcugcacggcgaacaccugc

SEQ ID NO: 12157 - RNA, 22 nt, Artificial Sequence
  ELANE RNA Guide
gaugagcugcacggcgaacacc

SEQ ID NO: 12158 - RNA, 22 nt, Artificial Sequence
  ELANE RNA Guide
gcagcucaucuucgaaaacggc

SEQ ID NO: 12159 - RNA, 22 nt, Artificial Sequence
  ELANE RNA Guide
gcagguguucgccgugcagcuc

SEQ ID NO: 12160 - RNA, 22 nt, Artificial Sequence
  ELANE RNA Guide
gccgugcagcucaucuucgaaa

SEQ ID NO: 12161 - RNA, 22 nt, Artificial Sequence
  ELANE RNA Guide
gccguuuucgaagaugagcugc

SEQ ID NO: 12162 - RNA, 22 nt, Artificial Sequence
  ELANE RNA Guide
gcucaucuucgaaaacggcuac

SEQ ID NO: 12163 - RNA, 22 nt, Artificial Sequence
  ELANE RNA Guide
ggcagguguucgccgugcagcu

SEQ ID NO: 12164 - RNA, 22 nt, Artificial Sequence
  ELANE RNA Guide
gguguucgccgugcagcucauc

SEQ ID NO: 12165 - RNA, 22 nt, Artificial Sequence
  ELANE RNA Guide
guagccguuuucgaagaugagc

SEQ ID NO: 12166 - RNA, 22 nt, Artificial Sequence
  ELANE RNA Guide
gugcagcucaucuucgaaaacg

SEQ ID NO: 12167 - RNA, 22 nt, Artificial Sequence
  ELANE RNA Guide
guguucgccgugcagcucaucu

SEQ ID NO: 12168 - RNA, 22 nt, Artificial Sequence
  ELANE RNA Guide
guucgccgugcagcucaucuuc

SEQ ID NO: 12169 - RNA, 22 nt, Artificial Sequence
  ELANE RNA Guide
guuuucgaagaugagcugcacg

SEQ ID NO: 12170 - RNA, 22 nt, Artificial Sequence
  ELANE RNA Guide
uagccguuuucgaagaugagcu

SEQ ID NO: 12171 - RNA, 22 nt, Artificial Sequence
  ELANE RNA Guide
ucgaagaugagcugcacggcga

SEQ ID NO: 12172 - RNA, 22 nt, Artificial Sequence
  ELANE RNA Guide
ucgccgugcagcucaucuucga

SEQ ID NO: 12173 - RNA, 22 nt, Artificial Sequence
  ELANE RNA Guide
ucguagccguuuucgaagauga

SEQ ID NO: 12174 - RNA, 22 nt, Artificial Sequence
  ELANE RNA Guide
ugagcugcacggcgaacaccug

SEQ ID NO: 12175 - RNA, 22 nt, Artificial Sequence
  ELANE RNA Guide
ugcagcucaucuucgaaaacgg

SEQ ID NO: 12176 - RNA, 22 nt, Artificial Sequence
  ELANE RNA Guide
uguucgccgugcagcucaucuu

SEQ ID NO: 12177 - RNA, 22 nt, Artificial Sequence
  ELANE RNA Guide
uucgaagaugagcugcacggcg

SEQ ID NO: 12178 - RNA, 22 nt, Artificial Sequence
  ELANE RNA Guide
uucgccgugcagcucaucuucg

SEQ ID NO: 12179 - RNA, 22 nt, Artificial Sequence
  ELANE RNA Guide
uuucgaagaugagcugcacggc

SEQ ID NO: 12180 - RNA, 22 nt, Artificial Sequence
  ELANE RNA Guide
uuuucgaagaugagcugcacgg

SEQ ID NO: 12181 - RNA, 20 nt, Artificial Sequence
  ELANE RNA Guide
aacuucgaaaacggcuacga

SEQ ID NO: 12182 - RNA, 20 nt, Artificial Sequence
  ELANE RNA Guide
aaguugcgcugcacggcgaa

SEQ ID NO: 12183 - RNA, 20 nt, Artificial Sequence
  ELANE RNA Guide
agccguuuucgaaguugcgc

SEQ ID NO: 12184 - RNA, 20 nt, Artificial Sequence
  ELANE RNA Guide
agcgcaacuucgaaaacggc

SEQ ID NO: 12185 - RNA, 20 nt, Artificial Sequence
  ELANE RNA Guide
agguguucgccgugcagcgc

SEQ ID NO: 12186 - RNA, 20 nt, Artificial Sequence
  ELANE RNA Guide
aguugcgcugcacggcgaac

SEQ ID NO: 12187 - RNA, 20 nt, Artificial Sequence
  ELANE RNA Guide
caacuucgaaaacggcuacg

SEQ ID NO: 12188 - RNA, 20 nt, Artificial Sequence
  ELANE RNA Guide
cagcgcaacuucgaaaacgg

SEQ ID NO: 12189 - RNA, 20 nt, Artificial Sequence
  ELANE RNA Guide
cagguguucgccgugcagcg

SEQ ID NO: 12190 - RNA, 20 nt, Artificial Sequence
  ELANE RNA Guide
ccgugcagcgcaacuucgaa

SEQ ID NO: 12191 - RNA, 20 nt, Artificial Sequence
  ELANE RNA Guide
ccguuuucgaaguugcgcug

SEQ ID NO: 12192 - RNA, 20 nt, Artificial Sequence
  ELANE RNA Guide
cgaaguugcgcugcacggcg

SEQ ID NO: 12193 - RNA, 20 nt, Artificial Sequence
  ELANE RNA Guide
cgcaacuucgaaaacggcua

SEQ ID NO: 12194 - RNA, 20 nt, Artificial Sequence
  ELANE RNA Guide
cgccgugcagcgcaacuucg

SEQ ID NO: 12195 - RNA, 20 nt, Artificial Sequence
  ELANE RNA Guide
cggggucguagccguuuucg

SEQ ID NO: 12196 - RNA, 20 nt, Artificial Sequence
  ELANE RNA Guide
cguagccguuuucgaaguug

SEQ ID NO: 12197 - RNA, 20 nt, Artificial Sequence
  ELANE RNA Guide
cgugcagcgcaacuucgaaa

SEQ ID NO: 12198 - RNA, 20 nt, Artificial Sequence
  ELANE RNA Guide
cguuuucgaaguugcgcugc

SEQ ID NO: 12199 - RNA, 20 nt, Artificial Sequence
  ELANE RNA Guide
gaaguugcgcugcacggcga

SEQ ID NO: 12200 - RNA, 20 nt, Artificial Sequence
  ELANE RNA Guide
gcaacuucgaaaacggcuac

SEQ ID NO: 12201 - RNA, 20 nt, Artificial Sequence
  ELANE RNA Guide
gcagcgcaacuucgaaaacg

SEQ ID NO: 12202 - RNA, 20 nt, Artificial Sequence
  ELANE RNA Guide
gccgugcagcgcaacuucga

SEQ ID NO: 12203 - RNA, 20 nt, Artificial Sequence
  ELANE RNA Guide
gccguuuucgaaguugcgcu

SEQ ID NO: 12204 - RNA, 20 nt, Artificial Sequence
  ELANE RNA Guide
gcgcaacuucgaaaacggcu

SEQ ID NO: 12205 - RNA, 20 nt, Artificial Sequence
  ELANE RNA Guide
ggggucguagccguuuucga

SEQ ID NO: 12206 - RNA, 20 nt, Artificial Sequence
  ELANE RNA Guide
gggucguagccguuuucgaa

SEQ ID NO: 12207 - RNA, 20 nt, Artificial Sequence
  ELANE RNA Guide
gguguucgccgugcagcgca

SEQ ID NO: 12208 - RNA, 20 nt, Artificial Sequence
  ELANE RNA Guide
guagccguuuucgaaguugc

SEQ ID NO: 12209 - RNA, 20 nt, Artificial Sequence
  ELANE RNA Guide
gucguagccguuuucgaagu

SEQ ID NO: 12210 - RNA, 20 nt, Artificial Sequence
  ELANE RNA Guide
gugcagcgcaacuucgaaaa

SEQ ID NO: 12211 - RNA, 20 nt, Artificial Sequence
  ELANE RNA Guide
guguucgccgugcagcgcaa

SEQ ID NO: 12212 - RNA, 20 nt, Artificial Sequence
  ELANE RNA Guide
guucgccgugcagcgcaacu

SEQ ID NO: 12213 - RNA, 20 nt, Artificial Sequence
  ELANE RNA Guide
guugcgcugcacggcgaaca

SEQ ID NO: 12214 - RNA, 20 nt, Artificial Sequence
  ELANE RNA Guide
guuuucgaaguugcgcugca

SEQ ID NO: 12215 - RNA, 20 nt, Artificial Sequence
  ELANE RNA Guide
uagccguuuucgaaguugcg

SEQ ID NO: 12216 - RNA, 20 nt, Artificial Sequence
  ELANE RNA Guide
ucgaaguugcgcugcacggc

SEQ ID NO: 12217 - RNA, 20 nt, Artificial Sequence
  ELANE RNA Guide
ucgccgugcagcgcaacuuc

SEQ ID NO: 12218 - RNA, 20 nt, Artificial Sequence
  ELANE RNA Guide
ucguagccguuuucgaaguu

SEQ ID NO: 12219 - RNA, 20 nt, Artificial Sequence
  ELANE RNA Guide
ugcagcgcaacuucgaaaac

SEQ ID NO: 12220 - RNA, 20 nt, Artificial Sequence
  ELANE RNA Guide
uguucgccgugcagcgcaac

SEQ ID NO: 12221 - RNA, 20 nt, Artificial Sequence
  ELANE RNA Guide
uucgaaguugcgcugcacgg

SEQ ID NO: 12222 - RNA, 20 nt, Artificial Sequence
  ELANE RNA Guide
uucgccgugcagcgcaacuu

SEQ ID NO: 12223 - RNA, 20 nt, Artificial Sequence
  ELANE RNA Guide
uuucgaaguugcgcugcacg

SEQ ID NO: 12224 - RNA, 20 nt, Artificial Sequence
  ELANE RNA Guide
uuuucgaaguugcgcugcac

SEQ ID NO: 12225 - RNA, 21 nt, Artificial Sequence
  ELANE RNA Guide
aacuucgaaaacggcuacgac

SEQ ID NO: 12226 - RNA, 21 nt, Artificial Sequence
  ELANE RNA Guide
aaguugcgcugcacggcgaac

SEQ ID NO: 12227 - RNA, 21 nt, Artificial Sequence
  ELANE RNA Guide
acggggucguagccguuuucg

SEQ ID NO: 12228 - RNA, 21 nt, Artificial Sequence
  ELANE RNA Guide
agccguuuucgaaguugcgcu

SEQ ID NO: 12229 - RNA, 21 nt, Artificial Sequence
  ELANE RNA Guide
agcgcaacuucgaaaacggcu

SEQ ID NO: 12230 - RNA, 21 nt, Artificial Sequence
  ELANE RNA Guide
agguguucgccgugcagcgca

SEQ ID NO: 12231 - RNA, 21 nt, Artificial Sequence
  ELANE RNA Guide
aguugcgcugcacggcgaaca

SEQ ID NO: 12232 - RNA, 21 nt, Artificial Sequence
  ELANE RNA Guide
caacuucgaaaacggcuacga

SEQ ID NO: 12233 - RNA, 21 nt, Artificial Sequence
  ELANE RNA Guide
cagcgcaacuucgaaaacggc

SEQ ID NO: 12234 - RNA, 21 nt, Artificial Sequence
  ELANE RNA Guide
cagguguucgccgugcagcgc

SEQ ID NO: 12235 - RNA, 21 nt, Artificial Sequence
  ELANE RNA Guide
ccgugcagcgcaacuucgaaa

SEQ ID NO: 12236 - RNA, 21 nt, Artificial Sequence
  ELANE RNA Guide
ccguuuucgaaguugcgcugc

SEQ ID NO: 12237 - RNA, 21 nt, Artificial Sequence
  ELANE RNA Guide
cgaaguugcgcugcacggcga

SEQ ID NO: 12238 - RNA, 21 nt, Artificial Sequence
  ELANE RNA Guide
cgcaacuucgaaaacggcuac

SEQ ID NO: 12239 - RNA, 21 nt, Artificial Sequence
  ELANE RNA Guide
cgccgugcagcgcaacuucga

SEQ ID NO: 12240 - RNA, 21 nt, Artificial Sequence
  ELANE RNA Guide
cggggucguagccguuuucga

SEQ ID NO: 12241 - RNA, 21 nt, Artificial Sequence
  ELANE RNA Guide
cguagccguuuucgaaguugc

SEQ ID NO: 12242 - RNA, 21 nt, Artificial Sequence
  ELANE RNA Guide
cgugcagcgcaacuucgaaaa

SEQ ID NO: 12243 - RNA, 21 nt, Artificial Sequence
  ELANE RNA Guide
cguuuucgaaguugcgcugca

SEQ ID NO: 12244 - RNA, 21 nt, Artificial Sequence
  ELANE RNA Guide
gaaguugcgcugcacggcgaa

SEQ ID NO: 12245 - RNA, 21 nt, Artificial Sequence
  ELANE RNA Guide
gcaacuucgaaaacggcuacg

SEQ ID NO: 12246 - RNA, 21 nt, Artificial Sequence
  ELANE RNA Guide
gcagcgcaacuucgaaaacgg

SEQ ID NO: 12247 - RNA, 21 nt, Artificial Sequence
  ELANE RNA Guide
gcagguguucgccgugcagcg

SEQ ID NO: 12248 - RNA, 21 nt, Artificial Sequence
  ELANE RNA Guide
gccgugcagcgcaacuucgaa

SEQ ID NO: 12249 - RNA, 21 nt, Artificial Sequence
  ELANE RNA Guide
gccguuuucgaaguugcgcug

SEQ ID NO: 12250 - RNA, 21 nt, Artificial Sequence
  ELANE RNA Guide
gcgcaacuucgaaaacggcua

SEQ ID NO: 12251 - RNA, 21 nt, Artificial Sequence
  ELANE RNA Guide
ggggucguagccguuuucgaa

SEQ ID NO: 12252 - RNA, 21 nt, Artificial Sequence
  ELANE RNA Guide
ggucguagccguuuucgaagu

SEQ ID NO: 12253 - RNA, 21 nt, Artificial Sequence
  ELANE RNA Guide
gguguucgccgugcagcgcaa

SEQ ID NO: 12254 - RNA, 21 nt, Artificial Sequence
  ELANE RNA Guide
guagccguuuucgaaguugcg

SEQ ID NO: 12255 - RNA, 21 nt, Artificial Sequence
  ELANE RNA Guide
gucguagccguuuucgaaguu

SEQ ID NO: 12256 - RNA, 21 nt, Artificial Sequence
  ELANE RNA Guide
gugcagcgcaacuucgaaaac

SEQ ID NO: 12257 - RNA, 21 nt, Artificial Sequence
  ELANE RNA Guide
guguucgccgugcagcgcaac

SEQ ID NO: 12258 - RNA, 21 nt, Artificial Sequence
  ELANE RNA Guide
guucgccgugcagcgcaacuu

SEQ ID NO: 12259 - RNA, 21 nt, Artificial Sequence
  ELANE RNA Guide
guugcgcugcacggcgaacac

SEQ ID NO: 12260 - RNA, 21 nt, Artificial Sequence
  ELANE RNA Guide
guuuucgaaguugcgcugcac

SEQ ID NO: 12261 - RNA, 21 nt, Artificial Sequence
  ELANE RNA Guide
uagccguuuucgaaguugcgc

SEQ ID NO: 12262 - RNA, 21 nt, Artificial Sequence
  ELANE RNA Guide
ucgaaguugcgcugcacggcg

SEQ ID NO: 12263 - RNA, 21 nt, Artificial Sequence
  ELANE RNA Guide
ucgccgugcagcgcaacuucg

SEQ ID NO: 12264 - RNA, 21 nt, Artificial Sequence
  ELANE RNA Guide
ucguagccguuuucgaaguug

SEQ ID NO: 12265 - RNA, 21 nt, Artificial Sequence
  ELANE RNA Guide
ugcagcgcaacuucgaaaacg

SEQ ID NO: 12266 - RNA, 21 nt, Artificial Sequence
  ELANE RNA Guide
uguucgccgugcagcgcaacu

SEQ ID NO: 12267 - RNA, 21 nt, Artificial Sequence
  ELANE RNA Guide
uucgaaguugcgcugcacggc

SEQ ID NO: 12268 - RNA, 21 nt, Artificial Sequence
  ELANE RNA Guide
uucgccgugcagcgcaacuuc

SEQ ID NO: 12269 - RNA, 21 nt, Artificial Sequence
  ELANE RNA Guide
uuucgaaguugcgcugcacgg

SEQ ID NO: 12270 - RNA, 21 nt, Artificial Sequence
  ELANE RNA Guide
uuuucgaaguugcgcugcacg

SEQ ID NO: 12271 - RNA, 22 nt, Artificial Sequence
  ELANE RNA Guide
aacuucgaaaacggcuacgacc

SEQ ID NO: 12272 - RNA, 22 nt, Artificial Sequence
  ELANE RNA Guide
aaguugcgcugcacggcgaaca

SEQ ID NO: 12273 - RNA, 22 nt, Artificial Sequence
  ELANE RNA Guide
acggggucguagccguuuucga

SEQ ID NO: 12274 - RNA, 22 nt, Artificial Sequence
  ELANE RNA Guide
agccguuuucgaaguugcgcug

SEQ ID NO: 12275 - RNA, 22 nt, Artificial Sequence
  ELANE RNA Guide
agcgcaacuucgaaaacggcua

SEQ ID NO: 12276 - RNA, 22 nt, Artificial Sequence
  ELANE RNA Guide
agguguucgccgugcagcgcaa

SEQ ID NO: 12277 - RNA, 22 nt, Artificial Sequence
  ELANE RNA Guide
aguugcgcugcacggcgaacac

SEQ ID NO: 12278 - RNA, 22 nt, Artificial Sequence
  ELANE RNA Guide
caacuucgaaaacggcuacgac

SEQ ID NO: 12279 - RNA, 22 nt, Artificial Sequence
  ELANE RNA Guide
cagcgcaacuucgaaaacggcu

SEQ ID NO: 12280 - RNA, 22 nt, Artificial Sequence
  ELANE RNA Guide
cagguguucgccgugcagcgca

SEQ ID NO: 12281 - RNA, 22 nt, Artificial Sequence
  ELANE RNA Guide
ccgugcagcgcaacuucgaaaa

SEQ ID NO: 12282 - RNA, 22 nt, Artificial Sequence
  ELANE RNA Guide
ccguuuucgaaguugcgcugca

SEQ ID NO: 12283 - RNA, 22 nt, Artificial Sequence
  ELANE RNA Guide
cgaaguugcgcugcacggcgaa

SEQ ID NO: 12284 - RNA, 22 nt, Artificial Sequence
  ELANE RNA Guide
cgcaacuucgaaaacggcuacg

SEQ ID NO: 12285 - RNA, 22 nt, Artificial Sequence
  ELANE RNA Guide
cgccgugcagcgcaacuucgaa

SEQ ID NO: 12286 - RNA, 22 nt, Artificial Sequence
  ELANE RNA Guide
cggggucguagccguuuucgaa

SEQ ID NO: 12287 - RNA, 22 nt, Artificial Sequence
  ELANE RNA Guide
cguagccguuuucgaaguugcg

SEQ ID NO: 12288 - RNA, 22 nt, Artificial Sequence
  ELANE RNA Guide
cgugcagcgcaacuucgaaaac

SEQ ID NO: 12289 - RNA, 22 nt, Artificial Sequence
  ELANE RNA Guide
cguuuucgaaguugcgcugcac

SEQ ID NO: 12290 - RNA, 22 nt, Artificial Sequence
  ELANE RNA Guide
gaaguugcgcugcacggcgaac

SEQ ID NO: 12291 - RNA, 22 nt, Artificial Sequence
  ELANE RNA Guide
gcaacuucgaaaacggcuacga

SEQ ID NO: 12292 - RNA, 22 nt, Artificial Sequence
  ELANE RNA Guide
gcagcgcaacuucgaaaacggc

SEQ ID NO: 12293 - RNA, 22 nt, Artificial Sequence
  ELANE RNA Guide
gcagguguucgccgugcagcgc

SEQ ID NO: 12294 - RNA, 22 nt, Artificial Sequence
  ELANE RNA Guide
gccgugcagcgcaacuucgaaa

SEQ ID NO: 12295 - RNA, 22 nt, Artificial Sequence
  ELANE RNA Guide
gccguuuucgaaguugcgcugc

SEQ ID NO: 12296 - RNA, 22 nt, Artificial Sequence
  ELANE RNA Guide
gcgcaacuucgaaaacggcuac

SEQ ID NO: 12297 - RNA, 22 nt, Artificial Sequence
  ELANE RNA Guide
ggcagguguucgccgugcagcg

SEQ ID NO: 12298 - RNA, 22 nt, Artificial Sequence
  ELANE RNA Guide
gggucguagccguuuucgaagu

SEQ ID NO: 12299 - RNA, 22 nt, Artificial Sequence
  ELANE RNA Guide
ggucguagccguuuucgaaguu

SEQ ID NO: 12300 - RNA, 22 nt, Artificial Sequence
  ELANE RNA Guide
gguguucgccgugcagcgcaac

SEQ ID NO: 12301 - RNA, 22 nt, Artificial Sequence
  ELANE RNA Guide
guagccguuuucgaaguugcgc

SEQ ID NO: 12302 - RNA, 22 nt, Artificial Sequence
  ELANE RNA Guide
gucguagccguuuucgaaguug

SEQ ID NO: 12303 - RNA, 22 nt, Artificial Sequence
  ELANE RNA Guide
gugcagcgcaacuucgaaaacg

SEQ ID NO: 12304 - RNA, 22 nt, Artificial Sequence
  ELANE RNA Guide
guguucgccgugcagcgcaacu

SEQ ID NO: 12305 - RNA, 22 nt, Artificial Sequence
  ELANE RNA Guide
guucgccgugcagcgcaacuuc

SEQ ID NO: 12306 - RNA, 22 nt, Artificial Sequence
  ELANE RNA Guide
guugcgcugcacggcgaacacc

SEQ ID NO: 12307 - RNA, 22 nt, Artificial Sequence
  ELANE RNA Guide
guuuucgaaguugcgcugcacg

SEQ ID NO: 12308 - RNA, 22 nt, Artificial Sequence
  ELANE RNA Guide
uacggggucguagccguuuucg

SEQ ID NO: 12309 - RNA, 22 nt, Artificial Sequence
  ELANE RNA Guide
uagccguuuucgaaguugcgcu

SEQ ID NO: 12310 - RNA, 22 nt, Artificial Sequence
  ELANE RNA Guide
ucgaaguugcgcugcacggcga

SEQ ID NO: 12311 - RNA, 22 nt, Artificial Sequence
  ELANE RNA Guide
ucgccgugcagcgcaacuucga

SEQ ID NO: 12312 - RNA, 22 nt, Artificial Sequence
  ELANE RNA Guide
ucguagccguuuucgaaguugc

SEQ ID NO: 12313 - RNA, 22 nt, Artificial Sequence
  ELANE RNA Guide
ugcagcgcaacuucgaaaacgg

SEQ ID NO: 12314 - RNA, 22 nt, Artificial Sequence
  ELANE RNA Guide
uguucgccgugcagcgcaacuu

SEQ ID NO: 12315 - RNA, 22 nt, Artificial Sequence
  ELANE RNA Guide
uucgaaguugcgcugcacggcg

SEQ ID NO: 12316 - RNA, 22 nt, Artificial Sequence
  ELANE RNA Guide
uucgccgugcagcgcaacuucg

SEQ ID NO: 12317 - RNA, 22 nt, Artificial Sequence
  ELANE RNA Guide
uuucgaaguugcgcugcacggc

SEQ ID NO: 12318 - RNA, 22 nt, Artificial Sequence
  ELANE RNA Guide
uuuucgaaguugcgcugcacgg

SEQ ID NO: 12319 - RNA, 20 nt, Artificial Sequence
  ELANE RNA Guide
aaaacggcuacgacccggua

SEQ ID NO: 12320 - RNA, 20 nt, Artificial Sequence
  ELANE RNA Guide
aaacggcuacgacccgguaa

SEQ ID NO: 12321 - RNA, 20 nt, Artificial Sequence
  ELANE RNA Guide
aacggcuacgacccgguaaa

SEQ ID NO: 12322 - RNA, 20 nt, Artificial Sequence
  ELANE RNA Guide
aaguuuaccgggucguagcc

SEQ ID NO: 12323 - RNA, 20 nt, Artificial Sequence
  ELANE RNA Guide
acccgguaaacuugcucaac

SEQ ID NO: 12324 - RNA, 20 nt, Artificial Sequence
  ELANE RNA Guide
accgggucguagccguuuuc

SEQ ID NO: 12325 - RNA, 20 nt, Artificial Sequence
  ELANE RNA Guide
acgacccgguaaacuugcuc

SEQ ID NO: 12326 - RNA, 20 nt, Artificial Sequence
  ELANE RNA Guide
acgaugucguugagcaaguu

SEQ ID NO: 12327 - RNA, 20 nt, Artificial Sequence
  ELANE RNA Guide
acggcuacgacccgguaaac

SEQ ID NO: 12328 - RNA, 20 nt, Artificial Sequence
  ELANE RNA Guide
agcaaguuuaccgggucgua

SEQ ID NO: 12329 - RNA, 20 nt, Artificial Sequence
  ELANE RNA Guide
aguuuaccgggucguagccg

SEQ ID NO: 12330 - RNA, 20 nt, Artificial Sequence
  ELANE RNA Guide
aucuucgaaaacggcuacga

SEQ ID NO: 12331 - RNA, 20 nt, Artificial Sequence
  ELANE RNA Guide
augucguugagcaaguuuac

SEQ ID NO: 12332 - RNA, 20 nt, Artificial Sequence
  ELANE RNA Guide
caaguuuaccgggucguagc

SEQ ID NO: 12333 - RNA, 20 nt, Artificial Sequence
  ELANE RNA Guide
cccgguaaacuugcucaacg

SEQ ID NO: 12334 - RNA, 20 nt, Artificial Sequence
  ELANE RNA Guide
ccgggucguagccguuuucg

SEQ ID NO: 12335 - RNA, 20 nt, Artificial Sequence
  ELANE RNA Guide
ccgguaaacuugcucaacga

SEQ ID NO: 12336 - RNA, 20 nt, Artificial Sequence
  ELANE RNA Guide
cgaaaacggcuacgacccgg

SEQ ID NO: 12337 - RNA, 20 nt, Artificial Sequence
  ELANE RNA Guide
cgacccgguaaacuugcuca

SEQ ID NO: 12338 - RNA, 20 nt, Artificial Sequence
  ELANE RNA Guide
cgaugucguugagcaaguuu

SEQ ID NO: 12339 - RNA, 20 nt, Artificial Sequence
  ELANE RNA Guide
cggcuacgacccgguaaacu

SEQ ID NO: 12340 - RNA, 20 nt, Artificial Sequence
  ELANE RNA Guide
cgguaaacuugcucaacgac

SEQ ID NO: 12341 - RNA, 20 nt, Artificial Sequence
  ELANE RNA Guide
cguugagcaaguuuaccggg

SEQ ID NO: 12342 - RNA, 20 nt, Artificial Sequence
  ELANE RNA Guide
cuacgacccgguaaacuugc

SEQ ID NO: 12343 - RNA, 20 nt, Artificial Sequence
  ELANE RNA Guide
cuucgaaaacggcuacgacc

SEQ ID NO: 12344 - RNA, 20 nt, Artificial Sequence
  ELANE RNA Guide
gaaaacggcuacgacccggu

SEQ ID NO: 12345 - RNA, 20 nt, Artificial Sequence
  ELANE RNA Guide
gacccgguaaacuugcucaa

SEQ ID NO: 12346 - RNA, 20 nt, Artificial Sequence
  ELANE RNA Guide
gagcaaguuuaccgggucgu

SEQ ID NO: 12347 - RNA, 20 nt, Artificial Sequence
  ELANE RNA Guide
gaugucguugagcaaguuua

SEQ ID NO: 12348 - RNA, 20 nt, Artificial Sequence
  ELANE RNA Guide
gcaaguuuaccgggucguag

SEQ ID NO: 12349 - RNA, 20 nt, Artificial Sequence
  ELANE RNA Guide
gcuacgacccgguaaacuug

SEQ ID NO: 12350 - RNA, 20 nt, Artificial Sequence
  ELANE RNA Guide
ggcuacgacccgguaaacuu

SEQ ID NO: 12351 - RNA, 20 nt, Artificial Sequence
  ELANE RNA Guide
gucguugagcaaguuuaccg

SEQ ID NO: 12352 - RNA, 20 nt, Artificial Sequence
  ELANE RNA Guide
guugagcaaguuuaccgggu

SEQ ID NO: 12353 - RNA, 20 nt, Artificial Sequence
  ELANE RNA Guide
guuuaccgggucguagccgu

SEQ ID NO: 12354 - RNA, 20 nt, Artificial Sequence
  ELANE RNA Guide
uaccgggucguagccguuuu

SEQ ID NO: 12355 - RNA, 20 nt, Artificial Sequence
  ELANE RNA Guide
uacgacccgguaaacuugcu

SEQ ID NO: 12356 - RNA, 20 nt, Artificial Sequence
  ELANE RNA Guide
ucgaaaacggcuacgacccg

SEQ ID NO: 12357 - RNA, 20 nt, Artificial Sequence
  ELANE RNA Guide
ucguugagcaaguuuaccgg

SEQ ID NO: 12358 - RNA, 20 nt, Artificial Sequence
  ELANE RNA Guide
ucuucgaaaacggcuacgac

SEQ ID NO: 12359 - RNA, 20 nt, Artificial Sequence
  ELANE RNA Guide
ugagcaaguuuaccgggucg

SEQ ID NO: 12360 - RNA, 20 nt, Artificial Sequence
  ELANE RNA Guide
ugucguugagcaaguuuacc

SEQ ID NO: 12361 - RNA, 20 nt, Artificial Sequence
  ELANE RNA Guide
uuaccgggucguagccguuu

SEQ ID NO: 12362 - RNA, 20 nt, Artificial Sequence
  ELANE RNA Guide
uucgaaaacggcuacgaccc

SEQ ID NO: 12363 - RNA, 20 nt, Artificial Sequence
  ELANE RNA Guide
uugagcaaguuuaccggguc

SEQ ID NO: 12364 - RNA, 20 nt, Artificial Sequence
  ELANE RNA Guide
uuuaccgggucguagccguu

SEQ ID NO: 12365 - RNA, 21 nt, Artificial Sequence
  ELANE RNA Guide
aaaacggcuacgacccgguaa

SEQ ID NO: 12366 - RNA, 21 nt, Artificial Sequence
  ELANE RNA Guide
aaacggcuacgacccgguaaa

SEQ ID NO: 12367 - RNA, 21 nt, Artificial Sequence
  ELANE RNA Guide
aacggcuacgacccgguaaac

SEQ ID NO: 12368 - RNA, 21 nt, Artificial Sequence
  ELANE RNA Guide
aaguuuaccgggucguagccg

SEQ ID NO: 12369 - RNA, 21 nt, Artificial Sequence
  ELANE RNA Guide
acccgguaaacuugcucaacg

SEQ ID NO: 12370 - RNA, 21 nt, Artificial Sequence
  ELANE RNA Guide
accgggucguagccguuuucg

SEQ ID NO: 12371 - RNA, 21 nt, Artificial Sequence
  ELANE RNA Guide
acgacccgguaaacuugcuca

SEQ ID NO: 12372 - RNA, 21 nt, Artificial Sequence
  ELANE RNA Guide
acgaugucguugagcaaguuu

SEQ ID NO: 12373 - RNA, 21 nt, Artificial Sequence
  ELANE RNA Guide
acggcuacgacccgguaaacu

SEQ ID NO: 12374 - RNA, 21 nt, Artificial Sequence
  ELANE RNA Guide
agcaaguuuaccgggucguag

SEQ ID NO: 12375 - RNA, 21 nt, Artificial Sequence
  ELANE RNA Guide
aguuuaccgggucguagccgu

SEQ ID NO: 12376 - RNA, 21 nt, Artificial Sequence
  ELANE RNA Guide
aucuucgaaaacggcuacgac

SEQ ID NO: 12377 - RNA, 21 nt, Artificial Sequence
  ELANE RNA Guide
augucguugagcaaguuuacc

SEQ ID NO: 12378 - RNA, 21 nt, Artificial Sequence
  ELANE RNA Guide
caaguuuaccgggucguagcc

SEQ ID NO: 12379 - RNA, 21 nt, Artificial Sequence
  ELANE RNA Guide
cacgaugucguugagcaaguu

SEQ ID NO: 12380 - RNA, 21 nt, Artificial Sequence
  ELANE RNA Guide
caucuucgaaaacggcuacga

SEQ ID NO: 12381 - RNA, 21 nt, Artificial Sequence
  ELANE RNA Guide
cccgguaaacuugcucaacga

SEQ ID NO: 12382 - RNA, 21 nt, Artificial Sequence
  ELANE RNA Guide
ccgggucguagccguuuucga

SEQ ID NO: 12383 - RNA, 21 nt, Artificial Sequence
  ELANE RNA Guide
ccgguaaacuugcucaacgac

SEQ ID NO: 12384 - RNA, 21 nt, Artificial Sequence
  ELANE RNA Guide
cgaaaacggcuacgacccggu

SEQ ID NO: 12385 - RNA, 21 nt, Artificial Sequence
  ELANE RNA Guide
cgacccgguaaacuugcucaa

SEQ ID NO: 12386 - RNA, 21 nt, Artificial Sequence
  ELANE RNA Guide
cgaugucguugagcaaguuua

SEQ ID NO: 12387 - RNA, 21 nt, Artificial Sequence
  ELANE RNA Guide
cggcuacgacccgguaaacuu

SEQ ID NO: 12388 - RNA, 21 nt, Artificial Sequence
  ELANE RNA Guide
cgguaaacuugcucaacgaca

SEQ ID NO: 12389 - RNA, 21 nt, Artificial Sequence
  ELANE RNA Guide
cguugagcaaguuuaccgggu

SEQ ID NO: 12390 - RNA, 21 nt, Artificial Sequence
  ELANE RNA Guide
cuacgacccgguaaacuugcu

SEQ ID NO: 12391 - RNA, 21 nt, Artificial Sequence
  ELANE RNA Guide
cuucgaaaacggcuacgaccc

SEQ ID NO: 12392 - RNA, 21 nt, Artificial Sequence
  ELANE RNA Guide
gaaaacggcuacgacccggua

SEQ ID NO: 12393 - RNA, 21 nt, Artificial Sequence
  ELANE RNA Guide
gacccgguaaacuugcucaac

SEQ ID NO: 12394 - RNA, 21 nt, Artificial Sequence
  ELANE RNA Guide
gagcaaguuuaccgggucgua

SEQ ID NO: 12395 - RNA, 21 nt, Artificial Sequence
  ELANE RNA Guide
gaugucguugagcaaguuuac

SEQ ID NO: 12396 - RNA, 21 nt, Artificial Sequence
  ELANE RNA Guide
gcaaguuuaccgggucguagc

SEQ ID NO: 12397 - RNA, 21 nt, Artificial Sequence
  ELANE RNA Guide
gcuacgacccgguaaacuugc

SEQ ID NO: 12398 - RNA, 21 nt, Artificial Sequence
  ELANE RNA Guide
ggcuacgacccgguaaacuug

SEQ ID NO: 12399 - RNA, 21 nt, Artificial Sequence
  ELANE RNA Guide
gucguugagcaaguuuaccgg

SEQ ID NO: 12400 - RNA, 21 nt, Artificial Sequence
  ELANE RNA Guide
guugagcaaguuuaccggguc

SEQ ID NO: 12401 - RNA, 21 nt, Artificial Sequence
  ELANE RNA Guide
guuuaccgggucguagccguu

SEQ ID NO: 12402 - RNA, 21 nt, Artificial Sequence
  ELANE RNA Guide
uaccgggucguagccguuuuc

SEQ ID NO: 12403 - RNA, 21 nt, Artificial Sequence
  ELANE RNA Guide
uacgacccgguaaacuugcuc

SEQ ID NO: 12404 - RNA, 21 nt, Artificial Sequence
  ELANE RNA Guide
ucgaaaacggcuacgacccgg

SEQ ID NO: 12405 - RNA, 21 nt, Artificial Sequence
  ELANE RNA Guide
ucguugagcaaguuuaccggg

SEQ ID NO: 12406 - RNA, 21 nt, Artificial Sequence
  ELANE RNA Guide
ucuucgaaaacggcuacgacc

SEQ ID NO: 12407 - RNA, 21 nt, Artificial Sequence
  ELANE RNA Guide
ugagcaaguuuaccgggucgu

SEQ ID NO: 12408 - RNA, 21 nt, Artificial Sequence
  ELANE RNA Guide
ugucguugagcaaguuuaccg

SEQ ID NO: 12409 - RNA, 21 nt, Artificial Sequence
  ELANE RNA Guide
uuaccgggucguagccguuuu

SEQ ID NO: 12410 - RNA, 21 nt, Artificial Sequence
  ELANE RNA Guide
uucgaaaacggcuacgacccg

SEQ ID NO: 12411 - RNA, 21 nt, Artificial Sequence
  ELANE RNA Guide
uugagcaaguuuaccgggucg

SEQ ID NO: 12412 - RNA, 21 nt, Artificial Sequence
  ELANE RNA Guide
uuuaccgggucguagccguuu

SEQ ID NO: 12413 - RNA, 22 nt, Artificial Sequence
  ELANE RNA Guide
aaaacggcuacgacccgguaaa

SEQ ID NO: 12414 - RNA, 22 nt, Artificial Sequence
  ELANE RNA Guide
aaacggcuacgacccgguaaac

SEQ ID NO: 12415 - RNA, 22 nt, Artificial Sequence
  ELANE RNA Guide
aacggcuacgacccgguaaacu

SEQ ID NO: 12416 - RNA, 22 nt, Artificial Sequence
  ELANE RNA Guide
aaguuuaccgggucguagccgu

SEQ ID NO: 12417 - RNA, 22 nt, Artificial Sequence
  ELANE RNA Guide
acccgguaaacuugcucaacga

SEQ ID NO: 12418 - RNA, 22 nt, Artificial Sequence
  ELANE RNA Guide
accgggucguagccguuuucga

SEQ ID NO: 12419 - RNA, 22 nt, Artificial Sequence
  ELANE RNA Guide
acgacccgguaaacuugcucaa

SEQ ID NO: 12420 - RNA, 22 nt, Artificial Sequence
  ELANE RNA Guide
acgaugucguugagcaaguuua

SEQ ID NO: 12421 - RNA, 22 nt, Artificial Sequence
  ELANE RNA Guide
acggcuacgacccgguaaacuu

SEQ ID NO: 12422 - RNA, 22 nt, Artificial Sequence
  ELANE RNA Guide
agcaaguuuaccgggucguagc

SEQ ID NO: 12423 - RNA, 22 nt, Artificial Sequence
  ELANE RNA Guide
aguuuaccgggucguagccguu

SEQ ID NO: 12424 - RNA, 22 nt, Artificial Sequence
  ELANE RNA Guide
aucuucgaaaacggcuacgacc

SEQ ID NO: 12425 - RNA, 22 nt, Artificial Sequence
  ELANE RNA Guide
augucguugagcaaguuuaccg

SEQ ID NO: 12426 - RNA, 22 nt, Artificial Sequence
  ELANE RNA Guide
caaguuuaccgggucguagccg

SEQ ID NO: 12427 - RNA, 22 nt, Artificial Sequence
  ELANE RNA Guide
cacgaugucguugagcaaguuu

SEQ ID NO: 12428 - RNA, 22 nt, Artificial Sequence
  ELANE RNA Guide
caucuucgaaaacggcuacgac

SEQ ID NO: 12429 - RNA, 22 nt, Artificial Sequence
  ELANE RNA Guide
cccgguaaacuugcucaacgac

SEQ ID NO: 12430 - RNA, 22 nt, Artificial Sequence
  ELANE RNA Guide
ccgggucguagccguuuucgaa

SEQ ID NO: 12431 - RNA, 22 nt, Artificial Sequence
  ELANE RNA Guide
ccgguaaacuugcucaacgaca

SEQ ID NO: 12432 - RNA, 22 nt, Artificial Sequence
  ELANE RNA Guide
cgaaaacggcuacgacccggua

SEQ ID NO: 12433 - RNA, 22 nt, Artificial Sequence
  ELANE RNA Guide
cgacccgguaaacuugcucaac

SEQ ID NO: 12434 - RNA, 22 nt, Artificial Sequence
  ELANE RNA Guide
cgaugucguugagcaaguuuac

SEQ ID NO: 12435 - RNA, 22 nt, Artificial Sequence
  ELANE RNA Guide
cggcuacgacccgguaaacuug

SEQ ID NO: 12436 - RNA, 22 nt, Artificial Sequence
  ELANE RNA Guide
cgguaaacuugcucaacgacau

SEQ ID NO: 12437 - RNA, 22 nt, Artificial Sequence
  ELANE RNA Guide
cguugagcaaguuuaccggguc

SEQ ID NO: 12438 - RNA, 22 nt, Artificial Sequence
  ELANE RNA Guide
cuacgacccgguaaacuugcuc

SEQ ID NO: 12439 - RNA, 22 nt, Artificial Sequence
  ELANE RNA Guide
cuucgaaaacggcuacgacccg

SEQ ID NO: 12440 - RNA, 22 nt, Artificial Sequence
  ELANE RNA Guide
gaaaacggcuacgacccgguaa

SEQ ID NO: 12441 - RNA, 22 nt, Artificial Sequence
  ELANE RNA Guide
gacccgguaaacuugcucaacg

SEQ ID NO: 12442 - RNA, 22 nt, Artificial Sequence
  ELANE RNA Guide
gagcaaguuuaccgggucguag

SEQ ID NO: 12443 - RNA, 22 nt, Artificial Sequence
  ELANE RNA Guide
gaugucguugagcaaguuuacc

SEQ ID NO: 12444 - RNA, 22 nt, Artificial Sequence
  ELANE RNA Guide
gcaaguuuaccgggucguagcc

SEQ ID NO: 12445 - RNA, 22 nt, Artificial Sequence
  ELANE RNA Guide
gcaucuucgaaaacggcuacga

SEQ ID NO: 12446 - RNA, 22 nt, Artificial Sequence
  ELANE RNA Guide
gcuacgacccgguaaacuugcu

SEQ ID NO: 12447 - RNA, 22 nt, Artificial Sequence
  ELANE RNA Guide
ggcuacgacccgguaaacuugc

SEQ ID NO: 12448 - RNA, 22 nt, Artificial Sequence
  ELANE RNA Guide
gucguugagcaaguuuaccggg

SEQ ID NO: 12449 - RNA, 22 nt, Artificial Sequence
  ELANE RNA Guide
guugagcaaguuuaccgggucg

SEQ ID NO: 12450 - RNA, 22 nt, Artificial Sequence
  ELANE RNA Guide
guuuaccgggucguagccguuu

SEQ ID NO: 12451 - RNA, 22 nt, Artificial Sequence
  ELANE RNA Guide
uaccgggucguagccguuuucg

SEQ ID NO: 12452 - RNA, 22 nt, Artificial Sequence
  ELANE RNA Guide
uacgacccgguaaacuugcuca

SEQ ID NO: 12453 - RNA, 22 nt, Artificial Sequence
  ELANE RNA Guide
ucacgaugucguugagcaaguu

SEQ ID NO: 12454 - RNA, 22 nt, Artificial Sequence
  ELANE RNA Guide
ucgaaaacggcuacgacccggu

SEQ ID NO: 12455 - RNA, 22 nt, Artificial Sequence
  ELANE RNA Guide
ucguugagcaaguuuaccgggu

SEQ ID NO: 12456 - RNA, 22 nt, Artificial Sequence
  ELANE RNA Guide
ucuucgaaaacggcuacgaccc

SEQ ID NO: 12457 - RNA, 22 nt, Artificial Sequence
  ELANE RNA Guide
ugagcaaguuuaccgggucgua

SEQ ID NO: 12458 - RNA, 22 nt, Artificial Sequence
  ELANE RNA Guide
ugucguugagcaaguuuaccgg

SEQ ID NO: 12459 - RNA, 22 nt, Artificial Sequence
  ELANE RNA Guide
uuaccgggucguagccguuuuc

SEQ ID NO: 12460 - RNA, 22 nt, Artificial Sequence
  ELANE RNA Guide
uucgaaaacggcuacgacccgg

SEQ ID NO: 12461 - RNA, 22 nt, Artificial Sequence
  ELANE RNA Guide
uugagcaaguuuaccgggucgu

SEQ ID NO: 12462 - RNA, 22 nt, Artificial Sequence
  ELANE RNA Guide
uuuaccgggucguagccguuuu

SEQ ID NO: 12463 - RNA, 20 nt, Artificial Sequence
  ELANE RNA Guide
aaaacggcuacgaccccguu

SEQ ID NO: 12464 - RNA, 20 nt, Artificial Sequence
  ELANE RNA Guide
aaacggcuacgaccccguuc

SEQ ID NO: 12465 - RNA, 20 nt, Artificial Sequence
  ELANE RNA Guide
aacggcuacgaccccguucu

SEQ ID NO: 12466 - RNA, 20 nt, Artificial Sequence
  ELANE RNA Guide
aacggggucguagccguuuu

SEQ ID NO: 12467 - RNA, 20 nt, Artificial Sequence
  ELANE RNA Guide
accccguucuccaggugccg

SEQ ID NO: 12468 - RNA, 20 nt, Artificial Sequence
  ELANE RNA Guide
accuggagaacggggucgua

SEQ ID NO: 12469 - RNA, 20 nt, Artificial Sequence
  ELANE RNA Guide
acgaccccguucuccaggug

SEQ ID NO: 12470 - RNA, 20 nt, Artificial Sequence
  ELANE RNA Guide
acggcuacgaccccguucuc

SEQ ID NO: 12471 - RNA, 20 nt, Artificial Sequence
  ELANE RNA Guide
agaacggggucguagccguu

SEQ ID NO: 12472 - RNA, 20 nt, Artificial Sequence
  ELANE RNA Guide
caccuggagaacggggucgu

SEQ ID NO: 12473 - RNA, 20 nt, Artificial Sequence
  ELANE RNA Guide
ccccguucuccaggugccgc

SEQ ID NO: 12474 - RNA, 20 nt, Artificial Sequence
  ELANE RNA Guide
cccggcggcaccuggagaac

SEQ ID NO: 12475 - RNA, 20 nt, Artificial Sequence
  ELANE RNA Guide
cccguucuccaggugccgcc

SEQ ID NO: 12476 - RNA, 20 nt, Artificial Sequence
  ELANE RNA Guide
ccggcggcaccuggagaacg

SEQ ID NO: 12477 - RNA, 20 nt, Artificial Sequence
  ELANE RNA Guide
ccguucuccaggugccgccg

SEQ ID NO: 12478 - RNA, 20 nt, Artificial Sequence
  ELANE RNA Guide
ccuggagaacggggucguag

SEQ ID NO: 12479 - RNA, 20 nt, Artificial Sequence
  ELANE RNA Guide
cgaaaacggcuacgaccccg

SEQ ID NO: 12480 - RNA, 20 nt, Artificial Sequence
  ELANE RNA Guide
cgaccccguucuccaggugc

SEQ ID NO: 12481 - RNA, 20 nt, Artificial Sequence
  ELANE RNA Guide
cgcccggcggcaccuggaga

SEQ ID NO: 12482 - RNA, 20 nt, Artificial Sequence
  ELANE RNA Guide
cggcaccuggagaacggggu

SEQ ID NO: 12483 - RNA, 20 nt, Artificial Sequence
  ELANE RNA Guide
cggcggcaccuggagaacgg

SEQ ID NO: 12484 - RNA, 20 nt, Artificial Sequence
  ELANE RNA Guide
cggcuacgaccccguucucc

SEQ ID NO: 12485 - RNA, 20 nt, Artificial Sequence
  ELANE RNA Guide
cguucuccaggugccgccgg

SEQ ID NO: 12486 - RNA, 20 nt, Artificial Sequence
  ELANE RNA Guide
cuacgaccccguucuccagg

SEQ ID NO: 12487 - RNA, 20 nt, Artificial Sequence
  ELANE RNA Guide
cuggagaacggggucguagc

SEQ ID NO: 12488 - RNA, 20 nt, Artificial Sequence
  ELANE RNA Guide
gaaaacggcuacgaccccgu

SEQ ID NO: 12489 - RNA, 20 nt, Artificial Sequence
  ELANE RNA Guide
gaacggggucguagccguuu

SEQ ID NO: 12490 - RNA, 20 nt, Artificial Sequence
  ELANE RNA Guide
gaccccguucuccaggugcc

SEQ ID NO: 12491 - RNA, 20 nt, Artificial Sequence
  ELANE RNA Guide
gagaacggggucguagccgu

SEQ ID NO: 12492 - RNA, 20 nt, Artificial Sequence
  ELANE RNA Guide
gcaccuggagaacggggucg

SEQ ID NO: 12493 - RNA, 20 nt, Artificial Sequence
  ELANE RNA Guide
gcccggcggcaccuggagaa

SEQ ID NO: 12494 - RNA, 20 nt, Artificial Sequence
  ELANE RNA Guide
gcggcaccuggagaacgggg

SEQ ID NO: 12495 - RNA, 20 nt, Artificial Sequence
  ELANE RNA Guide
gcuacgaccccguucuccag

SEQ ID NO: 12496 - RNA, 20 nt, Artificial Sequence
  ELANE RNA Guide
ggagaacggggucguagccg

SEQ ID NO: 12497 - RNA, 20 nt, Artificial Sequence
  ELANE RNA Guide
ggcaccuggagaacgggguc

SEQ ID NO: 12498 - RNA, 20 nt, Artificial Sequence
  ELANE RNA Guide
ggcggcaccuggagaacggg

SEQ ID NO: 12499 - RNA, 20 nt, Artificial Sequence
  ELANE RNA Guide
ggcuacgaccccguucucca

SEQ ID NO: 12500 - RNA, 20 nt, Artificial Sequence
  ELANE RNA Guide
guucuccaggugccgccggg

SEQ ID NO: 12501 - RNA, 20 nt, Artificial Sequence
  ELANE RNA Guide
uacgaccccguucuccaggu

SEQ ID NO: 12502 - RNA, 20 nt, Artificial Sequence
  ELANE RNA Guide
ucgaaaacggcuacgacccc

SEQ ID NO: 12503 - RNA, 20 nt, Artificial Sequence
  ELANE RNA Guide
uggagaacggggucguagcc

SEQ ID NO: 12504 - RNA, 21 nt, Artificial Sequence
  ELANE RNA Guide
aaaacggcuacgaccccguuc

SEQ ID NO: 12505 - RNA, 21 nt, Artificial Sequence
  ELANE RNA Guide
aaacggcuacgaccccguucu

SEQ ID NO: 12506 - RNA, 21 nt, Artificial Sequence
  ELANE RNA Guide
aacggcuacgaccccguucuc

SEQ ID NO: 12507 - RNA, 21 nt, Artificial Sequence
  ELANE RNA Guide
aacggggucguagccguuuuc

SEQ ID NO: 12508 - RNA, 21 nt, Artificial Sequence
  ELANE RNA Guide
accccguucuccaggugccgc

SEQ ID NO: 12509 - RNA, 21 nt, Artificial Sequence
  ELANE RNA Guide
accuggagaacggggucguag

SEQ ID NO: 12510 - RNA, 21 nt, Artificial Sequence
  ELANE RNA Guide
acgaccccguucuccaggugc

SEQ ID NO: 12511 - RNA, 21 nt, Artificial Sequence
  ELANE RNA Guide
acggcuacgaccccguucucc

SEQ ID NO: 12512 - RNA, 21 nt, Artificial Sequence
  ELANE RNA Guide
agaacggggucguagccguuu

SEQ ID NO: 12513 - RNA, 21 nt, Artificial Sequence
  ELANE RNA Guide
caccuggagaacggggucgua

SEQ ID NO: 12514 - RNA, 21 nt, Artificial Sequence
  ELANE RNA Guide
ccccguucuccaggugccgcc

SEQ ID NO: 12515 - RNA, 21 nt, Artificial Sequence
  ELANE RNA Guide
cccggcggcaccuggagaacg

SEQ ID NO: 12516 - RNA, 21 nt, Artificial Sequence
  ELANE RNA Guide
cccguucuccaggugccgccg

SEQ ID NO: 12517 - RNA, 21 nt, Artificial Sequence
  ELANE RNA Guide
ccggcggcaccuggagaacgg

SEQ ID NO: 12518 - RNA, 21 nt, Artificial Sequence
  ELANE RNA Guide
ccguucuccaggugccgccgg

SEQ ID NO: 12519 - RNA, 21 nt, Artificial Sequence
  ELANE RNA Guide
ccuggagaacggggucguagc

SEQ ID NO: 12520 - RNA, 21 nt, Artificial Sequence
  ELANE RNA Guide
cgaaaacggcuacgaccccgu

SEQ ID NO: 12521 - RNA, 21 nt, Artificial Sequence
  ELANE RNA Guide
cgaccccguucuccaggugcc

SEQ ID NO: 12522 - RNA, 21 nt, Artificial Sequence
  ELANE RNA Guide
cgcccggcggcaccuggagaa

SEQ ID NO: 12523 - RNA, 21 nt, Artificial Sequence
  ELANE RNA Guide
cggcaccuggagaacgggguc

SEQ ID NO: 12524 - RNA, 21 nt, Artificial Sequence
  ELANE RNA Guide
cggcggcaccuggagaacggg

SEQ ID NO: 12525 - RNA, 21 nt, Artificial Sequence
  ELANE RNA Guide
cggcuacgaccccguucucca

SEQ ID NO: 12526 - RNA, 21 nt, Artificial Sequence
  ELANE RNA Guide
cguucuccaggugccgccggg

SEQ ID NO: 12527 - RNA, 21 nt, Artificial Sequence
  ELANE RNA Guide
cuacgaccccguucuccaggu

SEQ ID NO: 12528 - RNA, 21 nt, Artificial Sequence
  ELANE RNA Guide
cuggagaacggggucguagcc

SEQ ID NO: 12529 - RNA, 21 nt, Artificial Sequence
  ELANE RNA Guide
gaaaacggcuacgaccccguu

SEQ ID NO: 12530 - RNA, 21 nt, Artificial Sequence
  ELANE RNA Guide
gaacggggucguagccguuuu

SEQ ID NO: 12531 - RNA, 21 nt, Artificial Sequence
  ELANE RNA Guide
gaccccguucuccaggugccg

SEQ ID NO: 12532 - RNA, 21 nt, Artificial Sequence
  ELANE RNA Guide
gagaacggggucguagccguu

SEQ ID NO: 12533 - RNA, 21 nt, Artificial Sequence
  ELANE RNA Guide
gcaccuggagaacggggucgu

SEQ ID NO: 12534 - RNA, 21 nt, Artificial Sequence
  ELANE RNA Guide
gcccggcggcaccuggagaac

SEQ ID NO: 12535 - RNA, 21 nt, Artificial Sequence
  ELANE RNA Guide
gcggcaccuggagaacggggu

SEQ ID NO: 12536 - RNA, 21 nt, Artificial Sequence
  ELANE RNA Guide
gcuacgaccccguucuccagg

SEQ ID NO: 12537 - RNA, 21 nt, Artificial Sequence
  ELANE RNA Guide
ggagaacggggucguagccgu

SEQ ID NO: 12538 - RNA, 21 nt, Artificial Sequence
  ELANE RNA Guide
ggcaccuggagaacggggucg

SEQ ID NO: 12539 - RNA, 21 nt, Artificial Sequence
  ELANE RNA Guide
ggcggcaccuggagaacgggg

SEQ ID NO: 12540 - RNA, 21 nt, Artificial Sequence
  ELANE RNA Guide
ggcuacgaccccguucuccag

SEQ ID NO: 12541 - RNA, 21 nt, Artificial Sequence
  ELANE RNA Guide
guucuccaggugccgccgggc

SEQ ID NO: 12542 - RNA, 21 nt, Artificial Sequence
  ELANE RNA Guide
uacgaccccguucuccaggug

SEQ ID NO: 12543 - RNA, 21 nt, Artificial Sequence
  ELANE RNA Guide
ucgaaaacggcuacgaccccg

SEQ ID NO: 12544 - RNA, 21 nt, Artificial Sequence
  ELANE RNA Guide
uggagaacggggucguagccg

SEQ ID NO: 12545 - RNA, 21 nt, Artificial Sequence
  ELANE RNA Guide
uucgaaaacggcuacgacccc

SEQ ID NO: 12546 - RNA, 22 nt, Artificial Sequence
  ELANE RNA Guide
aaaacggcuacgaccccguucu

SEQ ID NO: 12547 - RNA, 22 nt, Artificial Sequence
  ELANE RNA Guide
aaacggcuacgaccccguucuc

SEQ ID NO: 12548 - RNA, 22 nt, Artificial Sequence
  ELANE RNA Guide
aacggcuacgaccccguucucc

SEQ ID NO: 12549 - RNA, 22 nt, Artificial Sequence
  ELANE RNA Guide
aacggggucguagccguuuucg

SEQ ID NO: 12550 - RNA, 22 nt, Artificial Sequence
  ELANE RNA Guide
accccguucuccaggugccgcc

SEQ ID NO: 12551 - RNA, 22 nt, Artificial Sequence
  ELANE RNA Guide
accuggagaacggggucguagc

SEQ ID NO: 12552 - RNA, 22 nt, Artificial Sequence
  ELANE RNA Guide
acgaccccguucuccaggugcc

SEQ ID NO: 12553 - RNA, 22 nt, Artificial Sequence
  ELANE RNA Guide
acggcuacgaccccguucucca

SEQ ID NO: 12554 - RNA, 22 nt, Artificial Sequence
  ELANE RNA Guide
agaacggggucguagccguuuu

SEQ ID NO: 12555 - RNA, 22 nt, Artificial Sequence
  ELANE RNA Guide
caccuggagaacggggucguag

SEQ ID NO: 12556 - RNA, 22 nt, Artificial Sequence
  ELANE RNA Guide
ccccguucuccaggugccgccg

SEQ ID NO: 12557 - RNA, 22 nt, Artificial Sequence
  ELANE RNA Guide
cccggcggcaccuggagaacgg

SEQ ID NO: 12558 - RNA, 22 nt, Artificial Sequence
  ELANE RNA Guide
cccguucuccaggugccgccgg

SEQ ID NO: 12559 - RNA, 22 nt, Artificial Sequence
  ELANE RNA Guide
ccgcccggcggcaccuggagaa

SEQ ID NO: 12560 - RNA, 22 nt, Artificial Sequence
  ELANE RNA Guide
ccggcggcaccuggagaacggg

SEQ ID NO: 12561 - RNA, 22 nt, Artificial Sequence
  ELANE RNA Guide
ccguucuccaggugccgccggg

SEQ ID NO: 12562 - RNA, 22 nt, Artificial Sequence
  ELANE RNA Guide
ccuggagaacggggucguagcc

SEQ ID NO: 12563 - RNA, 22 nt, Artificial Sequence
  ELANE RNA Guide
cgaaaacggcuacgaccccguu

SEQ ID NO: 12564 - RNA, 22 nt, Artificial Sequence
  ELANE RNA Guide
cgaccccguucuccaggugccg

SEQ ID NO: 12565 - RNA, 22 nt, Artificial Sequence
  ELANE RNA Guide
cgcccggcggcaccuggagaac

SEQ ID NO: 12566 - RNA, 22 nt, Artificial Sequence
  ELANE RNA Guide
cggcaccuggagaacggggucg

SEQ ID NO: 12567 - RNA, 22 nt, Artificial Sequence
  ELANE RNA Guide
cggcggcaccuggagaacgggg

SEQ ID NO: 12568 - RNA, 22 nt, Artificial Sequence
  ELANE RNA Guide
cggcuacgaccccguucuccag

SEQ ID NO: 12569 - RNA, 22 nt, Artificial Sequence
  ELANE RNA Guide
cguucuccaggugccgccgggc

SEQ ID NO: 12570 - RNA, 22 nt, Artificial Sequence
  ELANE RNA Guide
cuacgaccccguucuccaggug

SEQ ID NO: 12571 - RNA, 22 nt, Artificial Sequence
  ELANE RNA Guide
cuggagaacggggucguagccg

SEQ ID NO: 12572 - RNA, 22 nt, Artificial Sequence
  ELANE RNA Guide
cuucgaaaacggcuacgacccc

SEQ ID NO: 12573 - RNA, 22 nt, Artificial Sequence
  ELANE RNA Guide
gaaaacggcuacgaccccguuc

SEQ ID NO: 12574 - RNA, 22 nt, Artificial Sequence
  ELANE RNA Guide
gaacggggucguagccguuuuc

SEQ ID NO: 12575 - RNA, 22 nt, Artificial Sequence
  ELANE RNA Guide
gaccccguucuccaggugccgc

SEQ ID NO: 12576 - RNA, 22 nt, Artificial Sequence
  ELANE RNA Guide
gagaacggggucguagccguuu

SEQ ID NO: 12577 - RNA, 22 nt, Artificial Sequence
  ELANE RNA Guide
gcaccuggagaacggggucgua

SEQ ID NO: 12578 - RNA, 22 nt, Artificial Sequence
  ELANE RNA Guide
gcccggcggcaccuggagaacg

SEQ ID NO: 12579 - RNA, 22 nt, Artificial Sequence
  ELANE RNA Guide
gcggcaccuggagaacgggguc

SEQ ID NO: 12580 - RNA, 22 nt, Artificial Sequence
  ELANE RNA Guide
gcuacgaccccguucuccaggu

SEQ ID NO: 12581 - RNA, 22 nt, Artificial Sequence
  ELANE RNA Guide
ggagaacggggucguagccguu

SEQ ID NO: 12582 - RNA, 22 nt, Artificial Sequence
  ELANE RNA Guide
ggcaccuggagaacggggucgu

SEQ ID NO: 12583 - RNA, 22 nt, Artificial Sequence
  ELANE RNA Guide
ggcggcaccuggagaacggggu

SEQ ID NO: 12584 - RNA, 22 nt, Artificial Sequence
  ELANE RNA Guide
ggcuacgaccccguucuccagg

SEQ ID NO: 12585 - RNA, 22 nt, Artificial Sequence
  ELANE RNA Guide
guucuccaggugccgccgggcg

SEQ ID NO: 12586 - RNA, 22 nt, Artificial Sequence
  ELANE RNA Guide
uacgaccccguucuccaggugc

SEQ ID NO: 12587 - RNA, 22 nt, Artificial Sequence
  ELANE RNA Guide
ucgaaaacggcuacgaccccgu

SEQ ID NO: 12588 - RNA, 22 nt, Artificial Sequence
  ELANE RNA Guide
uggagaacggggucguagccgu

SEQ ID NO: 12589 - RNA, 22 nt, Artificial Sequence
  ELANE RNA Guide
uucgaaaacggcuacgaccccg

SEQ ID NO: 12590 - RNA, 20 nt, Artificial Sequence
  ELANE RNA Guide
aaaacggcuacgaccccgua

SEQ ID NO: 12591 - RNA, 20 nt, Artificial Sequence
  ELANE RNA Guide
aaacggcuacgaccccguaa

SEQ ID NO: 12592 - RNA, 20 nt, Artificial Sequence
  ELANE RNA Guide
aacggcuacgaccccguaau

SEQ ID NO: 12593 - RNA, 20 nt, Artificial Sequence
  ELANE RNA Guide
aagauuacggggucguagcc

SEQ ID NO: 12594 - RNA, 20 nt, Artificial Sequence
  ELANE RNA Guide
aaucacgaugucguugagca

SEQ ID NO: 12595 - RNA, 20 nt, Artificial Sequence
  ELANE RNA Guide
aaucuugcucaacgacaucg

SEQ ID NO: 12596 - RNA, 20 nt, Artificial Sequence
  ELANE RNA Guide
accccguaaucuugcucaac

SEQ ID NO: 12597 - RNA, 20 nt, Artificial Sequence
  ELANE RNA Guide
acgaccccguaaucuugcuc

SEQ ID NO: 12598 - RNA, 20 nt, Artificial Sequence
  ELANE RNA Guide
acgaugucguugagcaagau

SEQ ID NO: 12599 - RNA, 20 nt, Artificial Sequence
  ELANE RNA Guide
acggcuacgaccccguaauc

SEQ ID NO: 12600 - RNA, 20 nt, Artificial Sequence
  ELANE RNA Guide
agauuacggggucguagccg

SEQ ID NO: 12601 - RNA, 20 nt, Artificial Sequence
  ELANE RNA Guide
agcaagauuacggggucgua

SEQ ID NO: 12602 - RNA, 20 nt, Artificial Sequence
  ELANE RNA Guide
aucacgaugucguugagcaa

SEQ ID NO: 12603 - RNA, 20 nt, Artificial Sequence
  ELANE RNA Guide
aucuugcucaacgacaucgu

SEQ ID NO: 12604 - RNA, 20 nt, Artificial Sequence
  ELANE RNA Guide
augucguugagcaagauuac

SEQ ID NO: 12605 - RNA, 20 nt, Artificial Sequence
  ELANE RNA Guide
caagauuacggggucguagc

SEQ ID NO: 12606 - RNA, 20 nt, Artificial Sequence
  ELANE RNA Guide
cacgaugucguugagcaaga

SEQ ID NO: 12607 - RNA, 20 nt, Artificial Sequence
  ELANE RNA Guide
ccccguaaucuugcucaacg

SEQ ID NO: 12608 - RNA, 20 nt, Artificial Sequence
  ELANE RNA Guide
cccguaaucuugcucaacga

SEQ ID NO: 12609 - RNA, 20 nt, Artificial Sequence
  ELANE RNA Guide
ccguaaucuugcucaacgac

SEQ ID NO: 12610 - RNA, 20 nt, Artificial Sequence
  ELANE RNA Guide
cgaccccguaaucuugcuca

SEQ ID NO: 12611 - RNA, 20 nt, Artificial Sequence
  ELANE RNA Guide
cgaugucguugagcaagauu

SEQ ID NO: 12612 - RNA, 20 nt, Artificial Sequence
  ELANE RNA Guide
cggcuacgaccccguaaucu

SEQ ID NO: 12613 - RNA, 20 nt, Artificial Sequence
  ELANE RNA Guide
cguaaucuugcucaacgaca

SEQ ID NO: 12614 - RNA, 20 nt, Artificial Sequence
  ELANE RNA Guide
cguugagcaagauuacgggg

SEQ ID NO: 12615 - RNA, 20 nt, Artificial Sequence
  ELANE RNA Guide
cuacgaccccguaaucuugc

SEQ ID NO: 12616 - RNA, 20 nt, Artificial Sequence
  ELANE RNA Guide
gaaucacgaugucguugagc

SEQ ID NO: 12617 - RNA, 20 nt, Artificial Sequence
  ELANE RNA Guide
gaccccguaaucuugcucaa

SEQ ID NO: 12618 - RNA, 20 nt, Artificial Sequence
  ELANE RNA Guide
gagcaagauuacggggucgu

SEQ ID NO: 12619 - RNA, 20 nt, Artificial Sequence
  ELANE RNA Guide
gaugucguugagcaagauua

SEQ ID NO: 12620 - RNA, 20 nt, Artificial Sequence
  ELANE RNA Guide
gauuacggggucguagccgu

SEQ ID NO: 12621 - RNA, 20 nt, Artificial Sequence
  ELANE RNA Guide
gcaagauuacggggucguag

SEQ ID NO: 12622 - RNA, 20 nt, Artificial Sequence
  ELANE RNA Guide
gcuacgaccccguaaucuug

SEQ ID NO: 12623 - RNA, 20 nt, Artificial Sequence
  ELANE RNA Guide
ggcuacgaccccguaaucuu

SEQ ID NO: 12624 - RNA, 20 nt, Artificial Sequence
  ELANE RNA Guide
guaaucuugcucaacgacau

SEQ ID NO: 12625 - RNA, 20 nt, Artificial Sequence
  ELANE RNA Guide
gucguugagcaagauuacgg

SEQ ID NO: 12626 - RNA, 20 nt, Artificial Sequence
  ELANE RNA Guide
guugagcaagauuacggggu

SEQ ID NO: 12627 - RNA, 20 nt, Artificial Sequence
  ELANE RNA Guide
uaaucuugcucaacgacauc

SEQ ID NO: 12628 - RNA, 20 nt, Artificial Sequence
  ELANE RNA Guide
uacgaccccguaaucuugcu

SEQ ID NO: 12629 - RNA, 20 nt, Artificial Sequence
  ELANE RNA Guide
ucacgaugucguugagcaag

SEQ ID NO: 12630 - RNA, 20 nt, Artificial Sequence
  ELANE RNA Guide
ucguugagcaagauuacggg

SEQ ID NO: 12631 - RNA, 20 nt, Artificial Sequence
  ELANE RNA Guide
ugagcaagauuacggggucg

SEQ ID NO: 12632 - RNA, 20 nt, Artificial Sequence
  ELANE RNA Guide
ugucguugagcaagauuacg

SEQ ID NO: 12633 - RNA, 20 nt, Artificial Sequence
  ELANE RNA Guide
uugagcaagauuacgggguc

SEQ ID NO: 12634 - RNA, 21 nt, Artificial Sequence
  ELANE RNA Guide
aaaacggcuacgaccccguaa

SEQ ID NO: 12635 - RNA, 21 nt, Artificial Sequence
  ELANE RNA Guide
aaacggcuacgaccccguaau

SEQ ID NO: 12636 - RNA, 21 nt, Artificial Sequence
  ELANE RNA Guide
aacggcuacgaccccguaauc

SEQ ID NO: 12637 - RNA, 21 nt, Artificial Sequence
  ELANE RNA Guide
aagauuacggggucguagccg

SEQ ID NO: 12638 - RNA, 21 nt, Artificial Sequence
  ELANE RNA Guide
aaucacgaugucguugagcaa

SEQ ID NO: 12639 - RNA, 21 nt, Artificial Sequence
  ELANE RNA Guide
aaucuugcucaacgacaucgu

SEQ ID NO: 12640 - RNA, 21 nt, Artificial Sequence
  ELANE RNA Guide
accccguaaucuugcucaacg

SEQ ID NO: 12641 - RNA, 21 nt, Artificial Sequence
  ELANE RNA Guide
acgaccccguaaucuugcuca

SEQ ID NO: 12642 - RNA, 21 nt, Artificial Sequence
  ELANE RNA Guide
acgaugucguugagcaagauu

SEQ ID NO: 12643 - RNA, 21 nt, Artificial Sequence
  ELANE RNA Guide
acggcuacgaccccguaaucu

SEQ ID NO: 12644 - RNA, 21 nt, Artificial Sequence
  ELANE RNA Guide
agaaucacgaugucguugagc

SEQ ID NO: 12645 - RNA, 21 nt, Artificial Sequence
  ELANE RNA Guide
agauuacggggucguagccgu

SEQ ID NO: 12646 - RNA, 21 nt, Artificial Sequence
  ELANE RNA Guide
agcaagauuacggggucguag

SEQ ID NO: 12647 - RNA, 21 nt, Artificial Sequence
  ELANE RNA Guide
aucacgaugucguugagcaag

SEQ ID NO: 12648 - RNA, 21 nt, Artificial Sequence
  ELANE RNA Guide
aucuugcucaacgacaucgug

SEQ ID NO: 12649 - RNA, 21 nt, Artificial Sequence
  ELANE RNA Guide
augucguugagcaagauuacg

SEQ ID NO: 12650 - RNA, 21 nt, Artificial Sequence
  ELANE RNA Guide
caagauuacggggucguagcc

SEQ ID NO: 12651 - RNA, 21 nt, Artificial Sequence
  ELANE RNA Guide
cacgaugucguugagcaagau

SEQ ID NO: 12652 - RNA, 21 nt, Artificial Sequence
  ELANE RNA Guide
ccccguaaucuugcucaacga

SEQ ID NO: 12653 - RNA, 21 nt, Artificial Sequence
  ELANE RNA Guide
cccguaaucuugcucaacgac

SEQ ID NO: 12654 - RNA, 21 nt, Artificial Sequence
  ELANE RNA Guide
ccguaaucuugcucaacgaca

SEQ ID NO: 12655 - RNA, 21 nt, Artificial Sequence
  ELANE RNA Guide
cgaccccguaaucuugcucaa

SEQ ID NO: 12656 - RNA, 21 nt, Artificial Sequence
  ELANE RNA Guide
cgaugucguugagcaagauua

SEQ ID NO: 12657 - RNA, 21 nt, Artificial Sequence
  ELANE RNA Guide
cggcuacgaccccguaaucuu

SEQ ID NO: 12658 - RNA, 21 nt, Artificial Sequence
  ELANE RNA Guide
cguaaucuugcucaacgacau

SEQ ID NO: 12659 - RNA, 21 nt, Artificial Sequence
  ELANE RNA Guide
cguugagcaagauuacggggu

SEQ ID NO: 12660 - RNA, 21 nt, Artificial Sequence
  ELANE RNA Guide
cuacgaccccguaaucuugcu

SEQ ID NO: 12661 - RNA, 21 nt, Artificial Sequence
  ELANE RNA Guide
gaaaacggcuacgaccccgua

SEQ ID NO: 12662 - RNA, 21 nt, Artificial Sequence
  ELANE RNA Guide
gaaucacgaugucguugagca

SEQ ID NO: 12663 - RNA, 21 nt, Artificial Sequence
  ELANE RNA Guide
gaccccguaaucuugcucaac

SEQ ID NO: 12664 - RNA, 21 nt, Artificial Sequence
  ELANE RNA Guide
gagcaagauuacggggucgua

SEQ ID NO: 12665 - RNA, 21 nt, Artificial Sequence
  ELANE RNA Guide
gaugucguugagcaagauuac

SEQ ID NO: 12666 - RNA, 21 nt, Artificial Sequence
  ELANE RNA Guide
gauuacggggucguagccguu

SEQ ID NO: 12667 - RNA, 21 nt, Artificial Sequence
  ELANE RNA Guide
gcaagauuacggggucguagc

SEQ ID NO: 12668 - RNA, 21 nt, Artificial Sequence
  ELANE RNA Guide
gcuacgaccccguaaucuugc

SEQ ID NO: 12669 - RNA, 21 nt, Artificial Sequence
  ELANE RNA Guide
ggcuacgaccccguaaucuug

SEQ ID NO: 12670 - RNA, 21 nt, Artificial Sequence
  ELANE RNA Guide
guaaucuugcucaacgacauc

SEQ ID NO: 12671 - RNA, 21 nt, Artificial Sequence
  ELANE RNA Guide
gucguugagcaagauuacggg

SEQ ID NO: 12672 - RNA, 21 nt, Artificial Sequence
  ELANE RNA Guide
guugagcaagauuacgggguc

SEQ ID NO: 12673 - RNA, 21 nt, Artificial Sequence
  ELANE RNA Guide
uaaucuugcucaacgacaucg

SEQ ID NO: 12674 - RNA, 21 nt, Artificial Sequence
  ELANE RNA Guide
uacgaccccguaaucuugcuc

SEQ ID NO: 12675 - RNA, 21 nt, Artificial Sequence
  ELANE RNA Guide
ucacgaugucguugagcaaga

SEQ ID NO: 12676 - RNA, 21 nt, Artificial Sequence
  ELANE RNA Guide
ucguugagcaagauuacgggg

SEQ ID NO: 12677 - RNA, 21 nt, Artificial Sequence
  ELANE RNA Guide
ugagcaagauuacggggucgu

SEQ ID NO: 12678 - RNA, 21 nt, Artificial Sequence
  ELANE RNA Guide
ugucguugagcaagauuacgg

SEQ ID NO: 12679 - RNA, 21 nt, Artificial Sequence
  ELANE RNA Guide
uugagcaagauuacggggucg

SEQ ID NO: 12680 - RNA, 22 nt, Artificial Sequence
  ELANE RNA Guide
aaaacggcuacgaccccguaau

SEQ ID NO: 12681 - RNA, 22 nt, Artificial Sequence
  ELANE RNA Guide
aaacggcuacgaccccguaauc

SEQ ID NO: 12682 - RNA, 22 nt, Artificial Sequence
  ELANE RNA Guide
aacggcuacgaccccguaaucu

SEQ ID NO: 12683 - RNA, 22 nt, Artificial Sequence
  ELANE RNA Guide
aagauuacggggucguagccgu

SEQ ID NO: 12684 - RNA, 22 nt, Artificial Sequence
  ELANE RNA Guide
aaucacgaugucguugagcaag

SEQ ID NO: 12685 - RNA, 22 nt, Artificial Sequence
  ELANE RNA Guide
aaucuugcucaacgacaucgug

SEQ ID NO: 12686 - RNA, 22 nt, Artificial Sequence
  ELANE RNA Guide
accccguaaucuugcucaacga

SEQ ID NO: 12687 - RNA, 22 nt, Artificial Sequence
  ELANE RNA Guide
acgaccccguaaucuugcucaa

SEQ ID NO: 12688 - RNA, 22 nt, Artificial Sequence
  ELANE RNA Guide
acgaugucguugagcaagauua

SEQ ID NO: 12689 - RNA, 22 nt, Artificial Sequence
  ELANE RNA Guide
acggcuacgaccccguaaucuu

SEQ ID NO: 12690 - RNA, 22 nt, Artificial Sequence
  ELANE RNA Guide
agaaucacgaugucguugagca

SEQ ID NO: 12691 - RNA, 22 nt, Artificial Sequence
  ELANE RNA Guide
agauuacggggucguagccguu

SEQ ID NO: 12692 - RNA, 22 nt, Artificial Sequence
  ELANE RNA Guide
agcaagauuacggggucguagc

SEQ ID NO: 12693 - RNA, 22 nt, Artificial Sequence
  ELANE RNA Guide
aucacgaugucguugagcaaga

SEQ ID NO: 12694 - RNA, 22 nt, Artificial Sequence
  ELANE RNA Guide
aucuugcucaacgacaucguga

SEQ ID NO: 12695 - RNA, 22 nt, Artificial Sequence
  ELANE RNA Guide
augucguugagcaagauuacgg

SEQ ID NO: 12696 - RNA, 22 nt, Artificial Sequence
  ELANE RNA Guide
caagauuacggggucguagccg

SEQ ID NO: 12697 - RNA, 22 nt, Artificial Sequence
  ELANE RNA Guide
cacgaugucguugagcaagauu

SEQ ID NO: 12698 - RNA, 22 nt, Artificial Sequence
  ELANE RNA Guide
ccccguaaucuugcucaacgac

SEQ ID NO: 12699 - RNA, 22 nt, Artificial Sequence
  ELANE RNA Guide
cccguaaucuugcucaacgaca

SEQ ID NO: 12700 - RNA, 22 nt, Artificial Sequence
  ELANE RNA Guide
ccguaaucuugcucaacgacau

SEQ ID NO: 12701 - RNA, 22 nt, Artificial Sequence
  ELANE RNA Guide
cgaaaacggcuacgaccccgua

SEQ ID NO: 12702 - RNA, 22 nt, Artificial Sequence
  ELANE RNA Guide
cgaccccguaaucuugcucaac

SEQ ID NO: 12703 - RNA, 22 nt, Artificial Sequence
  ELANE RNA Guide
cgaugucguugagcaagauuac

SEQ ID NO: 12704 - RNA, 22 nt, Artificial Sequence
  ELANE RNA Guide
cggcuacgaccccguaaucuug

SEQ ID NO: 12705 - RNA, 22 nt, Artificial Sequence
  ELANE RNA Guide
cguaaucuugcucaacgacauc

SEQ ID NO: 12706 - RNA, 22 nt, Artificial Sequence
  ELANE RNA Guide
cguugagcaagauuacgggguc

SEQ ID NO: 12707 - RNA, 22 nt, Artificial Sequence
  ELANE RNA Guide
cuacgaccccguaaucuugcuc

SEQ ID NO: 12708 - RNA, 22 nt, Artificial Sequence
  ELANE RNA Guide
gaaaacggcuacgaccccguaa

SEQ ID NO: 12709 - RNA, 22 nt, Artificial Sequence
  ELANE RNA Guide
gaaucacgaugucguugagcaa

SEQ ID NO: 12710 - RNA, 22 nt, Artificial Sequence
  ELANE RNA Guide
gaccccguaaucuugcucaacg

SEQ ID NO: 12711 - RNA, 22 nt, Artificial Sequence
  ELANE RNA Guide
gagaaucacgaugucguugagc

SEQ ID NO: 12712 - RNA, 22 nt, Artificial Sequence
  ELANE RNA Guide
gagcaagauuacggggucguag

SEQ ID NO: 12713 - RNA, 22 nt, Artificial Sequence
  ELANE RNA Guide
gaugucguugagcaagauuacg

SEQ ID NO: 12714 - RNA, 22 nt, Artificial Sequence
  ELANE RNA Guide
gauuacggggucguagccguuu

SEQ ID NO: 12715 - RNA, 22 nt, Artificial Sequence
  ELANE RNA Guide
gcaagauuacggggucguagcc

SEQ ID NO: 12716 - RNA, 22 nt, Artificial Sequence
  ELANE RNA Guide
gcuacgaccccguaaucuugcu

SEQ ID NO: 12717 - RNA, 22 nt, Artificial Sequence
  ELANE RNA Guide
ggcuacgaccccguaaucuugc

SEQ ID NO: 12718 - RNA, 22 nt, Artificial Sequence
  ELANE RNA Guide
guaaucuugcucaacgacaucg

SEQ ID NO: 12719 - RNA, 22 nt, Artificial Sequence
  ELANE RNA Guide
gucguugagcaagauuacgggg

SEQ ID NO: 12720 - RNA, 22 nt, Artificial Sequence
  ELANE RNA Guide
guugagcaagauuacggggucg

SEQ ID NO: 12721 - RNA, 22 nt, Artificial Sequence
  ELANE RNA Guide
uaaucuugcucaacgacaucgu

SEQ ID NO: 12722 - RNA, 22 nt, Artificial Sequence
  ELANE RNA Guide
uacgaccccguaaucuugcuca

SEQ ID NO: 12723 - RNA, 22 nt, Artificial Sequence
  ELANE RNA Guide
ucacgaugucguugagcaagau

SEQ ID NO: 12724 - RNA, 22 nt, Artificial Sequence
  ELANE RNA Guide
ucguugagcaagauuacggggu

SEQ ID NO: 12725 - RNA, 22 nt, Artificial Sequence
  ELANE RNA Guide
ugagcaagauuacggggucgua

SEQ ID NO: 12726 - RNA, 22 nt, Artificial Sequence
  ELANE RNA Guide
ugucguugagcaagauuacggg

SEQ ID NO: 12727 - RNA, 22 nt, Artificial Sequence
  ELANE RNA Guide
uugagcaagauuacggggucgu

SEQ ID NO: 12728 - RNA, 20 nt, Artificial Sequence
  ELANE RNA Guide
aaacuuucucaacgacaucg

SEQ ID NO: 12729 - RNA, 20 nt, Artificial Sequence
  ELANE RNA Guide
aacggcuacgaccccguaaa

SEQ ID NO: 12730 - RNA, 20 nt, Artificial Sequence
  ELANE RNA Guide
aacuuucucaacgacaucgu

SEQ ID NO: 12731 - RNA, 20 nt, Artificial Sequence
  ELANE RNA Guide
aaucacgaugucguugagaa

SEQ ID NO: 12732 - RNA, 20 nt, Artificial Sequence
  ELANE RNA Guide
accccguaaacuuucucaac

SEQ ID NO: 12733 - RNA, 20 nt, Artificial Sequence
  ELANE RNA Guide
acgaccccguaaacuuucuc

SEQ ID NO: 12734 - RNA, 20 nt, Artificial Sequence
  ELANE RNA Guide
acgaugucguugagaaaguu

SEQ ID NO: 12735 - RNA, 20 nt, Artificial Sequence
  ELANE RNA Guide
acggcuacgaccccguaaac

SEQ ID NO: 12736 - RNA, 20 nt, Artificial Sequence
  ELANE RNA Guide
acuuucucaacgacaucgug

SEQ ID NO: 12737 - RNA, 20 nt, Artificial Sequence
  ELANE RNA Guide
agaaaguuuacggggucgua

SEQ ID NO: 12738 - RNA, 20 nt, Artificial Sequence
  ELANE RNA Guide
agaaucacgaugucguugag

SEQ ID NO: 12739 - RNA, 20 nt, Artificial Sequence
  ELANE RNA Guide
aucacgaugucguugagaaa

SEQ ID NO: 12740 - RNA, 20 nt, Artificial Sequence
  ELANE RNA Guide
augucguugagaaaguuuac

SEQ ID NO: 12741 - RNA, 20 nt, Artificial Sequence
  ELANE RNA Guide
cacgaugucguugagaaagu

SEQ ID NO: 12742 - RNA, 20 nt, Artificial Sequence
  ELANE RNA Guide
ccccguaaacuuucucaacg

SEQ ID NO: 12743 - RNA, 20 nt, Artificial Sequence
  ELANE RNA Guide
cccguaaacuuucucaacga

SEQ ID NO: 12744 - RNA, 20 nt, Artificial Sequence
  ELANE RNA Guide
ccguaaacuuucucaacgac

SEQ ID NO: 12745 - RNA, 20 nt, Artificial Sequence
  ELANE RNA Guide
cgaccccguaaacuuucuca

SEQ ID NO: 12746 - RNA, 20 nt, Artificial Sequence
  ELANE RNA Guide
cgaugucguugagaaaguuu

SEQ ID NO: 12747 - RNA, 20 nt, Artificial Sequence
  ELANE RNA Guide
cggcuacgaccccguaaacu

SEQ ID NO: 12748 - RNA, 20 nt, Artificial Sequence
  ELANE RNA Guide
cguaaacuuucucaacgaca

SEQ ID NO: 12749 - RNA, 20 nt, Artificial Sequence
  ELANE RNA Guide
cguugagaaaguuuacgggg

SEQ ID NO: 12750 - RNA, 20 nt, Artificial Sequence
  ELANE RNA Guide
cuacgaccccguaaacuuuc

SEQ ID NO: 12751 - RNA, 20 nt, Artificial Sequence
  ELANE RNA Guide
cuuucucaacgacaucguga

SEQ ID NO: 12752 - RNA, 20 nt, Artificial Sequence
  ELANE RNA Guide
gaaaguuuacggggucguag

SEQ ID NO: 12753 - RNA, 20 nt, Artificial Sequence
  ELANE RNA Guide
gaaucacgaugucguugaga

SEQ ID NO: 12754 - RNA, 20 nt, Artificial Sequence
  ELANE RNA Guide
gaccccguaaacuuucucaa

SEQ ID NO: 12755 - RNA, 20 nt, Artificial Sequence
  ELANE RNA Guide
gagaaaguuuacggggucgu

SEQ ID NO: 12756 - RNA, 20 nt, Artificial Sequence
  ELANE RNA Guide
gagaaucacgaugucguuga

SEQ ID NO: 12757 - RNA, 20 nt, Artificial Sequence
  ELANE RNA Guide
gaugucguugagaaaguuua

SEQ ID NO: 12758 - RNA, 20 nt, Artificial Sequence
  ELANE RNA Guide
gcuacgaccccguaaacuuu

SEQ ID NO: 12759 - RNA, 20 nt, Artificial Sequence
  ELANE RNA Guide
ggagaaucacgaugucguug

SEQ ID NO: 12760 - RNA, 20 nt, Artificial Sequence
  ELANE RNA Guide
ggcuacgaccccguaaacuu

SEQ ID NO: 12761 - RNA, 20 nt, Artificial Sequence
  ELANE RNA Guide
guaaacuuucucaacgacau

SEQ ID NO: 12762 - RNA, 20 nt, Artificial Sequence
  ELANE RNA Guide
gucguugagaaaguuuacgg

SEQ ID NO: 12763 - RNA, 20 nt, Artificial Sequence
  ELANE RNA Guide
guugagaaaguuuacggggu

SEQ ID NO: 12764 - RNA, 20 nt, Artificial Sequence
  ELANE RNA Guide
uaaacuuucucaacgacauc

SEQ ID NO: 12765 - RNA, 20 nt, Artificial Sequence
  ELANE RNA Guide
uacgaccccguaaacuuucu

SEQ ID NO: 12766 - RNA, 20 nt, Artificial Sequence
  ELANE RNA Guide
ucacgaugucguugagaaag

SEQ ID NO: 12767 - RNA, 20 nt, Artificial Sequence
  ELANE RNA Guide
ucguugagaaaguuuacggg

SEQ ID NO: 12768 - RNA, 20 nt, Artificial Sequence
  ELANE RNA Guide
ugagaaaguuuacggggucg

SEQ ID NO: 12769 - RNA, 20 nt, Artificial Sequence
  ELANE RNA Guide
uggagaaucacgaugucguu

SEQ ID NO: 12770 - RNA, 20 nt, Artificial Sequence
  ELANE RNA Guide
ugucguugagaaaguuuacg

SEQ ID NO: 12771 - RNA, 20 nt, Artificial Sequence
  ELANE RNA Guide
uucucaacgacaucgugauu

SEQ ID NO: 12772 - RNA, 20 nt, Artificial Sequence
  ELANE RNA Guide
uugagaaaguuuacgggguc

SEQ ID NO: 12773 - RNA, 20 nt, Artificial Sequence
  ELANE RNA Guide
uuucucaacgacaucgugau

SEQ ID NO: 12774 - RNA, 21 nt, Artificial Sequence
  ELANE RNA Guide
aaacggcuacgaccccguaaa

SEQ ID NO: 12775 - RNA, 21 nt, Artificial Sequence
  ELANE RNA Guide
aaacuuucucaacgacaucgu

SEQ ID NO: 12776 - RNA, 21 nt, Artificial Sequence
  ELANE RNA Guide
aacggcuacgaccccguaaac

SEQ ID NO: 12777 - RNA, 21 nt, Artificial Sequence
  ELANE RNA Guide
aacuuucucaacgacaucgug

SEQ ID NO: 12778 - RNA, 21 nt, Artificial Sequence
  ELANE RNA Guide
aaucacgaugucguugagaaa

SEQ ID NO: 12779 - RNA, 21 nt, Artificial Sequence
  ELANE RNA Guide
accccguaaacuuucucaacg

SEQ ID NO: 12780 - RNA, 21 nt, Artificial Sequence
  ELANE RNA Guide
acgaccccguaaacuuucuca

SEQ ID NO: 12781 - RNA, 21 nt, Artificial Sequence
  ELANE RNA Guide
acgaugucguugagaaaguuu

SEQ ID NO: 12782 - RNA, 21 nt, Artificial Sequence
  ELANE RNA Guide
acggcuacgaccccguaaacu

SEQ ID NO: 12783 - RNA, 21 nt, Artificial Sequence
  ELANE RNA Guide
acuuucucaacgacaucguga

SEQ ID NO: 12784 - RNA, 21 nt, Artificial Sequence
  ELANE RNA Guide
agaaaguuuacggggucguag

SEQ ID NO: 12785 - RNA, 21 nt, Artificial Sequence
  ELANE RNA Guide
agaaucacgaugucguugaga

SEQ ID NO: 12786 - RNA, 21 nt, Artificial Sequence
  ELANE RNA Guide
aucacgaugucguugagaaag

SEQ ID NO: 12787 - RNA, 21 nt, Artificial Sequence
  ELANE RNA Guide
augucguugagaaaguuuacg

SEQ ID NO: 12788 - RNA, 21 nt, Artificial Sequence
  ELANE RNA Guide
cacgaugucguugagaaaguu

SEQ ID NO: 12789 - RNA, 21 nt, Artificial Sequence
  ELANE RNA Guide
ccccguaaacuuucucaacga

SEQ ID NO: 12790 - RNA, 21 nt, Artificial Sequence
  ELANE RNA Guide
cccguaaacuuucucaacgac

SEQ ID NO: 12791 - RNA, 21 nt, Artificial Sequence
  ELANE RNA Guide
ccguaaacuuucucaacgaca

SEQ ID NO: 12792 - RNA, 21 nt, Artificial Sequence
  ELANE RNA Guide
cgaccccguaaacuuucucaa

SEQ ID NO: 12793 - RNA, 21 nt, Artificial Sequence
  ELANE RNA Guide
cgaugucguugagaaaguuua

SEQ ID NO: 12794 - RNA, 21 nt, Artificial Sequence
  ELANE RNA Guide
cggcuacgaccccguaaacuu

SEQ ID NO: 12795 - RNA, 21 nt, Artificial Sequence
  ELANE RNA Guide
cguaaacuuucucaacgacau

SEQ ID NO: 12796 - RNA, 21 nt, Artificial Sequence
  ELANE RNA Guide
cguugagaaaguuuacggggu

SEQ ID NO: 12797 - RNA, 21 nt, Artificial Sequence
  ELANE RNA Guide
cuacgaccccguaaacuuucu

SEQ ID NO: 12798 - RNA, 21 nt, Artificial Sequence
  ELANE RNA Guide
cuggagaaucacgaugucguu

SEQ ID NO: 12799 - RNA, 21 nt, Artificial Sequence
  ELANE RNA Guide
cuuucucaacgacaucgugau

SEQ ID NO: 12800 - RNA, 21 nt, Artificial Sequence
  ELANE RNA Guide
gaaaguuuacggggucguagc

SEQ ID NO: 12801 - RNA, 21 nt, Artificial Sequence
  ELANE RNA Guide
gaaucacgaugucguugagaa

SEQ ID NO: 12802 - RNA, 21 nt, Artificial Sequence
  ELANE RNA Guide
gaccccguaaacuuucucaac

SEQ ID NO: 12803 - RNA, 21 nt, Artificial Sequence
  ELANE RNA Guide
gagaaaguuuacggggucgua

SEQ ID NO: 12804 - RNA, 21 nt, Artificial Sequence
  ELANE RNA Guide
gagaaucacgaugucguugag

SEQ ID NO: 12805 - RNA, 21 nt, Artificial Sequence
  ELANE RNA Guide
gaugucguugagaaaguuuac

SEQ ID NO: 12806 - RNA, 21 nt, Artificial Sequence
  ELANE RNA Guide
gcuacgaccccguaaacuuuc

SEQ ID NO: 12807 - RNA, 21 nt, Artificial Sequence
  ELANE RNA Guide
ggagaaucacgaugucguuga

SEQ ID NO: 12808 - RNA, 21 nt, Artificial Sequence
  ELANE RNA Guide
ggcuacgaccccguaaacuuu

SEQ ID NO: 12809 - RNA, 21 nt, Artificial Sequence
  ELANE RNA Guide
guaaacuuucucaacgacauc

SEQ ID NO: 12810 - RNA, 21 nt, Artificial Sequence
  ELANE RNA Guide
gucguugagaaaguuuacggg

SEQ ID NO: 12811 - RNA, 21 nt, Artificial Sequence
  ELANE RNA Guide
guugagaaaguuuacgggguc

SEQ ID NO: 12812 - RNA, 21 nt, Artificial Sequence
  ELANE RNA Guide
uaaacuuucucaacgacaucg

SEQ ID NO: 12813 - RNA, 21 nt, Artificial Sequence
  ELANE RNA Guide
uacgaccccguaaacuuucuc

SEQ ID NO: 12814 - RNA, 21 nt, Artificial Sequence
  ELANE RNA Guide
ucacgaugucguugagaaagu

SEQ ID NO: 12815 - RNA, 21 nt, Artificial Sequence
  ELANE RNA Guide
ucguugagaaaguuuacgggg

SEQ ID NO: 12816 - RNA, 21 nt, Artificial Sequence
  ELANE RNA Guide
ugagaaaguuuacggggucgu

SEQ ID NO: 12817 - RNA, 21 nt, Artificial Sequence
  ELANE RNA Guide
uggagaaucacgaugucguug

SEQ ID NO: 12818 - RNA, 21 nt, Artificial Sequence
  ELANE RNA Guide
ugucguugagaaaguuuacgg

SEQ ID NO: 12819 - RNA, 21 nt, Artificial Sequence
  ELANE RNA Guide
uucucaacgacaucgugauuc

SEQ ID NO: 12820 - RNA, 21 nt, Artificial Sequence
  ELANE RNA Guide
uugagaaaguuuacggggucg

SEQ ID NO: 12821 - RNA, 21 nt, Artificial Sequence
  ELANE RNA Guide
uuucucaacgacaucgugauu

SEQ ID NO: 12822 - RNA, 22 nt, Artificial Sequence
  ELANE RNA Guide
aaaacggcuacgaccccguaaa

SEQ ID NO: 12823 - RNA, 22 nt, Artificial Sequence
  ELANE RNA Guide
aaacggcuacgaccccguaaac

SEQ ID NO: 12824 - RNA, 22 nt, Artificial Sequence
  ELANE RNA Guide
aaacuuucucaacgacaucgug

SEQ ID NO: 12825 - RNA, 22 nt, Artificial Sequence
  ELANE RNA Guide
aacggcuacgaccccguaaacu

SEQ ID NO: 12826 - RNA, 22 nt, Artificial Sequence
  ELANE RNA Guide
aacuuucucaacgacaucguga

SEQ ID NO: 12827 - RNA, 22 nt, Artificial Sequence
  ELANE RNA Guide
aaucacgaugucguugagaaag

SEQ ID NO: 12828 - RNA, 22 nt, Artificial Sequence
  ELANE RNA Guide
accccguaaacuuucucaacga

SEQ ID NO: 12829 - RNA, 22 nt, Artificial Sequence
  ELANE RNA Guide
acgaccccguaaacuuucucaa

SEQ ID NO: 12830 - RNA, 22 nt, Artificial Sequence
  ELANE RNA Guide
acgaugucguugagaaaguuua

SEQ ID NO: 12831 - RNA, 22 nt, Artificial Sequence
  ELANE RNA Guide
acggcuacgaccccguaaacuu

SEQ ID NO: 12832 - RNA, 22 nt, Artificial Sequence
  ELANE RNA Guide
acuuucucaacgacaucgugau

SEQ ID NO: 12833 - RNA, 22 nt, Artificial Sequence
  ELANE RNA Guide
agaaaguuuacggggucguagc

SEQ ID NO: 12834 - RNA, 22 nt, Artificial Sequence
  ELANE RNA Guide
agaaucacgaugucguugagaa

SEQ ID NO: 12835 - RNA, 22 nt, Artificial Sequence
  ELANE RNA Guide
aucacgaugucguugagaaagu

SEQ ID NO: 12836 - RNA, 22 nt, Artificial Sequence
  ELANE RNA Guide
augucguugagaaaguuuacgg

SEQ ID NO: 12837 - RNA, 22 nt, Artificial Sequence
  ELANE RNA Guide
cacgaugucguugagaaaguuu

SEQ ID NO: 12838 - RNA, 22 nt, Artificial Sequence
  ELANE RNA Guide
ccccguaaacuuucucaacgac

SEQ ID NO: 12839 - RNA, 22 nt, Artificial Sequence
  ELANE RNA Guide
cccguaaacuuucucaacgaca

SEQ ID NO: 12840 - RNA, 22 nt, Artificial Sequence
  ELANE RNA Guide
ccguaaacuuucucaacgacau

SEQ ID NO: 12841 - RNA, 22 nt, Artificial Sequence
  ELANE RNA Guide
ccuggagaaucacgaugucguu

SEQ ID NO: 12842 - RNA, 22 nt, Artificial Sequence
  ELANE RNA Guide
cgaccccguaaacuuucucaac

SEQ ID NO: 12843 - RNA, 22 nt, Artificial Sequence
  ELANE RNA Guide
cgaugucguugagaaaguuuac

SEQ ID NO: 12844 - RNA, 22 nt, Artificial Sequence
  ELANE RNA Guide
cggcuacgaccccguaaacuuu

SEQ ID NO: 12845 - RNA, 22 nt, Artificial Sequence
  ELANE RNA Guide
cguaaacuuucucaacgacauc

SEQ ID NO: 12846 - RNA, 22 nt, Artificial Sequence
  ELANE RNA Guide
cguugagaaaguuuacgggguc

SEQ ID NO: 12847 - RNA, 22 nt, Artificial Sequence
  ELANE RNA Guide
cuacgaccccguaaacuuucuc

SEQ ID NO: 12848 - RNA, 22 nt, Artificial Sequence
  ELANE RNA Guide
cuggagaaucacgaugucguug

SEQ ID NO: 12849 - RNA, 22 nt, Artificial Sequence
  ELANE RNA Guide
cuuucucaacgacaucgugauu

SEQ ID NO: 12850 - RNA, 22 nt, Artificial Sequence
  ELANE RNA Guide
gaaaguuuacggggucguagcc

SEQ ID NO: 12851 - RNA, 22 nt, Artificial Sequence
  ELANE RNA Guide
gaaucacgaugucguugagaaa

SEQ ID NO: 12852 - RNA, 22 nt, Artificial Sequence
  ELANE RNA Guide
gaccccguaaacuuucucaacg

SEQ ID NO: 12853 - RNA, 22 nt, Artificial Sequence
  ELANE RNA Guide
gagaaaguuuacggggucguag

SEQ ID NO: 12854 - RNA, 22 nt, Artificial Sequence
  ELANE RNA Guide
gagaaucacgaugucguugaga

SEQ ID NO: 12855 - RNA, 22 nt, Artificial Sequence
  ELANE RNA Guide
gaugucguugagaaaguuuacg

SEQ ID NO: 12856 - RNA, 22 nt, Artificial Sequence
  ELANE RNA Guide
gcuacgaccccguaaacuuucu

SEQ ID NO: 12857 - RNA, 22 nt, Artificial Sequence
  ELANE RNA Guide
ggagaaucacgaugucguugag

SEQ ID NO: 12858 - RNA, 22 nt, Artificial Sequence
  ELANE RNA Guide
ggcuacgaccccguaaacuuuc

SEQ ID NO: 12859 - RNA, 22 nt, Artificial Sequence
  ELANE RNA Guide
guaaacuuucucaacgacaucg

SEQ ID NO: 12860 - RNA, 22 nt, Artificial Sequence
  ELANE RNA Guide
gucguugagaaaguuuacgggg

SEQ ID NO: 12861 - RNA, 22 nt, Artificial Sequence
  ELANE RNA Guide
guugagaaaguuuacggggucg

SEQ ID NO: 12862 - RNA, 22 nt, Artificial Sequence
  ELANE RNA Guide
uaaacuuucucaacgacaucgu

SEQ ID NO: 12863 - RNA, 22 nt, Artificial Sequence
  ELANE RNA Guide
uacgaccccguaaacuuucuca

SEQ ID NO: 12864 - RNA, 22 nt, Artificial Sequence
  ELANE RNA Guide
ucacgaugucguugagaaaguu

SEQ ID NO: 12865 - RNA, 22 nt, Artificial Sequence
  ELANE RNA Guide
ucguugagaaaguuuacggggu

SEQ ID NO: 12866 - RNA, 22 nt, Artificial Sequence
  ELANE RNA Guide
ugagaaaguuuacggggucgua

SEQ ID NO: 12867 - RNA, 22 nt, Artificial Sequence
  ELANE RNA Guide
uggagaaucacgaugucguuga

SEQ ID NO: 12868 - RNA, 22 nt, Artificial Sequence
  ELANE RNA Guide
ugucguugagaaaguuuacggg

SEQ ID NO: 12869 - RNA, 22 nt, Artificial Sequence
  ELANE RNA Guide
uucucaacgacaucgugauucu

SEQ ID NO: 12870 - RNA, 22 nt, Artificial Sequence
  ELANE RNA Guide
uugagaaaguuuacggggucgu

SEQ ID NO: 12871 - RNA, 22 nt, Artificial Sequence
  ELANE RNA Guide
uuucucaacgacaucgugauuc

SEQ ID NO: 12872 - RNA, 20 nt, Artificial Sequence
  ELANE RNA Guide
aaacuugcucagcgacaucg

SEQ ID NO: 12873 - RNA, 20 nt, Artificial Sequence
  ELANE RNA Guide
aacuugcucagcgacaucgu

SEQ ID NO: 12874 - RNA, 20 nt, Artificial Sequence
  ELANE RNA Guide
aaucacgaugucgcugagca

SEQ ID NO: 12875 - RNA, 20 nt, Artificial Sequence
  ELANE RNA Guide
accccguaaacuugcucagc

SEQ ID NO: 12876 - RNA, 20 nt, Artificial Sequence
  ELANE RNA Guide
accuggagaaucacgauguc

SEQ ID NO: 12877 - RNA, 20 nt, Artificial Sequence
  ELANE RNA Guide
acgaccccguaaacuugcuc

SEQ ID NO: 12878 - RNA, 20 nt, Artificial Sequence
  ELANE RNA Guide
acgaugucgcugagcaaguu

SEQ ID NO: 12879 - RNA, 20 nt, Artificial Sequence
  ELANE RNA Guide
acuugcucagcgacaucgug

SEQ ID NO: 12880 - RNA, 20 nt, Artificial Sequence
  ELANE RNA Guide
agaaucacgaugucgcugag

SEQ ID NO: 12881 - RNA, 20 nt, Artificial Sequence
  ELANE RNA Guide
agcgacaucgugauucucca

SEQ ID NO: 12882 - RNA, 20 nt, Artificial Sequence
  ELANE RNA Guide
aucacgaugucgcugagcaa

SEQ ID NO: 12883 - RNA, 20 nt, Artificial Sequence
  ELANE RNA Guide
augucgcugagcaaguuuac

SEQ ID NO: 12884 - RNA, 20 nt, Artificial Sequence
  ELANE RNA Guide
caccuggagaaucacgaugu

SEQ ID NO: 12885 - RNA, 20 nt, Artificial Sequence
  ELANE RNA Guide
cacgaugucgcugagcaagu

SEQ ID NO: 12886 - RNA, 20 nt, Artificial Sequence
  ELANE RNA Guide
cagcgacaucgugauucucc

SEQ ID NO: 12887 - RNA, 20 nt, Artificial Sequence
  ELANE RNA Guide
ccccguaaacuugcucagcg

SEQ ID NO: 12888 - RNA, 20 nt, Artificial Sequence
  ELANE RNA Guide
cccguaaacuugcucagcga

SEQ ID NO: 12889 - RNA, 20 nt, Artificial Sequence
  ELANE RNA Guide
ccguaaacuugcucagcgac

SEQ ID NO: 12890 - RNA, 20 nt, Artificial Sequence
  ELANE RNA Guide
ccuggagaaucacgaugucg

SEQ ID NO: 12891 - RNA, 20 nt, Artificial Sequence
  ELANE RNA Guide
cgaccccguaaacuugcuca

SEQ ID NO: 12892 - RNA, 20 nt, Artificial Sequence
  ELANE RNA Guide
cgaugucgcugagcaaguuu

SEQ ID NO: 12893 - RNA, 20 nt, Artificial Sequence
  ELANE RNA Guide
cgcugagcaaguuuacgggg

SEQ ID NO: 12894 - RNA, 20 nt, Artificial Sequence
  ELANE RNA Guide
cguaaacuugcucagcgaca

SEQ ID NO: 12895 - RNA, 20 nt, Artificial Sequence
  ELANE RNA Guide
cuacgaccccguaaacuugc

SEQ ID NO: 12896 - RNA, 20 nt, Artificial Sequence
  ELANE RNA Guide
cucagcgacaucgugauucu

SEQ ID NO: 12897 - RNA, 20 nt, Artificial Sequence
  ELANE RNA Guide
cuggagaaucacgaugucgc

SEQ ID NO: 12898 - RNA, 20 nt, Artificial Sequence
  ELANE RNA Guide
cuugcucagcgacaucguga

SEQ ID NO: 12899 - RNA, 20 nt, Artificial Sequence
  ELANE RNA Guide
gaaucacgaugucgcugagc

SEQ ID NO: 12900 - RNA, 20 nt, Artificial Sequence
  ELANE RNA Guide
gaccccguaaacuugcucag

SEQ ID NO: 12901 - RNA, 20 nt, Artificial Sequence
  ELANE RNA Guide
gagaaucacgaugucgcuga

SEQ ID NO: 12902 - RNA, 20 nt, Artificial Sequence
  ELANE RNA Guide
gaugucgcugagcaaguuua

SEQ ID NO: 12903 - RNA, 20 nt, Artificial Sequence
  ELANE RNA Guide
gcaccuggagaaucacgaug

SEQ ID NO: 12904 - RNA, 20 nt, Artificial Sequence
  ELANE RNA Guide
gcucagcgacaucgugauuc

SEQ ID NO: 12905 - RNA, 20 nt, Artificial Sequence
  ELANE RNA Guide
gcugagcaaguuuacggggu

SEQ ID NO: 12906 - RNA, 20 nt, Artificial Sequence
  ELANE RNA Guide
ggagaaucacgaugucgcug

SEQ ID NO: 12907 - RNA, 20 nt, Artificial Sequence
  ELANE RNA Guide
guaaacuugcucagcgacau

SEQ ID NO: 12908 - RNA, 20 nt, Artificial Sequence
  ELANE RNA Guide
gucgcugagcaaguuuacgg

SEQ ID NO: 12909 - RNA, 20 nt, Artificial Sequence
  ELANE RNA Guide
uaaacuugcucagcgacauc

SEQ ID NO: 12910 - RNA, 20 nt, Artificial Sequence
  ELANE RNA Guide
uacgaccccguaaacuugcu

SEQ ID NO: 12911 - RNA, 20 nt, Artificial Sequence
  ELANE RNA Guide
ucacgaugucgcugagcaag

SEQ ID NO: 12912 - RNA, 20 nt, Artificial Sequence
  ELANE RNA Guide
ucagcgacaucgugauucuc

SEQ ID NO: 12913 - RNA, 20 nt, Artificial Sequence
  ELANE RNA Guide
ucgcugagcaaguuuacggg

SEQ ID NO: 12914 - RNA, 20 nt, Artificial Sequence
  ELANE RNA Guide
ugcucagcgacaucgugauu

SEQ ID NO: 12915 - RNA, 20 nt, Artificial Sequence
  ELANE RNA Guide
uggagaaucacgaugucgcu

SEQ ID NO: 12916 - RNA, 20 nt, Artificial Sequence
  ELANE RNA Guide
ugucgcugagcaaguuuacg

SEQ ID NO: 12917 - RNA, 20 nt, Artificial Sequence
  ELANE RNA Guide
uugcucagcgacaucgugau

SEQ ID NO: 12918 - RNA, 21 nt, Artificial Sequence
  ELANE RNA Guide
aaacuugcucagcgacaucgu

SEQ ID NO: 12919 - RNA, 21 nt, Artificial Sequence
  ELANE RNA Guide
aacuugcucagcgacaucgug

SEQ ID NO: 12920 - RNA, 21 nt, Artificial Sequence
  ELANE RNA Guide
aaucacgaugucgcugagcaa

SEQ ID NO: 12921 - RNA, 21 nt, Artificial Sequence
  ELANE RNA Guide
accccguaaacuugcucagcg

SEQ ID NO: 12922 - RNA, 21 nt, Artificial Sequence
  ELANE RNA Guide
accuggagaaucacgaugucg

SEQ ID NO: 12923 - RNA, 21 nt, Artificial Sequence
  ELANE RNA Guide
acgaccccguaaacuugcuca

SEQ ID NO: 12924 - RNA, 21 nt, Artificial Sequence
  ELANE RNA Guide
acgaugucgcugagcaaguuu

SEQ ID NO: 12925 - RNA, 21 nt, Artificial Sequence
  ELANE RNA Guide
acuugcucagcgacaucguga

SEQ ID NO: 12926 - RNA, 21 nt, Artificial Sequence
  ELANE RNA Guide
agaaucacgaugucgcugagc

SEQ ID NO: 12927 - RNA, 21 nt, Artificial Sequence
  ELANE RNA Guide
agcgacaucgugauucuccag

SEQ ID NO: 12928 - RNA, 21 nt, Artificial Sequence
  ELANE RNA Guide
aucacgaugucgcugagcaag

SEQ ID NO: 12929 - RNA, 21 nt, Artificial Sequence
  ELANE RNA Guide
augucgcugagcaaguuuacg

SEQ ID NO: 12930 - RNA, 21 nt, Artificial Sequence
  ELANE RNA Guide
caccuggagaaucacgauguc

SEQ ID NO: 12931 - RNA, 21 nt, Artificial Sequence
  ELANE RNA Guide
cacgaugucgcugagcaaguu

SEQ ID NO: 12932 - RNA, 21 nt, Artificial Sequence
  ELANE RNA Guide
cagcgacaucgugauucucca

SEQ ID NO: 12933 - RNA, 21 nt, Artificial Sequence
  ELANE RNA Guide
ccccguaaacuugcucagcga

SEQ ID NO: 12934 - RNA, 21 nt, Artificial Sequence
  ELANE RNA Guide
cccguaaacuugcucagcgac

SEQ ID NO: 12935 - RNA, 21 nt, Artificial Sequence
  ELANE RNA Guide
ccguaaacuugcucagcgaca

SEQ ID NO: 12936 - RNA, 21 nt, Artificial Sequence
  ELANE RNA Guide
ccuggagaaucacgaugucgc

SEQ ID NO: 12937 - RNA, 21 nt, Artificial Sequence
  ELANE RNA Guide
cgaccccguaaacuugcucag

SEQ ID NO: 12938 - RNA, 21 nt, Artificial Sequence
  ELANE RNA Guide
cgaugucgcugagcaaguuua

SEQ ID NO: 12939 - RNA, 21 nt, Artificial Sequence
  ELANE RNA Guide
cgcugagcaaguuuacggggu

SEQ ID NO: 12940 - RNA, 21 nt, Artificial Sequence
  ELANE RNA Guide
cguaaacuugcucagcgacau

SEQ ID NO: 12941 - RNA, 21 nt, Artificial Sequence
  ELANE RNA Guide
cuacgaccccguaaacuugcu

SEQ ID NO: 12942 - RNA, 21 nt, Artificial Sequence
  ELANE RNA Guide
cucagcgacaucgugauucuc

SEQ ID NO: 12943 - RNA, 21 nt, Artificial Sequence
  ELANE RNA Guide
cuggagaaucacgaugucgcu

SEQ ID NO: 12944 - RNA, 21 nt, Artificial Sequence
  ELANE RNA Guide
cuugcucagcgacaucgugau

SEQ ID NO: 12945 - RNA, 21 nt, Artificial Sequence
  ELANE RNA Guide
gaaucacgaugucgcugagca

SEQ ID NO: 12946 - RNA, 21 nt, Artificial Sequence
  ELANE RNA Guide
gaccccguaaacuugcucagc

SEQ ID NO: 12947 - RNA, 21 nt, Artificial Sequence
  ELANE RNA Guide
gagaaucacgaugucgcugag

SEQ ID NO: 12948 - RNA, 21 nt, Artificial Sequence
  ELANE RNA Guide
gaugucgcugagcaaguuuac

SEQ ID NO: 12949 - RNA, 21 nt, Artificial Sequence
  ELANE RNA Guide
gcaccuggagaaucacgaugu

SEQ ID NO: 12950 - RNA, 21 nt, Artificial Sequence
  ELANE RNA Guide
gcuacgaccccguaaacuugc

SEQ ID NO: 12951 - RNA, 21 nt, Artificial Sequence
  ELANE RNA Guide
gcucagcgacaucgugauucu

SEQ ID NO: 12952 - RNA, 21 nt, Artificial Sequence
  ELANE RNA Guide
gcugagcaaguuuacgggguc

SEQ ID NO: 12953 - RNA, 21 nt, Artificial Sequence
  ELANE RNA Guide
ggagaaucacgaugucgcuga

SEQ ID NO: 12954 - RNA, 21 nt, Artificial Sequence
  ELANE RNA Guide
ggcaccuggagaaucacgaug

SEQ ID NO: 12955 - RNA, 21 nt, Artificial Sequence
  ELANE RNA Guide
guaaacuugcucagcgacauc

SEQ ID NO: 12956 - RNA, 21 nt, Artificial Sequence
  ELANE RNA Guide
gucgcugagcaaguuuacggg

SEQ ID NO: 12957 - RNA, 21 nt, Artificial Sequence
  ELANE RNA Guide
uaaacuugcucagcgacaucg

SEQ ID NO: 12958 - RNA, 21 nt, Artificial Sequence
  ELANE RNA Guide
uacgaccccguaaacuugcuc

SEQ ID NO: 12959 - RNA, 21 nt, Artificial Sequence
  ELANE RNA Guide
ucacgaugucgcugagcaagu

SEQ ID NO: 12960 - RNA, 21 nt, Artificial Sequence
  ELANE RNA Guide
ucagcgacaucgugauucucc

SEQ ID NO: 12961 - RNA, 21 nt, Artificial Sequence
  ELANE RNA Guide
ucgcugagcaaguuuacgggg

SEQ ID NO: 12962 - RNA, 21 nt, Artificial Sequence
  ELANE RNA Guide
ugcucagcgacaucgugauuc

SEQ ID NO: 12963 - RNA, 21 nt, Artificial Sequence
  ELANE RNA Guide
uggagaaucacgaugucgcug

SEQ ID NO: 12964 - RNA, 21 nt, Artificial Sequence
  ELANE RNA Guide
ugucgcugagcaaguuuacgg

SEQ ID NO: 12965 - RNA, 21 nt, Artificial Sequence
  ELANE RNA Guide
uugcucagcgacaucgugauu

SEQ ID NO: 12966 - RNA, 22 nt, Artificial Sequence
  ELANE RNA Guide
aaacuugcucagcgacaucgug

SEQ ID NO: 12967 - RNA, 22 nt, Artificial Sequence
  ELANE RNA Guide
aacuugcucagcgacaucguga

SEQ ID NO: 12968 - RNA, 22 nt, Artificial Sequence
  ELANE RNA Guide
aaucacgaugucgcugagcaag

SEQ ID NO: 12969 - RNA, 22 nt, Artificial Sequence
  ELANE RNA Guide
accccguaaacuugcucagcga

SEQ ID NO: 12970 - RNA, 22 nt, Artificial Sequence
  ELANE RNA Guide
accuggagaaucacgaugucgc

SEQ ID NO: 12971 - RNA, 22 nt, Artificial Sequence
  ELANE RNA Guide
acgaccccguaaacuugcucag

SEQ ID NO: 12972 - RNA, 22 nt, Artificial Sequence
  ELANE RNA Guide
acgaugucgcugagcaaguuua

SEQ ID NO: 12973 - RNA, 22 nt, Artificial Sequence
  ELANE RNA Guide
acuugcucagcgacaucgugau

SEQ ID NO: 12974 - RNA, 22 nt, Artificial Sequence
  ELANE RNA Guide
agaaucacgaugucgcugagca

SEQ ID NO: 12975 - RNA, 22 nt, Artificial Sequence
  ELANE RNA Guide
agcgacaucgugauucuccagg

SEQ ID NO: 12976 - RNA, 22 nt, Artificial Sequence
  ELANE RNA Guide
aucacgaugucgcugagcaagu

SEQ ID NO: 12977 - RNA, 22 nt, Artificial Sequence
  ELANE RNA Guide
augucgcugagcaaguuuacgg

SEQ ID NO: 12978 - RNA, 22 nt, Artificial Sequence
  ELANE RNA Guide
caccuggagaaucacgaugucg

SEQ ID NO: 12979 - RNA, 22 nt, Artificial Sequence
  ELANE RNA Guide
cacgaugucgcugagcaaguuu

SEQ ID NO: 12980 - RNA, 22 nt, Artificial Sequence
  ELANE RNA Guide
cagcgacaucgugauucuccag

SEQ ID NO: 12981 - RNA, 22 nt, Artificial Sequence
  ELANE RNA Guide
ccccguaaacuugcucagcgac

SEQ ID NO: 12982 - RNA, 22 nt, Artificial Sequence
  ELANE RNA Guide
cccguaaacuugcucagcgaca

SEQ ID NO: 12983 - RNA, 22 nt, Artificial Sequence
  ELANE RNA Guide
ccguaaacuugcucagcgacau

SEQ ID NO: 12984 - RNA, 22 nt, Artificial Sequence
  ELANE RNA Guide
ccuggagaaucacgaugucgcu

SEQ ID NO: 12985 - RNA, 22 nt, Artificial Sequence
  ELANE RNA Guide
cgaccccguaaacuugcucagc

SEQ ID NO: 12986 - RNA, 22 nt, Artificial Sequence
  ELANE RNA Guide
cgaugucgcugagcaaguuuac

SEQ ID NO: 12987 - RNA, 22 nt, Artificial Sequence
  ELANE RNA Guide
cgcugagcaaguuuacgggguc

SEQ ID NO: 12988 - RNA, 22 nt, Artificial Sequence
  ELANE RNA Guide
cggcaccuggagaaucacgaug

SEQ ID NO: 12989 - RNA, 22 nt, Artificial Sequence
  ELANE RNA Guide
cguaaacuugcucagcgacauc

SEQ ID NO: 12990 - RNA, 22 nt, Artificial Sequence
  ELANE RNA Guide
cuacgaccccguaaacuugcuc

SEQ ID NO: 12991 - RNA, 22 nt, Artificial Sequence
  ELANE RNA Guide
cucagcgacaucgugauucucc

SEQ ID NO: 12992 - RNA, 22 nt, Artificial Sequence
  ELANE RNA Guide
cuggagaaucacgaugucgcug

SEQ ID NO: 12993 - RNA, 22 nt, Artificial Sequence
  ELANE RNA Guide
cuugcucagcgacaucgugauu

SEQ ID NO: 12994 - RNA, 22 nt, Artificial Sequence
  ELANE RNA Guide
gaaucacgaugucgcugagcaa

SEQ ID NO: 12995 - RNA, 22 nt, Artificial Sequence
  ELANE RNA Guide
gaccccguaaacuugcucagcg

SEQ ID NO: 12996 - RNA, 22 nt, Artificial Sequence
  ELANE RNA Guide
gagaaucacgaugucgcugagc

SEQ ID NO: 12997 - RNA, 22 nt, Artificial Sequence
  ELANE RNA Guide
gaugucgcugagcaaguuuacg

SEQ ID NO: 12998 - RNA, 22 nt, Artificial Sequence
  ELANE RNA Guide
gcaccuggagaaucacgauguc

SEQ ID NO: 12999 - RNA, 22 nt, Artificial Sequence
  ELANE RNA Guide
gcuacgaccccguaaacuugcu

SEQ ID NO: 13000 - RNA, 22 nt, Artificial Sequence
  ELANE RNA Guide
gcucagcgacaucgugauucuc

SEQ ID NO: 13001 - RNA, 22 nt, Artificial Sequence
  ELANE RNA Guide
gcugagcaaguuuacggggucg

SEQ ID NO: 13002 - RNA, 22 nt, Artificial Sequence
  ELANE RNA Guide
ggagaaucacgaugucgcugag

SEQ ID NO: 13003 - RNA, 22 nt, Artificial Sequence
  ELANE RNA Guide
ggcaccuggagaaucacgaugu

SEQ ID NO: 13004 - RNA, 22 nt, Artificial Sequence
  ELANE RNA Guide
ggcuacgaccccguaaacuugc

SEQ ID NO: 13005 - RNA, 22 nt, Artificial Sequence
  ELANE RNA Guide
guaaacuugcucagcgacaucg

SEQ ID NO: 13006 - RNA, 22 nt, Artificial Sequence
  ELANE RNA Guide
gucgcugagcaaguuuacgggg

SEQ ID NO: 13007 - RNA, 22 nt, Artificial Sequence
  ELANE RNA Guide
uaaacuugcucagcgacaucgu

SEQ ID NO: 13008 - RNA, 22 nt, Artificial Sequence
  ELANE RNA Guide
uacgaccccguaaacuugcuca

SEQ ID NO: 13009 - RNA, 22 nt, Artificial Sequence
  ELANE RNA Guide
ucacgaugucgcugagcaaguu

SEQ ID NO: 13010 - RNA, 22 nt, Artificial Sequence
  ELANE RNA Guide
ucagcgacaucgugauucucca

SEQ ID NO: 13011 - RNA, 22 nt, Artificial Sequence
  ELANE RNA Guide
ucgcugagcaaguuuacggggu

SEQ ID NO: 13012 - RNA, 22 nt, Artificial Sequence
  ELANE RNA Guide
ugcucagcgacaucgugauucu

SEQ ID NO: 13013 - RNA, 22 nt, Artificial Sequence
  ELANE RNA Guide
uggagaaucacgaugucgcuga

SEQ ID NO: 13014 - RNA, 22 nt, Artificial Sequence
  ELANE RNA Guide
ugucgcugagcaaguuuacggg

SEQ ID NO: 13015 - RNA, 22 nt, Artificial Sequence
  ELANE RNA Guide
uugcucagcgacaucgugauuc

SEQ ID NO: 13016 - RNA, 20 nt, Artificial Sequence
  ELANE RNA Guide
aaacuugcucaacgacaacg

SEQ ID NO: 13017 - RNA, 20 nt, Artificial Sequence
  ELANE RNA Guide
aacgacaacgugauucucca

SEQ ID NO: 13018 - RNA, 20 nt, Artificial Sequence
  ELANE RNA Guide
aacgugauucuccaggugcc

SEQ ID NO: 13019 - RNA, 20 nt, Artificial Sequence
  ELANE RNA Guide
aacuugcucaacgacaacgu

SEQ ID NO: 13020 - RNA, 20 nt, Artificial Sequence
  ELANE RNA Guide
aaucacguugucguugagca

SEQ ID NO: 13021 - RNA, 20 nt, Artificial Sequence
  ELANE RNA Guide
acaacgugauucuccaggug

SEQ ID NO: 13022 - RNA, 20 nt, Artificial Sequence
  ELANE RNA Guide
accuggagaaucacguuguc

SEQ ID NO: 13023 - RNA, 20 nt, Artificial Sequence
  ELANE RNA Guide
acgacaacgugauucuccag

SEQ ID NO: 13024 - RNA, 20 nt, Artificial Sequence
  ELANE RNA Guide
acguugucguugagcaaguu

SEQ ID NO: 13025 - RNA, 20 nt, Artificial Sequence
  ELANE RNA Guide
acuugcucaacgacaacgug

SEQ ID NO: 13026 - RNA, 20 nt, Artificial Sequence
  ELANE RNA Guide
agaaucacguugucguugag

SEQ ID NO: 13027 - RNA, 20 nt, Artificial Sequence
  ELANE RNA Guide
aucacguugucguugagcaa

SEQ ID NO: 13028 - RNA, 20 nt, Artificial Sequence
  ELANE RNA Guide
caacgacaacgugauucucc

SEQ ID NO: 13029 - RNA, 20 nt, Artificial Sequence
  ELANE RNA Guide
caacgugauucuccaggugc

SEQ ID NO: 13030 - RNA, 20 nt, Artificial Sequence
  ELANE RNA Guide
caccuggagaaucacguugu

SEQ ID NO: 13031 - RNA, 20 nt, Artificial Sequence
  ELANE RNA Guide
cacguugucguugagcaagu

SEQ ID NO: 13032 - RNA, 20 nt, Artificial Sequence
  ELANE RNA Guide
ccccguaaacuugcucaacg

SEQ ID NO: 13033 - RNA, 20 nt, Artificial Sequence
  ELANE RNA Guide
cccguaaacuugcucaacga

SEQ ID NO: 13034 - RNA, 20 nt, Artificial Sequence
  ELANE RNA Guide
ccggcggcaccuggagaauc

SEQ ID NO: 13035 - RNA, 20 nt, Artificial Sequence
  ELANE RNA Guide
ccguaaacuugcucaacgac

SEQ ID NO: 13036 - RNA, 20 nt, Artificial Sequence
  ELANE RNA Guide
ccuggagaaucacguugucg

SEQ ID NO: 13037 - RNA, 20 nt, Artificial Sequence
  ELANE RNA Guide
cgacaacgugauucuccagg

SEQ ID NO: 13038 - RNA, 20 nt, Artificial Sequence
  ELANE RNA Guide
cggcaccuggagaaucacgu

SEQ ID NO: 13039 - RNA, 20 nt, Artificial Sequence
  ELANE RNA Guide
cggcggcaccuggagaauca

SEQ ID NO: 13040 - RNA, 20 nt, Artificial Sequence
  ELANE RNA Guide
cguaaacuugcucaacgaca

SEQ ID NO: 13041 - RNA, 20 nt, Artificial Sequence
  ELANE RNA Guide
cguugucguugagcaaguuu

SEQ ID NO: 13042 - RNA, 20 nt, Artificial Sequence
  ELANE RNA Guide
cucaacgacaacgugauucu

SEQ ID NO: 13043 - RNA, 20 nt, Artificial Sequence
  ELANE RNA Guide
cuggagaaucacguugucgu

SEQ ID NO: 13044 - RNA, 20 nt, Artificial Sequence
  ELANE RNA Guide
cuugcucaacgacaacguga

SEQ ID NO: 13045 - RNA, 20 nt, Artificial Sequence
  ELANE RNA Guide
gaaucacguugucguugagc

SEQ ID NO: 13046 - RNA, 20 nt, Artificial Sequence
  ELANE RNA Guide
gacaacgugauucuccaggu

SEQ ID NO: 13047 - RNA, 20 nt, Artificial Sequence
  ELANE RNA Guide
gagaaucacguugucguuga

SEQ ID NO: 13048 - RNA, 20 nt, Artificial Sequence
  ELANE RNA Guide
gcaccuggagaaucacguug

SEQ ID NO: 13049 - RNA, 20 nt, Artificial Sequence
  ELANE RNA Guide
gcggcaccuggagaaucacg

SEQ ID NO: 13050 - RNA, 20 nt, Artificial Sequence
  ELANE RNA Guide
gcucaacgacaacgugauuc

SEQ ID NO: 13051 - RNA, 20 nt, Artificial Sequence
  ELANE RNA Guide
ggagaaucacguugucguug

SEQ ID NO: 13052 - RNA, 20 nt, Artificial Sequence
  ELANE RNA Guide
ggcaccuggagaaucacguu

SEQ ID NO: 13053 - RNA, 20 nt, Artificial Sequence
  ELANE RNA Guide
ggcggcaccuggagaaucac

SEQ ID NO: 13054 - RNA, 20 nt, Artificial Sequence
  ELANE RNA Guide
guaaacuugcucaacgacaa

SEQ ID NO: 13055 - RNA, 20 nt, Artificial Sequence
  ELANE RNA Guide
guugucguugagcaaguuua

SEQ ID NO: 13056 - RNA, 20 nt, Artificial Sequence
  ELANE RNA Guide
uaaacuugcucaacgacaac

SEQ ID NO: 13057 - RNA, 20 nt, Artificial Sequence
  ELANE RNA Guide
ucaacgacaacgugauucuc

SEQ ID NO: 13058 - RNA, 20 nt, Artificial Sequence
  ELANE RNA Guide
ucacguugucguugagcaag

SEQ ID NO: 13059 - RNA, 20 nt, Artificial Sequence
  ELANE RNA Guide
ugcucaacgacaacgugauu

SEQ ID NO: 13060 - RNA, 20 nt, Artificial Sequence
  ELANE RNA Guide
uggagaaucacguugucguu

SEQ ID NO: 13061 - RNA, 20 nt, Artificial Sequence
  ELANE RNA Guide
uugcucaacgacaacgugau

SEQ ID NO: 13062 - RNA, 21 nt, Artificial Sequence
  ELANE RNA Guide
aaacuugcucaacgacaacgu

SEQ ID NO: 13063 - RNA, 21 nt, Artificial Sequence
  ELANE RNA Guide
aacgacaacgugauucuccag

SEQ ID NO: 13064 - RNA, 21 nt, Artificial Sequence
  ELANE RNA Guide
aacgugauucuccaggugccg

SEQ ID NO: 13065 - RNA, 21 nt, Artificial Sequence
  ELANE RNA Guide
aacuugcucaacgacaacgug

SEQ ID NO: 13066 - RNA, 21 nt, Artificial Sequence
  ELANE RNA Guide
aaucacguugucguugagcaa

SEQ ID NO: 13067 - RNA, 21 nt, Artificial Sequence
  ELANE RNA Guide
acaacgugauucuccaggugc

SEQ ID NO: 13068 - RNA, 21 nt, Artificial Sequence
  ELANE RNA Guide
accccguaaacuugcucaacg

SEQ ID NO: 13069 - RNA, 21 nt, Artificial Sequence
  ELANE RNA Guide
accuggagaaucacguugucg

SEQ ID NO: 13070 - RNA, 21 nt, Artificial Sequence
  ELANE RNA Guide
acgacaacgugauucuccagg

SEQ ID NO: 13071 - RNA, 21 nt, Artificial Sequence
  ELANE RNA Guide
acguugucguugagcaaguuu

SEQ ID NO: 13072 - RNA, 21 nt, Artificial Sequence
  ELANE RNA Guide
acuugcucaacgacaacguga

SEQ ID NO: 13073 - RNA, 21 nt, Artificial Sequence
  ELANE RNA Guide
agaaucacguugucguugagc

SEQ ID NO: 13074 - RNA, 21 nt, Artificial Sequence
  ELANE RNA Guide
aucacguugucguugagcaag

SEQ ID NO: 13075 - RNA, 21 nt, Artificial Sequence
  ELANE RNA Guide
caacgacaacgugauucucca

SEQ ID NO: 13076 - RNA, 21 nt, Artificial Sequence
  ELANE RNA Guide
caacgugauucuccaggugcc

SEQ ID NO: 13077 - RNA, 21 nt, Artificial Sequence
  ELANE RNA Guide
caccuggagaaucacguuguc

SEQ ID NO: 13078 - RNA, 21 nt, Artificial Sequence
  ELANE RNA Guide
cacguugucguugagcaaguu

SEQ ID NO: 13079 - RNA, 21 nt, Artificial Sequence
  ELANE RNA Guide
ccccguaaacuugcucaacga

SEQ ID NO: 13080 - RNA, 21 nt, Artificial Sequence
  ELANE RNA Guide
cccggcggcaccuggagaauc

SEQ ID NO: 13081 - RNA, 21 nt, Artificial Sequence
  ELANE RNA Guide
cccguaaacuugcucaacgac

SEQ ID NO: 13082 - RNA, 21 nt, Artificial Sequence
  ELANE RNA Guide
ccggcggcaccuggagaauca

SEQ ID NO: 13083 - RNA, 21 nt, Artificial Sequence
  ELANE RNA Guide
ccguaaacuugcucaacgaca

SEQ ID NO: 13084 - RNA, 21 nt, Artificial Sequence
  ELANE RNA Guide
ccuggagaaucacguugucgu

SEQ ID NO: 13085 - RNA, 21 nt, Artificial Sequence
  ELANE RNA Guide
cgacaacgugauucuccaggu

SEQ ID NO: 13086 - RNA, 21 nt, Artificial Sequence
  ELANE RNA Guide
cggcaccuggagaaucacguu

SEQ ID NO: 13087 - RNA, 21 nt, Artificial Sequence
  ELANE RNA Guide
cggcggcaccuggagaaucac

SEQ ID NO: 13088 - RNA, 21 nt, Artificial Sequence
  ELANE RNA Guide
cguaaacuugcucaacgacaa

SEQ ID NO: 13089 - RNA, 21 nt, Artificial Sequence
  ELANE RNA Guide
cguugucguugagcaaguuua

SEQ ID NO: 13090 - RNA, 21 nt, Artificial Sequence
  ELANE RNA Guide
cucaacgacaacgugauucuc

SEQ ID NO: 13091 - RNA, 21 nt, Artificial Sequence
  ELANE RNA Guide
cuggagaaucacguugucguu

SEQ ID NO: 13092 - RNA, 21 nt, Artificial Sequence
  ELANE RNA Guide
cuugcucaacgacaacgugau

SEQ ID NO: 13093 - RNA, 21 nt, Artificial Sequence
  ELANE RNA Guide
gaaucacguugucguugagca

SEQ ID NO: 13094 - RNA, 21 nt, Artificial Sequence
  ELANE RNA Guide
gacaacgugauucuccaggug

SEQ ID NO: 13095 - RNA, 21 nt, Artificial Sequence
  ELANE RNA Guide
gagaaucacguugucguugag

SEQ ID NO: 13096 - RNA, 21 nt, Artificial Sequence
  ELANE RNA Guide
gcaccuggagaaucacguugu

SEQ ID NO: 13097 - RNA, 21 nt, Artificial Sequence
  ELANE RNA Guide
gcggcaccuggagaaucacgu

SEQ ID NO: 13098 - RNA, 21 nt, Artificial Sequence
  ELANE RNA Guide
gcucaacgacaacgugauucu

SEQ ID NO: 13099 - RNA, 21 nt, Artificial Sequence
  ELANE RNA Guide
ggagaaucacguugucguuga

SEQ ID NO: 13100 - RNA, 21 nt, Artificial Sequence
  ELANE RNA Guide
ggcaccuggagaaucacguug

SEQ ID NO: 13101 - RNA, 21 nt, Artificial Sequence
  ELANE RNA Guide
ggcggcaccuggagaaucacg

SEQ ID NO: 13102 - RNA, 21 nt, Artificial Sequence
  ELANE RNA Guide
guaaacuugcucaacgacaac

SEQ ID NO: 13103 - RNA, 21 nt, Artificial Sequence
  ELANE RNA Guide
guugucguugagcaaguuuac

SEQ ID NO: 13104 - RNA, 21 nt, Artificial Sequence
  ELANE RNA Guide
uaaacuugcucaacgacaacg

SEQ ID NO: 13105 - RNA, 21 nt, Artificial Sequence
  ELANE RNA Guide
ucaacgacaacgugauucucc

SEQ ID NO: 13106 - RNA, 21 nt, Artificial Sequence
  ELANE RNA Guide
ucacguugucguugagcaagu

SEQ ID NO: 13107 - RNA, 21 nt, Artificial Sequence
  ELANE RNA Guide
ugcucaacgacaacgugauuc

SEQ ID NO: 13108 - RNA, 21 nt, Artificial Sequence
  ELANE RNA Guide
uggagaaucacguugucguug

SEQ ID NO: 13109 - RNA, 21 nt, Artificial Sequence
  ELANE RNA Guide
uugcucaacgacaacgugauu

SEQ ID NO: 13110 - RNA, 22 nt, Artificial Sequence
  ELANE RNA Guide
aaacuugcucaacgacaacgug

SEQ ID NO: 13111 - RNA, 22 nt, Artificial Sequence
  ELANE RNA Guide
aacgacaacgugauucuccagg

SEQ ID NO: 13112 - RNA, 22 nt, Artificial Sequence
  ELANE RNA Guide
aacgugauucuccaggugccgc

SEQ ID NO: 13113 - RNA, 22 nt, Artificial Sequence
  ELANE RNA Guide
aacuugcucaacgacaacguga

SEQ ID NO: 13114 - RNA, 22 nt, Artificial Sequence
  ELANE RNA Guide
aaucacguugucguugagcaag

SEQ ID NO: 13115 - RNA, 22 nt, Artificial Sequence
  ELANE RNA Guide
acaacgugauucuccaggugcc

SEQ ID NO: 13116 - RNA, 22 nt, Artificial Sequence
  ELANE RNA Guide
accccguaaacuugcucaacga

SEQ ID NO: 13117 - RNA, 22 nt, Artificial Sequence
  ELANE RNA Guide
accuggagaaucacguugucgu

SEQ ID NO: 13118 - RNA, 22 nt, Artificial Sequence
  ELANE RNA Guide
acgacaacgugauucuccaggu

SEQ ID NO: 13119 - RNA, 22 nt, Artificial Sequence
  ELANE RNA Guide
acguugucguugagcaaguuua

SEQ ID NO: 13120 - RNA, 22 nt, Artificial Sequence
  ELANE RNA Guide
acuugcucaacgacaacgugau

SEQ ID NO: 13121 - RNA, 22 nt, Artificial Sequence
  ELANE RNA Guide
agaaucacguugucguugagca

SEQ ID NO: 13122 - RNA, 22 nt, Artificial Sequence
  ELANE RNA Guide
aucacguugucguugagcaagu

SEQ ID NO: 13123 - RNA, 22 nt, Artificial Sequence
  ELANE RNA Guide
caacgacaacgugauucuccag

SEQ ID NO: 13124 - RNA, 22 nt, Artificial Sequence
  ELANE RNA Guide
caacgugauucuccaggugccg

SEQ ID NO: 13125 - RNA, 22 nt, Artificial Sequence
  ELANE RNA Guide
caccuggagaaucacguugucg

SEQ ID NO: 13126 - RNA, 22 nt, Artificial Sequence
  ELANE RNA Guide
cacguugucguugagcaaguuu

SEQ ID NO: 13127 - RNA, 22 nt, Artificial Sequence
  ELANE RNA Guide
ccccguaaacuugcucaacgac

SEQ ID NO: 13128 - RNA, 22 nt, Artificial Sequence
  ELANE RNA Guide
cccggcggcaccuggagaauca

SEQ ID NO: 13129 - RNA, 22 nt, Artificial Sequence
  ELANE RNA Guide
cccguaaacuugcucaacgaca

SEQ ID NO: 13130 - RNA, 22 nt, Artificial Sequence
  ELANE RNA Guide
ccggcggcaccuggagaaucac

SEQ ID NO: 13131 - RNA, 22 nt, Artificial Sequence
  ELANE RNA Guide
ccguaaacuugcucaacgacaa

SEQ ID NO: 13132 - RNA, 22 nt, Artificial Sequence
  ELANE RNA Guide
ccuggagaaucacguugucguu

SEQ ID NO: 13133 - RNA, 22 nt, Artificial Sequence
  ELANE RNA Guide
cgacaacgugauucuccaggug

SEQ ID NO: 13134 - RNA, 22 nt, Artificial Sequence
  ELANE RNA Guide
cggcaccuggagaaucacguug

SEQ ID NO: 13135 - RNA, 22 nt, Artificial Sequence
  ELANE RNA Guide
cggcggcaccuggagaaucacg

SEQ ID NO: 13136 - RNA, 22 nt, Artificial Sequence
  ELANE RNA Guide
cguaaacuugcucaacgacaac

SEQ ID NO: 13137 - RNA, 22 nt, Artificial Sequence
  ELANE RNA Guide
cguugucguugagcaaguuuac

SEQ ID NO: 13138 - RNA, 22 nt, Artificial Sequence
  ELANE RNA Guide
cucaacgacaacgugauucucc

SEQ ID NO: 13139 - RNA, 22 nt, Artificial Sequence
  ELANE RNA Guide
cuggagaaucacguugucguug

SEQ ID NO: 13140 - RNA, 22 nt, Artificial Sequence
  ELANE RNA Guide
cuugcucaacgacaacgugauu

SEQ ID NO: 13141 - RNA, 22 nt, Artificial Sequence
  ELANE RNA Guide
gaaucacguugucguugagcaa

SEQ ID NO: 13142 - RNA, 22 nt, Artificial Sequence
  ELANE RNA Guide
gacaacgugauucuccaggugc

SEQ ID NO: 13143 - RNA, 22 nt, Artificial Sequence
  ELANE RNA Guide
gaccccguaaacuugcucaacg

SEQ ID NO: 13144 - RNA, 22 nt, Artificial Sequence
  ELANE RNA Guide
gagaaucacguugucguugagc

SEQ ID NO: 13145 - RNA, 22 nt, Artificial Sequence
  ELANE RNA Guide
gcaccuggagaaucacguuguc

SEQ ID NO: 13146 - RNA, 22 nt, Artificial Sequence
  ELANE RNA Guide
gcccggcggcaccuggagaauc

SEQ ID NO: 13147 - RNA, 22 nt, Artificial Sequence
  ELANE RNA Guide
gcggcaccuggagaaucacguu

SEQ ID NO: 13148 - RNA, 22 nt, Artificial Sequence
  ELANE RNA Guide
gcucaacgacaacgugauucuc

SEQ ID NO: 13149 - RNA, 22 nt, Artificial Sequence
  ELANE RNA Guide
ggagaaucacguugucguugag

SEQ ID NO: 13150 - RNA, 22 nt, Artificial Sequence
  ELANE RNA Guide
ggcaccuggagaaucacguugu

SEQ ID NO: 13151 - RNA, 22 nt, Artificial Sequence
  ELANE RNA Guide
ggcggcaccuggagaaucacgu

SEQ ID NO: 13152 - RNA, 22 nt, Artificial Sequence
  ELANE RNA Guide
guaaacuugcucaacgacaacg

SEQ ID NO: 13153 - RNA, 22 nt, Artificial Sequence
  ELANE RNA Guide
guugucguugagcaaguuuacg

SEQ ID NO: 13154 - RNA, 22 nt, Artificial Sequence
  ELANE RNA Guide
uaaacuugcucaacgacaacgu

SEQ ID NO: 13155 - RNA, 22 nt, Artificial Sequence
  ELANE RNA Guide
ucaacgacaacgugauucucca

SEQ ID NO: 13156 - RNA, 22 nt, Artificial Sequence
  ELANE RNA Guide
ucacguugucguugagcaaguu

SEQ ID NO: 13157 - RNA, 22 nt, Artificial Sequence
  ELANE RNA Guide
ugcucaacgacaacgugauucu

SEQ ID NO: 13158 - RNA, 22 nt, Artificial Sequence
  ELANE RNA Guide
uggagaaucacguugucguuga

SEQ ID NO: 13159 - RNA, 22 nt, Artificial Sequence
  ELANE RNA Guide
uugcucaacgacaacgugauuc

SEQ ID NO: 13160 - RNA, 20 nt, Artificial Sequence
  ELANE RNA Guide
aaacacgaugucguugagca

SEQ ID NO: 13161 - RNA, 20 nt, Artificial Sequence
  ELANE RNA Guide
aaacuugcucaacgacaucg

SEQ ID NO: 13162 - RNA, 20 nt, Artificial Sequence
  ELANE RNA Guide
aacacgaugucguugagcaa

SEQ ID NO: 13163 - RNA, 20 nt, Artificial Sequence
  ELANE RNA Guide
aacgacaucguguuucucca

SEQ ID NO: 13164 - RNA, 20 nt, Artificial Sequence
  ELANE RNA Guide
aacuugcucaacgacaucgu

SEQ ID NO: 13165 - RNA, 20 nt, Artificial Sequence
  ELANE RNA Guide
acaucguguuucuccaggug

SEQ ID NO: 13166 - RNA, 20 nt, Artificial Sequence
  ELANE RNA Guide
accuggagaaacacgauguc

SEQ ID NO: 13167 - RNA, 20 nt, Artificial Sequence
  ELANE RNA Guide
acgacaucguguuucuccag

SEQ ID NO: 13168 - RNA, 20 nt, Artificial Sequence
  ELANE RNA Guide
acuugcucaacgacaucgug

SEQ ID NO: 13169 - RNA, 20 nt, Artificial Sequence
  ELANE RNA Guide
agaaacacgaugucguugag

SEQ ID NO: 13170 - RNA, 20 nt, Artificial Sequence
  ELANE RNA Guide
aucguguuucuccaggugcc

SEQ ID NO: 13171 - RNA, 20 nt, Artificial Sequence
  ELANE RNA Guide
caacgacaucguguuucucc

SEQ ID NO: 13172 - RNA, 20 nt, Artificial Sequence
  ELANE RNA Guide
caccuggagaaacacgaugu

SEQ ID NO: 13173 - RNA, 20 nt, Artificial Sequence
  ELANE RNA Guide
caucguguuucuccaggugc

SEQ ID NO: 13174 - RNA, 20 nt, Artificial Sequence
  ELANE RNA Guide
cccggcggcaccuggagaaa

SEQ ID NO: 13175 - RNA, 20 nt, Artificial Sequence
  ELANE RNA Guide
ccggcggcaccuggagaaac

SEQ ID NO: 13176 - RNA, 20 nt, Artificial Sequence
  ELANE RNA Guide
ccuggagaaacacgaugucg

SEQ ID NO: 13177 - RNA, 20 nt, Artificial Sequence
  ELANE RNA Guide
cgacaucguguuucuccagg

SEQ ID NO: 13178 - RNA, 20 nt, Artificial Sequence
  ELANE RNA Guide
cggcaccuggagaaacacga

SEQ ID NO: 13179 - RNA, 20 nt, Artificial Sequence
  ELANE RNA Guide
cggcggcaccuggagaaaca

SEQ ID NO: 13180 - RNA, 20 nt, Artificial Sequence
  ELANE RNA Guide
cguguuucuccaggugccgc

SEQ ID NO: 13181 - RNA, 20 nt, Artificial Sequence
  ELANE RNA Guide
cucaacgacaucguguuucu

SEQ ID NO: 13182 - RNA, 20 nt, Artificial Sequence
  ELANE RNA Guide
cuggagaaacacgaugucgu

SEQ ID NO: 13183 - RNA, 20 nt, Artificial Sequence
  ELANE RNA Guide
cuugcucaacgacaucgugu

SEQ ID NO: 13184 - RNA, 20 nt, Artificial Sequence
  ELANE RNA Guide
gaaacacgaugucguugagc

SEQ ID NO: 13185 - RNA, 20 nt, Artificial Sequence
  ELANE RNA Guide
gacaucguguuucuccaggu

SEQ ID NO: 13186 - RNA, 20 nt, Artificial Sequence
  ELANE RNA Guide
gagaaacacgaugucguuga

SEQ ID NO: 13187 - RNA, 20 nt, Artificial Sequence
  ELANE RNA Guide
gcaccuggagaaacacgaug

SEQ ID NO: 13188 - RNA, 20 nt, Artificial Sequence
  ELANE RNA Guide
gcggcaccuggagaaacacg

SEQ ID NO: 13189 - RNA, 20 nt, Artificial Sequence
  ELANE RNA Guide
gcucaacgacaucguguuuc

SEQ ID NO: 13190 - RNA, 20 nt, Artificial Sequence
  ELANE RNA Guide
ggagaaacacgaugucguug

SEQ ID NO: 13191 - RNA, 20 nt, Artificial Sequence
  ELANE RNA Guide
ggcaccuggagaaacacgau

SEQ ID NO: 13192 - RNA, 20 nt, Artificial Sequence
  ELANE RNA Guide
ggcggcaccuggagaaacac

SEQ ID NO: 13193 - RNA, 20 nt, Artificial Sequence
  ELANE RNA Guide
guguuucuccaggugccgcc

SEQ ID NO: 13194 - RNA, 20 nt, Artificial Sequence
  ELANE RNA Guide
guuucuccaggugccgccgg

SEQ ID NO: 13195 - RNA, 20 nt, Artificial Sequence
  ELANE RNA Guide
uaaacuugcucaacgacauc

SEQ ID NO: 13196 - RNA, 20 nt, Artificial Sequence
  ELANE RNA Guide
ucaacgacaucguguuucuc

SEQ ID NO: 13197 - RNA, 20 nt, Artificial Sequence
  ELANE RNA Guide
ucguguuucuccaggugccg

SEQ ID NO: 13198 - RNA, 20 nt, Artificial Sequence
  ELANE RNA Guide
ugcucaacgacaucguguuu

SEQ ID NO: 13199 - RNA, 20 nt, Artificial Sequence
  ELANE RNA Guide
uggagaaacacgaugucguu

SEQ ID NO: 13200 - RNA, 20 nt, Artificial Sequence
  ELANE RNA Guide
uguuucuccaggugccgccg

SEQ ID NO: 13201 - RNA, 20 nt, Artificial Sequence
  ELANE RNA Guide
uugcucaacgacaucguguu

SEQ ID NO: 13202 - RNA, 21 nt, Artificial Sequence
  ELANE RNA Guide
aaacacgaugucguugagcaa

SEQ ID NO: 13203 - RNA, 21 nt, Artificial Sequence
  ELANE RNA Guide
aaacuugcucaacgacaucgu

SEQ ID NO: 13204 - RNA, 21 nt, Artificial Sequence
  ELANE RNA Guide
aacacgaugucguugagcaag

SEQ ID NO: 13205 - RNA, 21 nt, Artificial Sequence
  ELANE RNA Guide
aacgacaucguguuucuccag

SEQ ID NO: 13206 - RNA, 21 nt, Artificial Sequence
  ELANE RNA Guide
aacuugcucaacgacaucgug

SEQ ID NO: 13207 - RNA, 21 nt, Artificial Sequence
  ELANE RNA Guide
acaucguguuucuccaggugc

SEQ ID NO: 13208 - RNA, 21 nt, Artificial Sequence
  ELANE RNA Guide
accuggagaaacacgaugucg

SEQ ID NO: 13209 - RNA, 21 nt, Artificial Sequence
  ELANE RNA Guide
acgacaucguguuucuccagg

SEQ ID NO: 13210 - RNA, 21 nt, Artificial Sequence
  ELANE RNA Guide
acuugcucaacgacaucgugu

SEQ ID NO: 13211 - RNA, 21 nt, Artificial Sequence
  ELANE RNA Guide
agaaacacgaugucguugagc

SEQ ID NO: 13212 - RNA, 21 nt, Artificial Sequence
  ELANE RNA Guide
aucguguuucuccaggugccg

SEQ ID NO: 13213 - RNA, 21 nt, Artificial Sequence
  ELANE RNA Guide
caacgacaucguguuucucca

SEQ ID NO: 13214 - RNA, 21 nt, Artificial Sequence
  ELANE RNA Guide
caccuggagaaacacgauguc

SEQ ID NO: 13215 - RNA, 21 nt, Artificial Sequence
  ELANE RNA Guide
caucguguuucuccaggugcc

SEQ ID NO: 13216 - RNA, 21 nt, Artificial Sequence
  ELANE RNA Guide
cccggcggcaccuggagaaac

SEQ ID NO: 13217 - RNA, 21 nt, Artificial Sequence
  ELANE RNA Guide
ccggcggcaccuggagaaaca

SEQ ID NO: 13218 - RNA, 21 nt, Artificial Sequence
  ELANE RNA Guide
ccuggagaaacacgaugucgu

SEQ ID NO: 13219 - RNA, 21 nt, Artificial Sequence
  ELANE RNA Guide
cgacaucguguuucuccaggu

SEQ ID NO: 13220 - RNA, 21 nt, Artificial Sequence
  ELANE RNA Guide
cggcaccuggagaaacacgau

SEQ ID NO: 13221 - RNA, 21 nt, Artificial Sequence
  ELANE RNA Guide
cggcggcaccuggagaaacac

SEQ ID NO: 13222 - RNA, 21 nt, Artificial Sequence
  ELANE RNA Guide
cguguuucuccaggugccgcc

SEQ ID NO: 13223 - RNA, 21 nt, Artificial Sequence
  ELANE RNA Guide
cucaacgacaucguguuucuc

SEQ ID NO: 13224 - RNA, 21 nt, Artificial Sequence
  ELANE RNA Guide
cuggagaaacacgaugucguu

SEQ ID NO: 13225 - RNA, 21 nt, Artificial Sequence
  ELANE RNA Guide
cuugcucaacgacaucguguu

SEQ ID NO: 13226 - RNA, 21 nt, Artificial Sequence
  ELANE RNA Guide
gaaacacgaugucguugagca

SEQ ID NO: 13227 - RNA, 21 nt, Artificial Sequence
  ELANE RNA Guide
gacaucguguuucuccaggug

SEQ ID NO: 13228 - RNA, 21 nt, Artificial Sequence
  ELANE RNA Guide
gagaaacacgaugucguugag

SEQ ID NO: 13229 - RNA, 21 nt, Artificial Sequence
  ELANE RNA Guide
gcaccuggagaaacacgaugu

SEQ ID NO: 13230 - RNA, 21 nt, Artificial Sequence
  ELANE RNA Guide
gcccggcggcaccuggagaaa

SEQ ID NO: 13231 - RNA, 21 nt, Artificial Sequence
  ELANE RNA Guide
gcggcaccuggagaaacacga

SEQ ID NO: 13232 - RNA, 21 nt, Artificial Sequence
  ELANE RNA Guide
gcucaacgacaucguguuucu

SEQ ID NO: 13233 - RNA, 21 nt, Artificial Sequence
  ELANE RNA Guide
ggagaaacacgaugucguuga

SEQ ID NO: 13234 - RNA, 21 nt, Artificial Sequence
  ELANE RNA Guide
ggcaccuggagaaacacgaug

SEQ ID NO: 13235 - RNA, 21 nt, Artificial Sequence
  ELANE RNA Guide
ggcggcaccuggagaaacacg

SEQ ID NO: 13236 - RNA, 21 nt, Artificial Sequence
  ELANE RNA Guide
guaaacuugcucaacgacauc

SEQ ID NO: 13237 - RNA, 21 nt, Artificial Sequence
  ELANE RNA Guide
guguuucuccaggugccgccg

SEQ ID NO: 13238 - RNA, 21 nt, Artificial Sequence
  ELANE RNA Guide
guuucuccaggugccgccggg

SEQ ID NO: 13239 - RNA, 21 nt, Artificial Sequence
  ELANE RNA Guide
uaaacuugcucaacgacaucg

SEQ ID NO: 13240 - RNA, 21 nt, Artificial Sequence
  ELANE RNA Guide
ucaacgacaucguguuucucc

SEQ ID NO: 13241 - RNA, 21 nt, Artificial Sequence
  ELANE RNA Guide
ucguguuucuccaggugccgc

SEQ ID NO: 13242 - RNA, 21 nt, Artificial Sequence
  ELANE RNA Guide
ugcucaacgacaucguguuuc

SEQ ID NO: 13243 - RNA, 21 nt, Artificial Sequence
  ELANE RNA Guide
uggagaaacacgaugucguug

SEQ ID NO: 13244 - RNA, 21 nt, Artificial Sequence
  ELANE RNA Guide
uguuucuccaggugccgccgg

SEQ ID NO: 13245 - RNA, 21 nt, Artificial Sequence
  ELANE RNA Guide
uugcucaacgacaucguguuu

SEQ ID NO: 13246 - RNA, 22 nt, Artificial Sequence
  ELANE RNA Guide
aaacacgaugucguugagcaag

SEQ ID NO: 13247 - RNA, 22 nt, Artificial Sequence
  ELANE RNA Guide
aaacuugcucaacgacaucgug

SEQ ID NO: 13248 - RNA, 22 nt, Artificial Sequence
  ELANE RNA Guide
aacacgaugucguugagcaagu

SEQ ID NO: 13249 - RNA, 22 nt, Artificial Sequence
  ELANE RNA Guide
aacgacaucguguuucuccagg

SEQ ID NO: 13250 - RNA, 22 nt, Artificial Sequence
  ELANE RNA Guide
aacuugcucaacgacaucgugu

SEQ ID NO: 13251 - RNA, 22 nt, Artificial Sequence
  ELANE RNA Guide
acaucguguuucuccaggugcc

SEQ ID NO: 13252 - RNA, 22 nt, Artificial Sequence
  ELANE RNA Guide
accuggagaaacacgaugucgu

SEQ ID NO: 13253 - RNA, 22 nt, Artificial Sequence
  ELANE RNA Guide
acgacaucguguuucuccaggu

SEQ ID NO: 13254 - RNA, 22 nt, Artificial Sequence
  ELANE RNA Guide
acuugcucaacgacaucguguu

SEQ ID NO: 13255 - RNA, 22 nt, Artificial Sequence
  ELANE RNA Guide
agaaacacgaugucguugagca

SEQ ID NO: 13256 - RNA, 22 nt, Artificial Sequence
  ELANE RNA Guide
aucguguuucuccaggugccgc

SEQ ID NO: 13257 - RNA, 22 nt, Artificial Sequence
  ELANE RNA Guide
caacgacaucguguuucuccag

SEQ ID NO: 13258 - RNA, 22 nt, Artificial Sequence
  ELANE RNA Guide
caccuggagaaacacgaugucg

SEQ ID NO: 13259 - RNA, 22 nt, Artificial Sequence
  ELANE RNA Guide
caucguguuucuccaggugccg

SEQ ID NO: 13260 - RNA, 22 nt, Artificial Sequence
  ELANE RNA Guide
cccggcggcaccuggagaaaca

SEQ ID NO: 13261 - RNA, 22 nt, Artificial Sequence
  ELANE RNA Guide
ccggcggcaccuggagaaacac

SEQ ID NO: 13262 - RNA, 22 nt, Artificial Sequence
  ELANE RNA Guide
ccuggagaaacacgaugucguu

SEQ ID NO: 13263 - RNA, 22 nt, Artificial Sequence
  ELANE RNA Guide
cgacaucguguuucuccaggug

SEQ ID NO: 13264 - RNA, 22 nt, Artificial Sequence
  ELANE RNA Guide
cgcccggcggcaccuggagaaa

SEQ ID NO: 13265 - RNA, 22 nt, Artificial Sequence
  ELANE RNA Guide
cggcaccuggagaaacacgaug

SEQ ID NO: 13266 - RNA, 22 nt, Artificial Sequence
  ELANE RNA Guide
cggcggcaccuggagaaacacg

SEQ ID NO: 13267 - RNA, 22 nt, Artificial Sequence
  ELANE RNA Guide
cguaaacuugcucaacgacauc

SEQ ID NO: 13268 - RNA, 22 nt, Artificial Sequence
  ELANE RNA Guide
cguguuucuccaggugccgccg

SEQ ID NO: 13269 - RNA, 22 nt, Artificial Sequence
  ELANE RNA Guide
cucaacgacaucguguuucucc

SEQ ID NO: 13270 - RNA, 22 nt, Artificial Sequence
  ELANE RNA Guide
cuggagaaacacgaugucguug

SEQ ID NO: 13271 - RNA, 22 nt, Artificial Sequence
  ELANE RNA Guide
cuugcucaacgacaucguguuu

SEQ ID NO: 13272 - RNA, 22 nt, Artificial Sequence
  ELANE RNA Guide
gaaacacgaugucguugagcaa

SEQ ID NO: 13273 - RNA, 22 nt, Artificial Sequence
  ELANE RNA Guide
gacaucguguuucuccaggugc

SEQ ID NO: 13274 - RNA, 22 nt, Artificial Sequence
  ELANE RNA Guide
gagaaacacgaugucguugagc

SEQ ID NO: 13275 - RNA, 22 nt, Artificial Sequence
  ELANE RNA Guide
gcaccuggagaaacacgauguc

SEQ ID NO: 13276 - RNA, 22 nt, Artificial Sequence
  ELANE RNA Guide
gcccggcggcaccuggagaaac

SEQ ID NO: 13277 - RNA, 22 nt, Artificial Sequence
  ELANE RNA Guide
gcggcaccuggagaaacacgau

SEQ ID NO: 13278 - RNA, 22 nt, Artificial Sequence
  ELANE RNA Guide
gcucaacgacaucguguuucuc

SEQ ID NO: 13279 - RNA, 22 nt, Artificial Sequence
  ELANE RNA Guide
ggagaaacacgaugucguugag

SEQ ID NO: 13280 - RNA, 22 nt, Artificial Sequence
  ELANE RNA Guide
ggcaccuggagaaacacgaugu

SEQ ID NO: 13281 - RNA, 22 nt, Artificial Sequence
  ELANE RNA Guide
ggcggcaccuggagaaacacga

SEQ ID NO: 13282 - RNA, 22 nt, Artificial Sequence
  ELANE RNA Guide
guaaacuugcucaacgacaucg

SEQ ID NO: 13283 - RNA, 22 nt, Artificial Sequence
  ELANE RNA Guide
guguuucuccaggugccgccgg

SEQ ID NO: 13284 - RNA, 22 nt, Artificial Sequence
  ELANE RNA Guide
guuucuccaggugccgccgggc

SEQ ID NO: 13285 - RNA, 22 nt, Artificial Sequence
  ELANE RNA Guide
uaaacuugcucaacgacaucgu

SEQ ID NO: 13286 - RNA, 22 nt, Artificial Sequence
  ELANE RNA Guide
ucaacgacaucguguuucucca

SEQ ID NO: 13287 - RNA, 22 nt, Artificial Sequence
  ELANE RNA Guide
ucguguuucuccaggugccgcc

SEQ ID NO: 13288 - RNA, 22 nt, Artificial Sequence
  ELANE RNA Guide
ugcucaacgacaucguguuucu

SEQ ID NO: 13289 - RNA, 22 nt, Artificial Sequence
  ELANE RNA Guide
uggagaaacacgaugucguuga

SEQ ID NO: 13290 - RNA, 22 nt, Artificial Sequence
  ELANE RNA Guide
uguuucuccaggugccgccggg

SEQ ID NO: 13291 - RNA, 22 nt, Artificial Sequence
  ELANE RNA Guide
uugcucaacgacaucguguuuc

SEQ ID NO: 13292 - RNA, 20 nt, Artificial Sequence
  ELANE RNA Guide
aacgacaucgugaaucucca

SEQ ID NO: 13293 - RNA, 20 nt, Artificial Sequence
  ELANE RNA Guide
aaucuccaggugccgccggg

SEQ ID NO: 13294 - RNA, 20 nt, Artificial Sequence
  ELANE RNA Guide
acaucgugaaucuccaggug

SEQ ID NO: 13295 - RNA, 20 nt, Artificial Sequence
  ELANE RNA Guide
accuggagauucacgauguc

SEQ ID NO: 13296 - RNA, 20 nt, Artificial Sequence
  ELANE RNA Guide
acgacaucgugaaucuccag

SEQ ID NO: 13297 - RNA, 20 nt, Artificial Sequence
  ELANE RNA Guide
agauucacgaugucguugag

SEQ ID NO: 13298 - RNA, 20 nt, Artificial Sequence
  ELANE RNA Guide
aucgugaaucuccaggugcc

SEQ ID NO: 13299 - RNA, 20 nt, Artificial Sequence
  ELANE RNA Guide
auucacgaugucguugagca

SEQ ID NO: 13300 - RNA, 20 nt, Artificial Sequence
  ELANE RNA Guide
caacgacaucgugaaucucc

SEQ ID NO: 13301 - RNA, 20 nt, Artificial Sequence
  ELANE RNA Guide
caccuggagauucacgaugu

SEQ ID NO: 13302 - RNA, 20 nt, Artificial Sequence
  ELANE RNA Guide
caucgugaaucuccaggugc

SEQ ID NO: 13303 - RNA, 20 nt, Artificial Sequence
  ELANE RNA Guide
cccggcggcaccuggagauu

SEQ ID NO: 13304 - RNA, 20 nt, Artificial Sequence
  ELANE RNA Guide
ccggcggcaccuggagauuc

SEQ ID NO: 13305 - RNA, 20 nt, Artificial Sequence
  ELANE RNA Guide
ccuggagauucacgaugucg

SEQ ID NO: 13306 - RNA, 20 nt, Artificial Sequence
  ELANE RNA Guide
cgacaucgugaaucuccagg

SEQ ID NO: 13307 - RNA, 20 nt, Artificial Sequence
  ELANE RNA Guide
cggcaccuggagauucacga

SEQ ID NO: 13308 - RNA, 20 nt, Artificial Sequence
  ELANE RNA Guide
cggcggcaccuggagauuca

SEQ ID NO: 13309 - RNA, 20 nt, Artificial Sequence
  ELANE RNA Guide
cgugaaucuccaggugccgc

SEQ ID NO: 13310 - RNA, 20 nt, Artificial Sequence
  ELANE RNA Guide
cucaacgacaucgugaaucu

SEQ ID NO: 13311 - RNA, 20 nt, Artificial Sequence
  ELANE RNA Guide
cuggagauucacgaugucgu

SEQ ID NO: 13312 - RNA, 20 nt, Artificial Sequence
  ELANE RNA Guide
cuugcucaacgacaucguga

SEQ ID NO: 13313 - RNA, 20 nt, Artificial Sequence
  ELANE RNA Guide
gaaucuccaggugccgccgg

SEQ ID NO: 13314 - RNA, 20 nt, Artificial Sequence
  ELANE RNA Guide
gacaucgugaaucuccaggu

SEQ ID NO: 13315 - RNA, 20 nt, Artificial Sequence
  ELANE RNA Guide
gagauucacgaugucguuga

SEQ ID NO: 13316 - RNA, 20 nt, Artificial Sequence
  ELANE RNA Guide
gauucacgaugucguugagc

SEQ ID NO: 13317 - RNA, 20 nt, Artificial Sequence
  ELANE RNA Guide
gcaccuggagauucacgaug

SEQ ID NO: 13318 - RNA, 20 nt, Artificial Sequence
  ELANE RNA Guide
gcccggcggcaccuggagau

SEQ ID NO: 13319 - RNA, 20 nt, Artificial Sequence
  ELANE RNA Guide
gcggcaccuggagauucacg

SEQ ID NO: 13320 - RNA, 20 nt, Artificial Sequence
  ELANE RNA Guide
gcucaacgacaucgugaauc

SEQ ID NO: 13321 - RNA, 20 nt, Artificial Sequence
  ELANE RNA Guide
ggagauucacgaugucguug

SEQ ID NO: 13322 - RNA, 20 nt, Artificial Sequence
  ELANE RNA Guide
ggcaccuggagauucacgau

SEQ ID NO: 13323 - RNA, 20 nt, Artificial Sequence
  ELANE RNA Guide
ggcggcaccuggagauucac

SEQ ID NO: 13324 - RNA, 20 nt, Artificial Sequence
  ELANE RNA Guide
gugaaucuccaggugccgcc

SEQ ID NO: 13325 - RNA, 20 nt, Artificial Sequence
  ELANE RNA Guide
ucaacgacaucgugaaucuc

SEQ ID NO: 13326 - RNA, 20 nt, Artificial Sequence
  ELANE RNA Guide
ucgugaaucuccaggugccg

SEQ ID NO: 13327 - RNA, 20 nt, Artificial Sequence
  ELANE RNA Guide
ugaaucuccaggugccgccg

SEQ ID NO: 13328 - RNA, 20 nt, Artificial Sequence
  ELANE RNA Guide
ugcucaacgacaucgugaau

SEQ ID NO: 13329 - RNA, 20 nt, Artificial Sequence
  ELANE RNA Guide
uggagauucacgaugucguu

SEQ ID NO: 13330 - RNA, 20 nt, Artificial Sequence
  ELANE RNA Guide
uugcucaacgacaucgugaa

SEQ ID NO: 13331 - RNA, 21 nt, Artificial Sequence
  ELANE RNA Guide
aacgacaucgugaaucuccag

SEQ ID NO: 13332 - RNA, 21 nt, Artificial Sequence
  ELANE RNA Guide
aaucuccaggugccgccgggc

SEQ ID NO: 13333 - RNA, 21 nt, Artificial Sequence
  ELANE RNA Guide
acaucgugaaucuccaggugc

SEQ ID NO: 13334 - RNA, 21 nt, Artificial Sequence
  ELANE RNA Guide
accuggagauucacgaugucg

SEQ ID NO: 13335 - RNA, 21 nt, Artificial Sequence
  ELANE RNA Guide
acgacaucgugaaucuccagg

SEQ ID NO: 13336 - RNA, 21 nt, Artificial Sequence
  ELANE RNA Guide
acuugcucaacgacaucguga

SEQ ID NO: 13337 - RNA, 21 nt, Artificial Sequence
  ELANE RNA Guide
agauucacgaugucguugagc

SEQ ID NO: 13338 - RNA, 21 nt, Artificial Sequence
  ELANE RNA Guide
aucgugaaucuccaggugccg

SEQ ID NO: 13339 - RNA, 21 nt, Artificial Sequence
  ELANE RNA Guide
auucacgaugucguugagcaa

SEQ ID NO: 13340 - RNA, 21 nt, Artificial Sequence
  ELANE RNA Guide
caacgacaucgugaaucucca

SEQ ID NO: 13341 - RNA, 21 nt, Artificial Sequence
  ELANE RNA Guide
caccuggagauucacgauguc

SEQ ID NO: 13342 - RNA, 21 nt, Artificial Sequence
  ELANE RNA Guide
caucgugaaucuccaggugcc

SEQ ID NO: 13343 - RNA, 21 nt, Artificial Sequence
  ELANE RNA Guide
cccggcggcaccuggagauuc

SEQ ID NO: 13344 - RNA, 21 nt, Artificial Sequence
  ELANE RNA Guide
ccggcggcaccuggagauuca

SEQ ID NO: 13345 - RNA, 21 nt, Artificial Sequence
  ELANE RNA Guide
ccuggagauucacgaugucgu

SEQ ID NO: 13346 - RNA, 21 nt, Artificial Sequence
  ELANE RNA Guide
cgacaucgugaaucuccaggu

SEQ ID NO: 13347 - RNA, 21 nt, Artificial Sequence
  ELANE RNA Guide
cgcccggcggcaccuggagau

SEQ ID NO: 13348 - RNA, 21 nt, Artificial Sequence
  ELANE RNA Guide
cggcaccuggagauucacgau

SEQ ID NO: 13349 - RNA, 21 nt, Artificial Sequence
  ELANE RNA Guide
cggcggcaccuggagauucac

SEQ ID NO: 13350 - RNA, 21 nt, Artificial Sequence
  ELANE RNA Guide
cgugaaucuccaggugccgcc

SEQ ID NO: 13351 - RNA, 21 nt, Artificial Sequence
  ELANE RNA Guide
cucaacgacaucgugaaucuc

SEQ ID NO: 13352 - RNA, 21 nt, Artificial Sequence
  ELANE RNA Guide
cuggagauucacgaugucguu

SEQ ID NO: 13353 - RNA, 21 nt, Artificial Sequence
  ELANE RNA Guide
cuugcucaacgacaucgugaa

SEQ ID NO: 13354 - RNA, 21 nt, Artificial Sequence
  ELANE RNA Guide
gaaucuccaggugccgccggg

SEQ ID NO: 13355 - RNA, 21 nt, Artificial Sequence
  ELANE RNA Guide
gacaucgugaaucuccaggug

SEQ ID NO: 13356 - RNA, 21 nt, Artificial Sequence
  ELANE RNA Guide
gagauucacgaugucguugag

SEQ ID NO: 13357 - RNA, 21 nt, Artificial Sequence
  ELANE RNA Guide
gauucacgaugucguugagca

SEQ ID NO: 13358 - RNA, 21 nt, Artificial Sequence
  ELANE RNA Guide
gcaccuggagauucacgaugu

SEQ ID NO: 13359 - RNA, 21 nt, Artificial Sequence
  ELANE RNA Guide
gcccggcggcaccuggagauu

SEQ ID NO: 13360 - RNA, 21 nt, Artificial Sequence
  ELANE RNA Guide
gcggcaccuggagauucacga

SEQ ID NO: 13361 - RNA, 21 nt, Artificial Sequence
  ELANE RNA Guide
gcucaacgacaucgugaaucu

SEQ ID NO: 13362 - RNA, 21 nt, Artificial Sequence
  ELANE RNA Guide
ggagauucacgaugucguuga

SEQ ID NO: 13363 - RNA, 21 nt, Artificial Sequence
  ELANE RNA Guide
ggcaccuggagauucacgaug

SEQ ID NO: 13364 - RNA, 21 nt, Artificial Sequence
  ELANE RNA Guide
ggcggcaccuggagauucacg

SEQ ID NO: 13365 - RNA, 21 nt, Artificial Sequence
  ELANE RNA Guide
gugaaucuccaggugccgccg

SEQ ID NO: 13366 - RNA, 21 nt, Artificial Sequence
  ELANE RNA Guide
ucaacgacaucgugaaucucc

SEQ ID NO: 13367 - RNA, 21 nt, Artificial Sequence
  ELANE RNA Guide
ucgugaaucuccaggugccgc

SEQ ID NO: 13368 - RNA, 21 nt, Artificial Sequence
  ELANE RNA Guide
ugaaucuccaggugccgccgg

SEQ ID NO: 13369 - RNA, 21 nt, Artificial Sequence
  ELANE RNA Guide
ugcucaacgacaucgugaauc

SEQ ID NO: 13370 - RNA, 21 nt, Artificial Sequence
  ELANE RNA Guide
uggagauucacgaugucguug

SEQ ID NO: 13371 - RNA, 21 nt, Artificial Sequence
  ELANE RNA Guide
uugcucaacgacaucgugaau

SEQ ID NO: 13372 - RNA, 22 nt, Artificial Sequence
  ELANE RNA Guide
aacgacaucgugaaucuccagg

SEQ ID NO: 13373 - RNA, 22 nt, Artificial Sequence
  ELANE RNA Guide
aacuugcucaacgacaucguga

SEQ ID NO: 13374 - RNA, 22 nt, Artificial Sequence
  ELANE RNA Guide
aaucuccaggugccgccgggcg

SEQ ID NO: 13375 - RNA, 22 nt, Artificial Sequence
  ELANE RNA Guide
acaucgugaaucuccaggugcc

SEQ ID NO: 13376 - RNA, 22 nt, Artificial Sequence
  ELANE RNA Guide
accuggagauucacgaugucgu

SEQ ID NO: 13377 - RNA, 22 nt, Artificial Sequence
  ELANE RNA Guide
acgacaucgugaaucuccaggu

SEQ ID NO: 13378 - RNA, 22 nt, Artificial Sequence
  ELANE RNA Guide
acuugcucaacgacaucgugaa

SEQ ID NO: 13379 - RNA, 22 nt, Artificial Sequence
  ELANE RNA Guide
agauucacgaugucguugagca

SEQ ID NO: 13380 - RNA, 22 nt, Artificial Sequence
  ELANE RNA Guide
aucgugaaucuccaggugccgc

SEQ ID NO: 13381 - RNA, 22 nt, Artificial Sequence
  ELANE RNA Guide
auucacgaugucguugagcaag

SEQ ID NO: 13382 - RNA, 22 nt, Artificial Sequence
  ELANE RNA Guide
caacgacaucgugaaucuccag

SEQ ID NO: 13383 - RNA, 22 nt, Artificial Sequence
  ELANE RNA Guide
caccuggagauucacgaugucg

SEQ ID NO: 13384 - RNA, 22 nt, Artificial Sequence
  ELANE RNA Guide
caucgugaaucuccaggugccg

SEQ ID NO: 13385 - RNA, 22 nt, Artificial Sequence
  ELANE RNA Guide
cccggcggcaccuggagauuca

SEQ ID NO: 13386 - RNA, 22 nt, Artificial Sequence
  ELANE RNA Guide
ccgcccggcggcaccuggagau

SEQ ID NO: 13387 - RNA, 22 nt, Artificial Sequence
  ELANE RNA Guide
ccggcggcaccuggagauucac

SEQ ID NO: 13388 - RNA, 22 nt, Artificial Sequence
  ELANE RNA Guide
ccuggagauucacgaugucguu

SEQ ID NO: 13389 - RNA, 22 nt, Artificial Sequence
  ELANE RNA Guide
cgacaucgugaaucuccaggug

SEQ ID NO: 13390 - RNA, 22 nt, Artificial Sequence
  ELANE RNA Guide
cgcccggcggcaccuggagauu

SEQ ID NO: 13391 - RNA, 22 nt, Artificial Sequence
  ELANE RNA Guide
cggcaccuggagauucacgaug

SEQ ID NO: 13392 - RNA, 22 nt, Artificial Sequence
  ELANE RNA Guide
cggcggcaccuggagauucacg

SEQ ID NO: 13393 - RNA, 22 nt, Artificial Sequence
  ELANE RNA Guide
cgugaaucuccaggugccgccg

SEQ ID NO: 13394 - RNA, 22 nt, Artificial Sequence
  ELANE RNA Guide
cucaacgacaucgugaaucucc

SEQ ID NO: 13395 - RNA, 22 nt, Artificial Sequence
  ELANE RNA Guide
cuggagauucacgaugucguug

SEQ ID NO: 13396 - RNA, 22 nt, Artificial Sequence
  ELANE RNA Guide
cuugcucaacgacaucgugaau

SEQ ID NO: 13397 - RNA, 22 nt, Artificial Sequence
  ELANE RNA Guide
gaaucuccaggugccgccgggc

SEQ ID NO: 13398 - RNA, 22 nt, Artificial Sequence
  ELANE RNA Guide
gacaucgugaaucuccaggugc

SEQ ID NO: 13399 - RNA, 22 nt, Artificial Sequence
  ELANE RNA Guide
gagauucacgaugucguugagc

SEQ ID NO: 13400 - RNA, 22 nt, Artificial Sequence
  ELANE RNA Guide
gauucacgaugucguugagcaa

SEQ ID NO: 13401 - RNA, 22 nt, Artificial Sequence
  ELANE RNA Guide
gcaccuggagauucacgauguc

SEQ ID NO: 13402 - RNA, 22 nt, Artificial Sequence
  ELANE RNA Guide
gcccggcggcaccuggagauuc

SEQ ID NO: 13403 - RNA, 22 nt, Artificial Sequence
  ELANE RNA Guide
gcggcaccuggagauucacgau

SEQ ID NO: 13404 - RNA, 22 nt, Artificial Sequence
  ELANE RNA Guide
gcucaacgacaucgugaaucuc

SEQ ID NO: 13405 - RNA, 22 nt, Artificial Sequence
  ELANE RNA Guide
ggagauucacgaugucguugag

SEQ ID NO: 13406 - RNA, 22 nt, Artificial Sequence
  ELANE RNA Guide
ggcaccuggagauucacgaugu

SEQ ID NO: 13407 - RNA, 22 nt, Artificial Sequence
  ELANE RNA Guide
ggcggcaccuggagauucacga

SEQ ID NO: 13408 - RNA, 22 nt, Artificial Sequence
  ELANE RNA Guide
gugaaucuccaggugccgccgg

SEQ ID NO: 13409 - RNA, 22 nt, Artificial Sequence
  ELANE RNA Guide
ucaacgacaucgugaaucucca

SEQ ID NO: 13410 - RNA, 22 nt, Artificial Sequence
  ELANE RNA Guide
ucgugaaucuccaggugccgcc

SEQ ID NO: 13411 - RNA, 22 nt, Artificial Sequence
  ELANE RNA Guide
ugaaucuccaggugccgccggg

SEQ ID NO: 13412 - RNA, 22 nt, Artificial Sequence
  ELANE RNA Guide
ugcucaacgacaucgugaaucu

SEQ ID NO: 13413 - RNA, 22 nt, Artificial Sequence
  ELANE RNA Guide
uggagauucacgaugucguuga

SEQ ID NO: 13414 - RNA, 22 nt, Artificial Sequence
  ELANE RNA Guide
uugcucaacgacaucgugaauc

SEQ ID NO: 13415 - RNA, 20 nt, Artificial Sequence
  ELANE RNA Guide
aacgacaucgugagucucca

SEQ ID NO: 13416 - RNA, 20 nt, Artificial Sequence
  ELANE RNA Guide
acaucgugagucuccaggug

SEQ ID NO: 13417 - RNA, 20 nt, Artificial Sequence
  ELANE RNA Guide
accuggagacucacgauguc

SEQ ID NO: 13418 - RNA, 20 nt, Artificial Sequence
  ELANE RNA Guide
acgacaucgugagucuccag

SEQ ID NO: 13419 - RNA, 20 nt, Artificial Sequence
  ELANE RNA Guide
acucacgaugucguugagca

SEQ ID NO: 13420 - RNA, 20 nt, Artificial Sequence
  ELANE RNA Guide
agacucacgaugucguugag

SEQ ID NO: 13421 - RNA, 20 nt, Artificial Sequence
  ELANE RNA Guide
agucuccaggugccgccggg

SEQ ID NO: 13422 - RNA, 20 nt, Artificial Sequence
  ELANE RNA Guide
aucgugagucuccaggugcc

SEQ ID NO: 13423 - RNA, 20 nt, Artificial Sequence
  ELANE RNA Guide
caacgacaucgugagucucc

SEQ ID NO: 13424 - RNA, 20 nt, Artificial Sequence
  ELANE RNA Guide
caccuggagacucacgaugu

SEQ ID NO: 13425 - RNA, 20 nt, Artificial Sequence
  ELANE RNA Guide
caucgugagucuccaggugc

SEQ ID NO: 13426 - RNA, 20 nt, Artificial Sequence
  ELANE RNA Guide
cccggcggcaccuggagacu

SEQ ID NO: 13427 - RNA, 20 nt, Artificial Sequence
  ELANE RNA Guide
ccggcggcaccuggagacuc

SEQ ID NO: 13428 - RNA, 20 nt, Artificial Sequence
  ELANE RNA Guide
ccuggagacucacgaugucg

SEQ ID NO: 13429 - RNA, 20 nt, Artificial Sequence
  ELANE RNA Guide
cgacaucgugagucuccagg

SEQ ID NO: 13430 - RNA, 20 nt, Artificial Sequence
  ELANE RNA Guide
cggcaccuggagacucacga

SEQ ID NO: 13431 - RNA, 20 nt, Artificial Sequence
  ELANE RNA Guide
cggcggcaccuggagacuca

SEQ ID NO: 13432 - RNA, 20 nt, Artificial Sequence
  ELANE RNA Guide
cgugagucuccaggugccgc

SEQ ID NO: 13433 - RNA, 20 nt, Artificial Sequence
  ELANE RNA Guide
cucaacgacaucgugagucu

SEQ ID NO: 13434 - RNA, 20 nt, Artificial Sequence
  ELANE RNA Guide
cuggagacucacgaugucgu

SEQ ID NO: 13435 - RNA, 20 nt, Artificial Sequence
  ELANE RNA Guide
gacaucgugagucuccaggu

SEQ ID NO: 13436 - RNA, 20 nt, Artificial Sequence
  ELANE RNA Guide
gacucacgaugucguugagc

SEQ ID NO: 13437 - RNA, 20 nt, Artificial Sequence
  ELANE RNA Guide
gagacucacgaugucguuga

SEQ ID NO: 13438 - RNA, 20 nt, Artificial Sequence
  ELANE RNA Guide
gagucuccaggugccgccgg

SEQ ID NO: 13439 - RNA, 20 nt, Artificial Sequence
  ELANE RNA Guide
gcaccuggagacucacgaug

SEQ ID NO: 13440 - RNA, 20 nt, Artificial Sequence
  ELANE RNA Guide
gcccggcggcaccuggagac

SEQ ID NO: 13441 - RNA, 20 nt, Artificial Sequence
  ELANE RNA Guide
gcggcaccuggagacucacg

SEQ ID NO: 13442 - RNA, 20 nt, Artificial Sequence
  ELANE RNA Guide
gcucaacgacaucgugaguc

SEQ ID NO: 13443 - RNA, 20 nt, Artificial Sequence
  ELANE RNA Guide
ggagacucacgaugucguug

SEQ ID NO: 13444 - RNA, 20 nt, Artificial Sequence
  ELANE RNA Guide
ggcaccuggagacucacgau

SEQ ID NO: 13445 - RNA, 20 nt, Artificial Sequence
  ELANE RNA Guide
ggcggcaccuggagacucac

SEQ ID NO: 13446 - RNA, 20 nt, Artificial Sequence
  ELANE RNA Guide
gugagucuccaggugccgcc

SEQ ID NO: 13447 - RNA, 20 nt, Artificial Sequence
  ELANE RNA Guide
ucaacgacaucgugagucuc

SEQ ID NO: 13448 - RNA, 20 nt, Artificial Sequence
  ELANE RNA Guide
ucgugagucuccaggugccg

SEQ ID NO: 13449 - RNA, 20 nt, Artificial Sequence
  ELANE RNA Guide
ugagucuccaggugccgccg

SEQ ID NO: 13450 - RNA, 20 nt, Artificial Sequence
  ELANE RNA Guide
ugcucaacgacaucgugagu

SEQ ID NO: 13451 - RNA, 20 nt, Artificial Sequence
  ELANE RNA Guide
uggagacucacgaugucguu

SEQ ID NO: 13452 - RNA, 20 nt, Artificial Sequence
  ELANE RNA Guide
uugcucaacgacaucgugag

SEQ ID NO: 13453 - RNA, 21 nt, Artificial Sequence
  ELANE RNA Guide
aacgacaucgugagucuccag

SEQ ID NO: 13454 - RNA, 21 nt, Artificial Sequence
  ELANE RNA Guide
acaucgugagucuccaggugc

SEQ ID NO: 13455 - RNA, 21 nt, Artificial Sequence
  ELANE RNA Guide
accuggagacucacgaugucg

SEQ ID NO: 13456 - RNA, 21 nt, Artificial Sequence
  ELANE RNA Guide
acgacaucgugagucuccagg

SEQ ID NO: 13457 - RNA, 21 nt, Artificial Sequence
  ELANE RNA Guide
acucacgaugucguugagcaa

SEQ ID NO: 13458 - RNA, 21 nt, Artificial Sequence
  ELANE RNA Guide
agacucacgaugucguugagc

SEQ ID NO: 13459 - RNA, 21 nt, Artificial Sequence
  ELANE RNA Guide
agucuccaggugccgccgggc

SEQ ID NO: 13460 - RNA, 21 nt, Artificial Sequence
  ELANE RNA Guide
aucgugagucuccaggugccg

SEQ ID NO: 13461 - RNA, 21 nt, Artificial Sequence
  ELANE RNA Guide
caacgacaucgugagucucca

SEQ ID NO: 13462 - RNA, 21 nt, Artificial Sequence
  ELANE RNA Guide
caccuggagacucacgauguc

SEQ ID NO: 13463 - RNA, 21 nt, Artificial Sequence
  ELANE RNA Guide
caucgugagucuccaggugcc

SEQ ID NO: 13464 - RNA, 21 nt, Artificial Sequence
  ELANE RNA Guide
cccggcggcaccuggagacuc

SEQ ID NO: 13465 - RNA, 21 nt, Artificial Sequence
  ELANE RNA Guide
ccggcggcaccuggagacuca

SEQ ID NO: 13466 - RNA, 21 nt, Artificial Sequence
  ELANE RNA Guide
ccuggagacucacgaugucgu

SEQ ID NO: 13467 - RNA, 21 nt, Artificial Sequence
  ELANE RNA Guide
cgacaucgugagucuccaggu

SEQ ID NO: 13468 - RNA, 21 nt, Artificial Sequence
  ELANE RNA Guide
cggcaccuggagacucacgau

SEQ ID NO: 13469 - RNA, 21 nt, Artificial Sequence
  ELANE RNA Guide
cggcggcaccuggagacucac

SEQ ID NO: 13470 - RNA, 21 nt, Artificial Sequence
  ELANE RNA Guide
cgugagucuccaggugccgcc

SEQ ID NO: 13471 - RNA, 21 nt, Artificial Sequence
  ELANE RNA Guide
cucaacgacaucgugagucuc

SEQ ID NO: 13472 - RNA, 21 nt, Artificial Sequence
  ELANE RNA Guide
cuggagacucacgaugucguu

SEQ ID NO: 13473 - RNA, 21 nt, Artificial Sequence
  ELANE RNA Guide
cuugcucaacgacaucgugag

SEQ ID NO: 13474 - RNA, 21 nt, Artificial Sequence
  ELANE RNA Guide
gacaucgugagucuccaggug

SEQ ID NO: 13475 - RNA, 21 nt, Artificial Sequence
  ELANE RNA Guide
gacucacgaugucguugagca

SEQ ID NO: 13476 - RNA, 21 nt, Artificial Sequence
  ELANE RNA Guide
gagacucacgaugucguugag

SEQ ID NO: 13477 - RNA, 21 nt, Artificial Sequence
  ELANE RNA Guide
gagucuccaggugccgccggg

SEQ ID NO: 13478 - RNA, 21 nt, Artificial Sequence
  ELANE RNA Guide
gcaccuggagacucacgaugu

SEQ ID NO: 13479 - RNA, 21 nt, Artificial Sequence
  ELANE RNA Guide
gcccggcggcaccuggagacu

SEQ ID NO: 13480 - RNA, 21 nt, Artificial Sequence
  ELANE RNA Guide
gcggcaccuggagacucacga

SEQ ID NO: 13481 - RNA, 21 nt, Artificial Sequence
  ELANE RNA Guide
gcucaacgacaucgugagucu

SEQ ID NO: 13482 - RNA, 21 nt, Artificial Sequence
  ELANE RNA Guide
ggagacucacgaugucguuga

SEQ ID NO: 13483 - RNA, 21 nt, Artificial Sequence
  ELANE RNA Guide
ggcaccuggagacucacgaug

SEQ ID NO: 13484 - RNA, 21 nt, Artificial Sequence
  ELANE RNA Guide
ggcggcaccuggagacucacg

SEQ ID NO: 13485 - RNA, 21 nt, Artificial Sequence
  ELANE RNA Guide
gugagucuccaggugccgccg

SEQ ID NO: 13486 - RNA, 21 nt, Artificial Sequence
  ELANE RNA Guide
ucaacgacaucgugagucucc

SEQ ID NO: 13487 - RNA, 21 nt, Artificial Sequence
  ELANE RNA Guide
ucgugagucuccaggugccgc

SEQ ID NO: 13488 - RNA, 21 nt, Artificial Sequence
  ELANE RNA Guide
ugagucuccaggugccgccgg

SEQ ID NO: 13489 - RNA, 21 nt, Artificial Sequence
  ELANE RNA Guide
ugcucaacgacaucgugaguc

SEQ ID NO: 13490 - RNA, 21 nt, Artificial Sequence
  ELANE RNA Guide
uggagacucacgaugucguug

SEQ ID NO: 13491 - RNA, 21 nt, Artificial Sequence
  ELANE RNA Guide
uugcucaacgacaucgugagu

SEQ ID NO: 13492 - RNA, 22 nt, Artificial Sequence
  ELANE RNA Guide
aacgacaucgugagucuccagg

SEQ ID NO: 13493 - RNA, 22 nt, Artificial Sequence
  ELANE RNA Guide
acaucgugagucuccaggugcc

SEQ ID NO: 13494 - RNA, 22 nt, Artificial Sequence
  ELANE RNA Guide
accuggagacucacgaugucgu

SEQ ID NO: 13495 - RNA, 22 nt, Artificial Sequence
  ELANE RNA Guide
acgacaucgugagucuccaggu

SEQ ID NO: 13496 - RNA, 22 nt, Artificial Sequence
  ELANE RNA Guide
acucacgaugucguugagcaag

SEQ ID NO: 13497 - RNA, 22 nt, Artificial Sequence
  ELANE RNA Guide
acuugcucaacgacaucgugag

SEQ ID NO: 13498 - RNA, 22 nt, Artificial Sequence
  ELANE RNA Guide
agacucacgaugucguugagca

SEQ ID NO: 13499 - RNA, 22 nt, Artificial Sequence
  ELANE RNA Guide
agucuccaggugccgccgggcg

SEQ ID NO: 13500 - RNA, 22 nt, Artificial Sequence
  ELANE RNA Guide
aucgugagucuccaggugccgc

SEQ ID NO: 13501 - RNA, 22 nt, Artificial Sequence
  ELANE RNA Guide
caacgacaucgugagucuccag

SEQ ID NO: 13502 - RNA, 22 nt, Artificial Sequence
  ELANE RNA Guide
caccuggagacucacgaugucg

SEQ ID NO: 13503 - RNA, 22 nt, Artificial Sequence
  ELANE RNA Guide
caucgugagucuccaggugccg

SEQ ID NO: 13504 - RNA, 22 nt, Artificial Sequence
  ELANE RNA Guide
cccggcggcaccuggagacuca

SEQ ID NO: 13505 - RNA, 22 nt, Artificial Sequence
  ELANE RNA Guide
ccggcggcaccuggagacucac

SEQ ID NO: 13506 - RNA, 22 nt, Artificial Sequence
  ELANE RNA Guide
ccuggagacucacgaugucguu

SEQ ID NO: 13507 - RNA, 22 nt, Artificial Sequence
  ELANE RNA Guide
cgacaucgugagucuccaggug

SEQ ID NO: 13508 - RNA, 22 nt, Artificial Sequence
  ELANE RNA Guide
cgcccggcggcaccuggagacu

SEQ ID NO: 13509 - RNA, 22 nt, Artificial Sequence
  ELANE RNA Guide
cggcaccuggagacucacgaug

SEQ ID NO: 13510 - RNA, 22 nt, Artificial Sequence
  ELANE RNA Guide
cggcggcaccuggagacucacg

SEQ ID NO: 13511 - RNA, 22 nt, Artificial Sequence
  ELANE RNA Guide
cgugagucuccaggugccgccg

SEQ ID NO: 13512 - RNA, 22 nt, Artificial Sequence
  ELANE RNA Guide
cucaacgacaucgugagucucc

SEQ ID NO: 13513 - RNA, 22 nt, Artificial Sequence
  ELANE RNA Guide
cuggagacucacgaugucguug

SEQ ID NO: 13514 - RNA, 22 nt, Artificial Sequence
  ELANE RNA Guide
cuugcucaacgacaucgugagu

SEQ ID NO: 13515 - RNA, 22 nt, Artificial Sequence
  ELANE RNA Guide
gacaucgugagucuccaggugc

SEQ ID NO: 13516 - RNA, 22 nt, Artificial Sequence
  ELANE RNA Guide
gacucacgaugucguugagcaa

SEQ ID NO: 13517 - RNA, 22 nt, Artificial Sequence
  ELANE RNA Guide
gagacucacgaugucguugagc

SEQ ID NO: 13518 - RNA, 22 nt, Artificial Sequence
  ELANE RNA Guide
gagucuccaggugccgccgggc

SEQ ID NO: 13519 - RNA, 22 nt, Artificial Sequence
  ELANE RNA Guide
gcaccuggagacucacgauguc

SEQ ID NO: 13520 - RNA, 22 nt, Artificial Sequence
  ELANE RNA Guide
gcccggcggcaccuggagacuc

SEQ ID NO: 13521 - RNA, 22 nt, Artificial Sequence
  ELANE RNA Guide
gcggcaccuggagacucacgau

SEQ ID NO: 13522 - RNA, 22 nt, Artificial Sequence
  ELANE RNA Guide
gcucaacgacaucgugagucuc

SEQ ID NO: 13523 - RNA, 22 nt, Artificial Sequence
  ELANE RNA Guide
ggagacucacgaugucguugag

SEQ ID NO: 13524 - RNA, 22 nt, Artificial Sequence
  ELANE RNA Guide
ggcaccuggagacucacgaugu

SEQ ID NO: 13525 - RNA, 22 nt, Artificial Sequence
  ELANE RNA Guide
ggcggcaccuggagacucacga

SEQ ID NO: 13526 - RNA, 22 nt, Artificial Sequence
  ELANE RNA Guide
gugagucuccaggugccgccgg

SEQ ID NO: 13527 - RNA, 22 nt, Artificial Sequence
  ELANE RNA Guide
ucaacgacaucgugagucucca

SEQ ID NO: 13528 - RNA, 22 nt, Artificial Sequence
  ELANE RNA Guide
ucgugagucuccaggugccgcc

SEQ ID NO: 13529 - RNA, 22 nt, Artificial Sequence
  ELANE RNA Guide
ugagucuccaggugccgccggg

SEQ ID NO: 13530 - RNA, 22 nt, Artificial Sequence
  ELANE RNA Guide
ugcucaacgacaucgugagucu

SEQ ID NO: 13531 - RNA, 22 nt, Artificial Sequence
  ELANE RNA Guide
uggagacucacgaugucguuga

SEQ ID NO: 13532 - RNA, 22 nt, Artificial Sequence
  ELANE RNA Guide
uugcucaacgacaucgugaguc

SEQ ID NO: 13533 - RNA, 20 nt, Artificial Sequence
  ELANE RNA Guide
aaaaucacgaugucguugag

SEQ ID NO: 13534 - RNA, 20 nt, Artificial Sequence
  ELANE RNA Guide
aacgacaucgugauuuucca

SEQ ID NO: 13535 - RNA, 20 nt, Artificial Sequence
  ELANE RNA Guide
acaucgugauuuuccaggug

SEQ ID NO: 13536 - RNA, 20 nt, Artificial Sequence
  ELANE RNA Guide
accuggaaaaucacgauguc

SEQ ID NO: 13537 - RNA, 20 nt, Artificial Sequence
  ELANE RNA Guide
acgacaucgugauuuuccag

SEQ ID NO: 13538 - RNA, 20 nt, Artificial Sequence
  ELANE RNA Guide
aucgugauuuuccaggugcc

SEQ ID NO: 13539 - RNA, 20 nt, Artificial Sequence
  ELANE RNA Guide
auuuuccaggugccgccggg

SEQ ID NO: 13540 - RNA, 20 nt, Artificial Sequence
  ELANE RNA Guide
caacgacaucgugauuuucc

SEQ ID NO: 13541 - RNA, 20 nt, Artificial Sequence
  ELANE RNA Guide
caccuggaaaaucacgaugu

SEQ ID NO: 13542 - RNA, 20 nt, Artificial Sequence
  ELANE RNA Guide
caucgugauuuuccaggugc

SEQ ID NO: 13543 - RNA, 20 nt, Artificial Sequence
  ELANE RNA Guide
cccggcggcaccuggaaaau

SEQ ID NO: 13544 - RNA, 20 nt, Artificial Sequence
  ELANE RNA Guide
ccgcccggcggcaccuggaa

SEQ ID NO: 13545 - RNA, 20 nt, Artificial Sequence
  ELANE RNA Guide
ccggcggcaccuggaaaauc

SEQ ID NO: 13546 - RNA, 20 nt, Artificial Sequence
  ELANE RNA Guide
ccuggaaaaucacgaugucg

SEQ ID NO: 13547 - RNA, 20 nt, Artificial Sequence
  ELANE RNA Guide
cgacaucgugauuuuccagg

SEQ ID NO: 13548 - RNA, 20 nt, Artificial Sequence
  ELANE RNA Guide
cgcccggcggcaccuggaaa

SEQ ID NO: 13549 - RNA, 20 nt, Artificial Sequence
  ELANE RNA Guide
cggcaccuggaaaaucacga

SEQ ID NO: 13550 - RNA, 20 nt, Artificial Sequence
  ELANE RNA Guide
cggcggcaccuggaaaauca

SEQ ID NO: 13551 - RNA, 20 nt, Artificial Sequence
  ELANE RNA Guide
cgugauuuuccaggugccgc

SEQ ID NO: 13552 - RNA, 20 nt, Artificial Sequence
  ELANE RNA Guide
cucaacgacaucgugauuuu

SEQ ID NO: 13553 - RNA, 20 nt, Artificial Sequence
  ELANE RNA Guide
cuggaaaaucacgaugucgu

SEQ ID NO: 13554 - RNA, 20 nt, Artificial Sequence
  ELANE RNA Guide
gaaaaucacgaugucguuga

SEQ ID NO: 13555 - RNA, 20 nt, Artificial Sequence
  ELANE RNA Guide
gacaucgugauuuuccaggu

SEQ ID NO: 13556 - RNA, 20 nt, Artificial Sequence
  ELANE RNA Guide
gauuuuccaggugccgccgg

SEQ ID NO: 13557 - RNA, 20 nt, Artificial Sequence
  ELANE RNA Guide
gcaccuggaaaaucacgaug

SEQ ID NO: 13558 - RNA, 20 nt, Artificial Sequence
  ELANE RNA Guide
gcccggcggcaccuggaaaa

SEQ ID NO: 13559 - RNA, 20 nt, Artificial Sequence
  ELANE RNA Guide
gcggcaccuggaaaaucacg

SEQ ID NO: 13560 - RNA, 20 nt, Artificial Sequence
  ELANE RNA Guide
gcucaacgacaucgugauuu

SEQ ID NO: 13561 - RNA, 20 nt, Artificial Sequence
  ELANE RNA Guide
ggaaaaucacgaugucguug

SEQ ID NO: 13562 - RNA, 20 nt, Artificial Sequence
  ELANE RNA Guide
ggcaccuggaaaaucacgau

SEQ ID NO: 13563 - RNA, 20 nt, Artificial Sequence
  ELANE RNA Guide
ggcggcaccuggaaaaucac

SEQ ID NO: 13564 - RNA, 20 nt, Artificial Sequence
  ELANE RNA Guide
gugauuuuccaggugccgcc

SEQ ID NO: 13565 - RNA, 20 nt, Artificial Sequence
  ELANE RNA Guide
ucaacgacaucgugauuuuc

SEQ ID NO: 13566 - RNA, 20 nt, Artificial Sequence
  ELANE RNA Guide
ucgugauuuuccaggugccg

SEQ ID NO: 13567 - RNA, 20 nt, Artificial Sequence
  ELANE RNA Guide
ugauuuuccaggugccgccg

SEQ ID NO: 13568 - RNA, 20 nt, Artificial Sequence
  ELANE RNA Guide
ugcucaacgacaucgugauu

SEQ ID NO: 13569 - RNA, 20 nt, Artificial Sequence
  ELANE RNA Guide
uggaaaaucacgaugucguu

SEQ ID NO: 13570 - RNA, 20 nt, Artificial Sequence
  ELANE RNA Guide
uugcucaacgacaucgugau

SEQ ID NO: 13571 - RNA, 20 nt, Artificial Sequence
  ELANE RNA Guide
uuuccaggugccgccgggcg

SEQ ID NO: 13572 - RNA, 20 nt, Artificial Sequence
  ELANE RNA Guide
uuuuccaggugccgccgggc

SEQ ID NO: 13573 - RNA, 21 nt, Artificial Sequence
  ELANE RNA Guide
aaaaucacgaugucguugagc

SEQ ID NO: 13574 - RNA, 21 nt, Artificial Sequence
  ELANE RNA Guide
aacgacaucgugauuuuccag

SEQ ID NO: 13575 - RNA, 21 nt, Artificial Sequence
  ELANE RNA Guide
acaucgugauuuuccaggugc

SEQ ID NO: 13576 - RNA, 21 nt, Artificial Sequence
  ELANE RNA Guide
accuggaaaaucacgaugucg

SEQ ID NO: 13577 - RNA, 21 nt, Artificial Sequence
  ELANE RNA Guide
acgacaucgugauuuuccagg

SEQ ID NO: 13578 - RNA, 21 nt, Artificial Sequence
  ELANE RNA Guide
aucgugauuuuccaggugccg

SEQ ID NO: 13579 - RNA, 21 nt, Artificial Sequence
  ELANE RNA Guide
auuuuccaggugccgccgggc

SEQ ID NO: 13580 - RNA, 21 nt, Artificial Sequence
  ELANE RNA Guide
caacgacaucgugauuuucca

SEQ ID NO: 13581 - RNA, 21 nt, Artificial Sequence
  ELANE RNA Guide
caccuggaaaaucacgauguc

SEQ ID NO: 13582 - RNA, 21 nt, Artificial Sequence
  ELANE RNA Guide
caucgugauuuuccaggugcc

SEQ ID NO: 13583 - RNA, 21 nt, Artificial Sequence
  ELANE RNA Guide
cccggcggcaccuggaaaauc

SEQ ID NO: 13584 - RNA, 21 nt, Artificial Sequence
  ELANE RNA Guide
ccgcccggcggcaccuggaaa

SEQ ID NO: 13585 - RNA, 21 nt, Artificial Sequence
  ELANE RNA Guide
ccggcggcaccuggaaaauca

SEQ ID NO: 13586 - RNA, 21 nt, Artificial Sequence
  ELANE RNA Guide
ccuggaaaaucacgaugucgu

SEQ ID NO: 13587 - RNA, 21 nt, Artificial Sequence
  ELANE RNA Guide
cgacaucgugauuuuccaggu

SEQ ID NO: 13588 - RNA, 21 nt, Artificial Sequence
  ELANE RNA Guide
cgcccggcggcaccuggaaaa

SEQ ID NO: 13589 - RNA, 21 nt, Artificial Sequence
  ELANE RNA Guide
cggcaccuggaaaaucacgau

SEQ ID NO: 13590 - RNA, 21 nt, Artificial Sequence
  ELANE RNA Guide
cggcggcaccuggaaaaucac

SEQ ID NO: 13591 - RNA, 21 nt, Artificial Sequence
  ELANE RNA Guide
cgugauuuuccaggugccgcc

SEQ ID NO: 13592 - RNA, 21 nt, Artificial Sequence
  ELANE RNA Guide
cucaacgacaucgugauuuuc

SEQ ID NO: 13593 - RNA, 21 nt, Artificial Sequence
  ELANE RNA Guide
cuggaaaaucacgaugucguu

SEQ ID NO: 13594 - RNA, 21 nt, Artificial Sequence
  ELANE RNA Guide
cuugcucaacgacaucgugau

SEQ ID NO: 13595 - RNA, 21 nt, Artificial Sequence
  ELANE RNA Guide
gaaaaucacgaugucguugag

SEQ ID NO: 13596 - RNA, 21 nt, Artificial Sequence
  ELANE RNA Guide
gacaucgugauuuuccaggug

SEQ ID NO: 13597 - RNA, 21 nt, Artificial Sequence
  ELANE RNA Guide
gauuuuccaggugccgccggg

SEQ ID NO: 13598 - RNA, 21 nt, Artificial Sequence
  ELANE RNA Guide
gcaccuggaaaaucacgaugu

SEQ ID NO: 13599 - RNA, 21 nt, Artificial Sequence
  ELANE RNA Guide
gcccggcggcaccuggaaaau

SEQ ID NO: 13600 - RNA, 21 nt, Artificial Sequence
  ELANE RNA Guide
gcggcaccuggaaaaucacga

SEQ ID NO: 13601 - RNA, 21 nt, Artificial Sequence
  ELANE RNA Guide
gcucaacgacaucgugauuuu

SEQ ID NO: 13602 - RNA, 21 nt, Artificial Sequence
  ELANE RNA Guide
ggaaaaucacgaugucguuga

SEQ ID NO: 13603 - RNA, 21 nt, Artificial Sequence
  ELANE RNA Guide
ggcaccuggaaaaucacgaug

SEQ ID NO: 13604 - RNA, 21 nt, Artificial Sequence
  ELANE RNA Guide
ggcggcaccuggaaaaucacg

SEQ ID NO: 13605 - RNA, 21 nt, Artificial Sequence
  ELANE RNA Guide
gugauuuuccaggugccgccg

SEQ ID NO: 13606 - RNA, 21 nt, Artificial Sequence
  ELANE RNA Guide
ucaacgacaucgugauuuucc

SEQ ID NO: 13607 - RNA, 21 nt, Artificial Sequence
  ELANE RNA Guide
ucgugauuuuccaggugccgc

SEQ ID NO: 13608 - RNA, 21 nt, Artificial Sequence
  ELANE RNA Guide
ugauuuuccaggugccgccgg

SEQ ID NO: 13609 - RNA, 21 nt, Artificial Sequence
  ELANE RNA Guide
ugcucaacgacaucgugauuu

SEQ ID NO: 13610 - RNA, 21 nt, Artificial Sequence
  ELANE RNA Guide
uggaaaaucacgaugucguug

SEQ ID NO: 13611 - RNA, 21 nt, Artificial Sequence
  ELANE RNA Guide
uugcucaacgacaucgugauu

SEQ ID NO: 13612 - RNA, 21 nt, Artificial Sequence
  ELANE RNA Guide
uuuccaggugccgccgggcgg

SEQ ID NO: 13613 - RNA, 21 nt, Artificial Sequence
  ELANE RNA Guide
uuuuccaggugccgccgggcg

SEQ ID NO: 13614 - RNA, 22 nt, Artificial Sequence
  ELANE RNA Guide
aaaaucacgaugucguugagca

SEQ ID NO: 13615 - RNA, 22 nt, Artificial Sequence
  ELANE RNA Guide
aacgacaucgugauuuuccagg

SEQ ID NO: 13616 - RNA, 22 nt, Artificial Sequence
  ELANE RNA Guide
acaucgugauuuuccaggugcc

SEQ ID NO: 13617 - RNA, 22 nt, Artificial Sequence
  ELANE RNA Guide
accuggaaaaucacgaugucgu

SEQ ID NO: 13618 - RNA, 22 nt, Artificial Sequence
  ELANE RNA Guide
acgacaucgugauuuuccaggu

SEQ ID NO: 13619 - RNA, 22 nt, Artificial Sequence
  ELANE RNA Guide
acuugcucaacgacaucgugau

SEQ ID NO: 13620 - RNA, 22 nt, Artificial Sequence
  ELANE RNA Guide
aucgugauuuuccaggugccgc

SEQ ID NO: 13621 - RNA, 22 nt, Artificial Sequence
  ELANE RNA Guide
auuuuccaggugccgccgggcg

SEQ ID NO: 13622 - RNA, 22 nt, Artificial Sequence
  ELANE RNA Guide
caacgacaucgugauuuuccag

SEQ ID NO: 13623 - RNA, 22 nt, Artificial Sequence
  ELANE RNA Guide
caccuggaaaaucacgaugucg

SEQ ID NO: 13624 - RNA, 22 nt, Artificial Sequence
  ELANE RNA Guide
caucgugauuuuccaggugccg

SEQ ID NO: 13625 - RNA, 22 nt, Artificial Sequence
  ELANE RNA Guide
cccgcccggcggcaccuggaaa

SEQ ID NO: 13626 - RNA, 22 nt, Artificial Sequence
  ELANE RNA Guide
cccggcggcaccuggaaaauca

SEQ ID NO: 13627 - RNA, 22 nt, Artificial Sequence
  ELANE RNA Guide
ccgcccggcggcaccuggaaaa

SEQ ID NO: 13628 - RNA, 22 nt, Artificial Sequence
  ELANE RNA Guide
ccggcggcaccuggaaaaucac

SEQ ID NO: 13629 - RNA, 22 nt, Artificial Sequence
  ELANE RNA Guide
ccuggaaaaucacgaugucguu

SEQ ID NO: 13630 - RNA, 22 nt, Artificial Sequence
  ELANE RNA Guide
cgacaucgugauuuuccaggug

SEQ ID NO: 13631 - RNA, 22 nt, Artificial Sequence
  ELANE RNA Guide
cgcccggcggcaccuggaaaau

SEQ ID NO: 13632 - RNA, 22 nt, Artificial Sequence
  ELANE RNA Guide
cggcaccuggaaaaucacgaug

SEQ ID NO: 13633 - RNA, 22 nt, Artificial Sequence
  ELANE RNA Guide
cggcggcaccuggaaaaucacg

SEQ ID NO: 13634 - RNA, 22 nt, Artificial Sequence
  ELANE RNA Guide
cgugauuuuccaggugccgccg

SEQ ID NO: 13635 - RNA, 22 nt, Artificial Sequence
  ELANE RNA Guide
cucaacgacaucgugauuuucc

SEQ ID NO: 13636 - RNA, 22 nt, Artificial Sequence
  ELANE RNA Guide
cuggaaaaucacgaugucguug

SEQ ID NO: 13637 - RNA, 22 nt, Artificial Sequence
  ELANE RNA Guide
cuugcucaacgacaucgugauu

SEQ ID NO: 13638 - RNA, 22 nt, Artificial Sequence
  ELANE RNA Guide
gaaaaucacgaugucguugagc

SEQ ID NO: 13639 - RNA, 22 nt, Artificial Sequence
  ELANE RNA Guide
gacaucgugauuuuccaggugc

SEQ ID NO: 13640 - RNA, 22 nt, Artificial Sequence
  ELANE RNA Guide
gauuuuccaggugccgccgggc

SEQ ID NO: 13641 - RNA, 22 nt, Artificial Sequence
  ELANE RNA Guide
gcaccuggaaaaucacgauguc

SEQ ID NO: 13642 - RNA, 22 nt, Artificial Sequence
  ELANE RNA Guide
gcccggcggcaccuggaaaauc

SEQ ID NO: 13643 - RNA, 22 nt, Artificial Sequence
  ELANE RNA Guide
gcggcaccuggaaaaucacgau

SEQ ID NO: 13644 - RNA, 22 nt, Artificial Sequence
  ELANE RNA Guide
gcucaacgacaucgugauuuuc

SEQ ID NO: 13645 - RNA, 22 nt, Artificial Sequence
  ELANE RNA Guide
ggaaaaucacgaugucguugag

SEQ ID NO: 13646 - RNA, 22 nt, Artificial Sequence
  ELANE RNA Guide
ggcaccuggaaaaucacgaugu

SEQ ID NO: 13647 - RNA, 22 nt, Artificial Sequence
  ELANE RNA Guide
ggcggcaccuggaaaaucacga

SEQ ID NO: 13648 - RNA, 22 nt, Artificial Sequence
  ELANE RNA Guide
gugauuuuccaggugccgccgg

SEQ ID NO: 13649 - RNA, 22 nt, Artificial Sequence
  ELANE RNA Guide
ucaacgacaucgugauuuucca

SEQ ID NO: 13650 - RNA, 22 nt, Artificial Sequence
  ELANE RNA Guide
ucgugauuuuccaggugccgcc

SEQ ID NO: 13651 - RNA, 22 nt, Artificial Sequence
  ELANE RNA Guide
ugauuuuccaggugccgccggg

SEQ ID NO: 13652 - RNA, 22 nt, Artificial Sequence
  ELANE RNA Guide
ugcucaacgacaucgugauuuu

SEQ ID NO: 13653 - RNA, 22 nt, Artificial Sequence
  ELANE RNA Guide
uggaaaaucacgaugucguuga

SEQ ID NO: 13654 - RNA, 22 nt, Artificial Sequence
  ELANE RNA Guide
uugcucaacgacaucgugauuu

SEQ ID NO: 13655 - RNA, 22 nt, Artificial Sequence
  ELANE RNA Guide
uuuccaggugccgccgggcggg

SEQ ID NO: 13656 - RNA, 22 nt, Artificial Sequence
  ELANE RNA Guide
uuuuccaggugccgccgggcgg

SEQ ID NO: 13657 - RNA, 20 nt, Artificial Sequence
  ELANE RNA Guide
aacgacaucgugauucacca

SEQ ID NO: 13658 - RNA, 20 nt, Artificial Sequence
  ELANE RNA Guide
acaucgugauucaccaggug

SEQ ID NO: 13659 - RNA, 20 nt, Artificial Sequence
  ELANE RNA Guide
accuggugaaucacgauguc

SEQ ID NO: 13660 - RNA, 20 nt, Artificial Sequence
  ELANE RNA Guide
acgacaucgugauucaccag

SEQ ID NO: 13661 - RNA, 20 nt, Artificial Sequence
  ELANE RNA Guide
aucgugauucaccaggugcc

SEQ ID NO: 13662 - RNA, 20 nt, Artificial Sequence
  ELANE RNA Guide
auucaccaggugccgccggg

SEQ ID NO: 13663 - RNA, 20 nt, Artificial Sequence
  ELANE RNA Guide
caacgacaucgugauucacc

SEQ ID NO: 13664 - RNA, 20 nt, Artificial Sequence
  ELANE RNA Guide
caccuggugaaucacgaugu

SEQ ID NO: 13665 - RNA, 20 nt, Artificial Sequence
  ELANE RNA Guide
caucgugauucaccaggugc

SEQ ID NO: 13666 - RNA, 20 nt, Artificial Sequence
  ELANE RNA Guide
cccggcggcaccuggugaau

SEQ ID NO: 13667 - RNA, 20 nt, Artificial Sequence
  ELANE RNA Guide
ccggcggcaccuggugaauc

SEQ ID NO: 13668 - RNA, 20 nt, Artificial Sequence
  ELANE RNA Guide
ccuggugaaucacgaugucg

SEQ ID NO: 13669 - RNA, 20 nt, Artificial Sequence
  ELANE RNA Guide
cgacaucgugauucaccagg

SEQ ID NO: 13670 - RNA, 20 nt, Artificial Sequence
  ELANE RNA Guide
cgcccggcggcaccugguga

SEQ ID NO: 13671 - RNA, 20 nt, Artificial Sequence
  ELANE RNA Guide
cggcaccuggugaaucacga

SEQ ID NO: 13672 - RNA, 20 nt, Artificial Sequence
  ELANE RNA Guide
cggcggcaccuggugaauca

SEQ ID NO: 13673 - RNA, 20 nt, Artificial Sequence
  ELANE RNA Guide
cgugauucaccaggugccgc

SEQ ID NO: 13674 - RNA, 20 nt, Artificial Sequence
  ELANE RNA Guide
cucaacgacaucgugauuca

SEQ ID NO: 13675 - RNA, 20 nt, Artificial Sequence
  ELANE RNA Guide
cuggugaaucacgaugucgu

SEQ ID NO: 13676 - RNA, 20 nt, Artificial Sequence
  ELANE RNA Guide
gacaucgugauucaccaggu

SEQ ID NO: 13677 - RNA, 20 nt, Artificial Sequence
  ELANE RNA Guide
gauucaccaggugccgccgg

SEQ ID NO: 13678 - RNA, 20 nt, Artificial Sequence
  ELANE RNA Guide
gcaccuggugaaucacgaug

SEQ ID NO: 13679 - RNA, 20 nt, Artificial Sequence
  ELANE RNA Guide
gcccggcggcaccuggugaa

SEQ ID NO: 13680 - RNA, 20 nt, Artificial Sequence
  ELANE RNA Guide
gcggcaccuggugaaucacg

SEQ ID NO: 13681 - RNA, 20 nt, Artificial Sequence
  ELANE RNA Guide
gcucaacgacaucgugauuc

SEQ ID NO: 13682 - RNA, 20 nt, Artificial Sequence
  ELANE RNA Guide
ggcaccuggugaaucacgau

SEQ ID NO: 13683 - RNA, 20 nt, Artificial Sequence
  ELANE RNA Guide
ggcggcaccuggugaaucac

SEQ ID NO: 13684 - RNA, 20 nt, Artificial Sequence
  ELANE RNA Guide
ggugaaucacgaugucguug

SEQ ID NO: 13685 - RNA, 20 nt, Artificial Sequence
  ELANE RNA Guide
gugaaucacgaugucguuga

SEQ ID NO: 13686 - RNA, 20 nt, Artificial Sequence
  ELANE RNA Guide
gugauucaccaggugccgcc

SEQ ID NO: 13687 - RNA, 20 nt, Artificial Sequence
  ELANE RNA Guide
ucaacgacaucgugauucac

SEQ ID NO: 13688 - RNA, 20 nt, Artificial Sequence
  ELANE RNA Guide
ucaccaggugccgccgggcg

SEQ ID NO: 13689 - RNA, 20 nt, Artificial Sequence
  ELANE RNA Guide
ucgugauucaccaggugccg

SEQ ID NO: 13690 - RNA, 20 nt, Artificial Sequence
  ELANE RNA Guide
ugauucaccaggugccgccg

SEQ ID NO: 13691 - RNA, 20 nt, Artificial Sequence
  ELANE RNA Guide
uggugaaucacgaugucguu

SEQ ID NO: 13692 - RNA, 20 nt, Artificial Sequence
  ELANE RNA Guide
uucaccaggugccgccgggc

SEQ ID NO: 13693 - RNA, 21 nt, Artificial Sequence
  ELANE RNA Guide
aacgacaucgugauucaccag

SEQ ID NO: 13694 - RNA, 21 nt, Artificial Sequence
  ELANE RNA Guide
acaucgugauucaccaggugc

SEQ ID NO: 13695 - RNA, 21 nt, Artificial Sequence
  ELANE RNA Guide
accuggugaaucacgaugucg

SEQ ID NO: 13696 - RNA, 21 nt, Artificial Sequence
  ELANE RNA Guide
acgacaucgugauucaccagg

SEQ ID NO: 13697 - RNA, 21 nt, Artificial Sequence
  ELANE RNA Guide
aucgugauucaccaggugccg

SEQ ID NO: 13698 - RNA, 21 nt, Artificial Sequence
  ELANE RNA Guide
auucaccaggugccgccgggc

SEQ ID NO: 13699 - RNA, 21 nt, Artificial Sequence
  ELANE RNA Guide
caacgacaucgugauucacca

SEQ ID NO: 13700 - RNA, 21 nt, Artificial Sequence
  ELANE RNA Guide
caccuggugaaucacgauguc

SEQ ID NO: 13701 - RNA, 21 nt, Artificial Sequence
  ELANE RNA Guide
caucgugauucaccaggugcc

SEQ ID NO: 13702 - RNA, 21 nt, Artificial Sequence
  ELANE RNA Guide
cccggcggcaccuggugaauc

SEQ ID NO: 13703 - RNA, 21 nt, Artificial Sequence
  ELANE RNA Guide
ccggcggcaccuggugaauca

SEQ ID NO: 13704 - RNA, 21 nt, Artificial Sequence
  ELANE RNA Guide
ccuggugaaucacgaugucgu

SEQ ID NO: 13705 - RNA, 21 nt, Artificial Sequence
  ELANE RNA Guide
cgacaucgugauucaccaggu

SEQ ID NO: 13706 - RNA, 21 nt, Artificial Sequence
  ELANE RNA Guide
cgcccggcggcaccuggugaa

SEQ ID NO: 13707 - RNA, 21 nt, Artificial Sequence
  ELANE RNA Guide
cggcaccuggugaaucacgau

SEQ ID NO: 13708 - RNA, 21 nt, Artificial Sequence
  ELANE RNA Guide
cggcggcaccuggugaaucac

SEQ ID NO: 13709 - RNA, 21 nt, Artificial Sequence
  ELANE RNA Guide
cgugauucaccaggugccgcc

SEQ ID NO: 13710 - RNA, 21 nt, Artificial Sequence
  ELANE RNA Guide
cucaacgacaucgugauucac

SEQ ID NO: 13711 - RNA, 21 nt, Artificial Sequence
  ELANE RNA Guide
cuggugaaucacgaugucguu

SEQ ID NO: 13712 - RNA, 21 nt, Artificial Sequence
  ELANE RNA Guide
gacaucgugauucaccaggug

SEQ ID NO: 13713 - RNA, 21 nt, Artificial Sequence
  ELANE RNA Guide
gauucaccaggugccgccggg

SEQ ID NO: 13714 - RNA, 21 nt, Artificial Sequence
  ELANE RNA Guide
gcaccuggugaaucacgaugu

SEQ ID NO: 13715 - RNA, 21 nt, Artificial Sequence
  ELANE RNA Guide
gcccggcggcaccuggugaau

SEQ ID NO: 13716 - RNA, 21 nt, Artificial Sequence
  ELANE RNA Guide
gcggcaccuggugaaucacga

SEQ ID NO: 13717 - RNA, 21 nt, Artificial Sequence
  ELANE RNA Guide
gcucaacgacaucgugauuca

SEQ ID NO: 13718 - RNA, 21 nt, Artificial Sequence
  ELANE RNA Guide
ggcaccuggugaaucacgaug

SEQ ID NO: 13719 - RNA, 21 nt, Artificial Sequence
  ELANE RNA Guide
ggcggcaccuggugaaucacg

SEQ ID NO: 13720 - RNA, 21 nt, Artificial Sequence
  ELANE RNA Guide
ggugaaucacgaugucguuga

SEQ ID NO: 13721 - RNA, 21 nt, Artificial Sequence
  ELANE RNA Guide
gugaaucacgaugucguugag

SEQ ID NO: 13722 - RNA, 21 nt, Artificial Sequence
  ELANE RNA Guide
gugauucaccaggugccgccg

SEQ ID NO: 13723 - RNA, 21 nt, Artificial Sequence
  ELANE RNA Guide
ucaacgacaucgugauucacc

SEQ ID NO: 13724 - RNA, 21 nt, Artificial Sequence
  ELANE RNA Guide
ucgugauucaccaggugccgc

SEQ ID NO: 13725 - RNA, 21 nt, Artificial Sequence
  ELANE RNA Guide
ugauucaccaggugccgccgg

SEQ ID NO: 13726 - RNA, 21 nt, Artificial Sequence
  ELANE RNA Guide
ugcucaacgacaucgugauuc

SEQ ID NO: 13727 - RNA, 21 nt, Artificial Sequence
  ELANE RNA Guide
uggugaaucacgaugucguug

SEQ ID NO: 13728 - RNA, 21 nt, Artificial Sequence
  ELANE RNA Guide
uucaccaggugccgccgggcg

SEQ ID NO: 13729 - RNA, 22 nt, Artificial Sequence
  ELANE RNA Guide
aacgacaucgugauucaccagg

SEQ ID NO: 13730 - RNA, 22 nt, Artificial Sequence
  ELANE RNA Guide
acaucgugauucaccaggugcc

SEQ ID NO: 13731 - RNA, 22 nt, Artificial Sequence
  ELANE RNA Guide
accuggugaaucacgaugucgu

SEQ ID NO: 13732 - RNA, 22 nt, Artificial Sequence
  ELANE RNA Guide
acgacaucgugauucaccaggu

SEQ ID NO: 13733 - RNA, 22 nt, Artificial Sequence
  ELANE RNA Guide
aucgugauucaccaggugccgc

SEQ ID NO: 13734 - RNA, 22 nt, Artificial Sequence
  ELANE RNA Guide
auucaccaggugccgccgggcg

SEQ ID NO: 13735 - RNA, 22 nt, Artificial Sequence
  ELANE RNA Guide
caacgacaucgugauucaccag

SEQ ID NO: 13736 - RNA, 22 nt, Artificial Sequence
  ELANE RNA Guide
caccuggugaaucacgaugucg

SEQ ID NO: 13737 - RNA, 22 nt, Artificial Sequence
  ELANE RNA Guide
caucgugauucaccaggugccg

SEQ ID NO: 13738 - RNA, 22 nt, Artificial Sequence
  ELANE RNA Guide
cccggcggcaccuggugaauca

SEQ ID NO: 13739 - RNA, 22 nt, Artificial Sequence
  ELANE RNA Guide
ccgcccggcggcaccuggugaa

SEQ ID NO: 13740 - RNA, 22 nt, Artificial Sequence
  ELANE RNA Guide
ccggcggcaccuggugaaucac

SEQ ID NO: 13741 - RNA, 22 nt, Artificial Sequence
  ELANE RNA Guide
ccuggugaaucacgaugucguu

SEQ ID NO: 13742 - RNA, 22 nt, Artificial Sequence
  ELANE RNA Guide
cgacaucgugauucaccaggug

SEQ ID NO: 13743 - RNA, 22 nt, Artificial Sequence
  ELANE RNA Guide
cgcccggcggcaccuggugaau

SEQ ID NO: 13744 - RNA, 22 nt, Artificial Sequence
  ELANE RNA Guide
cggcaccuggugaaucacgaug

SEQ ID NO: 13745 - RNA, 22 nt, Artificial Sequence
  ELANE RNA Guide
cggcggcaccuggugaaucacg

SEQ ID NO: 13746 - RNA, 22 nt, Artificial Sequence
  ELANE RNA Guide
cgugauucaccaggugccgccg

SEQ ID NO: 13747 - RNA, 22 nt, Artificial Sequence
  ELANE RNA Guide
cucaacgacaucgugauucacc

SEQ ID NO: 13748 - RNA, 22 nt, Artificial Sequence
  ELANE RNA Guide
cuggugaaucacgaugucguug

SEQ ID NO: 13749 - RNA, 22 nt, Artificial Sequence
  ELANE RNA Guide
gacaucgugauucaccaggugc

SEQ ID NO: 13750 - RNA, 22 nt, Artificial Sequence
  ELANE RNA Guide
gauucaccaggugccgccgggc

SEQ ID NO: 13751 - RNA, 22 nt, Artificial Sequence
  ELANE RNA Guide
gcaccuggugaaucacgauguc

SEQ ID NO: 13752 - RNA, 22 nt, Artificial Sequence
  ELANE RNA Guide
gcccggcggcaccuggugaauc

SEQ ID NO: 13753 - RNA, 22 nt, Artificial Sequence
  ELANE RNA Guide
gcggcaccuggugaaucacgau

SEQ ID NO: 13754 - RNA, 22 nt, Artificial Sequence
  ELANE RNA Guide
gcucaacgacaucgugauucac

SEQ ID NO: 13755 - RNA, 22 nt, Artificial Sequence
  ELANE RNA Guide
ggcaccuggugaaucacgaugu

SEQ ID NO: 13756 - RNA, 22 nt, Artificial Sequence
  ELANE RNA Guide
ggcggcaccuggugaaucacga

SEQ ID NO: 13757 - RNA, 22 nt, Artificial Sequence
  ELANE RNA Guide
ggugaaucacgaugucguugag

SEQ ID NO: 13758 - RNA, 22 nt, Artificial Sequence
  ELANE RNA Guide
gugaaucacgaugucguugagc

SEQ ID NO: 13759 - RNA, 22 nt, Artificial Sequence
  ELANE RNA Guide
gugauucaccaggugccgccgg

SEQ ID NO: 13760 - RNA, 22 nt, Artificial Sequence
  ELANE RNA Guide
ucaacgacaucgugauucacca

SEQ ID NO: 13761 - RNA, 22 nt, Artificial Sequence
  ELANE RNA Guide
ucgugauucaccaggugccgcc

SEQ ID NO: 13762 - RNA, 22 nt, Artificial Sequence
  ELANE RNA Guide
ugauucaccaggugccgccggg

SEQ ID NO: 13763 - RNA, 22 nt, Artificial Sequence
  ELANE RNA Guide
ugcucaacgacaucgugauuca

SEQ ID NO: 13764 - RNA, 22 nt, Artificial Sequence
  ELANE RNA Guide
uggugaaucacgaugucguuga

SEQ ID NO: 13765 - RNA, 22 nt, Artificial Sequence
  ELANE RNA Guide
uucaccaggugccgccgggcgg

SEQ ID NO: 13766 - RNA, 22 nt, Artificial Sequence
  ELANE RNA Guide
uugcucaacgacaucgugauuc

SEQ ID NO: 13767 - RNA, 20 nt, Artificial Sequence
  ELANE RNA Guide
aacgacaucgugauucccca

SEQ ID NO: 13768 - RNA, 20 nt, Artificial Sequence
  ELANE RNA Guide
acaucgugauuccccaggug

SEQ ID NO: 13769 - RNA, 20 nt, Artificial Sequence
  ELANE RNA Guide
accuggggaaucacgauguc

SEQ ID NO: 13770 - RNA, 20 nt, Artificial Sequence
  ELANE RNA Guide
acgacaucgugauuccccag

SEQ ID NO: 13771 - RNA, 20 nt, Artificial Sequence
  ELANE RNA Guide
aucgugauuccccaggugcc

SEQ ID NO: 13772 - RNA, 20 nt, Artificial Sequence
  ELANE RNA Guide
auuccccaggugccgccggg

SEQ ID NO: 13773 - RNA, 20 nt, Artificial Sequence
  ELANE RNA Guide
caacgacaucgugauucccc

SEQ ID NO: 13774 - RNA, 20 nt, Artificial Sequence
  ELANE RNA Guide
caccuggggaaucacgaugu

SEQ ID NO: 13775 - RNA, 20 nt, Artificial Sequence
  ELANE RNA Guide
caucgugauuccccaggugc

SEQ ID NO: 13776 - RNA, 20 nt, Artificial Sequence
  ELANE RNA Guide
cccggcggcaccuggggaau

SEQ ID NO: 13777 - RNA, 20 nt, Artificial Sequence
  ELANE RNA Guide
ccggcggcaccuggggaauc

SEQ ID NO: 13778 - RNA, 20 nt, Artificial Sequence
  ELANE RNA Guide
ccuggggaaucacgaugucg

SEQ ID NO: 13779 - RNA, 20 nt, Artificial Sequence
  ELANE RNA Guide
cgacaucgugauuccccagg

SEQ ID NO: 13780 - RNA, 20 nt, Artificial Sequence
  ELANE RNA Guide
cggcaccuggggaaucacga

SEQ ID NO: 13781 - RNA, 20 nt, Artificial Sequence
  ELANE RNA Guide
cggcggcaccuggggaauca

SEQ ID NO: 13782 - RNA, 20 nt, Artificial Sequence
  ELANE RNA Guide
cgugauuccccaggugccgc

SEQ ID NO: 13783 - RNA, 20 nt, Artificial Sequence
  ELANE RNA Guide
cucaacgacaucgugauucc

SEQ ID NO: 13784 - RNA, 20 nt, Artificial Sequence
  ELANE RNA Guide
cuggggaaucacgaugucgu

SEQ ID NO: 13785 - RNA, 20 nt, Artificial Sequence
  ELANE RNA Guide
gacaucgugauuccccaggu

SEQ ID NO: 13786 - RNA, 20 nt, Artificial Sequence
  ELANE RNA Guide
gauuccccaggugccgccgg

SEQ ID NO: 13787 - RNA, 20 nt, Artificial Sequence
  ELANE RNA Guide
gcaccuggggaaucacgaug

SEQ ID NO: 13788 - RNA, 20 nt, Artificial Sequence
  ELANE RNA Guide
gcccggcggcaccuggggaa

SEQ ID NO: 13789 - RNA, 20 nt, Artificial Sequence
  ELANE RNA Guide
gcggcaccuggggaaucacg

SEQ ID NO: 13790 - RNA, 20 nt, Artificial Sequence
  ELANE RNA Guide
ggcaccuggggaaucacgau

SEQ ID NO: 13791 - RNA, 20 nt, Artificial Sequence
  ELANE RNA Guide
ggcggcaccuggggaaucac

SEQ ID NO: 13792 - RNA, 20 nt, Artificial Sequence
  ELANE RNA Guide
gggaaucacgaugucguuga

SEQ ID NO: 13793 - RNA, 20 nt, Artificial Sequence
  ELANE RNA Guide
ggggaaucacgaugucguug

SEQ ID NO: 13794 - RNA, 20 nt, Artificial Sequence
  ELANE RNA Guide
gugauuccccaggugccgcc

SEQ ID NO: 13795 - RNA, 20 nt, Artificial Sequence
  ELANE RNA Guide
ucaacgacaucgugauuccc

SEQ ID NO: 13796 - RNA, 20 nt, Artificial Sequence
  ELANE RNA Guide
ucgugauuccccaggugccg

SEQ ID NO: 13797 - RNA, 20 nt, Artificial Sequence
  ELANE RNA Guide
ugauuccccaggugccgccg

SEQ ID NO: 13798 - RNA, 20 nt, Artificial Sequence
  ELANE RNA Guide
uggggaaucacgaugucguu

SEQ ID NO: 13799 - RNA, 20 nt, Artificial Sequence
  ELANE RNA Guide
uuccccaggugccgccgggc

SEQ ID NO: 13800 - RNA, 21 nt, Artificial Sequence
  ELANE RNA Guide
aacgacaucgugauuccccag

SEQ ID NO: 13801 - RNA, 21 nt, Artificial Sequence
  ELANE RNA Guide
acaucgugauuccccaggugc

SEQ ID NO: 13802 - RNA, 21 nt, Artificial Sequence
  ELANE RNA Guide
accuggggaaucacgaugucg

SEQ ID NO: 13803 - RNA, 21 nt, Artificial Sequence
  ELANE RNA Guide
acgacaucgugauuccccagg

SEQ ID NO: 13804 - RNA, 21 nt, Artificial Sequence
  ELANE RNA Guide
aucgugauuccccaggugccg

SEQ ID NO: 13805 - RNA, 21 nt, Artificial Sequence
  ELANE RNA Guide
auuccccaggugccgccgggc

SEQ ID NO: 13806 - RNA, 21 nt, Artificial Sequence
  ELANE RNA Guide
caacgacaucgugauucccca

SEQ ID NO: 13807 - RNA, 21 nt, Artificial Sequence
  ELANE RNA Guide
caccuggggaaucacgauguc

SEQ ID NO: 13808 - RNA, 21 nt, Artificial Sequence
  ELANE RNA Guide
caucgugauuccccaggugcc

SEQ ID NO: 13809 - RNA, 21 nt, Artificial Sequence
  ELANE RNA Guide
cccggcggcaccuggggaauc

SEQ ID NO: 13810 - RNA, 21 nt, Artificial Sequence
  ELANE RNA Guide
ccggcggcaccuggggaauca

SEQ ID NO: 13811 - RNA, 21 nt, Artificial Sequence
  ELANE RNA Guide
ccuggggaaucacgaugucgu

SEQ ID NO: 13812 - RNA, 21 nt, Artificial Sequence
  ELANE RNA Guide
cgacaucgugauuccccaggu

SEQ ID NO: 13813 - RNA, 21 nt, Artificial Sequence
  ELANE RNA Guide
cggcaccuggggaaucacgau

SEQ ID NO: 13814 - RNA, 21 nt, Artificial Sequence
  ELANE RNA Guide
cggcggcaccuggggaaucac

SEQ ID NO: 13815 - RNA, 21 nt, Artificial Sequence
  ELANE RNA Guide
cgugauuccccaggugccgcc

SEQ ID NO: 13816 - RNA, 21 nt, Artificial Sequence
  ELANE RNA Guide
cucaacgacaucgugauuccc

SEQ ID NO: 13817 - RNA, 21 nt, Artificial Sequence
  ELANE RNA Guide
cuggggaaucacgaugucguu

SEQ ID NO: 13818 - RNA, 21 nt, Artificial Sequence
  ELANE RNA Guide
gacaucgugauuccccaggug

SEQ ID NO: 13819 - RNA, 21 nt, Artificial Sequence
  ELANE RNA Guide
gauuccccaggugccgccggg

SEQ ID NO: 13820 - RNA, 21 nt, Artificial Sequence
  ELANE RNA Guide
gcaccuggggaaucacgaugu

SEQ ID NO: 13821 - RNA, 21 nt, Artificial Sequence
  ELANE RNA Guide
gcccggcggcaccuggggaau

SEQ ID NO: 13822 - RNA, 21 nt, Artificial Sequence
  ELANE RNA Guide
gcggcaccuggggaaucacga

SEQ ID NO: 13823 - RNA, 21 nt, Artificial Sequence
  ELANE RNA Guide
gcucaacgacaucgugauucc

SEQ ID NO: 13824 - RNA, 21 nt, Artificial Sequence
  ELANE RNA Guide
ggcaccuggggaaucacgaug

SEQ ID NO: 13825 - RNA, 21 nt, Artificial Sequence
  ELANE RNA Guide
ggcggcaccuggggaaucacg

SEQ ID NO: 13826 - RNA, 21 nt, Artificial Sequence
  ELANE RNA Guide
gggaaucacgaugucguugag

SEQ ID NO: 13827 - RNA, 21 nt, Artificial Sequence
  ELANE RNA Guide
ggggaaucacgaugucguuga

SEQ ID NO: 13828 - RNA, 21 nt, Artificial Sequence
  ELANE RNA Guide
gugauuccccaggugccgccg

SEQ ID NO: 13829 - RNA, 21 nt, Artificial Sequence
  ELANE RNA Guide
ucaacgacaucgugauucccc

SEQ ID NO: 13830 - RNA, 21 nt, Artificial Sequence
  ELANE RNA Guide
ucgugauuccccaggugccgc

SEQ ID NO: 13831 - RNA, 21 nt, Artificial Sequence
  ELANE RNA Guide
ugauuccccaggugccgccgg

SEQ ID NO: 13832 - RNA, 21 nt, Artificial Sequence
  ELANE RNA Guide
uggggaaucacgaugucguug

SEQ ID NO: 13833 - RNA, 22 nt, Artificial Sequence
  ELANE RNA Guide
aacgacaucgugauuccccagg

SEQ ID NO: 13834 - RNA, 22 nt, Artificial Sequence
  ELANE RNA Guide
acaucgugauuccccaggugcc

SEQ ID NO: 13835 - RNA, 22 nt, Artificial Sequence
  ELANE RNA Guide
accuggggaaucacgaugucgu

SEQ ID NO: 13836 - RNA, 22 nt, Artificial Sequence
  ELANE RNA Guide
acgacaucgugauuccccaggu

SEQ ID NO: 13837 - RNA, 22 nt, Artificial Sequence
  ELANE RNA Guide
aucgugauuccccaggugccgc

SEQ ID NO: 13838 - RNA, 22 nt, Artificial Sequence
  ELANE RNA Guide
auuccccaggugccgccgggcg

SEQ ID NO: 13839 - RNA, 22 nt, Artificial Sequence
  ELANE RNA Guide
caacgacaucgugauuccccag

SEQ ID NO: 13840 - RNA, 22 nt, Artificial Sequence
  ELANE RNA Guide
caccuggggaaucacgaugucg

SEQ ID NO: 13841 - RNA, 22 nt, Artificial Sequence
  ELANE RNA Guide
caucgugauuccccaggugccg

SEQ ID NO: 13842 - RNA, 22 nt, Artificial Sequence
  ELANE RNA Guide
cccggcggcaccuggggaauca

SEQ ID NO: 13843 - RNA, 22 nt, Artificial Sequence
  ELANE RNA Guide
ccggcggcaccuggggaaucac

SEQ ID NO: 13844 - RNA, 22 nt, Artificial Sequence
  ELANE RNA Guide
ccuggggaaucacgaugucguu

SEQ ID NO: 13845 - RNA, 22 nt, Artificial Sequence
  ELANE RNA Guide
cgacaucgugauuccccaggug

SEQ ID NO: 13846 - RNA, 22 nt, Artificial Sequence
  ELANE RNA Guide
cgcccggcggcaccuggggaau

SEQ ID NO: 13847 - RNA, 22 nt, Artificial Sequence
  ELANE RNA Guide
cggcaccuggggaaucacgaug

SEQ ID NO: 13848 - RNA, 22 nt, Artificial Sequence
  ELANE RNA Guide
cggcggcaccuggggaaucacg

SEQ ID NO: 13849 - RNA, 22 nt, Artificial Sequence
  ELANE RNA Guide
cgugauuccccaggugccgccg

SEQ ID NO: 13850 - RNA, 22 nt, Artificial Sequence
  ELANE RNA Guide
cucaacgacaucgugauucccc

SEQ ID NO: 13851 - RNA, 22 nt, Artificial Sequence
  ELANE RNA Guide
cuggggaaucacgaugucguug

SEQ ID NO: 13852 - RNA, 22 nt, Artificial Sequence
  ELANE RNA Guide
gacaucgugauuccccaggugc

SEQ ID NO: 13853 - RNA, 22 nt, Artificial Sequence
  ELANE RNA Guide
gauuccccaggugccgccgggc

SEQ ID NO: 13854 - RNA, 22 nt, Artificial Sequence
  ELANE RNA Guide
gcaccuggggaaucacgauguc

SEQ ID NO: 13855 - RNA, 22 nt, Artificial Sequence
  ELANE RNA Guide
gcccggcggcaccuggggaauc

SEQ ID NO: 13856 - RNA, 22 nt, Artificial Sequence
  ELANE RNA Guide
gcggcaccuggggaaucacgau

SEQ ID NO: 13857 - RNA, 22 nt, Artificial Sequence
  ELANE RNA Guide
gcucaacgacaucgugauuccc

SEQ ID NO: 13858 - RNA, 22 nt, Artificial Sequence
  ELANE RNA Guide
ggcaccuggggaaucacgaugu

SEQ ID NO: 13859 - RNA, 22 nt, Artificial Sequence
  ELANE RNA Guide
ggcggcaccuggggaaucacga

SEQ ID NO: 13860 - RNA, 22 nt, Artificial Sequence
  ELANE RNA Guide
gggaaucacgaugucguugagc

SEQ ID NO: 13861 - RNA, 22 nt, Artificial Sequence
  ELANE RNA Guide
ggggaaucacgaugucguugag

SEQ ID NO: 13862 - RNA, 22 nt, Artificial Sequence
  ELANE RNA Guide
gugauuccccaggugccgccgg

SEQ ID NO: 13863 - RNA, 22 nt, Artificial Sequence
  ELANE RNA Guide
ucaacgacaucgugauucccca

SEQ ID NO: 13864 - RNA, 22 nt, Artificial Sequence
  ELANE RNA Guide
ucgugauuccccaggugccgcc

SEQ ID NO: 13865 - RNA, 22 nt, Artificial Sequence
  ELANE RNA Guide
ugauuccccaggugccgccggg

SEQ ID NO: 13866 - RNA, 22 nt, Artificial Sequence
  ELANE RNA Guide
ugcucaacgacaucgugauucc

SEQ ID NO: 13867 - RNA, 22 nt, Artificial Sequence
  ELANE RNA Guide
uggggaaucacgaugucguuga

SEQ ID NO: 13868 - RNA, 20 nt, Artificial Sequence
  ELANE RNA Guide
aacgacaucgugauucucua

SEQ ID NO: 13869 - RNA, 20 nt, Artificial Sequence
  ELANE RNA Guide
acaucgugauucucuaggug

SEQ ID NO: 13870 - RNA, 20 nt, Artificial Sequence
  ELANE RNA Guide
accuagagaaucacgauguc

SEQ ID NO: 13871 - RNA, 20 nt, Artificial Sequence
  ELANE RNA Guide
acgacaucgugauucucuag

SEQ ID NO: 13872 - RNA, 20 nt, Artificial Sequence
  ELANE RNA Guide
aucgugauucucuaggugcc

SEQ ID NO: 13873 - RNA, 20 nt, Artificial Sequence
  ELANE RNA Guide
auucucuaggugccgccggg

SEQ ID NO: 13874 - RNA, 20 nt, Artificial Sequence
  ELANE RNA Guide
caacgacaucgugauucucu

SEQ ID NO: 13875 - RNA, 20 nt, Artificial Sequence
  ELANE RNA Guide
caccuagagaaucacgaugu

SEQ ID NO: 13876 - RNA, 20 nt, Artificial Sequence
  ELANE RNA Guide
caucgugauucucuaggugc

SEQ ID NO: 13877 - RNA, 20 nt, Artificial Sequence
  ELANE RNA Guide
cccgcccggcggcaccuaga

SEQ ID NO: 13878 - RNA, 20 nt, Artificial Sequence
  ELANE RNA Guide
cccggcggcaccuagagaau

SEQ ID NO: 13879 - RNA, 20 nt, Artificial Sequence
  ELANE RNA Guide
ccgcccggcggcaccuagag

SEQ ID NO: 13880 - RNA, 20 nt, Artificial Sequence
  ELANE RNA Guide
ccggcggcaccuagagaauc

SEQ ID NO: 13881 - RNA, 20 nt, Artificial Sequence
  ELANE RNA Guide
ccuagagaaucacgaugucg

SEQ ID NO: 13882 - RNA, 20 nt, Artificial Sequence
  ELANE RNA Guide
cgacaucgugauucucuagg

SEQ ID NO: 13883 - RNA, 20 nt, Artificial Sequence
  ELANE RNA Guide
cgcccggcggcaccuagaga

SEQ ID NO: 13884 - RNA, 20 nt, Artificial Sequence
  ELANE RNA Guide
cggcaccuagagaaucacga

SEQ ID NO: 13885 - RNA, 20 nt, Artificial Sequence
  ELANE RNA Guide
cggcggcaccuagagaauca

SEQ ID NO: 13886 - RNA, 20 nt, Artificial Sequence
  ELANE RNA Guide
cgugauucucuaggugccgc

SEQ ID NO: 13887 - RNA, 20 nt, Artificial Sequence
  ELANE RNA Guide
cuagagaaucacgaugucgu

SEQ ID NO: 13888 - RNA, 20 nt, Artificial Sequence
  ELANE RNA Guide
cucaacgacaucgugauucu

SEQ ID NO: 13889 - RNA, 20 nt, Artificial Sequence
  ELANE RNA Guide
cucuaggugccgccgggcgg

SEQ ID NO: 13890 - RNA, 20 nt, Artificial Sequence
  ELANE RNA Guide
gacaucgugauucucuaggu

SEQ ID NO: 13891 - RNA, 20 nt, Artificial Sequence
  ELANE RNA Guide
gauucucuaggugccgccgg

SEQ ID NO: 13892 - RNA, 20 nt, Artificial Sequence
  ELANE RNA Guide
gcaccuagagaaucacgaug

SEQ ID NO: 13893 - RNA, 20 nt, Artificial Sequence
  ELANE RNA Guide
gcccggcggcaccuagagaa

SEQ ID NO: 13894 - RNA, 20 nt, Artificial Sequence
  ELANE RNA Guide
gcggcaccuagagaaucacg

SEQ ID NO: 13895 - RNA, 20 nt, Artificial Sequence
  ELANE RNA Guide
ggcaccuagagaaucacgau

SEQ ID NO: 13896 - RNA, 20 nt, Artificial Sequence
  ELANE RNA Guide
ggcggcaccuagagaaucac

SEQ ID NO: 13897 - RNA, 20 nt, Artificial Sequence
  ELANE RNA Guide
gugauucucuaggugccgcc

SEQ ID NO: 13898 - RNA, 20 nt, Artificial Sequence
  ELANE RNA Guide
uagagaaucacgaugucguu

SEQ ID NO: 13899 - RNA, 20 nt, Artificial Sequence
  ELANE RNA Guide
ucaacgacaucgugauucuc

SEQ ID NO: 13900 - RNA, 20 nt, Artificial Sequence
  ELANE RNA Guide
ucgugauucucuaggugccg

SEQ ID NO: 13901 - RNA, 20 nt, Artificial Sequence
  ELANE RNA Guide
ucuaggugccgccgggcggg

SEQ ID NO: 13902 - RNA, 20 nt, Artificial Sequence
  ELANE RNA Guide
ucucuaggugccgccgggcg

SEQ ID NO: 13903 - RNA, 20 nt, Artificial Sequence
  ELANE RNA Guide
ugauucucuaggugccgccg

SEQ ID NO: 13904 - RNA, 20 nt, Artificial Sequence
  ELANE RNA Guide
uucucuaggugccgccgggc

SEQ ID NO: 13905 - RNA, 21 nt, Artificial Sequence
  ELANE RNA Guide
aacgacaucgugauucucuag

SEQ ID NO: 13906 - RNA, 21 nt, Artificial Sequence
  ELANE RNA Guide
acaucgugauucucuaggugc

SEQ ID NO: 13907 - RNA, 21 nt, Artificial Sequence
  ELANE RNA Guide
accuagagaaucacgaugucg

SEQ ID NO: 13908 - RNA, 21 nt, Artificial Sequence
  ELANE RNA Guide
acgacaucgugauucucuagg

SEQ ID NO: 13909 - RNA, 21 nt, Artificial Sequence
  ELANE RNA Guide
aucgugauucucuaggugccg

SEQ ID NO: 13910 - RNA, 21 nt, Artificial Sequence
  ELANE RNA Guide
auucucuaggugccgccgggc

SEQ ID NO: 13911 - RNA, 21 nt, Artificial Sequence
  ELANE RNA Guide
caacgacaucgugauucucua

SEQ ID NO: 13912 - RNA, 21 nt, Artificial Sequence
  ELANE RNA Guide
caccuagagaaucacgauguc

SEQ ID NO: 13913 - RNA, 21 nt, Artificial Sequence
  ELANE RNA Guide
caucgugauucucuaggugcc

SEQ ID NO: 13914 - RNA, 21 nt, Artificial Sequence
  ELANE RNA Guide
cccggcggcaccuagagaauc

SEQ ID NO: 13915 - RNA, 21 nt, Artificial Sequence
  ELANE RNA Guide
ccgcccggcggcaccuagaga

SEQ ID NO: 13916 - RNA, 21 nt, Artificial Sequence
  ELANE RNA Guide
ccggcggcaccuagagaauca

SEQ ID NO: 13917 - RNA, 21 nt, Artificial Sequence
  ELANE RNA Guide
ccuagagaaucacgaugucgu

SEQ ID NO: 13918 - RNA, 21 nt, Artificial Sequence
  ELANE RNA Guide
cgacaucgugauucucuaggu

SEQ ID NO: 13919 - RNA, 21 nt, Artificial Sequence
  ELANE RNA Guide
cgcccggcggcaccuagagaa

SEQ ID NO: 13920 - RNA, 21 nt, Artificial Sequence
  ELANE RNA Guide
cggcaccuagagaaucacgau

SEQ ID NO: 13921 - RNA, 21 nt, Artificial Sequence
  ELANE RNA Guide
cggcggcaccuagagaaucac

SEQ ID NO: 13922 - RNA, 21 nt, Artificial Sequence
  ELANE RNA Guide
cgugauucucuaggugccgcc

SEQ ID NO: 13923 - RNA, 21 nt, Artificial Sequence
  ELANE RNA Guide
cuagagaaucacgaugucguu

SEQ ID NO: 13924 - RNA, 21 nt, Artificial Sequence
  ELANE RNA Guide
cucaacgacaucgugauucuc

SEQ ID NO: 13925 - RNA, 21 nt, Artificial Sequence
  ELANE RNA Guide
gacaucgugauucucuaggug

SEQ ID NO: 13926 - RNA, 21 nt, Artificial Sequence
  ELANE RNA Guide
gauucucuaggugccgccggg

SEQ ID NO: 13927 - RNA, 21 nt, Artificial Sequence
  ELANE RNA Guide
gcaccuagagaaucacgaugu

SEQ ID NO: 13928 - RNA, 21 nt, Artificial Sequence
  ELANE RNA Guide
gcccggcggcaccuagagaau

SEQ ID NO: 13929 - RNA, 21 nt, Artificial Sequence
  ELANE RNA Guide
gcggcaccuagagaaucacga

SEQ ID NO: 13930 - RNA, 21 nt, Artificial Sequence
  ELANE RNA Guide
gcucaacgacaucgugauucu

SEQ ID NO: 13931 - RNA, 21 nt, Artificial Sequence
  ELANE RNA Guide
ggcaccuagagaaucacgaug

SEQ ID NO: 13932 - RNA, 21 nt, Artificial Sequence
  ELANE RNA Guide
ggcggcaccuagagaaucacg

SEQ ID NO: 13933 - RNA, 21 nt, Artificial Sequence
  ELANE RNA Guide
gugauucucuaggugccgccg

SEQ ID NO: 13934 - RNA, 21 nt, Artificial Sequence
  ELANE RNA Guide
uagagaaucacgaugucguug

SEQ ID NO: 13935 - RNA, 21 nt, Artificial Sequence
  ELANE RNA Guide
ucaacgacaucgugauucucu

SEQ ID NO: 13936 - RNA, 21 nt, Artificial Sequence
  ELANE RNA Guide
ucgugauucucuaggugccgc

SEQ ID NO: 13937 - RNA, 21 nt, Artificial Sequence
  ELANE RNA Guide
ucucuaggugccgccgggcgg

SEQ ID NO: 13938 - RNA, 21 nt, Artificial Sequence
  ELANE RNA Guide
ugauucucuaggugccgccgg

SEQ ID NO: 13939 - RNA, 21 nt, Artificial Sequence
  ELANE RNA Guide
uucucuaggugccgccgggcg

SEQ ID NO: 13940 - RNA, 22 nt, Artificial Sequence
  ELANE RNA Guide
aacgacaucgugauucucuagg

SEQ ID NO: 13941 - RNA, 22 nt, Artificial Sequence
  ELANE RNA Guide
acaucgugauucucuaggugcc

SEQ ID NO: 13942 - RNA, 22 nt, Artificial Sequence
  ELANE RNA Guide
accuagagaaucacgaugucgu

SEQ ID NO: 13943 - RNA, 22 nt, Artificial Sequence
  ELANE RNA Guide
acgacaucgugauucucuaggu

SEQ ID NO: 13944 - RNA, 22 nt, Artificial Sequence
  ELANE RNA Guide
aucgugauucucuaggugccgc

SEQ ID NO: 13945 - RNA, 22 nt, Artificial Sequence
  ELANE RNA Guide
auucucuaggugccgccgggcg

SEQ ID NO: 13946 - RNA, 22 nt, Artificial Sequence
  ELANE RNA Guide
caacgacaucgugauucucuag

SEQ ID NO: 13947 - RNA, 22 nt, Artificial Sequence
  ELANE RNA Guide
caccuagagaaucacgaugucg

SEQ ID NO: 13948 - RNA, 22 nt, Artificial Sequence
  ELANE RNA Guide
caucgugauucucuaggugccg

SEQ ID NO: 13949 - RNA, 22 nt, Artificial Sequence
  ELANE RNA Guide
cccgcccggcggcaccuagaga

SEQ ID NO: 13950 - RNA, 22 nt, Artificial Sequence
  ELANE RNA Guide
cccggcggcaccuagagaauca

SEQ ID NO: 13951 - RNA, 22 nt, Artificial Sequence
  ELANE RNA Guide
ccgcccggcggcaccuagagaa

SEQ ID NO: 13952 - RNA, 22 nt, Artificial Sequence
  ELANE RNA Guide
ccggcggcaccuagagaaucac

SEQ ID NO: 13953 - RNA, 22 nt, Artificial Sequence
  ELANE RNA Guide
ccuagagaaucacgaugucguu

SEQ ID NO: 13954 - RNA, 22 nt, Artificial Sequence
  ELANE RNA Guide
cgacaucgugauucucuaggug

SEQ ID NO: 13955 - RNA, 22 nt, Artificial Sequence
  ELANE RNA Guide
cgcccggcggcaccuagagaau

SEQ ID NO: 13956 - RNA, 22 nt, Artificial Sequence
  ELANE RNA Guide
cggcaccuagagaaucacgaug

SEQ ID NO: 13957 - RNA, 22 nt, Artificial Sequence
  ELANE RNA Guide
cggcggcaccuagagaaucacg

SEQ ID NO: 13958 - RNA, 22 nt, Artificial Sequence
  ELANE RNA Guide
cgugauucucuaggugccgccg

SEQ ID NO: 13959 - RNA, 22 nt, Artificial Sequence
  ELANE RNA Guide
cuagagaaucacgaugucguug

SEQ ID NO: 13960 - RNA, 22 nt, Artificial Sequence
  ELANE RNA Guide
cucaacgacaucgugauucucu

SEQ ID NO: 13961 - RNA, 22 nt, Artificial Sequence
  ELANE RNA Guide
gacaucgugauucucuaggugc

SEQ ID NO: 13962 - RNA, 22 nt, Artificial Sequence
  ELANE RNA Guide
gauucucuaggugccgccgggc

SEQ ID NO: 13963 - RNA, 22 nt, Artificial Sequence
  ELANE RNA Guide
gcaccuagagaaucacgauguc

SEQ ID NO: 13964 - RNA, 22 nt, Artificial Sequence
  ELANE RNA Guide
gcccggcggcaccuagagaauc

SEQ ID NO: 13965 - RNA, 22 nt, Artificial Sequence
  ELANE RNA Guide
gcggcaccuagagaaucacgau

SEQ ID NO: 13966 - RNA, 22 nt, Artificial Sequence
  ELANE RNA Guide
gcucaacgacaucgugauucuc

SEQ ID NO: 13967 - RNA, 22 nt, Artificial Sequence
  ELANE RNA Guide
ggcaccuagagaaucacgaugu

SEQ ID NO: 13968 - RNA, 22 nt, Artificial Sequence
  ELANE RNA Guide
ggcggcaccuagagaaucacga

SEQ ID NO: 13969 - RNA, 22 nt, Artificial Sequence
  ELANE RNA Guide
gugauucucuaggugccgccgg

SEQ ID NO: 13970 - RNA, 22 nt, Artificial Sequence
  ELANE RNA Guide
uagagaaucacgaugucguuga

SEQ ID NO: 13971 - RNA, 22 nt, Artificial Sequence
  ELANE RNA Guide
ucaacgacaucgugauucucua

SEQ ID NO: 13972 - RNA, 22 nt, Artificial Sequence
  ELANE RNA Guide
ucgugauucucuaggugccgcc

SEQ ID NO: 13973 - RNA, 22 nt, Artificial Sequence
  ELANE RNA Guide
ucucuaggugccgccgggcggg

SEQ ID NO: 13974 - RNA, 22 nt, Artificial Sequence
  ELANE RNA Guide
ugauucucuaggugccgccggg

SEQ ID NO: 13975 - RNA, 22 nt, Artificial Sequence
  ELANE RNA Guide
ugcucaacgacaucgugauucu

SEQ ID NO: 13976 - RNA, 22 nt, Artificial Sequence
  ELANE RNA Guide
uucucuaggugccgccgggcgg

SEQ ID NO: 13977 - RNA, 20 nt, Artificial Sequence
  ELANE RNA Guide
acccguugagcuguggcggu

SEQ ID NO: 13978 - RNA, 20 nt, Artificial Sequence
  ELANE RNA Guide
acgaucuguccccacaccgc

SEQ ID NO: 13979 - RNA, 20 nt, Artificial Sequence
  ELANE RNA Guide
acgcgcugacgaucuguccc

SEQ ID NO: 13980 - RNA, 20 nt, Artificial Sequence
  ELANE RNA Guide
agcuguggcgguguggggac

SEQ ID NO: 13981 - RNA, 20 nt, Artificial Sequence
  ELANE RNA Guide
aucuguccccacaccgccac

SEQ ID NO: 13982 - RNA, 20 nt, Artificial Sequence
  ELANE RNA Guide
ccacaccgccacagcucaac

SEQ ID NO: 13983 - RNA, 20 nt, Artificial Sequence
  ELANE RNA Guide
cccacaccgccacagcucaa

SEQ ID NO: 13984 - RNA, 20 nt, Artificial Sequence
  ELANE RNA Guide
ccccacaccgccacagcuca

SEQ ID NO: 13985 - RNA, 20 nt, Artificial Sequence
  ELANE RNA Guide
cccguugagcuguggcggug

SEQ ID NO: 13986 - RNA, 20 nt, Artificial Sequence
  ELANE RNA Guide
ccguugagcuguggcggugu

SEQ ID NO: 13987 - RNA, 20 nt, Artificial Sequence
  ELANE RNA Guide
cgaucuguccccacaccgcc

SEQ ID NO: 13988 - RNA, 20 nt, Artificial Sequence
  ELANE RNA Guide
cgcgcugacgaucugucccc

SEQ ID NO: 13989 - RNA, 20 nt, Artificial Sequence
  ELANE RNA Guide
cgcugacgaucuguccccac

SEQ ID NO: 13990 - RNA, 20 nt, Artificial Sequence
  ELANE RNA Guide
cgguguggggacagaucguc

SEQ ID NO: 13991 - RNA, 20 nt, Artificial Sequence
  ELANE RNA Guide
cguugagcuguggcggugug

SEQ ID NO: 13992 - RNA, 20 nt, Artificial Sequence
  ELANE RNA Guide
cugacgaucuguccccacac

SEQ ID NO: 13993 - RNA, 20 nt, Artificial Sequence
  ELANE RNA Guide
cuguccccacaccgccacag

SEQ ID NO: 13994 - RNA, 20 nt, Artificial Sequence
  ELANE RNA Guide
cuguggcgguguggggacag

SEQ ID NO: 13995 - RNA, 20 nt, Artificial Sequence
  ELANE RNA Guide
gacccguugagcuguggcgg

SEQ ID NO: 13996 - RNA, 20 nt, Artificial Sequence
  ELANE RNA Guide
gacgaucuguccccacaccg

SEQ ID NO: 13997 - RNA, 20 nt, Artificial Sequence
  ELANE RNA Guide
gagcuguggcggugugggga

SEQ ID NO: 13998 - RNA, 20 nt, Artificial Sequence
  ELANE RNA Guide
gaucuguccccacaccgcca

SEQ ID NO: 13999 - RNA, 20 nt, Artificial Sequence
  ELANE RNA Guide
gcgcugacgaucugucccca

SEQ ID NO: 14000 - RNA, 20 nt, Artificial Sequence
  ELANE RNA Guide
gcgguguggggacagaucgu

SEQ ID NO: 14001 - RNA, 20 nt, Artificial Sequence
  ELANE RNA Guide
gcugacgaucuguccccaca

SEQ ID NO: 14002 - RNA, 20 nt, Artificial Sequence
  ELANE RNA Guide
gcuguggcgguguggggaca

SEQ ID NO: 14003 - RNA, 20 nt, Artificial Sequence
  ELANE RNA Guide
ggcgguguggggacagaucg

SEQ ID NO: 14004 - RNA, 20 nt, Artificial Sequence
  ELANE RNA Guide
gguguggggacagaucguca

SEQ ID NO: 14005 - RNA, 20 nt, Artificial Sequence
  ELANE RNA Guide
guccccacaccgccacagcu

SEQ ID NO: 14006 - RNA, 20 nt, Artificial Sequence
  ELANE RNA Guide
guggcgguguggggacagau

SEQ ID NO: 14007 - RNA, 20 nt, Artificial Sequence
  ELANE RNA Guide
guguggggacagaucgucag

SEQ ID NO: 14008 - RNA, 20 nt, Artificial Sequence
  ELANE RNA Guide
guugagcuguggcggugugg

SEQ ID NO: 14009 - RNA, 20 nt, Artificial Sequence
  ELANE RNA Guide
uccccacaccgccacagcuc

SEQ ID NO: 14010 - RNA, 20 nt, Artificial Sequence
  ELANE RNA Guide
ucuguccccacaccgccaca

SEQ ID NO: 14011 - RNA, 20 nt, Artificial Sequence
  ELANE RNA Guide
ugacgaucuguccccacacc

SEQ ID NO: 14012 - RNA, 20 nt, Artificial Sequence
  ELANE RNA Guide
ugagcuguggcggugugggg

SEQ ID NO: 14013 - RNA, 20 nt, Artificial Sequence
  ELANE RNA Guide
uggcgguguggggacagauc

SEQ ID NO: 14014 - RNA, 20 nt, Artificial Sequence
  ELANE RNA Guide
uguccccacaccgccacagc

SEQ ID NO: 14015 - RNA, 20 nt, Artificial Sequence
  ELANE RNA Guide
uguggcgguguggggacaga

SEQ ID NO: 14016 - RNA, 20 nt, Artificial Sequence
  ELANE RNA Guide
uguggggacagaucgucagc

SEQ ID NO: 14017 - RNA, 20 nt, Artificial Sequence
  ELANE RNA Guide
uugagcuguggcgguguggg

SEQ ID NO: 14018 - RNA, 21 nt, Artificial Sequence
  ELANE RNA Guide
acccguugagcuguggcggug

SEQ ID NO: 14019 - RNA, 21 nt, Artificial Sequence
  ELANE RNA Guide
acgaucuguccccacaccgcc

SEQ ID NO: 14020 - RNA, 21 nt, Artificial Sequence
  ELANE RNA Guide
acgcgcugacgaucugucccc

SEQ ID NO: 14021 - RNA, 21 nt, Artificial Sequence
  ELANE RNA Guide
agcuguggcgguguggggaca

SEQ ID NO: 14022 - RNA, 21 nt, Artificial Sequence
  ELANE RNA Guide
aucuguccccacaccgccaca

SEQ ID NO: 14023 - RNA, 21 nt, Artificial Sequence
  ELANE RNA Guide
ccacaccgccacagcucaacg

SEQ ID NO: 14024 - RNA, 21 nt, Artificial Sequence
  ELANE RNA Guide
cccacaccgccacagcucaac

SEQ ID NO: 14025 - RNA, 21 nt, Artificial Sequence
  ELANE RNA Guide
ccccacaccgccacagcucaa

SEQ ID NO: 14026 - RNA, 21 nt, Artificial Sequence
  ELANE RNA Guide
cccguugagcuguggcggugu

SEQ ID NO: 14027 - RNA, 21 nt, Artificial Sequence
  ELANE RNA Guide
ccguugagcuguggcggugug

SEQ ID NO: 14028 - RNA, 21 nt, Artificial Sequence
  ELANE RNA Guide
cgacccguugagcuguggcgg

SEQ ID NO: 14029 - RNA, 21 nt, Artificial Sequence
  ELANE RNA Guide
cgaucuguccccacaccgcca

SEQ ID NO: 14030 - RNA, 21 nt, Artificial Sequence
  ELANE RNA Guide
cgcgcugacgaucugucccca

SEQ ID NO: 14031 - RNA, 21 nt, Artificial Sequence
  ELANE RNA Guide
cgcugacgaucuguccccaca

SEQ ID NO: 14032 - RNA, 21 nt, Artificial Sequence
  ELANE RNA Guide
cgguguggggacagaucguca

SEQ ID NO: 14033 - RNA, 21 nt, Artificial Sequence
  ELANE RNA Guide
cguugagcuguggcggugugg

SEQ ID NO: 14034 - RNA, 21 nt, Artificial Sequence
  ELANE RNA Guide
cugacgaucuguccccacacc

SEQ ID NO: 14035 - RNA, 21 nt, Artificial Sequence
  ELANE RNA Guide
cuguccccacaccgccacagc

SEQ ID NO: 14036 - RNA, 21 nt, Artificial Sequence
  ELANE RNA Guide
cuguggcgguguggggacaga

SEQ ID NO: 14037 - RNA, 21 nt, Artificial Sequence
  ELANE RNA Guide
gacccguugagcuguggcggu

SEQ ID NO: 14038 - RNA, 21 nt, Artificial Sequence
  ELANE RNA Guide
gacgaucuguccccacaccgc

SEQ ID NO: 14039 - RNA, 21 nt, Artificial Sequence
  ELANE RNA Guide
gacgcgcugacgaucuguccc

SEQ ID NO: 14040 - RNA, 21 nt, Artificial Sequence
  ELANE RNA Guide
gagcuguggcgguguggggac

SEQ ID NO: 14041 - RNA, 21 nt, Artificial Sequence
  ELANE RNA Guide
gaucuguccccacaccgccac

SEQ ID NO: 14042 - RNA, 21 nt, Artificial Sequence
  ELANE RNA Guide
gcgcugacgaucuguccccac

SEQ ID NO: 14043 - RNA, 21 nt, Artificial Sequence
  ELANE RNA Guide
gcgguguggggacagaucguc

SEQ ID NO: 14044 - RNA, 21 nt, Artificial Sequence
  ELANE RNA Guide
gcugacgaucuguccccacac

SEQ ID NO: 14045 - RNA, 21 nt, Artificial Sequence
  ELANE RNA Guide
gcuguggcgguguggggacag

SEQ ID NO: 14046 - RNA, 21 nt, Artificial Sequence
  ELANE RNA Guide
ggcgguguggggacagaucgu

SEQ ID NO: 14047 - RNA, 21 nt, Artificial Sequence
  ELANE RNA Guide
gguguggggacagaucgucag

SEQ ID NO: 14048 - RNA, 21 nt, Artificial Sequence
  ELANE RNA Guide
guccccacaccgccacagcuc

SEQ ID NO: 14049 - RNA, 21 nt, Artificial Sequence
  ELANE RNA Guide
guggcgguguggggacagauc

SEQ ID NO: 14050 - RNA, 21 nt, Artificial Sequence
  ELANE RNA Guide
guguggggacagaucgucagc

SEQ ID NO: 14051 - RNA, 21 nt, Artificial Sequence
  ELANE RNA Guide
guugagcuguggcgguguggg

SEQ ID NO: 14052 - RNA, 21 nt, Artificial Sequence
  ELANE RNA Guide
uccccacaccgccacagcuca

SEQ ID NO: 14053 - RNA, 21 nt, Artificial Sequence
  ELANE RNA Guide
ucuguccccacaccgccacag

SEQ ID NO: 14054 - RNA, 21 nt, Artificial Sequence
  ELANE RNA Guide
ugacgaucuguccccacaccg

SEQ ID NO: 14055 - RNA, 21 nt, Artificial Sequence
  ELANE RNA Guide
ugagcuguggcggugugggga

SEQ ID NO: 14056 - RNA, 21 nt, Artificial Sequence
  ELANE RNA Guide
uggcgguguggggacagaucg

SEQ ID NO: 14057 - RNA, 21 nt, Artificial Sequence
  ELANE RNA Guide
uguccccacaccgccacagcu

SEQ ID NO: 14058 - RNA, 21 nt, Artificial Sequence
  ELANE RNA Guide
uguggcgguguggggacagau

SEQ ID NO: 14059 - RNA, 21 nt, Artificial Sequence
  ELANE RNA Guide
uguggggacagaucgucagcg

SEQ ID NO: 14060 - RNA, 21 nt, Artificial Sequence
  ELANE RNA Guide
uugagcuguggcggugugggg

SEQ ID NO: 14061 - RNA, 22 nt, Artificial Sequence
  ELANE RNA Guide
acccguugagcuguggcggugu

SEQ ID NO: 14062 - RNA, 22 nt, Artificial Sequence
  ELANE RNA Guide
acgaucuguccccacaccgcca

SEQ ID NO: 14063 - RNA, 22 nt, Artificial Sequence
  ELANE RNA Guide
acgcgcugacgaucugucccca

SEQ ID NO: 14064 - RNA, 22 nt, Artificial Sequence
  ELANE RNA Guide
agcuguggcgguguggggacag

SEQ ID NO: 14065 - RNA, 22 nt, Artificial Sequence
  ELANE RNA Guide
aucuguccccacaccgccacag

SEQ ID NO: 14066 - RNA, 22 nt, Artificial Sequence
  ELANE RNA Guide
ccacaccgccacagcucaacgg

SEQ ID NO: 14067 - RNA, 22 nt, Artificial Sequence
  ELANE RNA Guide
cccacaccgccacagcucaacg

SEQ ID NO: 14068 - RNA, 22 nt, Artificial Sequence
  ELANE RNA Guide
ccccacaccgccacagcucaac

SEQ ID NO: 14069 - RNA, 22 nt, Artificial Sequence
  ELANE RNA Guide
cccguugagcuguggcggugug

SEQ ID NO: 14070 - RNA, 22 nt, Artificial Sequence
  ELANE RNA Guide
ccgacccguugagcuguggcgg

SEQ ID NO: 14071 - RNA, 22 nt, Artificial Sequence
  ELANE RNA Guide
ccguugagcuguggcggugugg

SEQ ID NO: 14072 - RNA, 22 nt, Artificial Sequence
  ELANE RNA Guide
cgacccguugagcuguggcggu

SEQ ID NO: 14073 - RNA, 22 nt, Artificial Sequence
  ELANE RNA Guide
cgaucuguccccacaccgccac

SEQ ID NO: 14074 - RNA, 22 nt, Artificial Sequence
  ELANE RNA Guide
cgcgcugacgaucuguccccac

SEQ ID NO: 14075 - RNA, 22 nt, Artificial Sequence
  ELANE RNA Guide
cgcugacgaucuguccccacac

SEQ ID NO: 14076 - RNA, 22 nt, Artificial Sequence
  ELANE RNA Guide
cgguguggggacagaucgucag

SEQ ID NO: 14077 - RNA, 22 nt, Artificial Sequence
  ELANE RNA Guide
cguugagcuguggcgguguggg

SEQ ID NO: 14078 - RNA, 22 nt, Artificial Sequence
  ELANE RNA Guide
cugacgaucuguccccacaccg

SEQ ID NO: 14079 - RNA, 22 nt, Artificial Sequence
  ELANE RNA Guide
cuguccccacaccgccacagcu

SEQ ID NO: 14080 - RNA, 22 nt, Artificial Sequence
  ELANE RNA Guide
cuguggcgguguggggacagau

SEQ ID NO: 14081 - RNA, 22 nt, Artificial Sequence
  ELANE RNA Guide
gacccguugagcuguggcggug

SEQ ID NO: 14082 - RNA, 22 nt, Artificial Sequence
  ELANE RNA Guide
gacgaucuguccccacaccgcc

SEQ ID NO: 14083 - RNA, 22 nt, Artificial Sequence
  ELANE RNA Guide
gacgcgcugacgaucugucccc

SEQ ID NO: 14084 - RNA, 22 nt, Artificial Sequence
  ELANE RNA Guide
gagcuguggcgguguggggaca

SEQ ID NO: 14085 - RNA, 22 nt, Artificial Sequence
  ELANE RNA Guide
gaucuguccccacaccgccaca

SEQ ID NO: 14086 - RNA, 22 nt, Artificial Sequence
  ELANE RNA Guide
gcgcugacgaucuguccccaca

SEQ ID NO: 14087 - RNA, 22 nt, Artificial Sequence
  ELANE RNA Guide
gcgguguggggacagaucguca

SEQ ID NO: 14088 - RNA, 22 nt, Artificial Sequence
  ELANE RNA Guide
gcugacgaucuguccccacacc

SEQ ID NO: 14089 - RNA, 22 nt, Artificial Sequence
  ELANE RNA Guide
gcuguggcgguguggggacaga

SEQ ID NO: 14090 - RNA, 22 nt, Artificial Sequence
  ELANE RNA Guide
ggcgguguggggacagaucguc

SEQ ID NO: 14091 - RNA, 22 nt, Artificial Sequence
  ELANE RNA Guide
gguguggggacagaucgucagc

SEQ ID NO: 14092 - RNA, 22 nt, Artificial Sequence
  ELANE RNA Guide
guccccacaccgccacagcuca

SEQ ID NO: 14093 - RNA, 22 nt, Artificial Sequence
  ELANE RNA Guide
guggcgguguggggacagaucg

SEQ ID NO: 14094 - RNA, 22 nt, Artificial Sequence
  ELANE RNA Guide
guguggggacagaucgucagcg

SEQ ID NO: 14095 - RNA, 22 nt, Artificial Sequence
  ELANE RNA Guide
guugagcuguggcggugugggg

SEQ ID NO: 14096 - RNA, 22 nt, Artificial Sequence
  ELANE RNA Guide
uccccacaccgccacagcucaa

SEQ ID NO: 14097 - RNA, 22 nt, Artificial Sequence
  ELANE RNA Guide
ucuguccccacaccgccacagc

SEQ ID NO: 14098 - RNA, 22 nt, Artificial Sequence
  ELANE RNA Guide
ugacgaucuguccccacaccgc

SEQ ID NO: 14099 - RNA, 22 nt, Artificial Sequence
  ELANE RNA Guide
ugacgcgcugacgaucuguccc

SEQ ID NO: 14100 - RNA, 22 nt, Artificial Sequence
  ELANE RNA Guide
ugagcuguggcgguguggggac

SEQ ID NO: 14101 - RNA, 22 nt, Artificial Sequence
  ELANE RNA Guide
uggcgguguggggacagaucgu

SEQ ID NO: 14102 - RNA, 22 nt, Artificial Sequence
  ELANE RNA Guide
uguccccacaccgccacagcuc

SEQ ID NO: 14103 - RNA, 22 nt, Artificial Sequence
  ELANE RNA Guide
uguggcgguguggggacagauc

SEQ ID NO: 14104 - RNA, 22 nt, Artificial Sequence
  ELANE RNA Guide
uguggggacagaucgucagcgc

SEQ ID NO: 14105 - RNA, 22 nt, Artificial Sequence
  ELANE RNA Guide
uugagcuguggcggugugggga

SEQ ID NO: 14106 - RNA, 20 nt, Artificial Sequence
  ELANE RNA Guide
acagccacagcucaacgggu

SEQ ID NO: 14107 - RNA, 20 nt, Artificial Sequence
  ELANE RNA Guide
acccguugagcuguggcugu

SEQ ID NO: 14108 - RNA, 20 nt, Artificial Sequence
  ELANE RNA Guide
acgaucuguccccacagcca

SEQ ID NO: 14109 - RNA, 20 nt, Artificial Sequence
  ELANE RNA Guide
agcuguggcuguggggacag

SEQ ID NO: 14110 - RNA, 20 nt, Artificial Sequence
  ELANE RNA Guide
aucuguccccacagccacag

SEQ ID NO: 14111 - RNA, 20 nt, Artificial Sequence
  ELANE RNA Guide
cacagccacagcucaacggg

SEQ ID NO: 14112 - RNA, 20 nt, Artificial Sequence
  ELANE RNA Guide
cagccacagcucaacggguc

SEQ ID NO: 14113 - RNA, 20 nt, Artificial Sequence
  ELANE RNA Guide
ccacagccacagcucaacgg

SEQ ID NO: 14114 - RNA, 20 nt, Artificial Sequence
  ELANE RNA Guide
cccacagccacagcucaacg

SEQ ID NO: 14115 - RNA, 20 nt, Artificial Sequence
  ELANE RNA Guide
ccccacagccacagcucaac

SEQ ID NO: 14116 - RNA, 20 nt, Artificial Sequence
  ELANE RNA Guide
cccguugagcuguggcugug

SEQ ID NO: 14117 - RNA, 20 nt, Artificial Sequence
  ELANE RNA Guide
ccgacccguugagcuguggc

SEQ ID NO: 14118 - RNA, 20 nt, Artificial Sequence
  ELANE RNA Guide
ccguugagcuguggcugugg

SEQ ID NO: 14119 - RNA, 20 nt, Artificial Sequence
  ELANE RNA Guide
cgacccguugagcuguggcu

SEQ ID NO: 14120 - RNA, 20 nt, Artificial Sequence
  ELANE RNA Guide
cgaucuguccccacagccac

SEQ ID NO: 14121 - RNA, 20 nt, Artificial Sequence
  ELANE RNA Guide
cguugagcuguggcuguggg

SEQ ID NO: 14122 - RNA, 20 nt, Artificial Sequence
  ELANE RNA Guide
cugacgaucuguccccacag

SEQ ID NO: 14123 - RNA, 20 nt, Artificial Sequence
  ELANE RNA Guide
cuguccccacagccacagcu

SEQ ID NO: 14124 - RNA, 20 nt, Artificial Sequence
  ELANE RNA Guide
cuguggcuguggggacagau

SEQ ID NO: 14125 - RNA, 20 nt, Artificial Sequence
  ELANE RNA Guide
cuguggggacagaucgucag

SEQ ID NO: 14126 - RNA, 20 nt, Artificial Sequence
  ELANE RNA Guide
gacccguugagcuguggcug

SEQ ID NO: 14127 - RNA, 20 nt, Artificial Sequence
  ELANE RNA Guide
gacgaucuguccccacagcc

SEQ ID NO: 14128 - RNA, 20 nt, Artificial Sequence
  ELANE RNA Guide
gagcuguggcuguggggaca

SEQ ID NO: 14129 - RNA, 20 nt, Artificial Sequence
  ELANE RNA Guide
gaucuguccccacagccaca

SEQ ID NO: 14130 - RNA, 20 nt, Artificial Sequence
  ELANE RNA Guide
gccgacccguugagcugugg

SEQ ID NO: 14131 - RNA, 20 nt, Artificial Sequence
  ELANE RNA Guide
gcuguggcuguggggacaga

SEQ ID NO: 14132 - RNA, 20 nt, Artificial Sequence
  ELANE RNA Guide
gcuguggggacagaucguca

SEQ ID NO: 14133 - RNA, 20 nt, Artificial Sequence
  ELANE RNA Guide
ggccgacccguugagcugug

SEQ ID NO: 14134 - RNA, 20 nt, Artificial Sequence
  ELANE RNA Guide
ggcuguggggacagaucguc

SEQ ID NO: 14135 - RNA, 20 nt, Artificial Sequence
  ELANE RNA Guide
guccccacagccacagcuca

SEQ ID NO: 14136 - RNA, 20 nt, Artificial Sequence
  ELANE RNA Guide
guggcuguggggacagaucg

SEQ ID NO: 14137 - RNA, 20 nt, Artificial Sequence
  ELANE RNA Guide
guugagcuguggcugugggg

SEQ ID NO: 14138 - RNA, 20 nt, Artificial Sequence
  ELANE RNA Guide
uccccacagccacagcucaa

SEQ ID NO: 14139 - RNA, 20 nt, Artificial Sequence
  ELANE RNA Guide
ucuguccccacagccacagc

SEQ ID NO: 14140 - RNA, 20 nt, Artificial Sequence
  ELANE RNA Guide
ugacgaucuguccccacagc

SEQ ID NO: 14141 - RNA, 20 nt, Artificial Sequence
  ELANE RNA Guide
ugagcuguggcuguggggac

SEQ ID NO: 14142 - RNA, 20 nt, Artificial Sequence
  ELANE RNA Guide
uggccgacccguugagcugu

SEQ ID NO: 14143 - RNA, 20 nt, Artificial Sequence
  ELANE RNA Guide
uggcuguggggacagaucgu

SEQ ID NO: 14144 - RNA, 20 nt, Artificial Sequence
  ELANE RNA Guide
uguccccacagccacagcuc

SEQ ID NO: 14145 - RNA, 20 nt, Artificial Sequence
  ELANE RNA Guide
uguggcuguggggacagauc

SEQ ID NO: 14146 - RNA, 20 nt, Artificial Sequence
  ELANE RNA Guide
uugagcuguggcugugggga

SEQ ID NO: 14147 - RNA, 21 nt, Artificial Sequence
  ELANE RNA Guide
acagccacagcucaacggguc

SEQ ID NO: 14148 - RNA, 21 nt, Artificial Sequence
  ELANE RNA Guide
acccguugagcuguggcugug

SEQ ID NO: 14149 - RNA, 21 nt, Artificial Sequence
  ELANE RNA Guide
acgaucuguccccacagccac

SEQ ID NO: 14150 - RNA, 21 nt, Artificial Sequence
  ELANE RNA Guide
agcuguggcuguggggacaga

SEQ ID NO: 14151 - RNA, 21 nt, Artificial Sequence
  ELANE RNA Guide
aucuguccccacagccacagc

SEQ ID NO: 14152 - RNA, 21 nt, Artificial Sequence
  ELANE RNA Guide
cacagccacagcucaacgggu

SEQ ID NO: 14153 - RNA, 21 nt, Artificial Sequence
  ELANE RNA Guide
cagccacagcucaacgggucg

SEQ ID NO: 14154 - RNA, 21 nt, Artificial Sequence
  ELANE RNA Guide
ccacagccacagcucaacggg

SEQ ID NO: 14155 - RNA, 21 nt, Artificial Sequence
  ELANE RNA Guide
cccacagccacagcucaacgg

SEQ ID NO: 14156 - RNA, 21 nt, Artificial Sequence
  ELANE RNA Guide
ccccacagccacagcucaacg

SEQ ID NO: 14157 - RNA, 21 nt, Artificial Sequence
  ELANE RNA Guide
cccguugagcuguggcugugg

SEQ ID NO: 14158 - RNA, 21 nt, Artificial Sequence
  ELANE RNA Guide
ccgacccguugagcuguggcu

SEQ ID NO: 14159 - RNA, 21 nt, Artificial Sequence
  ELANE RNA Guide
ccguugagcuguggcuguggg

SEQ ID NO: 14160 - RNA, 21 nt, Artificial Sequence
  ELANE RNA Guide
cgacccguugagcuguggcug

SEQ ID NO: 14161 - RNA, 21 nt, Artificial Sequence
  ELANE RNA Guide
cgaucuguccccacagccaca

SEQ ID NO: 14162 - RNA, 21 nt, Artificial Sequence
  ELANE RNA Guide
cguugagcuguggcugugggg

SEQ ID NO: 14163 - RNA, 21 nt, Artificial Sequence
  ELANE RNA Guide
cugacgaucuguccccacagc

SEQ ID NO: 14164 - RNA, 21 nt, Artificial Sequence
  ELANE RNA Guide
cuguccccacagccacagcuc

SEQ ID NO: 14165 - RNA, 21 nt, Artificial Sequence
  ELANE RNA Guide
cuguggcuguggggacagauc

SEQ ID NO: 14166 - RNA, 21 nt, Artificial Sequence
  ELANE RNA Guide
cuguggggacagaucgucagc

SEQ ID NO: 14167 - RNA, 21 nt, Artificial Sequence
  ELANE RNA Guide
gacccguugagcuguggcugu

SEQ ID NO: 14168 - RNA, 21 nt, Artificial Sequence
  ELANE RNA Guide
gacgaucuguccccacagcca

SEQ ID NO: 14169 - RNA, 21 nt, Artificial Sequence
  ELANE RNA Guide
gagcuguggcuguggggacag

SEQ ID NO: 14170 - RNA, 21 nt, Artificial Sequence
  ELANE RNA Guide
gaucuguccccacagccacag

SEQ ID NO: 14171 - RNA, 21 nt, Artificial Sequence
  ELANE RNA Guide
gccgacccguugagcuguggc

SEQ ID NO: 14172 - RNA, 21 nt, Artificial Sequence
  ELANE RNA Guide
gcugacgaucuguccccacag

SEQ ID NO: 14173 - RNA, 21 nt, Artificial Sequence
  ELANE RNA Guide
gcuguggcuguggggacagau

SEQ ID NO: 14174 - RNA, 21 nt, Artificial Sequence
  ELANE RNA Guide
gcuguggggacagaucgucag

SEQ ID NO: 14175 - RNA, 21 nt, Artificial Sequence
  ELANE RNA Guide
ggccgacccguugagcugugg

SEQ ID NO: 14176 - RNA, 21 nt, Artificial Sequence
  ELANE RNA Guide
ggcuguggggacagaucguca

SEQ ID NO: 14177 - RNA, 21 nt, Artificial Sequence
  ELANE RNA Guide
guccccacagccacagcucaa

SEQ ID NO: 14178 - RNA, 21 nt, Artificial Sequence
  ELANE RNA Guide
guggccgacccguugagcugu

SEQ ID NO: 14179 - RNA, 21 nt, Artificial Sequence
  ELANE RNA Guide
guggcuguggggacagaucgu

SEQ ID NO: 14180 - RNA, 21 nt, Artificial Sequence
  ELANE RNA Guide
guugagcuguggcugugggga

SEQ ID NO: 14181 - RNA, 21 nt, Artificial Sequence
  ELANE RNA Guide
uccccacagccacagcucaac

SEQ ID NO: 14182 - RNA, 21 nt, Artificial Sequence
  ELANE RNA Guide
ucuguccccacagccacagcu

SEQ ID NO: 14183 - RNA, 21 nt, Artificial Sequence
  ELANE RNA Guide
ugacgaucuguccccacagcc

SEQ ID NO: 14184 - RNA, 21 nt, Artificial Sequence
  ELANE RNA Guide
ugagcuguggcuguggggaca

SEQ ID NO: 14185 - RNA, 21 nt, Artificial Sequence
  ELANE RNA Guide
uggccgacccguugagcugug

SEQ ID NO: 14186 - RNA, 21 nt, Artificial Sequence
  ELANE RNA Guide
uggcuguggggacagaucguc

SEQ ID NO: 14187 - RNA, 21 nt, Artificial Sequence
  ELANE RNA Guide
uguccccacagccacagcuca

SEQ ID NO: 14188 - RNA, 21 nt, Artificial Sequence
  ELANE RNA Guide
uguggcuguggggacagaucg

SEQ ID NO: 14189 - RNA, 21 nt, Artificial Sequence
  ELANE RNA Guide
uugagcuguggcuguggggac

SEQ ID NO: 14190 - RNA, 22 nt, Artificial Sequence
  ELANE RNA Guide
acagccacagcucaacgggucg

SEQ ID NO: 14191 - RNA, 22 nt, Artificial Sequence
  ELANE RNA Guide
acccguugagcuguggcugugg

SEQ ID NO: 14192 - RNA, 22 nt, Artificial Sequence
  ELANE RNA Guide
acgaucuguccccacagccaca

SEQ ID NO: 14193 - RNA, 22 nt, Artificial Sequence
  ELANE RNA Guide
agcuguggcuguggggacagau

SEQ ID NO: 14194 - RNA, 22 nt, Artificial Sequence
  ELANE RNA Guide
aucuguccccacagccacagcu

SEQ ID NO: 14195 - RNA, 22 nt, Artificial Sequence
  ELANE RNA Guide
cacagccacagcucaacggguc

SEQ ID NO: 14196 - RNA, 22 nt, Artificial Sequence
  ELANE RNA Guide
cagccacagcucaacgggucgg

SEQ ID NO: 14197 - RNA, 22 nt, Artificial Sequence
  ELANE RNA Guide
ccacagccacagcucaacgggu

SEQ ID NO: 14198 - RNA, 22 nt, Artificial Sequence
  ELANE RNA Guide
cccacagccacagcucaacggg

SEQ ID NO: 14199 - RNA, 22 nt, Artificial Sequence
  ELANE RNA Guide
ccccacagccacagcucaacgg

SEQ ID NO: 14200 - RNA, 22 nt, Artificial Sequence
  ELANE RNA Guide
cccguugagcuguggcuguggg

SEQ ID NO: 14201 - RNA, 22 nt, Artificial Sequence
  ELANE RNA Guide
ccgacccguugagcuguggcug

SEQ ID NO: 14202 - RNA, 22 nt, Artificial Sequence
  ELANE RNA Guide
ccguugagcuguggcugugggg

SEQ ID NO: 14203 - RNA, 22 nt, Artificial Sequence
  ELANE RNA Guide
cgacccguugagcuguggcugu

SEQ ID NO: 14204 - RNA, 22 nt, Artificial Sequence
  ELANE RNA Guide
cgaucuguccccacagccacag

SEQ ID NO: 14205 - RNA, 22 nt, Artificial Sequence
  ELANE RNA Guide
cgcugacgaucuguccccacag

SEQ ID NO: 14206 - RNA, 22 nt, Artificial Sequence
  ELANE RNA Guide
cguugagcuguggcugugggga

SEQ ID NO: 14207 - RNA, 22 nt, Artificial Sequence
  ELANE RNA Guide
cugacgaucuguccccacagcc

SEQ ID NO: 14208 - RNA, 22 nt, Artificial Sequence
  ELANE RNA Guide
cuguccccacagccacagcuca

SEQ ID NO: 14209 - RNA, 22 nt, Artificial Sequence
  ELANE RNA Guide
cuguggcuguggggacagaucg

SEQ ID NO: 14210 - RNA, 22 nt, Artificial Sequence
  ELANE RNA Guide
cuguggggacagaucgucagcg

SEQ ID NO: 14211 - RNA, 22 nt, Artificial Sequence
  ELANE RNA Guide
gacccguugagcuguggcugug

SEQ ID NO: 14212 - RNA, 22 nt, Artificial Sequence
  ELANE RNA Guide
gacgaucuguccccacagccac

SEQ ID NO: 14213 - RNA, 22 nt, Artificial Sequence
  ELANE RNA Guide
gagcuguggcuguggggacaga

SEQ ID NO: 14214 - RNA, 22 nt, Artificial Sequence
  ELANE RNA Guide
gaucuguccccacagccacagc

SEQ ID NO: 14215 - RNA, 22 nt, Artificial Sequence
  ELANE RNA Guide
gccgacccguugagcuguggcu

SEQ ID NO: 14216 - RNA, 22 nt, Artificial Sequence
  ELANE RNA Guide
gcugacgaucuguccccacagc

SEQ ID NO: 14217 - RNA, 22 nt, Artificial Sequence
  ELANE RNA Guide
gcuguggcuguggggacagauc

SEQ ID NO: 14218 - RNA, 22 nt, Artificial Sequence
  ELANE RNA Guide
gcuguggggacagaucgucagc

SEQ ID NO: 14219 - RNA, 22 nt, Artificial Sequence
  ELANE RNA Guide
ggccgacccguugagcuguggc

SEQ ID NO: 14220 - RNA, 22 nt, Artificial Sequence
  ELANE RNA Guide
ggcuguggggacagaucgucag

SEQ ID NO: 14221 - RNA, 22 nt, Artificial Sequence
  ELANE RNA Guide
gguggccgacccguugagcugu

SEQ ID NO: 14222 - RNA, 22 nt, Artificial Sequence
  ELANE RNA Guide
guccccacagccacagcucaac

SEQ ID NO: 14223 - RNA, 22 nt, Artificial Sequence
  ELANE RNA Guide
guggccgacccguugagcugug

SEQ ID NO: 14224 - RNA, 22 nt, Artificial Sequence
  ELANE RNA Guide
guggcuguggggacagaucguc

SEQ ID NO: 14225 - RNA, 22 nt, Artificial Sequence
  ELANE RNA Guide
guugagcuguggcuguggggac

SEQ ID NO: 14226 - RNA, 22 nt, Artificial Sequence
  ELANE RNA Guide
uccccacagccacagcucaacg

SEQ ID NO: 14227 - RNA, 22 nt, Artificial Sequence
  ELANE RNA Guide
ucuguccccacagccacagcuc

SEQ ID NO: 14228 - RNA, 22 nt, Artificial Sequence
  ELANE RNA Guide
ugacgaucuguccccacagcca

SEQ ID NO: 14229 - RNA, 22 nt, Artificial Sequence
  ELANE RNA Guide
ugagcuguggcuguggggacag

SEQ ID NO: 14230 - RNA, 22 nt, Artificial Sequence
  ELANE RNA Guide
uggccgacccguugagcugugg

SEQ ID NO: 14231 - RNA, 22 nt, Artificial Sequence
  ELANE RNA Guide
uggcuguggggacagaucguca

SEQ ID NO: 14232 - RNA, 22 nt, Artificial Sequence
  ELANE RNA Guide
uguccccacagccacagcucaa

SEQ ID NO: 14233 - RNA, 22 nt, Artificial Sequence
  ELANE RNA Guide
uguggcuguggggacagaucgu

SEQ ID NO: 14234 - RNA, 22 nt, Artificial Sequence
  ELANE RNA Guide
uugagcuguggcuguggggaca

SEQ ID NO: 14235 - RNA, 20 nt, Artificial Sequence
  ELANE RNA Guide
acaccucaacgggucggcca

SEQ ID NO: 14236 - RNA, 20 nt, Artificial Sequence
  ELANE RNA Guide
acccguugagguguggcggu

SEQ ID NO: 14237 - RNA, 20 nt, Artificial Sequence
  ELANE RNA Guide
accgccacaccucaacgggu

SEQ ID NO: 14238 - RNA, 20 nt, Artificial Sequence
  ELANE RNA Guide
accucaacgggucggccacc

SEQ ID NO: 14239 - RNA, 20 nt, Artificial Sequence
  ELANE RNA Guide
acgaucuguccccaccgcca

SEQ ID NO: 14240 - RNA, 20 nt, Artificial Sequence
  ELANE RNA Guide
agguguggcgguggggacag

SEQ ID NO: 14241 - RNA, 20 nt, Artificial Sequence
  ELANE RNA Guide
aucuguccccaccgccacac

SEQ ID NO: 14242 - RNA, 20 nt, Artificial Sequence
  ELANE RNA Guide
augguggccgacccguugag

SEQ ID NO: 14243 - RNA, 20 nt, Artificial Sequence
  ELANE RNA Guide
cacaccucaacgggucggcc

SEQ ID NO: 14244 - RNA, 20 nt, Artificial Sequence
  ELANE RNA Guide
caccgccacaccucaacggg

SEQ ID NO: 14245 - RNA, 20 nt, Artificial Sequence
  ELANE RNA Guide
caccucaacgggucggccac

SEQ ID NO: 14246 - RNA, 20 nt, Artificial Sequence
  ELANE RNA Guide
ccacaccucaacgggucggc

SEQ ID NO: 14247 - RNA, 20 nt, Artificial Sequence
  ELANE RNA Guide
ccaccgccacaccucaacgg

SEQ ID NO: 14248 - RNA, 20 nt, Artificial Sequence
  ELANE RNA Guide
cccaccgccacaccucaacg

SEQ ID NO: 14249 - RNA, 20 nt, Artificial Sequence
  ELANE RNA Guide
ccccaccgccacaccucaac

SEQ ID NO: 14250 - RNA, 20 nt, Artificial Sequence
  ELANE RNA Guide
cccguugagguguggcggug

SEQ ID NO: 14251 - RNA, 20 nt, Artificial Sequence
  ELANE RNA Guide
ccgacccguugagguguggc

SEQ ID NO: 14252 - RNA, 20 nt, Artificial Sequence
  ELANE RNA Guide
ccgccacaccucaacggguc

SEQ ID NO: 14253 - RNA, 20 nt, Artificial Sequence
  ELANE RNA Guide
ccguugagguguggcggugg

SEQ ID NO: 14254 - RNA, 20 nt, Artificial Sequence
  ELANE RNA Guide
cgacccguugagguguggcg

SEQ ID NO: 14255 - RNA, 20 nt, Artificial Sequence
  ELANE RNA Guide
cgaucuguccccaccgccac

SEQ ID NO: 14256 - RNA, 20 nt, Artificial Sequence
  ELANE RNA Guide
cgccacaccucaacgggucg

SEQ ID NO: 14257 - RNA, 20 nt, Artificial Sequence
  ELANE RNA Guide
cguugagguguggcgguggg

SEQ ID NO: 14258 - RNA, 20 nt, Artificial Sequence
  ELANE RNA Guide
cuguccccaccgccacaccu

SEQ ID NO: 14259 - RNA, 20 nt, Artificial Sequence
  ELANE RNA Guide
gacccguugagguguggcgg

SEQ ID NO: 14260 - RNA, 20 nt, Artificial Sequence
  ELANE RNA Guide
gacgaucuguccccaccgcc

SEQ ID NO: 14261 - RNA, 20 nt, Artificial Sequence
  ELANE RNA Guide
gagguguggcgguggggaca

SEQ ID NO: 14262 - RNA, 20 nt, Artificial Sequence
  ELANE RNA Guide
gaucuguccccaccgccaca

SEQ ID NO: 14263 - RNA, 20 nt, Artificial Sequence
  ELANE RNA Guide
gaugguggccgacccguuga

SEQ ID NO: 14264 - RNA, 20 nt, Artificial Sequence
  ELANE RNA Guide
gccacaccucaacgggucgg

SEQ ID NO: 14265 - RNA, 20 nt, Artificial Sequence
  ELANE RNA Guide
gccgacccguugaggugugg

SEQ ID NO: 14266 - RNA, 20 nt, Artificial Sequence
  ELANE RNA Guide
ggccgacccguugaggugug

SEQ ID NO: 14267 - RNA, 20 nt, Artificial Sequence
  ELANE RNA Guide
gguggccgacccguugaggu

SEQ ID NO: 14268 - RNA, 20 nt, Artificial Sequence
  ELANE RNA Guide
gguguggcgguggggacaga

SEQ ID NO: 14269 - RNA, 20 nt, Artificial Sequence
  ELANE RNA Guide
guccccaccgccacaccuca

SEQ ID NO: 14270 - RNA, 20 nt, Artificial Sequence
  ELANE RNA Guide
guggccgacccguugaggug

SEQ ID NO: 14271 - RNA, 20 nt, Artificial Sequence
  ELANE RNA Guide
guugagguguggcggugggg

SEQ ID NO: 14272 - RNA, 20 nt, Artificial Sequence
  ELANE RNA Guide
uccccaccgccacaccucaa

SEQ ID NO: 14273 - RNA, 20 nt, Artificial Sequence
  ELANE RNA Guide
ucuguccccaccgccacacc

SEQ ID NO: 14274 - RNA, 20 nt, Artificial Sequence
  ELANE RNA Guide
ugagguguggcgguggggac

SEQ ID NO: 14275 - RNA, 20 nt, Artificial Sequence
  ELANE RNA Guide
ugaugguggccgacccguug

SEQ ID NO: 14276 - RNA, 20 nt, Artificial Sequence
  ELANE RNA Guide
uggccgacccguugaggugu

SEQ ID NO: 14277 - RNA, 20 nt, Artificial Sequence
  ELANE RNA Guide
ugguggccgacccguugagg

SEQ ID NO: 14278 - RNA, 20 nt, Artificial Sequence
  ELANE RNA Guide
uguccccaccgccacaccuc

SEQ ID NO: 14279 - RNA, 20 nt, Artificial Sequence
  ELANE RNA Guide
uugagguguggcggugggga

SEQ ID NO: 14280 - RNA, 20 nt, Artificial Sequence
  ELANE RNA Guide
uugaugguggccgacccguu

SEQ ID NO: 14281 - RNA, 21 nt, Artificial Sequence
  ELANE RNA Guide
acaccucaacgggucggccac

SEQ ID NO: 14282 - RNA, 21 nt, Artificial Sequence
  ELANE RNA Guide
acccguugagguguggcggug

SEQ ID NO: 14283 - RNA, 21 nt, Artificial Sequence
  ELANE RNA Guide
accgccacaccucaacggguc

SEQ ID NO: 14284 - RNA, 21 nt, Artificial Sequence
  ELANE RNA Guide
accucaacgggucggccacca

SEQ ID NO: 14285 - RNA, 21 nt, Artificial Sequence
  ELANE RNA Guide
acgaucuguccccaccgccac

SEQ ID NO: 14286 - RNA, 21 nt, Artificial Sequence
  ELANE RNA Guide
agguguggcgguggggacaga

SEQ ID NO: 14287 - RNA, 21 nt, Artificial Sequence
  ELANE RNA Guide
aucuguccccaccgccacacc

SEQ ID NO: 14288 - RNA, 21 nt, Artificial Sequence
  ELANE RNA Guide
augguggccgacccguugagg

SEQ ID NO: 14289 - RNA, 21 nt, Artificial Sequence
  ELANE RNA Guide
cacaccucaacgggucggcca

SEQ ID NO: 14290 - RNA, 21 nt, Artificial Sequence
  ELANE RNA Guide
caccgccacaccucaacgggu

SEQ ID NO: 14291 - RNA, 21 nt, Artificial Sequence
  ELANE RNA Guide
caccucaacgggucggccacc

SEQ ID NO: 14292 - RNA, 21 nt, Artificial Sequence
  ELANE RNA Guide
ccacaccucaacgggucggcc

SEQ ID NO: 14293 - RNA, 21 nt, Artificial Sequence
  ELANE RNA Guide
ccaccgccacaccucaacggg

SEQ ID NO: 14294 - RNA, 21 nt, Artificial Sequence
  ELANE RNA Guide
cccaccgccacaccucaacgg

SEQ ID NO: 14295 - RNA, 21 nt, Artificial Sequence
  ELANE RNA Guide
ccccaccgccacaccucaacg

SEQ ID NO: 14296 - RNA, 21 nt, Artificial Sequence
  ELANE RNA Guide
cccguugagguguggcggugg

SEQ ID NO: 14297 - RNA, 21 nt, Artificial Sequence
  ELANE RNA Guide
ccgacccguugagguguggcg

SEQ ID NO: 14298 - RNA, 21 nt, Artificial Sequence
  ELANE RNA Guide
ccgccacaccucaacgggucg

SEQ ID NO: 14299 - RNA, 21 nt, Artificial Sequence
  ELANE RNA Guide
ccguugagguguggcgguggg

SEQ ID NO: 14300 - RNA, 21 nt, Artificial Sequence
  ELANE RNA Guide
cgacccguugagguguggcgg

SEQ ID NO: 14301 - RNA, 21 nt, Artificial Sequence
  ELANE RNA Guide
cgaucuguccccaccgccaca

SEQ ID NO: 14302 - RNA, 21 nt, Artificial Sequence
  ELANE RNA Guide
cgccacaccucaacgggucgg

SEQ ID NO: 14303 - RNA, 21 nt, Artificial Sequence
  ELANE RNA Guide
cguugagguguggcggugggg

SEQ ID NO: 14304 - RNA, 21 nt, Artificial Sequence
  ELANE RNA Guide
cuguccccaccgccacaccuc

SEQ ID NO: 14305 - RNA, 21 nt, Artificial Sequence
  ELANE RNA Guide
gacccguugagguguggcggu

SEQ ID NO: 14306 - RNA, 21 nt, Artificial Sequence
  ELANE RNA Guide
gacgaucuguccccaccgcca

SEQ ID NO: 14307 - RNA, 21 nt, Artificial Sequence
  ELANE RNA Guide
gagguguggcgguggggacag

SEQ ID NO: 14308 - RNA, 21 nt, Artificial Sequence
  ELANE RNA Guide
gaucuguccccaccgccacac

SEQ ID NO: 14309 - RNA, 21 nt, Artificial Sequence
  ELANE RNA Guide
gaugguggccgacccguugag

SEQ ID NO: 14310 - RNA, 21 nt, Artificial Sequence
  ELANE RNA Guide
gccacaccucaacgggucggc

SEQ ID NO: 14311 - RNA, 21 nt, Artificial Sequence
  ELANE RNA Guide
gccgacccguugagguguggc

SEQ ID NO: 14312 - RNA, 21 nt, Artificial Sequence
  ELANE RNA Guide
ggccgacccguugaggugugg

SEQ ID NO: 14313 - RNA, 21 nt, Artificial Sequence
  ELANE RNA Guide
gguggccgacccguugaggug

SEQ ID NO: 14314 - RNA, 21 nt, Artificial Sequence
  ELANE RNA Guide
gguguggcgguggggacagau

SEQ ID NO: 14315 - RNA, 21 nt, Artificial Sequence
  ELANE RNA Guide
guccccaccgccacaccucaa

SEQ ID NO: 14316 - RNA, 21 nt, Artificial Sequence
  ELANE RNA Guide
guggccgacccguugaggugu

SEQ ID NO: 14317 - RNA, 21 nt, Artificial Sequence
  ELANE RNA Guide
guugagguguggcggugggga

SEQ ID NO: 14318 - RNA, 21 nt, Artificial Sequence
  ELANE RNA Guide
guugaugguggccgacccguu

SEQ ID NO: 14319 - RNA, 21 nt, Artificial Sequence
  ELANE RNA Guide
uccccaccgccacaccucaac

SEQ ID NO: 14320 - RNA, 21 nt, Artificial Sequence
  ELANE RNA Guide
ucuguccccaccgccacaccu

SEQ ID NO: 14321 - RNA, 21 nt, Artificial Sequence
  ELANE RNA Guide
ugacgaucuguccccaccgcc

SEQ ID NO: 14322 - RNA, 21 nt, Artificial Sequence
  ELANE RNA Guide
ugagguguggcgguggggaca

SEQ ID NO: 14323 - RNA, 21 nt, Artificial Sequence
  ELANE RNA Guide
ugaugguggccgacccguuga

SEQ ID NO: 14324 - RNA, 21 nt, Artificial Sequence
  ELANE RNA Guide
uggccgacccguugaggugug

SEQ ID NO: 14325 - RNA, 21 nt, Artificial Sequence
  ELANE RNA Guide
ugguggccgacccguugaggu

SEQ ID NO: 14326 - RNA, 21 nt, Artificial Sequence
  ELANE RNA Guide
uguccccaccgccacaccuca

SEQ ID NO: 14327 - RNA, 21 nt, Artificial Sequence
  ELANE RNA Guide
uugagguguggcgguggggac

SEQ ID NO: 14328 - RNA, 21 nt, Artificial Sequence
  ELANE RNA Guide
uugaugguggccgacccguug

SEQ ID NO: 14329 - RNA, 22 nt, Artificial Sequence
  ELANE RNA Guide
acaccucaacgggucggccacc

SEQ ID NO: 14330 - RNA, 22 nt, Artificial Sequence
  ELANE RNA Guide
acccguugagguguggcggugg

SEQ ID NO: 14331 - RNA, 22 nt, Artificial Sequence
  ELANE RNA Guide
accgccacaccucaacgggucg

SEQ ID NO: 14332 - RNA, 22 nt, Artificial Sequence
  ELANE RNA Guide
accucaacgggucggccaccau

SEQ ID NO: 14333 - RNA, 22 nt, Artificial Sequence
  ELANE RNA Guide
acgaucuguccccaccgccaca

SEQ ID NO: 14334 - RNA, 22 nt, Artificial Sequence
  ELANE RNA Guide
agguguggcgguggggacagau

SEQ ID NO: 14335 - RNA, 22 nt, Artificial Sequence
  ELANE RNA Guide
aucuguccccaccgccacaccu

SEQ ID NO: 14336 - RNA, 22 nt, Artificial Sequence
  ELANE RNA Guide
augguggccgacccguugaggu

SEQ ID NO: 14337 - RNA, 22 nt, Artificial Sequence
  ELANE RNA Guide
cacaccucaacgggucggccac

SEQ ID NO: 14338 - RNA, 22 nt, Artificial Sequence
  ELANE RNA Guide
caccgccacaccucaacggguc

SEQ ID NO: 14339 - RNA, 22 nt, Artificial Sequence
  ELANE RNA Guide
caccucaacgggucggccacca

SEQ ID NO: 14340 - RNA, 22 nt, Artificial Sequence
  ELANE RNA Guide
ccacaccucaacgggucggcca

SEQ ID NO: 14341 - RNA, 22 nt, Artificial Sequence
  ELANE RNA Guide
ccaccgccacaccucaacgggu

SEQ ID NO: 14342 - RNA, 22 nt, Artificial Sequence
  ELANE RNA Guide
cccaccgccacaccucaacggg

SEQ ID NO: 14343 - RNA, 22 nt, Artificial Sequence
  ELANE RNA Guide
ccccaccgccacaccucaacgg

SEQ ID NO: 14344 - RNA, 22 nt, Artificial Sequence
  ELANE RNA Guide
cccguugagguguggcgguggg

SEQ ID NO: 14345 - RNA, 22 nt, Artificial Sequence
  ELANE RNA Guide
ccgacccguugagguguggcgg

SEQ ID NO: 14346 - RNA, 22 nt, Artificial Sequence
  ELANE RNA Guide
ccgccacaccucaacgggucgg

SEQ ID NO: 14347 - RNA, 22 nt, Artificial Sequence
  ELANE RNA Guide
ccguugagguguggcggugggg

SEQ ID NO: 14348 - RNA, 22 nt, Artificial Sequence
  ELANE RNA Guide
cgacccguugagguguggcggu

SEQ ID NO: 14349 - RNA, 22 nt, Artificial Sequence
  ELANE RNA Guide
cgaucuguccccaccgccacac

SEQ ID NO: 14350 - RNA, 22 nt, Artificial Sequence
  ELANE RNA Guide
cgccacaccucaacgggucggc

SEQ ID NO: 14351 - RNA, 22 nt, Artificial Sequence
  ELANE RNA Guide
cguugagguguggcggugggga

SEQ ID NO: 14352 - RNA, 22 nt, Artificial Sequence
  ELANE RNA Guide
cguugaugguggccgacccguu

SEQ ID NO: 14353 - RNA, 22 nt, Artificial Sequence
  ELANE RNA Guide
cugacgaucuguccccaccgcc

SEQ ID NO: 14354 - RNA, 22 nt, Artificial Sequence
  ELANE RNA Guide
cuguccccaccgccacaccuca

SEQ ID NO: 14355 - RNA, 22 nt, Artificial Sequence
  ELANE RNA Guide
gacccguugagguguggcggug

SEQ ID NO: 14356 - RNA, 22 nt, Artificial Sequence
  ELANE RNA Guide
gacgaucuguccccaccgccac

SEQ ID NO: 14357 - RNA, 22 nt, Artificial Sequence
  ELANE RNA Guide
gagguguggcgguggggacaga

SEQ ID NO: 14358 - RNA, 22 nt, Artificial Sequence
  ELANE RNA Guide
gaucuguccccaccgccacacc

SEQ ID NO: 14359 - RNA, 22 nt, Artificial Sequence
  ELANE RNA Guide
gaugguggccgacccguugagg

SEQ ID NO: 14360 - RNA, 22 nt, Artificial Sequence
  ELANE RNA Guide
gccacaccucaacgggucggcc

SEQ ID NO: 14361 - RNA, 22 nt, Artificial Sequence
  ELANE RNA Guide
gccgacccguugagguguggcg

SEQ ID NO: 14362 - RNA, 22 nt, Artificial Sequence
  ELANE RNA Guide
ggccgacccguugagguguggc

SEQ ID NO: 14363 - RNA, 22 nt, Artificial Sequence
  ELANE RNA Guide
gguggccgacccguugaggugu

SEQ ID NO: 14364 - RNA, 22 nt, Artificial Sequence
  ELANE RNA Guide
gguguggcgguggggacagauc

SEQ ID NO: 14365 - RNA, 22 nt, Artificial Sequence
  ELANE RNA Guide
guccccaccgccacaccucaac

SEQ ID NO: 14366 - RNA, 22 nt, Artificial Sequence
  ELANE RNA Guide
guggccgacccguugaggugug

SEQ ID NO: 14367 - RNA, 22 nt, Artificial Sequence
  ELANE RNA Guide
guugagguguggcgguggggac

SEQ ID NO: 14368 - RNA, 22 nt, Artificial Sequence
  ELANE RNA Guide
guugaugguggccgacccguug

SEQ ID NO: 14369 - RNA, 22 nt, Artificial Sequence
  ELANE RNA Guide
uccccaccgccacaccucaacg

SEQ ID NO: 14370 - RNA, 22 nt, Artificial Sequence
  ELANE RNA Guide
ucuguccccaccgccacaccuc

SEQ ID NO: 14371 - RNA, 22 nt, Artificial Sequence
  ELANE RNA Guide
ugacgaucuguccccaccgcca

SEQ ID NO: 14372 - RNA, 22 nt, Artificial Sequence
  ELANE RNA Guide
ugagguguggcgguggggacag

SEQ ID NO: 14373 - RNA, 22 nt, Artificial Sequence
  ELANE RNA Guide
ugaugguggccgacccguugag

SEQ ID NO: 14374 - RNA, 22 nt, Artificial Sequence
  ELANE RNA Guide
uggccgacccguugaggugugg

SEQ ID NO: 14375 - RNA, 22 nt, Artificial Sequence
  ELANE RNA Guide
ugguggccgacccguugaggug

SEQ ID NO: 14376 - RNA, 22 nt, Artificial Sequence
  ELANE RNA Guide
uguccccaccgccacaccucaa

SEQ ID NO: 14377 - RNA, 22 nt, Artificial Sequence
  ELANE RNA Guide
uugagguguggcgguggggaca

SEQ ID NO: 14378 - RNA, 22 nt, Artificial Sequence
  ELANE RNA Guide
uugaugguggccgacccguuga

SEQ ID NO: 14379 - RNA, 20 nt, Artificial Sequence
  ELANE RNA Guide
aacuguggcgguggggacag

SEQ ID NO: 14380 - RNA, 20 nt, Artificial Sequence
  ELANE RNA Guide
acaguucaacgggucggcca

SEQ ID NO: 14381 - RNA, 20 nt, Artificial Sequence
  ELANE RNA Guide
acccguugaacuguggcggu

SEQ ID NO: 14382 - RNA, 20 nt, Artificial Sequence
  ELANE RNA Guide
accgccacaguucaacgggu

SEQ ID NO: 14383 - RNA, 20 nt, Artificial Sequence
  ELANE RNA Guide
aguucaacgggucggccacc

SEQ ID NO: 14384 - RNA, 20 nt, Artificial Sequence
  ELANE RNA Guide
aucuguccccaccgccacag

SEQ ID NO: 14385 - RNA, 20 nt, Artificial Sequence
  ELANE RNA Guide
augguggccgacccguugaa

SEQ ID NO: 14386 - RNA, 20 nt, Artificial Sequence
  ELANE RNA Guide
cacaguucaacgggucggcc

SEQ ID NO: 14387 - RNA, 20 nt, Artificial Sequence
  ELANE RNA Guide
caccgccacaguucaacggg

SEQ ID NO: 14388 - RNA, 20 nt, Artificial Sequence
  ELANE RNA Guide
caguucaacgggucggccac

SEQ ID NO: 14389 - RNA, 20 nt, Artificial Sequence
  ELANE RNA Guide
ccacaguucaacgggucggc

SEQ ID NO: 14390 - RNA, 20 nt, Artificial Sequence
  ELANE RNA Guide
ccaccgccacaguucaacgg

SEQ ID NO: 14391 - RNA, 20 nt, Artificial Sequence
  ELANE RNA Guide
cccaccgccacaguucaacg

SEQ ID NO: 14392 - RNA, 20 nt, Artificial Sequence
  ELANE RNA Guide
ccccaccgccacaguucaac

SEQ ID NO: 14393 - RNA, 20 nt, Artificial Sequence
  ELANE RNA Guide
cccguugaacuguggcggug

SEQ ID NO: 14394 - RNA, 20 nt, Artificial Sequence
  ELANE RNA Guide
ccgacccguugaacuguggc

SEQ ID NO: 14395 - RNA, 20 nt, Artificial Sequence
  ELANE RNA Guide
ccgccacaguucaacggguc

SEQ ID NO: 14396 - RNA, 20 nt, Artificial Sequence
  ELANE RNA Guide
ccguugaacuguggcggugg

SEQ ID NO: 14397 - RNA, 20 nt, Artificial Sequence
  ELANE RNA Guide
cgacccguugaacuguggcg

SEQ ID NO: 14398 - RNA, 20 nt, Artificial Sequence
  ELANE RNA Guide
cgccacaguucaacgggucg

SEQ ID NO: 14399 - RNA, 20 nt, Artificial Sequence
  ELANE RNA Guide
cguugaacuguggcgguggg

SEQ ID NO: 14400 - RNA, 20 nt, Artificial Sequence
  ELANE RNA Guide
cuguccccaccgccacaguu

SEQ ID NO: 14401 - RNA, 20 nt, Artificial Sequence
  ELANE RNA Guide
gaacuguggcgguggggaca

SEQ ID NO: 14402 - RNA, 20 nt, Artificial Sequence
  ELANE RNA Guide
gacccguugaacuguggcgg

SEQ ID NO: 14403 - RNA, 20 nt, Artificial Sequence
  ELANE RNA Guide
gccacaguucaacgggucgg

SEQ ID NO: 14404 - RNA, 20 nt, Artificial Sequence
  ELANE RNA Guide
gccgacccguugaacugugg

SEQ ID NO: 14405 - RNA, 20 nt, Artificial Sequence
  ELANE RNA Guide
ggccgacccguugaacugug

SEQ ID NO: 14406 - RNA, 20 nt, Artificial Sequence
  ELANE RNA Guide
gguggccgacccguugaacu

SEQ ID NO: 14407 - RNA, 20 nt, Artificial Sequence
  ELANE RNA Guide
guccccaccgccacaguuca

SEQ ID NO: 14408 - RNA, 20 nt, Artificial Sequence
  ELANE RNA Guide
guggccgacccguugaacug

SEQ ID NO: 14409 - RNA, 20 nt, Artificial Sequence
  ELANE RNA Guide
guucaacgggucggccacca

SEQ ID NO: 14410 - RNA, 20 nt, Artificial Sequence
  ELANE RNA Guide
guugaacuguggcggugggg

SEQ ID NO: 14411 - RNA, 20 nt, Artificial Sequence
  ELANE RNA Guide
guugaugguggccgacccgu

SEQ ID NO: 14412 - RNA, 20 nt, Artificial Sequence
  ELANE RNA Guide
uccccaccgccacaguucaa

SEQ ID NO: 14413 - RNA, 20 nt, Artificial Sequence
  ELANE RNA Guide
ucuguccccaccgccacagu

SEQ ID NO: 14414 - RNA, 20 nt, Artificial Sequence
  ELANE RNA Guide
ugaacuguggcgguggggac

SEQ ID NO: 14415 - RNA, 20 nt, Artificial Sequence
  ELANE RNA Guide
uggccgacccguugaacugu

SEQ ID NO: 14416 - RNA, 20 nt, Artificial Sequence
  ELANE RNA Guide
ugguggccgacccguugaac

SEQ ID NO: 14417 - RNA, 20 nt, Artificial Sequence
  ELANE RNA Guide
uguccccaccgccacaguuc

SEQ ID NO: 14418 - RNA, 20 nt, Artificial Sequence
  ELANE RNA Guide
uugaacuguggcggugggga

SEQ ID NO: 14419 - RNA, 21 nt, Artificial Sequence
  ELANE RNA Guide
aacuguggcgguggggacaga

SEQ ID NO: 14420 - RNA, 21 nt, Artificial Sequence
  ELANE RNA Guide
acaguucaacgggucggccac

SEQ ID NO: 14421 - RNA, 21 nt, Artificial Sequence
  ELANE RNA Guide
acccguugaacuguggcggug

SEQ ID NO: 14422 - RNA, 21 nt, Artificial Sequence
  ELANE RNA Guide
accgccacaguucaacggguc

SEQ ID NO: 14423 - RNA, 21 nt, Artificial Sequence
  ELANE RNA Guide
aguucaacgggucggccacca

SEQ ID NO: 14424 - RNA, 21 nt, Artificial Sequence
  ELANE RNA Guide
aucuguccccaccgccacagu

SEQ ID NO: 14425 - RNA, 21 nt, Artificial Sequence
  ELANE RNA Guide
augguggccgacccguugaac

SEQ ID NO: 14426 - RNA, 21 nt, Artificial Sequence
  ELANE RNA Guide
cacaguucaacgggucggcca

SEQ ID NO: 14427 - RNA, 21 nt, Artificial Sequence
  ELANE RNA Guide
caccgccacaguucaacgggu

SEQ ID NO: 14428 - RNA, 21 nt, Artificial Sequence
  ELANE RNA Guide
caguucaacgggucggccacc

SEQ ID NO: 14429 - RNA, 21 nt, Artificial Sequence
  ELANE RNA Guide
ccacaguucaacgggucggcc

SEQ ID NO: 14430 - RNA, 21 nt, Artificial Sequence
  ELANE RNA Guide
ccaccgccacaguucaacggg

SEQ ID NO: 14431 - RNA, 21 nt, Artificial Sequence
  ELANE RNA Guide
cccaccgccacaguucaacgg

SEQ ID NO: 14432 - RNA, 21 nt, Artificial Sequence
  ELANE RNA Guide
ccccaccgccacaguucaacg

SEQ ID NO: 14433 - RNA, 21 nt, Artificial Sequence
  ELANE RNA Guide
cccguugaacuguggcggugg

SEQ ID NO: 14434 - RNA, 21 nt, Artificial Sequence
  ELANE RNA Guide
ccgacccguugaacuguggcg

SEQ ID NO: 14435 - RNA, 21 nt, Artificial Sequence
  ELANE RNA Guide
ccgccacaguucaacgggucg

SEQ ID NO: 14436 - RNA, 21 nt, Artificial Sequence
  ELANE RNA Guide
ccguugaacuguggcgguggg

SEQ ID NO: 14437 - RNA, 21 nt, Artificial Sequence
  ELANE RNA Guide
cgacccguugaacuguggcgg

SEQ ID NO: 14438 - RNA, 21 nt, Artificial Sequence
  ELANE RNA Guide
cgccacaguucaacgggucgg

SEQ ID NO: 14439 - RNA, 21 nt, Artificial Sequence
  ELANE RNA Guide
cguugaacuguggcggugggg

SEQ ID NO: 14440 - RNA, 21 nt, Artificial Sequence
  ELANE RNA Guide
cguugaugguggccgacccgu

SEQ ID NO: 14441 - RNA, 21 nt, Artificial Sequence
  ELANE RNA Guide
cuguccccaccgccacaguuc

SEQ ID NO: 14442 - RNA, 21 nt, Artificial Sequence
  ELANE RNA Guide
gaacuguggcgguggggacag

SEQ ID NO: 14443 - RNA, 21 nt, Artificial Sequence
  ELANE RNA Guide
gacccguugaacuguggcggu

SEQ ID NO: 14444 - RNA, 21 nt, Artificial Sequence
  ELANE RNA Guide
gaucuguccccaccgccacag

SEQ ID NO: 14445 - RNA, 21 nt, Artificial Sequence
  ELANE RNA Guide
gaugguggccgacccguugaa

SEQ ID NO: 14446 - RNA, 21 nt, Artificial Sequence
  ELANE RNA Guide
gccacaguucaacgggucggc

SEQ ID NO: 14447 - RNA, 21 nt, Artificial Sequence
  ELANE RNA Guide
gccgacccguugaacuguggc

SEQ ID NO: 14448 - RNA, 21 nt, Artificial Sequence
  ELANE RNA Guide
ggccgacccguugaacugugg

SEQ ID NO: 14449 - RNA, 21 nt, Artificial Sequence
  ELANE RNA Guide
gguggccgacccguugaacug

SEQ ID NO: 14450 - RNA, 21 nt, Artificial Sequence
  ELANE RNA Guide
guccccaccgccacaguucaa

SEQ ID NO: 14451 - RNA, 21 nt, Artificial Sequence
  ELANE RNA Guide
guggccgacccguugaacugu

SEQ ID NO: 14452 - RNA, 21 nt, Artificial Sequence
  ELANE RNA Guide
guucaacgggucggccaccau

SEQ ID NO: 14453 - RNA, 21 nt, Artificial Sequence
  ELANE RNA Guide
guugaacuguggcggugggga

SEQ ID NO: 14454 - RNA, 21 nt, Artificial Sequence
  ELANE RNA Guide
uccccaccgccacaguucaac

SEQ ID NO: 14455 - RNA, 21 nt, Artificial Sequence
  ELANE RNA Guide
ucuguccccaccgccacaguu

SEQ ID NO: 14456 - RNA, 21 nt, Artificial Sequence
  ELANE RNA Guide
ugaacuguggcgguggggaca

SEQ ID NO: 14457 - RNA, 21 nt, Artificial Sequence
  ELANE RNA Guide
uggccgacccguugaacugug

SEQ ID NO: 14458 - RNA, 21 nt, Artificial Sequence
  ELANE RNA Guide
ugguggccgacccguugaacu

SEQ ID NO: 14459 - RNA, 21 nt, Artificial Sequence
  ELANE RNA Guide
uguccccaccgccacaguuca

SEQ ID NO: 14460 - RNA, 21 nt, Artificial Sequence
  ELANE RNA Guide
uugaacuguggcgguggggac

SEQ ID NO: 14461 - RNA, 22 nt, Artificial Sequence
  ELANE RNA Guide
aacuguggcgguggggacagau

SEQ ID NO: 14462 - RNA, 22 nt, Artificial Sequence
  ELANE RNA Guide
acaguucaacgggucggccacc

SEQ ID NO: 14463 - RNA, 22 nt, Artificial Sequence
  ELANE RNA Guide
acccguugaacuguggcggugg

SEQ ID NO: 14464 - RNA, 22 nt, Artificial Sequence
  ELANE RNA Guide
accgccacaguucaacgggucg

SEQ ID NO: 14465 - RNA, 22 nt, Artificial Sequence
  ELANE RNA Guide
aguucaacgggucggccaccau

SEQ ID NO: 14466 - RNA, 22 nt, Artificial Sequence
  ELANE RNA Guide
aucuguccccaccgccacaguu

SEQ ID NO: 14467 - RNA, 22 nt, Artificial Sequence
  ELANE RNA Guide
augguggccgacccguugaacu

SEQ ID NO: 14468 - RNA, 22 nt, Artificial Sequence
  ELANE RNA Guide
cacaguucaacgggucggccac

SEQ ID NO: 14469 - RNA, 22 nt, Artificial Sequence
  ELANE RNA Guide
caccgccacaguucaacggguc

SEQ ID NO: 14470 - RNA, 22 nt, Artificial Sequence
  ELANE RNA Guide
caguucaacgggucggccacca

SEQ ID NO: 14471 - RNA, 22 nt, Artificial Sequence
  ELANE RNA Guide
ccacaguucaacgggucggcca

SEQ ID NO: 14472 - RNA, 22 nt, Artificial Sequence
  ELANE RNA Guide
ccaccgccacaguucaacgggu

SEQ ID NO: 14473 - RNA, 22 nt, Artificial Sequence
  ELANE RNA Guide
cccaccgccacaguucaacggg

SEQ ID NO: 14474 - RNA, 22 nt, Artificial Sequence
  ELANE RNA Guide
ccccaccgccacaguucaacgg

SEQ ID NO: 14475 - RNA, 22 nt, Artificial Sequence
  ELANE RNA Guide
cccguugaacuguggcgguggg

SEQ ID NO: 14476 - RNA, 22 nt, Artificial Sequence
  ELANE RNA Guide
ccgacccguugaacuguggcgg

SEQ ID NO: 14477 - RNA, 22 nt, Artificial Sequence
  ELANE RNA Guide
ccgccacaguucaacgggucgg

SEQ ID NO: 14478 - RNA, 22 nt, Artificial Sequence
  ELANE RNA Guide
ccguugaacuguggcggugggg

SEQ ID NO: 14479 - RNA, 22 nt, Artificial Sequence
  ELANE RNA Guide
cgacccguugaacuguggcggu

SEQ ID NO: 14480 - RNA, 22 nt, Artificial Sequence
  ELANE RNA Guide
cgaucuguccccaccgccacag

SEQ ID NO: 14481 - RNA, 22 nt, Artificial Sequence
  ELANE RNA Guide
cgccacaguucaacgggucggc

SEQ ID NO: 14482 - RNA, 22 nt, Artificial Sequence
  ELANE RNA Guide
cguugaacuguggcggugggga

SEQ ID NO: 14483 - RNA, 22 nt, Artificial Sequence
  ELANE RNA Guide
cuguccccaccgccacaguuca

SEQ ID NO: 14484 - RNA, 22 nt, Artificial Sequence
  ELANE RNA Guide
gaacuguggcgguggggacaga

SEQ ID NO: 14485 - RNA, 22 nt, Artificial Sequence
  ELANE RNA Guide
gacccguugaacuguggcggug

SEQ ID NO: 14486 - RNA, 22 nt, Artificial Sequence
  ELANE RNA Guide
gaucuguccccaccgccacagu

SEQ ID NO: 14487 - RNA, 22 nt, Artificial Sequence
  ELANE RNA Guide
gaugguggccgacccguugaac

SEQ ID NO: 14488 - RNA, 22 nt, Artificial Sequence
  ELANE RNA Guide
gccacaguucaacgggucggcc

SEQ ID NO: 14489 - RNA, 22 nt, Artificial Sequence
  ELANE RNA Guide
gccgacccguugaacuguggcg

SEQ ID NO: 14490 - RNA, 22 nt, Artificial Sequence
  ELANE RNA Guide
gcguugaugguggccgacccgu

SEQ ID NO: 14491 - RNA, 22 nt, Artificial Sequence
  ELANE RNA Guide
ggccgacccguugaacuguggc

SEQ ID NO: 14492 - RNA, 22 nt, Artificial Sequence
  ELANE RNA Guide
gguggccgacccguugaacugu

SEQ ID NO: 14493 - RNA, 22 nt, Artificial Sequence
  ELANE RNA Guide
guccccaccgccacaguucaac

SEQ ID NO: 14494 - RNA, 22 nt, Artificial Sequence
  ELANE RNA Guide
guggccgacccguugaacugug

SEQ ID NO: 14495 - RNA, 22 nt, Artificial Sequence
  ELANE RNA Guide
guucaacgggucggccaccauc

SEQ ID NO: 14496 - RNA, 22 nt, Artificial Sequence
  ELANE RNA Guide
guugaacuguggcgguggggac

SEQ ID NO: 14497 - RNA, 22 nt, Artificial Sequence
  ELANE RNA Guide
uccccaccgccacaguucaacg

SEQ ID NO: 14498 - RNA, 22 nt, Artificial Sequence
  ELANE RNA Guide
ucuguccccaccgccacaguuc

SEQ ID NO: 14499 - RNA, 22 nt, Artificial Sequence
  ELANE RNA Guide
ugaacuguggcgguggggacag

SEQ ID NO: 14500 - RNA, 22 nt, Artificial Sequence
  ELANE RNA Guide
ugaugguggccgacccguugaa

SEQ ID NO: 14501 - RNA, 22 nt, Artificial Sequence
  ELANE RNA Guide
uggccgacccguugaacugugg

SEQ ID NO: 14502 - RNA, 22 nt, Artificial Sequence
  ELANE RNA Guide
ugguggccgacccguugaacug

SEQ ID NO: 14503 - RNA, 22 nt, Artificial Sequence
  ELANE RNA Guide
uguccccaccgccacaguucaa

SEQ ID NO: 14504 - RNA, 22 nt, Artificial Sequence
  ELANE RNA Guide
uugaacuguggcgguggggaca

SEQ ID NO: 14505 - RNA, 20 nt, Artificial Sequence
  ELANE RNA Guide
acagcacaacgggucggcca

SEQ ID NO: 14506 - RNA, 20 nt, Artificial Sequence
  ELANE RNA Guide
acccguugugcuguggcggu

SEQ ID NO: 14507 - RNA, 20 nt, Artificial Sequence
  ELANE RNA Guide
accgccacagcacaacgggu

SEQ ID NO: 14508 - RNA, 20 nt, Artificial Sequence
  ELANE RNA Guide
agcacaacgggucggccacc

SEQ ID NO: 14509 - RNA, 20 nt, Artificial Sequence
  ELANE RNA Guide
augguggccgacccguugug

SEQ ID NO: 14510 - RNA, 20 nt, Artificial Sequence
  ELANE RNA Guide
cacaacgggucggccaccau

SEQ ID NO: 14511 - RNA, 20 nt, Artificial Sequence
  ELANE RNA Guide
cacagcacaacgggucggcc

SEQ ID NO: 14512 - RNA, 20 nt, Artificial Sequence
  ELANE RNA Guide
caccgccacagcacaacggg

SEQ ID NO: 14513 - RNA, 20 nt, Artificial Sequence
  ELANE RNA Guide
cagcacaacgggucggccac

SEQ ID NO: 14514 - RNA, 20 nt, Artificial Sequence
  ELANE RNA Guide
ccacagcacaacgggucggc

SEQ ID NO: 14515 - RNA, 20 nt, Artificial Sequence
  ELANE RNA Guide
ccaccgccacagcacaacgg

SEQ ID NO: 14516 - RNA, 20 nt, Artificial Sequence
  ELANE RNA Guide
cccaccgccacagcacaacg

SEQ ID NO: 14517 - RNA, 20 nt, Artificial Sequence
  ELANE RNA Guide
ccccaccgccacagcacaac

SEQ ID NO: 14518 - RNA, 20 nt, Artificial Sequence
  ELANE RNA Guide
cccguugugcuguggcggug

SEQ ID NO: 14519 - RNA, 20 nt, Artificial Sequence
  ELANE RNA Guide
ccgacccguugugcuguggc

SEQ ID NO: 14520 - RNA, 20 nt, Artificial Sequence
  ELANE RNA Guide
ccgccacagcacaacggguc

SEQ ID NO: 14521 - RNA, 20 nt, Artificial Sequence
  ELANE RNA Guide
ccguugugcuguggcggugg

SEQ ID NO: 14522 - RNA, 20 nt, Artificial Sequence
  ELANE RNA Guide
cgacccguugugcuguggcg

SEQ ID NO: 14523 - RNA, 20 nt, Artificial Sequence
  ELANE RNA Guide
cgccacagcacaacgggucg

SEQ ID NO: 14524 - RNA, 20 nt, Artificial Sequence
  ELANE RNA Guide
cguugaugguggccgacccg

SEQ ID NO: 14525 - RNA, 20 nt, Artificial Sequence
  ELANE RNA Guide
cguugugcuguggcgguggg

SEQ ID NO: 14526 - RNA, 20 nt, Artificial Sequence
  ELANE RNA Guide
cuguccccaccgccacagca

SEQ ID NO: 14527 - RNA, 20 nt, Artificial Sequence
  ELANE RNA Guide
gacccguugugcuguggcgg

SEQ ID NO: 14528 - RNA, 20 nt, Artificial Sequence
  ELANE RNA Guide
gaugguggccgacccguugu

SEQ ID NO: 14529 - RNA, 20 nt, Artificial Sequence
  ELANE RNA Guide
gcacaacgggucggccacca

SEQ ID NO: 14530 - RNA, 20 nt, Artificial Sequence
  ELANE RNA Guide
gccacagcacaacgggucgg

SEQ ID NO: 14531 - RNA, 20 nt, Artificial Sequence
  ELANE RNA Guide
gccgacccguugugcugugg

SEQ ID NO: 14532 - RNA, 20 nt, Artificial Sequence
  ELANE RNA Guide
ggccgacccguugugcugug

SEQ ID NO: 14533 - RNA, 20 nt, Artificial Sequence
  ELANE RNA Guide
gguggccgacccguugugcu

SEQ ID NO: 14534 - RNA, 20 nt, Artificial Sequence
  ELANE RNA Guide
guccccaccgccacagcaca

SEQ ID NO: 14535 - RNA, 20 nt, Artificial Sequence
  ELANE RNA Guide
gugcuguggcgguggggaca

SEQ ID NO: 14536 - RNA, 20 nt, Artificial Sequence
  ELANE RNA Guide
guggccgacccguugugcug

SEQ ID NO: 14537 - RNA, 20 nt, Artificial Sequence
  ELANE RNA Guide
guugugcuguggcggugggg

SEQ ID NO: 14538 - RNA, 20 nt, Artificial Sequence
  ELANE RNA Guide
uccccaccgccacagcacaa

SEQ ID NO: 14539 - RNA, 20 nt, Artificial Sequence
  ELANE RNA Guide
ucuguccccaccgccacagc

SEQ ID NO: 14540 - RNA, 20 nt, Artificial Sequence
  ELANE RNA Guide
uggccgacccguugugcugu

SEQ ID NO: 14541 - RNA, 20 nt, Artificial Sequence
  ELANE RNA Guide
ugguggccgacccguugugc

SEQ ID NO: 14542 - RNA, 20 nt, Artificial Sequence
  ELANE RNA Guide
uguccccaccgccacagcac

SEQ ID NO: 14543 - RNA, 20 nt, Artificial Sequence
  ELANE RNA Guide
ugugcuguggcgguggggac

SEQ ID NO: 14544 - RNA, 20 nt, Artificial Sequence
  ELANE RNA Guide
uugugcuguggcggugggga

SEQ ID NO: 14545 - RNA, 21 nt, Artificial Sequence
  ELANE RNA Guide
acagcacaacgggucggccac

SEQ ID NO: 14546 - RNA, 21 nt, Artificial Sequence
  ELANE RNA Guide
acccguugugcuguggcggug

SEQ ID NO: 14547 - RNA, 21 nt, Artificial Sequence
  ELANE RNA Guide
accgccacagcacaacggguc

SEQ ID NO: 14548 - RNA, 21 nt, Artificial Sequence
  ELANE RNA Guide
agcacaacgggucggccacca

SEQ ID NO: 14549 - RNA, 21 nt, Artificial Sequence
  ELANE RNA Guide
aucuguccccaccgccacagc

SEQ ID NO: 14550 - RNA, 21 nt, Artificial Sequence
  ELANE RNA Guide
augguggccgacccguugugc

SEQ ID NO: 14551 - RNA, 21 nt, Artificial Sequence
  ELANE RNA Guide
cacaacgggucggccaccauc

SEQ ID NO: 14552 - RNA, 21 nt, Artificial Sequence
  ELANE RNA Guide
cacagcacaacgggucggcca

SEQ ID NO: 14553 - RNA, 21 nt, Artificial Sequence
  ELANE RNA Guide
caccgccacagcacaacgggu

SEQ ID NO: 14554 - RNA, 21 nt, Artificial Sequence
  ELANE RNA Guide
cagcacaacgggucggccacc

SEQ ID NO: 14555 - RNA, 21 nt, Artificial Sequence
  ELANE RNA Guide
ccacagcacaacgggucggcc

SEQ ID NO: 14556 - RNA, 21 nt, Artificial Sequence
  ELANE RNA Guide
ccaccgccacagcacaacggg

SEQ ID NO: 14557 - RNA, 21 nt, Artificial Sequence
  ELANE RNA Guide
cccaccgccacagcacaacgg

SEQ ID NO: 14558 - RNA, 21 nt, Artificial Sequence
  ELANE RNA Guide
ccccaccgccacagcacaacg

SEQ ID NO: 14559 - RNA, 21 nt, Artificial Sequence
  ELANE RNA Guide
cccguugugcuguggcggugg

SEQ ID NO: 14560 - RNA, 21 nt, Artificial Sequence
  ELANE RNA Guide
ccgacccguugugcuguggcg

SEQ ID NO: 14561 - RNA, 21 nt, Artificial Sequence
  ELANE RNA Guide
ccgccacagcacaacgggucg

SEQ ID NO: 14562 - RNA, 21 nt, Artificial Sequence
  ELANE RNA Guide
ccguugugcuguggcgguggg

SEQ ID NO: 14563 - RNA, 21 nt, Artificial Sequence
  ELANE RNA Guide
cgacccguugugcuguggcgg

SEQ ID NO: 14564 - RNA, 21 nt, Artificial Sequence
  ELANE RNA Guide
cgccacagcacaacgggucgg

SEQ ID NO: 14565 - RNA, 21 nt, Artificial Sequence
  ELANE RNA Guide
cguugugcuguggcggugggg

SEQ ID NO: 14566 - RNA, 21 nt, Artificial Sequence
  ELANE RNA Guide
cuguccccaccgccacagcac

SEQ ID NO: 14567 - RNA, 21 nt, Artificial Sequence
  ELANE RNA Guide
gacccguugugcuguggcggu

SEQ ID NO: 14568 - RNA, 21 nt, Artificial Sequence
  ELANE RNA Guide
gaugguggccgacccguugug

SEQ ID NO: 14569 - RNA, 21 nt, Artificial Sequence
  ELANE RNA Guide
gcacaacgggucggccaccau

SEQ ID NO: 14570 - RNA, 21 nt, Artificial Sequence
  ELANE RNA Guide
gccacagcacaacgggucggc

SEQ ID NO: 14571 - RNA, 21 nt, Artificial Sequence
  ELANE RNA Guide
gccgacccguugugcuguggc

SEQ ID NO: 14572 - RNA, 21 nt, Artificial Sequence
  ELANE RNA Guide
gcguugaugguggccgacccg

SEQ ID NO: 14573 - RNA, 21 nt, Artificial Sequence
  ELANE RNA Guide
ggccgacccguugugcugugg

SEQ ID NO: 14574 - RNA, 21 nt, Artificial Sequence
  ELANE RNA Guide
gguggccgacccguugugcug

SEQ ID NO: 14575 - RNA, 21 nt, Artificial Sequence
  ELANE RNA Guide
guccccaccgccacagcacaa

SEQ ID NO: 14576 - RNA, 21 nt, Artificial Sequence
  ELANE RNA Guide
gugcuguggcgguggggacag

SEQ ID NO: 14577 - RNA, 21 nt, Artificial Sequence
  ELANE RNA Guide
guggccgacccguugugcugu

SEQ ID NO: 14578 - RNA, 21 nt, Artificial Sequence
  ELANE RNA Guide
guugugcuguggcggugggga

SEQ ID NO: 14579 - RNA, 21 nt, Artificial Sequence
  ELANE RNA Guide
uccccaccgccacagcacaac

SEQ ID NO: 14580 - RNA, 21 nt, Artificial Sequence
  ELANE RNA Guide
ucuguccccaccgccacagca

SEQ ID NO: 14581 - RNA, 21 nt, Artificial Sequence
  ELANE RNA Guide
ugaugguggccgacccguugu

SEQ ID NO: 14582 - RNA, 21 nt, Artificial Sequence
  ELANE RNA Guide
uggccgacccguugugcugug

SEQ ID NO: 14583 - RNA, 21 nt, Artificial Sequence
  ELANE RNA Guide
ugguggccgacccguugugcu

SEQ ID NO: 14584 - RNA, 21 nt, Artificial Sequence
  ELANE RNA Guide
uguccccaccgccacagcaca

SEQ ID NO: 14585 - RNA, 21 nt, Artificial Sequence
  ELANE RNA Guide
ugugcuguggcgguggggaca

SEQ ID NO: 14586 - RNA, 21 nt, Artificial Sequence
  ELANE RNA Guide
uugugcuguggcgguggggac

SEQ ID NO: 14587 - RNA, 22 nt, Artificial Sequence
  ELANE RNA Guide
acagcacaacgggucggccacc

SEQ ID NO: 14588 - RNA, 22 nt, Artificial Sequence
  ELANE RNA Guide
acccguugugcuguggcggugg

SEQ ID NO: 14589 - RNA, 22 nt, Artificial Sequence
  ELANE RNA Guide
accgccacagcacaacgggucg

SEQ ID NO: 14590 - RNA, 22 nt, Artificial Sequence
  ELANE RNA Guide
agcacaacgggucggccaccau

SEQ ID NO: 14591 - RNA, 22 nt, Artificial Sequence
  ELANE RNA Guide
aucuguccccaccgccacagca

SEQ ID NO: 14592 - RNA, 22 nt, Artificial Sequence
  ELANE RNA Guide
augguggccgacccguugugcu

SEQ ID NO: 14593 - RNA, 22 nt, Artificial Sequence
  ELANE RNA Guide
cacaacgggucggccaccauca

SEQ ID NO: 14594 - RNA, 22 nt, Artificial Sequence
  ELANE RNA Guide
cacagcacaacgggucggccac

SEQ ID NO: 14595 - RNA, 22 nt, Artificial Sequence
  ELANE RNA Guide
caccgccacagcacaacggguc

SEQ ID NO: 14596 - RNA, 22 nt, Artificial Sequence
  ELANE RNA Guide
cagcacaacgggucggccacca

SEQ ID NO: 14597 - RNA, 22 nt, Artificial Sequence
  ELANE RNA Guide
ccacagcacaacgggucggcca

SEQ ID NO: 14598 - RNA, 22 nt, Artificial Sequence
  ELANE RNA Guide
ccaccgccacagcacaacgggu

SEQ ID NO: 14599 - RNA, 22 nt, Artificial Sequence
  ELANE RNA Guide
cccaccgccacagcacaacggg

SEQ ID NO: 14600 - RNA, 22 nt, Artificial Sequence
  ELANE RNA Guide
ccccaccgccacagcacaacgg

SEQ ID NO: 14601 - RNA, 22 nt, Artificial Sequence
  ELANE RNA Guide
cccguugugcuguggcgguggg

SEQ ID NO: 14602 - RNA, 22 nt, Artificial Sequence
  ELANE RNA Guide
ccgacccguugugcuguggcgg

SEQ ID NO: 14603 - RNA, 22 nt, Artificial Sequence
  ELANE RNA Guide
ccgccacagcacaacgggucgg

SEQ ID NO: 14604 - RNA, 22 nt, Artificial Sequence
  ELANE RNA Guide
ccguugugcuguggcggugggg

SEQ ID NO: 14605 - RNA, 22 nt, Artificial Sequence
  ELANE RNA Guide
cgacccguugugcuguggcggu

SEQ ID NO: 14606 - RNA, 22 nt, Artificial Sequence
  ELANE RNA Guide
cgccacagcacaacgggucggc

SEQ ID NO: 14607 - RNA, 22 nt, Artificial Sequence
  ELANE RNA Guide
cguugugcuguggcggugggga

SEQ ID NO: 14608 - RNA, 22 nt, Artificial Sequence
  ELANE RNA Guide
cuguccccaccgccacagcaca

SEQ ID NO: 14609 - RNA, 22 nt, Artificial Sequence
  ELANE RNA Guide
gacccguugugcuguggcggug

SEQ ID NO: 14610 - RNA, 22 nt, Artificial Sequence
  ELANE RNA Guide
gaucuguccccaccgccacagc

SEQ ID NO: 14611 - RNA, 22 nt, Artificial Sequence
  ELANE RNA Guide
gaugguggccgacccguugugc

SEQ ID NO: 14612 - RNA, 22 nt, Artificial Sequence
  ELANE RNA Guide
gcacaacgggucggccaccauc

SEQ ID NO: 14613 - RNA, 22 nt, Artificial Sequence
  ELANE RNA Guide
gccacagcacaacgggucggcc

SEQ ID NO: 14614 - RNA, 22 nt, Artificial Sequence
  ELANE RNA Guide
gccgacccguugugcuguggcg

SEQ ID NO: 14615 - RNA, 22 nt, Artificial Sequence
  ELANE RNA Guide
ggccgacccguugugcuguggc

SEQ ID NO: 14616 - RNA, 22 nt, Artificial Sequence
  ELANE RNA Guide
ggcguugaugguggccgacccg

SEQ ID NO: 14617 - RNA, 22 nt, Artificial Sequence
  ELANE RNA Guide
gguggccgacccguugugcugu

SEQ ID NO: 14618 - RNA, 22 nt, Artificial Sequence
  ELANE RNA Guide
guccccaccgccacagcacaac

SEQ ID NO: 14619 - RNA, 22 nt, Artificial Sequence
  ELANE RNA Guide
gugcuguggcgguggggacaga

SEQ ID NO: 14620 - RNA, 22 nt, Artificial Sequence
  ELANE RNA Guide
guggccgacccguugugcugug

SEQ ID NO: 14621 - RNA, 22 nt, Artificial Sequence
  ELANE RNA Guide
guugugcuguggcgguggggac

SEQ ID NO: 14622 - RNA, 22 nt, Artificial Sequence
  ELANE RNA Guide
uccccaccgccacagcacaacg

SEQ ID NO: 14623 - RNA, 22 nt, Artificial Sequence
  ELANE RNA Guide
ucuguccccaccgccacagcac

SEQ ID NO: 14624 - RNA, 22 nt, Artificial Sequence
  ELANE RNA Guide
ugaugguggccgacccguugug

SEQ ID NO: 14625 - RNA, 22 nt, Artificial Sequence
  ELANE RNA Guide
uggccgacccguugugcugugg

SEQ ID NO: 14626 - RNA, 22 nt, Artificial Sequence
  ELANE RNA Guide
ugguggccgacccguugugcug

SEQ ID NO: 14627 - RNA, 22 nt, Artificial Sequence
  ELANE RNA Guide
uguccccaccgccacagcacaa

SEQ ID NO: 14628 - RNA, 22 nt, Artificial Sequence
  ELANE RNA Guide
ugugcuguggcgguggggacag

SEQ ID NO: 14629 - RNA, 22 nt, Artificial Sequence
  ELANE RNA Guide
uugaugguggccgacccguugu

SEQ ID NO: 14630 - RNA, 22 nt, Artificial Sequence
  ELANE RNA Guide
uugugcuguggcgguggggaca

SEQ ID NO: 14631 - RNA, 20 nt, Artificial Sequence
  ELANE RNA Guide
acagcucaucgggucggcca

SEQ ID NO: 14632 - RNA, 20 nt, Artificial Sequence
  ELANE RNA Guide
acccgaugagcuguggcggu

SEQ ID NO: 14633 - RNA, 20 nt, Artificial Sequence
  ELANE RNA Guide
accgccacagcucaucgggu

SEQ ID NO: 14634 - RNA, 20 nt, Artificial Sequence
  ELANE RNA Guide
agcucaucgggucggccacc

SEQ ID NO: 14635 - RNA, 20 nt, Artificial Sequence
  ELANE RNA Guide
aucgggucggccaccaucaa

SEQ ID NO: 14636 - RNA, 20 nt, Artificial Sequence
  ELANE RNA Guide
augguggccgacccgaugag

SEQ ID NO: 14637 - RNA, 20 nt, Artificial Sequence
  ELANE RNA Guide
cacagcucaucgggucggcc

SEQ ID NO: 14638 - RNA, 20 nt, Artificial Sequence
  ELANE RNA Guide
caccgccacagcucaucggg

SEQ ID NO: 14639 - RNA, 20 nt, Artificial Sequence
  ELANE RNA Guide
cagcucaucgggucggccac

SEQ ID NO: 14640 - RNA, 20 nt, Artificial Sequence
  ELANE RNA Guide
caucgggucggccaccauca

SEQ ID NO: 14641 - RNA, 20 nt, Artificial Sequence
  ELANE RNA Guide
ccacagcucaucgggucggc

SEQ ID NO: 14642 - RNA, 20 nt, Artificial Sequence
  ELANE RNA Guide
ccaccgccacagcucaucgg

SEQ ID NO: 14643 - RNA, 20 nt, Artificial Sequence
  ELANE RNA Guide
cccaccgccacagcucaucg

SEQ ID NO: 14644 - RNA, 20 nt, Artificial Sequence
  ELANE RNA Guide
ccccaccgccacagcucauc

SEQ ID NO: 14645 - RNA, 20 nt, Artificial Sequence
  ELANE RNA Guide
cccgaugagcuguggcggug

SEQ ID NO: 14646 - RNA, 20 nt, Artificial Sequence
  ELANE RNA Guide
ccgacccgaugagcuguggc

SEQ ID NO: 14647 - RNA, 20 nt, Artificial Sequence
  ELANE RNA Guide
ccgaugagcuguggcggugg

SEQ ID NO: 14648 - RNA, 20 nt, Artificial Sequence
  ELANE RNA Guide
ccgccacagcucaucggguc

SEQ ID NO: 14649 - RNA, 20 nt, Artificial Sequence
  ELANE RNA Guide
cgacccgaugagcuguggcg

SEQ ID NO: 14650 - RNA, 20 nt, Artificial Sequence
  ELANE RNA Guide
cgaugagcuguggcgguggg

SEQ ID NO: 14651 - RNA, 20 nt, Artificial Sequence
  ELANE RNA Guide
cgccacagcucaucgggucg

SEQ ID NO: 14652 - RNA, 20 nt, Artificial Sequence
  ELANE RNA Guide
cucaucgggucggccaccau

SEQ ID NO: 14653 - RNA, 20 nt, Artificial Sequence
  ELANE RNA Guide
cuguccccaccgccacagcu

SEQ ID NO: 14654 - RNA, 20 nt, Artificial Sequence
  ELANE RNA Guide
gacccgaugagcuguggcgg

SEQ ID NO: 14655 - RNA, 20 nt, Artificial Sequence
  ELANE RNA Guide
gaugagcuguggcggugggg

SEQ ID NO: 14656 - RNA, 20 nt, Artificial Sequence
  ELANE RNA Guide
gaugguggccgacccgauga

SEQ ID NO: 14657 - RNA, 20 nt, Artificial Sequence
  ELANE RNA Guide
gccacagcucaucgggucgg

SEQ ID NO: 14658 - RNA, 20 nt, Artificial Sequence
  ELANE RNA Guide
gccgacccgaugagcugugg

SEQ ID NO: 14659 - RNA, 20 nt, Artificial Sequence
  ELANE RNA Guide
gcguugaugguggccgaccc

SEQ ID NO: 14660 - RNA, 20 nt, Artificial Sequence
  ELANE RNA Guide
gcucaucgggucggccacca

SEQ ID NO: 14661 - RNA, 20 nt, Artificial Sequence
  ELANE RNA Guide
ggccgacccgaugagcugug

SEQ ID NO: 14662 - RNA, 20 nt, Artificial Sequence
  ELANE RNA Guide
ggcguugaugguggccgacc

SEQ ID NO: 14663 - RNA, 20 nt, Artificial Sequence
  ELANE RNA Guide
gguggccgacccgaugagcu

SEQ ID NO: 14664 - RNA, 20 nt, Artificial Sequence
  ELANE RNA Guide
guccccaccgccacagcuca

SEQ ID NO: 14665 - RNA, 20 nt, Artificial Sequence
  ELANE RNA Guide
guggccgacccgaugagcug

SEQ ID NO: 14666 - RNA, 20 nt, Artificial Sequence
  ELANE RNA Guide
guugaugguggccgacccga

SEQ ID NO: 14667 - RNA, 20 nt, Artificial Sequence
  ELANE RNA Guide
ucaucgggucggccaccauc

SEQ ID NO: 14668 - RNA, 20 nt, Artificial Sequence
  ELANE RNA Guide
uccccaccgccacagcucau

SEQ ID NO: 14669 - RNA, 20 nt, Artificial Sequence
  ELANE RNA Guide
ugaugguggccgacccgaug

SEQ ID NO: 14670 - RNA, 20 nt, Artificial Sequence
  ELANE RNA Guide
uggccgacccgaugagcugu

SEQ ID NO: 14671 - RNA, 20 nt, Artificial Sequence
  ELANE RNA Guide
uggcguugaugguggccgac

SEQ ID NO: 14672 - RNA, 20 nt, Artificial Sequence
  ELANE RNA Guide
ugguggccgacccgaugagc

SEQ ID NO: 14673 - RNA, 20 nt, Artificial Sequence
  ELANE RNA Guide
uguccccaccgccacagcuc

SEQ ID NO: 14674 - RNA, 20 nt, Artificial Sequence
  ELANE RNA Guide
uugaugguggccgacccgau

SEQ ID NO: 14675 - RNA, 21 nt, Artificial Sequence
  ELANE RNA Guide
acagcucaucgggucggccac

SEQ ID NO: 14676 - RNA, 21 nt, Artificial Sequence
  ELANE RNA Guide
acccgaugagcuguggcggug

SEQ ID NO: 14677 - RNA, 21 nt, Artificial Sequence
  ELANE RNA Guide
accgccacagcucaucggguc

SEQ ID NO: 14678 - RNA, 21 nt, Artificial Sequence
  ELANE RNA Guide
agcucaucgggucggccacca

SEQ ID NO: 14679 - RNA, 21 nt, Artificial Sequence
  ELANE RNA Guide
aucgggucggccaccaucaac

SEQ ID NO: 14680 - RNA, 21 nt, Artificial Sequence
  ELANE RNA Guide
augguggccgacccgaugagc

SEQ ID NO: 14681 - RNA, 21 nt, Artificial Sequence
  ELANE RNA Guide
cacagcucaucgggucggcca

SEQ ID NO: 14682 - RNA, 21 nt, Artificial Sequence
  ELANE RNA Guide
caccgccacagcucaucgggu

SEQ ID NO: 14683 - RNA, 21 nt, Artificial Sequence
  ELANE RNA Guide
cagcucaucgggucggccacc

SEQ ID NO: 14684 - RNA, 21 nt, Artificial Sequence
  ELANE RNA Guide
caucgggucggccaccaucaa

SEQ ID NO: 14685 - RNA, 21 nt, Artificial Sequence
  ELANE RNA Guide
ccacagcucaucgggucggcc

SEQ ID NO: 14686 - RNA, 21 nt, Artificial Sequence
  ELANE RNA Guide
ccaccgccacagcucaucggg

SEQ ID NO: 14687 - RNA, 21 nt, Artificial Sequence
  ELANE RNA Guide
cccaccgccacagcucaucgg

SEQ ID NO: 14688 - RNA, 21 nt, Artificial Sequence
  ELANE RNA Guide
ccccaccgccacagcucaucg

SEQ ID NO: 14689 - RNA, 21 nt, Artificial Sequence
  ELANE RNA Guide
cccgaugagcuguggcggugg

SEQ ID NO: 14690 - RNA, 21 nt, Artificial Sequence
  ELANE RNA Guide
ccgacccgaugagcuguggcg

SEQ ID NO: 14691 - RNA, 21 nt, Artificial Sequence
  ELANE RNA Guide
ccgaugagcuguggcgguggg

SEQ ID NO: 14692 - RNA, 21 nt, Artificial Sequence
  ELANE RNA Guide
ccgccacagcucaucgggucg

SEQ ID NO: 14693 - RNA, 21 nt, Artificial Sequence
  ELANE RNA Guide
cgacccgaugagcuguggcgg

SEQ ID NO: 14694 - RNA, 21 nt, Artificial Sequence
  ELANE RNA Guide
cgaugagcuguggcggugggg

SEQ ID NO: 14695 - RNA, 21 nt, Artificial Sequence
  ELANE RNA Guide
cgccacagcucaucgggucgg

SEQ ID NO: 14696 - RNA, 21 nt, Artificial Sequence
  ELANE RNA Guide
cguugaugguggccgacccga

SEQ ID NO: 14697 - RNA, 21 nt, Artificial Sequence
  ELANE RNA Guide
cucaucgggucggccaccauc

SEQ ID NO: 14698 - RNA, 21 nt, Artificial Sequence
  ELANE RNA Guide
cuguccccaccgccacagcuc

SEQ ID NO: 14699 - RNA, 21 nt, Artificial Sequence
  ELANE RNA Guide
gacccgaugagcuguggcggu

SEQ ID NO: 14700 - RNA, 21 nt, Artificial Sequence
  ELANE RNA Guide
gaugagcuguggcggugggga

SEQ ID NO: 14701 - RNA, 21 nt, Artificial Sequence
  ELANE RNA Guide
gaugguggccgacccgaugag

SEQ ID NO: 14702 - RNA, 21 nt, Artificial Sequence
  ELANE RNA Guide
gccacagcucaucgggucggc

SEQ ID NO: 14703 - RNA, 21 nt, Artificial Sequence
  ELANE RNA Guide
gccgacccgaugagcuguggc

SEQ ID NO: 14704 - RNA, 21 nt, Artificial Sequence
  ELANE RNA Guide
gcucaucgggucggccaccau

SEQ ID NO: 14705 - RNA, 21 nt, Artificial Sequence
  ELANE RNA Guide
ggccgacccgaugagcugugg

SEQ ID NO: 14706 - RNA, 21 nt, Artificial Sequence
  ELANE RNA Guide
ggcguugaugguggccgaccc

SEQ ID NO: 14707 - RNA, 21 nt, Artificial Sequence
  ELANE RNA Guide
gguggccgacccgaugagcug

SEQ ID NO: 14708 - RNA, 21 nt, Artificial Sequence
  ELANE RNA Guide
guccccaccgccacagcucau

SEQ ID NO: 14709 - RNA, 21 nt, Artificial Sequence
  ELANE RNA Guide
guggccgacccgaugagcugu

SEQ ID NO: 14710 - RNA, 21 nt, Artificial Sequence
  ELANE RNA Guide
guugaugguggccgacccgau

SEQ ID NO: 14711 - RNA, 21 nt, Artificial Sequence
  ELANE RNA Guide
ucaucgggucggccaccauca

SEQ ID NO: 14712 - RNA, 21 nt, Artificial Sequence
  ELANE RNA Guide
uccccaccgccacagcucauc

SEQ ID NO: 14713 - RNA, 21 nt, Artificial Sequence
  ELANE RNA Guide
ucuguccccaccgccacagcu

SEQ ID NO: 14714 - RNA, 21 nt, Artificial Sequence
  ELANE RNA Guide
ugaugguggccgacccgauga

SEQ ID NO: 14715 - RNA, 21 nt, Artificial Sequence
  ELANE RNA Guide
uggccgacccgaugagcugug

SEQ ID NO: 14716 - RNA, 21 nt, Artificial Sequence
  ELANE RNA Guide
uggcguugaugguggccgacc

SEQ ID NO: 14717 - RNA, 21 nt, Artificial Sequence
  ELANE RNA Guide
ugguggccgacccgaugagcu

SEQ ID NO: 14718 - RNA, 21 nt, Artificial Sequence
  ELANE RNA Guide
uguccccaccgccacagcuca

SEQ ID NO: 14719 - RNA, 21 nt, Artificial Sequence
  ELANE RNA Guide
uugaugguggccgacccgaug

SEQ ID NO: 14720 - RNA, 21 nt, Artificial Sequence
  ELANE RNA Guide
uuggcguugaugguggccgac

SEQ ID NO: 14721 - RNA, 22 nt, Artificial Sequence
  ELANE RNA Guide
acagcucaucgggucggccacc

SEQ ID NO: 14722 - RNA, 22 nt, Artificial Sequence
  ELANE RNA Guide
acccgaugagcuguggcggugg

SEQ ID NO: 14723 - RNA, 22 nt, Artificial Sequence
  ELANE RNA Guide
accgccacagcucaucgggucg

SEQ ID NO: 14724 - RNA, 22 nt, Artificial Sequence
  ELANE RNA Guide
agcucaucgggucggccaccau

SEQ ID NO: 14725 - RNA, 22 nt, Artificial Sequence
  ELANE RNA Guide
aucgggucggccaccaucaacg

SEQ ID NO: 14726 - RNA, 22 nt, Artificial Sequence
  ELANE RNA Guide
aucuguccccaccgccacagcu

SEQ ID NO: 14727 - RNA, 22 nt, Artificial Sequence
  ELANE RNA Guide
augguggccgacccgaugagcu

SEQ ID NO: 14728 - RNA, 22 nt, Artificial Sequence
  ELANE RNA Guide
cacagcucaucgggucggccac

SEQ ID NO: 14729 - RNA, 22 nt, Artificial Sequence
  ELANE RNA Guide
caccgccacagcucaucggguc

SEQ ID NO: 14730 - RNA, 22 nt, Artificial Sequence
  ELANE RNA Guide
cagcucaucgggucggccacca

SEQ ID NO: 14731 - RNA, 22 nt, Artificial Sequence
  ELANE RNA Guide
caucgggucggccaccaucaac

SEQ ID NO: 14732 - RNA, 22 nt, Artificial Sequence
  ELANE RNA Guide
ccacagcucaucgggucggcca

SEQ ID NO: 14733 - RNA, 22 nt, Artificial Sequence
  ELANE RNA Guide
ccaccgccacagcucaucgggu

SEQ ID NO: 14734 - RNA, 22 nt, Artificial Sequence
  ELANE RNA Guide
cccaccgccacagcucaucggg

SEQ ID NO: 14735 - RNA, 22 nt, Artificial Sequence
  ELANE RNA Guide
ccccaccgccacagcucaucgg

SEQ ID NO: 14736 - RNA, 22 nt, Artificial Sequence
  ELANE RNA Guide
cccgaugagcuguggcgguggg

SEQ ID NO: 14737 - RNA, 22 nt, Artificial Sequence
  ELANE RNA Guide
ccgacccgaugagcuguggcgg

SEQ ID NO: 14738 - RNA, 22 nt, Artificial Sequence
  ELANE RNA Guide
ccgaugagcuguggcggugggg

SEQ ID NO: 14739 - RNA, 22 nt, Artificial Sequence
  ELANE RNA Guide
ccgccacagcucaucgggucgg

SEQ ID NO: 14740 - RNA, 22 nt, Artificial Sequence
  ELANE RNA Guide
cgacccgaugagcuguggcggu

SEQ ID NO: 14741 - RNA, 22 nt, Artificial Sequence
  ELANE RNA Guide
cgaugagcuguggcggugggga

SEQ ID NO: 14742 - RNA, 22 nt, Artificial Sequence
  ELANE RNA Guide
cgccacagcucaucgggucggc

SEQ ID NO: 14743 - RNA, 22 nt, Artificial Sequence
  ELANE RNA Guide
cguugaugguggccgacccgau

SEQ ID NO: 14744 - RNA, 22 nt, Artificial Sequence
  ELANE RNA Guide
cucaucgggucggccaccauca

SEQ ID NO: 14745 - RNA, 22 nt, Artificial Sequence
  ELANE RNA Guide
cuguccccaccgccacagcuca

SEQ ID NO: 14746 - RNA, 22 nt, Artificial Sequence
  ELANE RNA Guide
gacccgaugagcuguggcggug

SEQ ID NO: 14747 - RNA, 22 nt, Artificial Sequence
  ELANE RNA Guide
gaugagcuguggcgguggggac

SEQ ID NO: 14748 - RNA, 22 nt, Artificial Sequence
  ELANE RNA Guide
gaugguggccgacccgaugagc

SEQ ID NO: 14749 - RNA, 22 nt, Artificial Sequence
  ELANE RNA Guide
gccacagcucaucgggucggcc

SEQ ID NO: 14750 - RNA, 22 nt, Artificial Sequence
  ELANE RNA Guide
gccgacccgaugagcuguggcg

SEQ ID NO: 14751 - RNA, 22 nt, Artificial Sequence
  ELANE RNA Guide
gcguugaugguggccgacccga

SEQ ID NO: 14752 - RNA, 22 nt, Artificial Sequence
  ELANE RNA Guide
gcucaucgggucggccaccauc

SEQ ID NO: 14753 - RNA, 22 nt, Artificial Sequence
  ELANE RNA Guide
ggccgacccgaugagcuguggc

SEQ ID NO: 14754 - RNA, 22 nt, Artificial Sequence
  ELANE RNA Guide
gguggccgacccgaugagcugu

SEQ ID NO: 14755 - RNA, 22 nt, Artificial Sequence
  ELANE RNA Guide
guccccaccgccacagcucauc

SEQ ID NO: 14756 - RNA, 22 nt, Artificial Sequence
  ELANE RNA Guide
guggccgacccgaugagcugug

SEQ ID NO: 14757 - RNA, 22 nt, Artificial Sequence
  ELANE RNA Guide
guugaugguggccgacccgaug

SEQ ID NO: 14758 - RNA, 22 nt, Artificial Sequence
  ELANE RNA Guide
guuggcguugaugguggccgac

SEQ ID NO: 14759 - RNA, 22 nt, Artificial Sequence
  ELANE RNA Guide
ucaucgggucggccaccaucaa

SEQ ID NO: 14760 - RNA, 22 nt, Artificial Sequence
  ELANE RNA Guide
uccccaccgccacagcucaucg

SEQ ID NO: 14761 - RNA, 22 nt, Artificial Sequence
  ELANE RNA Guide
ucuguccccaccgccacagcuc

SEQ ID NO: 14762 - RNA, 22 nt, Artificial Sequence
  ELANE RNA Guide
ugaugguggccgacccgaugag

SEQ ID NO: 14763 - RNA, 22 nt, Artificial Sequence
  ELANE RNA Guide
uggccgacccgaugagcugugg

SEQ ID NO: 14764 - RNA, 22 nt, Artificial Sequence
  ELANE RNA Guide
uggcguugaugguggccgaccc

SEQ ID NO: 14765 - RNA, 22 nt, Artificial Sequence
  ELANE RNA Guide
ugguggccgacccgaugagcug

SEQ ID NO: 14766 - RNA, 22 nt, Artificial Sequence
  ELANE RNA Guide
uguccccaccgccacagcucau

SEQ ID NO: 14767 - RNA, 22 nt, Artificial Sequence
  ELANE RNA Guide
uugaugguggccgacccgauga

SEQ ID NO: 14768 - RNA, 22 nt, Artificial Sequence
  ELANE RNA Guide
uuggcguugaugguggccgacc

SEQ ID NO: 14769 - RNA, 20 nt, Artificial Sequence
  ELANE RNA Guide
aacgggugggccaccaucaa

SEQ ID NO: 14770 - RNA, 20 nt, Artificial Sequence
  ELANE RNA Guide
acagcucaacgggugggcca

SEQ ID NO: 14771 - RNA, 20 nt, Artificial Sequence
  ELANE RNA Guide
accgccacagcucaacgggu

SEQ ID NO: 14772 - RNA, 20 nt, Artificial Sequence
  ELANE RNA Guide
acgggugggccaccaucaac

SEQ ID NO: 14773 - RNA, 20 nt, Artificial Sequence
  ELANE RNA Guide
acguuggcguugaugguggc

SEQ ID NO: 14774 - RNA, 20 nt, Artificial Sequence
  ELANE RNA Guide
agcucaacgggugggccacc

SEQ ID NO: 14775 - RNA, 20 nt, Artificial Sequence
  ELANE RNA Guide
augguggcccacccguugag

SEQ ID NO: 14776 - RNA, 20 nt, Artificial Sequence
  ELANE RNA Guide
caacgggugggccaccauca

SEQ ID NO: 14777 - RNA, 20 nt, Artificial Sequence
  ELANE RNA Guide
cacagcucaacgggugggcc

SEQ ID NO: 14778 - RNA, 20 nt, Artificial Sequence
  ELANE RNA Guide
caccgccacagcucaacggg

SEQ ID NO: 14779 - RNA, 20 nt, Artificial Sequence
  ELANE RNA Guide
cacguuggcguugauggugg

SEQ ID NO: 14780 - RNA, 20 nt, Artificial Sequence
  ELANE RNA Guide
cagcucaacgggugggccac

SEQ ID NO: 14781 - RNA, 20 nt, Artificial Sequence
  ELANE RNA Guide
ccacagcucaacgggugggc

SEQ ID NO: 14782 - RNA, 20 nt, Artificial Sequence
  ELANE RNA Guide
ccacccguugagcuguggcg

SEQ ID NO: 14783 - RNA, 20 nt, Artificial Sequence
  ELANE RNA Guide
ccaccgccacagcucaacgg

SEQ ID NO: 14784 - RNA, 20 nt, Artificial Sequence
  ELANE RNA Guide
cccacccguugagcuguggc

SEQ ID NO: 14785 - RNA, 20 nt, Artificial Sequence
  ELANE RNA Guide
cccaccgccacagcucaacg

SEQ ID NO: 14786 - RNA, 20 nt, Artificial Sequence
  ELANE RNA Guide
ccgccacagcucaacgggug

SEQ ID NO: 14787 - RNA, 20 nt, Artificial Sequence
  ELANE RNA Guide
cgccacagcucaacgggugg

SEQ ID NO: 14788 - RNA, 20 nt, Artificial Sequence
  ELANE RNA Guide
cgggugggccaccaucaacg

SEQ ID NO: 14789 - RNA, 20 nt, Artificial Sequence
  ELANE RNA Guide
cguugaugguggcccacccg

SEQ ID NO: 14790 - RNA, 20 nt, Artificial Sequence
  ELANE RNA Guide
cguuggcguugaugguggcc

SEQ ID NO: 14791 - RNA, 20 nt, Artificial Sequence
  ELANE RNA Guide
cucaacgggugggccaccau

SEQ ID NO: 14792 - RNA, 20 nt, Artificial Sequence
  ELANE RNA Guide
gaugguggcccacccguuga

SEQ ID NO: 14793 - RNA, 20 nt, Artificial Sequence
  ELANE RNA Guide
gcacguuggcguugauggug

SEQ ID NO: 14794 - RNA, 20 nt, Artificial Sequence
  ELANE RNA Guide
gccacagcucaacggguggg

SEQ ID NO: 14795 - RNA, 20 nt, Artificial Sequence
  ELANE RNA Guide
gcccacccguugagcugugg

SEQ ID NO: 14796 - RNA, 20 nt, Artificial Sequence
  ELANE RNA Guide
gcguugaugguggcccaccc

SEQ ID NO: 14797 - RNA, 20 nt, Artificial Sequence
  ELANE RNA Guide
gcucaacgggugggccacca

SEQ ID NO: 14798 - RNA, 20 nt, Artificial Sequence
  ELANE RNA Guide
ggcccacccguugagcugug

SEQ ID NO: 14799 - RNA, 20 nt, Artificial Sequence
  ELANE RNA Guide
ggcguugaugguggcccacc

SEQ ID NO: 14800 - RNA, 20 nt, Artificial Sequence
  ELANE RNA Guide
gggugggccaccaucaacgc

SEQ ID NO: 14801 - RNA, 20 nt, Artificial Sequence
  ELANE RNA Guide
gguggcccacccguugagcu

SEQ ID NO: 14802 - RNA, 20 nt, Artificial Sequence
  ELANE RNA Guide
ggugggccaccaucaacgcc

SEQ ID NO: 14803 - RNA, 20 nt, Artificial Sequence
  ELANE RNA Guide
guggcccacccguugagcug

SEQ ID NO: 14804 - RNA, 20 nt, Artificial Sequence
  ELANE RNA Guide
gugggccaccaucaacgcca

SEQ ID NO: 14805 - RNA, 20 nt, Artificial Sequence
  ELANE RNA Guide
guugaugguggcccacccgu

SEQ ID NO: 14806 - RNA, 20 nt, Artificial Sequence
  ELANE RNA Guide
guuggcguugaugguggccc

SEQ ID NO: 14807 - RNA, 20 nt, Artificial Sequence
  ELANE RNA Guide
ucaacgggugggccaccauc

SEQ ID NO: 14808 - RNA, 20 nt, Artificial Sequence
  ELANE RNA Guide
ugaugguggcccacccguug

SEQ ID NO: 14809 - RNA, 20 nt, Artificial Sequence
  ELANE RNA Guide
uggcccacccguugagcugu

SEQ ID NO: 14810 - RNA, 20 nt, Artificial Sequence
  ELANE RNA Guide
uggcguugaugguggcccac

SEQ ID NO: 14811 - RNA, 20 nt, Artificial Sequence
  ELANE RNA Guide
ugggccaccaucaacgccaa

SEQ ID NO: 14812 - RNA, 20 nt, Artificial Sequence
  ELANE RNA Guide
ugguggcccacccguugagc

SEQ ID NO: 14813 - RNA, 20 nt, Artificial Sequence
  ELANE RNA Guide
uugaugguggcccacccguu

SEQ ID NO: 14814 - RNA, 20 nt, Artificial Sequence
  ELANE RNA Guide
uuggcguugaugguggccca

SEQ ID NO: 14815 - RNA, 21 nt, Artificial Sequence
  ELANE RNA Guide
aacgggugggccaccaucaac

SEQ ID NO: 14816 - RNA, 21 nt, Artificial Sequence
  ELANE RNA Guide
acagcucaacgggugggccac

SEQ ID NO: 14817 - RNA, 21 nt, Artificial Sequence
  ELANE RNA Guide
accgccacagcucaacgggug

SEQ ID NO: 14818 - RNA, 21 nt, Artificial Sequence
  ELANE RNA Guide
acgggugggccaccaucaacg

SEQ ID NO: 14819 - RNA, 21 nt, Artificial Sequence
  ELANE RNA Guide
acguuggcguugaugguggcc

SEQ ID NO: 14820 - RNA, 21 nt, Artificial Sequence
  ELANE RNA Guide
agcucaacgggugggccacca

SEQ ID NO: 14821 - RNA, 21 nt, Artificial Sequence
  ELANE RNA Guide
augguggcccacccguugagc

SEQ ID NO: 14822 - RNA, 21 nt, Artificial Sequence
  ELANE RNA Guide
caacgggugggccaccaucaa

SEQ ID NO: 14823 - RNA, 21 nt, Artificial Sequence
  ELANE RNA Guide
cacagcucaacgggugggcca

SEQ ID NO: 14824 - RNA, 21 nt, Artificial Sequence
  ELANE RNA Guide
caccgccacagcucaacgggu

SEQ ID NO: 14825 - RNA, 21 nt, Artificial Sequence
  ELANE RNA Guide
cacguuggcguugaugguggc

SEQ ID NO: 14826 - RNA, 21 nt, Artificial Sequence
  ELANE RNA Guide
cagcucaacgggugggccacc

SEQ ID NO: 14827 - RNA, 21 nt, Artificial Sequence
  ELANE RNA Guide
ccacagcucaacgggugggcc

SEQ ID NO: 14828 - RNA, 21 nt, Artificial Sequence
  ELANE RNA Guide
ccacccguugagcuguggcgg

SEQ ID NO: 14829 - RNA, 21 nt, Artificial Sequence
  ELANE RNA Guide
ccaccgccacagcucaacggg

SEQ ID NO: 14830 - RNA, 21 nt, Artificial Sequence
  ELANE RNA Guide
cccacccguugagcuguggcg

SEQ ID NO: 14831 - RNA, 21 nt, Artificial Sequence
  ELANE RNA Guide
cccaccgccacagcucaacgg

SEQ ID NO: 14832 - RNA, 21 nt, Artificial Sequence
  ELANE RNA Guide
ccccaccgccacagcucaacg

SEQ ID NO: 14833 - RNA, 21 nt, Artificial Sequence
  ELANE RNA Guide
ccgccacagcucaacgggugg

SEQ ID NO: 14834 - RNA, 21 nt, Artificial Sequence
  ELANE RNA Guide
cgccacagcucaacggguggg

SEQ ID NO: 14835 - RNA, 21 nt, Artificial Sequence
  ELANE RNA Guide
cgggugggccaccaucaacgc

SEQ ID NO: 14836 - RNA, 21 nt, Artificial Sequence
  ELANE RNA Guide
cguugaugguggcccacccgu

SEQ ID NO: 14837 - RNA, 21 nt, Artificial Sequence
  ELANE RNA Guide
cguuggcguugaugguggccc

SEQ ID NO: 14838 - RNA, 21 nt, Artificial Sequence
  ELANE RNA Guide
cucaacgggugggccaccauc

SEQ ID NO: 14839 - RNA, 21 nt, Artificial Sequence
  ELANE RNA Guide
gaugguggcccacccguugag

SEQ ID NO: 14840 - RNA, 21 nt, Artificial Sequence
  ELANE RNA Guide
gcacguuggcguugauggugg

SEQ ID NO: 14841 - RNA, 21 nt, Artificial Sequence
  ELANE RNA Guide
gccacagcucaacgggugggc

SEQ ID NO: 14842 - RNA, 21 nt, Artificial Sequence
  ELANE RNA Guide
gcccacccguugagcuguggc

SEQ ID NO: 14843 - RNA, 21 nt, Artificial Sequence
  ELANE RNA Guide
gcguugaugguggcccacccg

SEQ ID NO: 14844 - RNA, 21 nt, Artificial Sequence
  ELANE RNA Guide
gcucaacgggugggccaccau

SEQ ID NO: 14845 - RNA, 21 nt, Artificial Sequence
  ELANE RNA Guide
ggcccacccguugagcugugg

SEQ ID NO: 14846 - RNA, 21 nt, Artificial Sequence
  ELANE RNA Guide
ggcguugaugguggcccaccc

SEQ ID NO: 14847 - RNA, 21 nt, Artificial Sequence
  ELANE RNA Guide
gggugggccaccaucaacgcc

SEQ ID NO: 14848 - RNA, 21 nt, Artificial Sequence
  ELANE RNA Guide
gguggcccacccguugagcug

SEQ ID NO: 14849 - RNA, 21 nt, Artificial Sequence
  ELANE RNA Guide
ggugggccaccaucaacgcca

SEQ ID NO: 14850 - RNA, 21 nt, Artificial Sequence
  ELANE RNA Guide
guggcccacccguugagcugu

SEQ ID NO: 14851 - RNA, 21 nt, Artificial Sequence
  ELANE RNA Guide
gugggccaccaucaacgccaa

SEQ ID NO: 14852 - RNA, 21 nt, Artificial Sequence
  ELANE RNA Guide
guugaugguggcccacccguu

SEQ ID NO: 14853 - RNA, 21 nt, Artificial Sequence
  ELANE RNA Guide
guuggcguugaugguggccca

SEQ ID NO: 14854 - RNA, 21 nt, Artificial Sequence
  ELANE RNA Guide
ucaacgggugggccaccauca

SEQ ID NO: 14855 - RNA, 21 nt, Artificial Sequence
  ELANE RNA Guide
ugaugguggcccacccguuga

SEQ ID NO: 14856 - RNA, 21 nt, Artificial Sequence
  ELANE RNA Guide
ugcacguuggcguugauggug

SEQ ID NO: 14857 - RNA, 21 nt, Artificial Sequence
  ELANE RNA Guide
uggcccacccguugagcugug

SEQ ID NO: 14858 - RNA, 21 nt, Artificial Sequence
  ELANE RNA Guide
uggcguugaugguggcccacc

SEQ ID NO: 14859 - RNA, 21 nt, Artificial Sequence
  ELANE RNA Guide
ugggccaccaucaacgccaac

SEQ ID NO: 14860 - RNA, 21 nt, Artificial Sequence
  ELANE RNA Guide
ugguggcccacccguugagcu

SEQ ID NO: 14861 - RNA, 21 nt, Artificial Sequence
  ELANE RNA Guide
uugaugguggcccacccguug

SEQ ID NO: 14862 - RNA, 21 nt, Artificial Sequence
  ELANE RNA Guide
uuggcguugaugguggcccac

SEQ ID NO: 14863 - RNA, 22 nt, Artificial Sequence
  ELANE RNA Guide
aacgggugggccaccaucaacg

SEQ ID NO: 14864 - RNA, 22 nt, Artificial Sequence
  ELANE RNA Guide
acagcucaacgggugggccacc

SEQ ID NO: 14865 - RNA, 22 nt, Artificial Sequence
  ELANE RNA Guide
accgccacagcucaacgggugg

SEQ ID NO: 14866 - RNA, 22 nt, Artificial Sequence
  ELANE RNA Guide
acgggugggccaccaucaacgc

SEQ ID NO: 14867 - RNA, 22 nt, Artificial Sequence
  ELANE RNA Guide
acguuggcguugaugguggccc

SEQ ID NO: 14868 - RNA, 22 nt, Artificial Sequence
  ELANE RNA Guide
agcucaacgggugggccaccau

SEQ ID NO: 14869 - RNA, 22 nt, Artificial Sequence
  ELANE RNA Guide
augguggcccacccguugagcu

SEQ ID NO: 14870 - RNA, 22 nt, Artificial Sequence
  ELANE RNA Guide
caacgggugggccaccaucaac

SEQ ID NO: 14871 - RNA, 22 nt, Artificial Sequence
  ELANE RNA Guide
cacagcucaacgggugggccac

SEQ ID NO: 14872 - RNA, 22 nt, Artificial Sequence
  ELANE RNA Guide
caccgccacagcucaacgggug

SEQ ID NO: 14873 - RNA, 22 nt, Artificial Sequence
  ELANE RNA Guide
cacguuggcguugaugguggcc

SEQ ID NO: 14874 - RNA, 22 nt, Artificial Sequence
  ELANE RNA Guide
cagcucaacgggugggccacca

SEQ ID NO: 14875 - RNA, 22 nt, Artificial Sequence
  ELANE RNA Guide
ccacagcucaacgggugggcca

SEQ ID NO: 14876 - RNA, 22 nt, Artificial Sequence
  ELANE RNA Guide
ccacccguugagcuguggcggu

SEQ ID NO: 14877 - RNA, 22 nt, Artificial Sequence
  ELANE RNA Guide
ccaccgccacagcucaacgggu

SEQ ID NO: 14878 - RNA, 22 nt, Artificial Sequence
  ELANE RNA Guide
cccacccguugagcuguggcgg

SEQ ID NO: 14879 - RNA, 22 nt, Artificial Sequence
  ELANE RNA Guide
cccaccgccacagcucaacggg

SEQ ID NO: 14880 - RNA, 22 nt, Artificial Sequence
  ELANE RNA Guide
ccccaccgccacagcucaacgg

SEQ ID NO: 14881 - RNA, 22 nt, Artificial Sequence
  ELANE RNA Guide
ccgccacagcucaacggguggg

SEQ ID NO: 14882 - RNA, 22 nt, Artificial Sequence
  ELANE RNA Guide
cgccacagcucaacgggugggc

SEQ ID NO: 14883 - RNA, 22 nt, Artificial Sequence
  ELANE RNA Guide
cgggugggccaccaucaacgcc

SEQ ID NO: 14884 - RNA, 22 nt, Artificial Sequence
  ELANE RNA Guide
cguugaugguggcccacccguu

SEQ ID NO: 14885 - RNA, 22 nt, Artificial Sequence
  ELANE RNA Guide
cguuggcguugaugguggccca

SEQ ID NO: 14886 - RNA, 22 nt, Artificial Sequence
  ELANE RNA Guide
cucaacgggugggccaccauca

SEQ ID NO: 14887 - RNA, 22 nt, Artificial Sequence
  ELANE RNA Guide
cugcacguuggcguugauggug

SEQ ID NO: 14888 - RNA, 22 nt, Artificial Sequence
  ELANE RNA Guide
gaugguggcccacccguugagc

SEQ ID NO: 14889 - RNA, 22 nt, Artificial Sequence
  ELANE RNA Guide
gcacguuggcguugaugguggc

SEQ ID NO: 14890 - RNA, 22 nt, Artificial Sequence
  ELANE RNA Guide
gccacagcucaacgggugggcc

SEQ ID NO: 14891 - RNA, 22 nt, Artificial Sequence
  ELANE RNA Guide
gcccacccguugagcuguggcg

SEQ ID NO: 14892 - RNA, 22 nt, Artificial Sequence
  ELANE RNA Guide
gcguugaugguggcccacccgu

SEQ ID NO: 14893 - RNA, 22 nt, Artificial Sequence
  ELANE RNA Guide
gcucaacgggugggccaccauc

SEQ ID NO: 14894 - RNA, 22 nt, Artificial Sequence
  ELANE RNA Guide
ggcccacccguugagcuguggc

SEQ ID NO: 14895 - RNA, 22 nt, Artificial Sequence
  ELANE RNA Guide
ggcguugaugguggcccacccg

SEQ ID NO: 14896 - RNA, 22 nt, Artificial Sequence
  ELANE RNA Guide
gggugggccaccaucaacgcca

SEQ ID NO: 14897 - RNA, 22 nt, Artificial Sequence
  ELANE RNA Guide
gguggcccacccguugagcugu

SEQ ID NO: 14898 - RNA, 22 nt, Artificial Sequence
  ELANE RNA Guide
ggugggccaccaucaacgccaa

SEQ ID NO: 14899 - RNA, 22 nt, Artificial Sequence
  ELANE RNA Guide
guggcccacccguugagcugug

SEQ ID NO: 14900 - RNA, 22 nt, Artificial Sequence
  ELANE RNA Guide
gugggccaccaucaacgccaac

SEQ ID NO: 14901 - RNA, 22 nt, Artificial Sequence
  ELANE RNA Guide
guugaugguggcccacccguug

SEQ ID NO: 14902 - RNA, 22 nt, Artificial Sequence
  ELANE RNA Guide
guuggcguugaugguggcccac

SEQ ID NO: 14903 - RNA, 22 nt, Artificial Sequence
  ELANE RNA Guide
ucaacgggugggccaccaucaa

SEQ ID NO: 14904 - RNA, 22 nt, Artificial Sequence
  ELANE RNA Guide
uccccaccgccacagcucaacg

SEQ ID NO: 14905 - RNA, 22 nt, Artificial Sequence
  ELANE RNA Guide
ugaugguggcccacccguugag

SEQ ID NO: 14906 - RNA, 22 nt, Artificial Sequence
  ELANE RNA Guide
ugcacguuggcguugauggugg

SEQ ID NO: 14907 - RNA, 22 nt, Artificial Sequence
  ELANE RNA Guide
uggcccacccguugagcugugg

SEQ ID NO: 14908 - RNA, 22 nt, Artificial Sequence
  ELANE RNA Guide
uggcguugaugguggcccaccc

SEQ ID NO: 14909 - RNA, 22 nt, Artificial Sequence
  ELANE RNA Guide
ugggccaccaucaacgccaacg

SEQ ID NO: 14910 - RNA, 22 nt, Artificial Sequence
  ELANE RNA Guide
ugguggcccacccguugagcug

SEQ ID NO: 14911 - RNA, 22 nt, Artificial Sequence
  ELANE RNA Guide
uugaugguggcccacccguuga

SEQ ID NO: 14912 - RNA, 22 nt, Artificial Sequence
  ELANE RNA Guide
uuggcguugaugguggcccacc

SEQ ID NO: 14913 - RNA, 20 nt, Artificial Sequence
  ELANE RNA Guide
aacggguuggccaccaucaa

SEQ ID NO: 14914 - RNA, 20 nt, Artificial Sequence
  ELANE RNA Guide
acagcucaacggguuggcca

SEQ ID NO: 14915 - RNA, 20 nt, Artificial Sequence
  ELANE RNA Guide
acggguuggccaccaucaac

SEQ ID NO: 14916 - RNA, 20 nt, Artificial Sequence
  ELANE RNA Guide
agcucaacggguuggccacc

SEQ ID NO: 14917 - RNA, 20 nt, Artificial Sequence
  ELANE RNA Guide
augguggccaacccguugag

SEQ ID NO: 14918 - RNA, 20 nt, Artificial Sequence
  ELANE RNA Guide
caacccguugagcuguggcg

SEQ ID NO: 14919 - RNA, 20 nt, Artificial Sequence
  ELANE RNA Guide
caacggguuggccaccauca

SEQ ID NO: 14920 - RNA, 20 nt, Artificial Sequence
  ELANE RNA Guide
cacagcucaacggguuggcc

SEQ ID NO: 14921 - RNA, 20 nt, Artificial Sequence
  ELANE RNA Guide
cagcucaacggguuggccac

SEQ ID NO: 14922 - RNA, 20 nt, Artificial Sequence
  ELANE RNA Guide
ccaacccguugagcuguggc

SEQ ID NO: 14923 - RNA, 20 nt, Artificial Sequence
  ELANE RNA Guide
ccacagcucaacggguuggc

SEQ ID NO: 14924 - RNA, 20 nt, Artificial Sequence
  ELANE RNA Guide
ccgccacagcucaacggguu

SEQ ID NO: 14925 - RNA, 20 nt, Artificial Sequence
  ELANE RNA Guide
cgccacagcucaacggguug

SEQ ID NO: 14926 - RNA, 20 nt, Artificial Sequence
  ELANE RNA Guide
cggguuggccaccaucaacg

SEQ ID NO: 14927 - RNA, 20 nt, Artificial Sequence
  ELANE RNA Guide
cguugaugguggccaacccg

SEQ ID NO: 14928 - RNA, 20 nt, Artificial Sequence
  ELANE RNA Guide
cucaacggguuggccaccau

SEQ ID NO: 14929 - RNA, 20 nt, Artificial Sequence
  ELANE RNA Guide
gaugguggccaacccguuga

SEQ ID NO: 14930 - RNA, 20 nt, Artificial Sequence
  ELANE RNA Guide
gccaacccguugagcugugg

SEQ ID NO: 14931 - RNA, 20 nt, Artificial Sequence
  ELANE RNA Guide
gccacagcucaacggguugg

SEQ ID NO: 14932 - RNA, 20 nt, Artificial Sequence
  ELANE RNA Guide
gcguugaugguggccaaccc

SEQ ID NO: 14933 - RNA, 20 nt, Artificial Sequence
  ELANE RNA Guide
gcucaacggguuggccacca

SEQ ID NO: 14934 - RNA, 20 nt, Artificial Sequence
  ELANE RNA Guide
ggccaacccguugagcugug

SEQ ID NO: 14935 - RNA, 20 nt, Artificial Sequence
  ELANE RNA Guide
ggcguugaugguggccaacc

SEQ ID NO: 14936 - RNA, 20 nt, Artificial Sequence
  ELANE RNA Guide
ggguuggccaccaucaacgc

SEQ ID NO: 14937 - RNA, 20 nt, Artificial Sequence
  ELANE RNA Guide
gguggccaacccguugagcu

SEQ ID NO: 14938 - RNA, 20 nt, Artificial Sequence
  ELANE RNA Guide
gguuggccaccaucaacgcc

SEQ ID NO: 14939 - RNA, 20 nt, Artificial Sequence
  ELANE RNA Guide
guggccaacccguugagcug

SEQ ID NO: 14940 - RNA, 20 nt, Artificial Sequence
  ELANE RNA Guide
guugaugguggccaacccgu

SEQ ID NO: 14941 - RNA, 20 nt, Artificial Sequence
  ELANE RNA Guide
guuggccaccaucaacgcca

SEQ ID NO: 14942 - RNA, 20 nt, Artificial Sequence
  ELANE RNA Guide
guuggcguugaugguggcca

SEQ ID NO: 14943 - RNA, 20 nt, Artificial Sequence
  ELANE RNA Guide
ucaacggguuggccaccauc

SEQ ID NO: 14944 - RNA, 20 nt, Artificial Sequence
  ELANE RNA Guide
ugaugguggccaacccguug

SEQ ID NO: 14945 - RNA, 20 nt, Artificial Sequence
  ELANE RNA Guide
uggccaacccguugagcugu

SEQ ID NO: 14946 - RNA, 20 nt, Artificial Sequence
  ELANE RNA Guide
uggcguugaugguggccaac

SEQ ID NO: 14947 - RNA, 20 nt, Artificial Sequence
  ELANE RNA Guide
ugguggccaacccguugagc

SEQ ID NO: 14948 - RNA, 20 nt, Artificial Sequence
  ELANE RNA Guide
uugaugguggccaacccguu

SEQ ID NO: 14949 - RNA, 20 nt, Artificial Sequence
  ELANE RNA Guide
uuggccaccaucaacgccaa

SEQ ID NO: 14950 - RNA, 20 nt, Artificial Sequence
  ELANE RNA Guide
uuggcguugaugguggccaa

SEQ ID NO: 14951 - RNA, 21 nt, Artificial Sequence
  ELANE RNA Guide
aacggguuggccaccaucaac

SEQ ID NO: 14952 - RNA, 21 nt, Artificial Sequence
  ELANE RNA Guide
acagcucaacggguuggccac

SEQ ID NO: 14953 - RNA, 21 nt, Artificial Sequence
  ELANE RNA Guide
accgccacagcucaacggguu

SEQ ID NO: 14954 - RNA, 21 nt, Artificial Sequence
  ELANE RNA Guide
acggguuggccaccaucaacg

SEQ ID NO: 14955 - RNA, 21 nt, Artificial Sequence
  ELANE RNA Guide
agcucaacggguuggccacca

SEQ ID NO: 14956 - RNA, 21 nt, Artificial Sequence
  ELANE RNA Guide
augguggccaacccguugagc

SEQ ID NO: 14957 - RNA, 21 nt, Artificial Sequence
  ELANE RNA Guide
caacccguugagcuguggcgg

SEQ ID NO: 14958 - RNA, 21 nt, Artificial Sequence
  ELANE RNA Guide
caacggguuggccaccaucaa

SEQ ID NO: 14959 - RNA, 21 nt, Artificial Sequence
  ELANE RNA Guide
cacagcucaacggguuggcca

SEQ ID NO: 14960 - RNA, 21 nt, Artificial Sequence
  ELANE RNA Guide
cagcucaacggguuggccacc

SEQ ID NO: 14961 - RNA, 21 nt, Artificial Sequence
  ELANE RNA Guide
ccaacccguugagcuguggcg

SEQ ID NO: 14962 - RNA, 21 nt, Artificial Sequence
  ELANE RNA Guide
ccacagcucaacggguuggcc

SEQ ID NO: 14963 - RNA, 21 nt, Artificial Sequence
  ELANE RNA Guide
ccgccacagcucaacggguug

SEQ ID NO: 14964 - RNA, 21 nt, Artificial Sequence
  ELANE RNA Guide
cgccacagcucaacggguugg

SEQ ID NO: 14965 - RNA, 21 nt, Artificial Sequence
  ELANE RNA Guide
cggguuggccaccaucaacgc

SEQ ID NO: 14966 - RNA, 21 nt, Artificial Sequence
  ELANE RNA Guide
cguugaugguggccaacccgu

SEQ ID NO: 14967 - RNA, 21 nt, Artificial Sequence
  ELANE RNA Guide
cguuggcguugaugguggcca

SEQ ID NO: 14968 - RNA, 21 nt, Artificial Sequence
  ELANE RNA Guide
cucaacggguuggccaccauc

SEQ ID NO: 14969 - RNA, 21 nt, Artificial Sequence
  ELANE RNA Guide
gaugguggccaacccguugag

SEQ ID NO: 14970 - RNA, 21 nt, Artificial Sequence
  ELANE RNA Guide
gccaacccguugagcuguggc

SEQ ID NO: 14971 - RNA, 21 nt, Artificial Sequence
  ELANE RNA Guide
gccacagcucaacggguuggc

SEQ ID NO: 14972 - RNA, 21 nt, Artificial Sequence
  ELANE RNA Guide
gcguugaugguggccaacccg

SEQ ID NO: 14973 - RNA, 21 nt, Artificial Sequence
  ELANE RNA Guide
gcucaacggguuggccaccau

SEQ ID NO: 14974 - RNA, 21 nt, Artificial Sequence
  ELANE RNA Guide
ggccaacccguugagcugugg

SEQ ID NO: 14975 - RNA, 21 nt, Artificial Sequence
  ELANE RNA Guide
ggcguugaugguggccaaccc

SEQ ID NO: 14976 - RNA, 21 nt, Artificial Sequence
  ELANE RNA Guide
ggguuggccaccaucaacgcc

SEQ ID NO: 14977 - RNA, 21 nt, Artificial Sequence
  ELANE RNA Guide
gguggccaacccguugagcug

SEQ ID NO: 14978 - RNA, 21 nt, Artificial Sequence
  ELANE RNA Guide
gguuggccaccaucaacgcca

SEQ ID NO: 14979 - RNA, 21 nt, Artificial Sequence
  ELANE RNA Guide
guggccaacccguugagcugu

SEQ ID NO: 14980 - RNA, 21 nt, Artificial Sequence
  ELANE RNA Guide
guugaugguggccaacccguu

SEQ ID NO: 14981 - RNA, 21 nt, Artificial Sequence
  ELANE RNA Guide
guuggccaccaucaacgccaa

SEQ ID NO: 14982 - RNA, 21 nt, Artificial Sequence
  ELANE RNA Guide
guuggcguugaugguggccaa

SEQ ID NO: 14983 - RNA, 21 nt, Artificial Sequence
  ELANE RNA Guide
ucaacggguuggccaccauca

SEQ ID NO: 14984 - RNA, 21 nt, Artificial Sequence
  ELANE RNA Guide
ugaugguggccaacccguuga

SEQ ID NO: 14985 - RNA, 21 nt, Artificial Sequence
  ELANE RNA Guide
uggccaacccguugagcugug

SEQ ID NO: 14986 - RNA, 21 nt, Artificial Sequence
  ELANE RNA Guide
uggcguugaugguggccaacc

SEQ ID NO: 14987 - RNA, 21 nt, Artificial Sequence
  ELANE RNA Guide
ugguggccaacccguugagcu

SEQ ID NO: 14988 - RNA, 21 nt, Artificial Sequence
  ELANE RNA Guide
uugaugguggccaacccguug

SEQ ID NO: 14989 - RNA, 21 nt, Artificial Sequence
  ELANE RNA Guide
uuggccaccaucaacgccaac

SEQ ID NO: 14990 - RNA, 21 nt, Artificial Sequence
  ELANE RNA Guide
uuggcguugaugguggccaac

SEQ ID NO: 14991 - RNA, 22 nt, Artificial Sequence
  ELANE RNA Guide
aacggguuggccaccaucaacg

SEQ ID NO: 14992 - RNA, 22 nt, Artificial Sequence
  ELANE RNA Guide
acagcucaacggguuggccacc

SEQ ID NO: 14993 - RNA, 22 nt, Artificial Sequence
  ELANE RNA Guide
accgccacagcucaacggguug

SEQ ID NO: 14994 - RNA, 22 nt, Artificial Sequence
  ELANE RNA Guide
acggguuggccaccaucaacgc

SEQ ID NO: 14995 - RNA, 22 nt, Artificial Sequence
  ELANE RNA Guide
acguuggcguugaugguggcca

SEQ ID NO: 14996 - RNA, 22 nt, Artificial Sequence
  ELANE RNA Guide
agcucaacggguuggccaccau

SEQ ID NO: 14997 - RNA, 22 nt, Artificial Sequence
  ELANE RNA Guide
augguggccaacccguugagcu

SEQ ID NO: 14998 - RNA, 22 nt, Artificial Sequence
  ELANE RNA Guide
caacccguugagcuguggcggu

SEQ ID NO: 14999 - RNA, 22 nt, Artificial Sequence
  ELANE RNA Guide
caacggguuggccaccaucaac

SEQ ID NO: 15000 - RNA, 22 nt, Artificial Sequence
  ELANE RNA Guide
cacagcucaacggguuggccac

SEQ ID NO: 15001 - RNA, 22 nt, Artificial Sequence
  ELANE RNA Guide
caccgccacagcucaacggguu

SEQ ID NO: 15002 - RNA, 22 nt, Artificial Sequence
  ELANE RNA Guide
cagcucaacggguuggccacca

SEQ ID NO: 15003 - RNA, 22 nt, Artificial Sequence
  ELANE RNA Guide
ccaacccguugagcuguggcgg

SEQ ID NO: 15004 - RNA, 22 nt, Artificial Sequence
  ELANE RNA Guide
ccacagcucaacggguuggcca

SEQ ID NO: 15005 - RNA, 22 nt, Artificial Sequence
  ELANE RNA Guide
ccgccacagcucaacggguugg

SEQ ID NO: 15006 - RNA, 22 nt, Artificial Sequence
  ELANE RNA Guide
cgccacagcucaacggguuggc

SEQ ID NO: 15007 - RNA, 22 nt, Artificial Sequence
  ELANE RNA Guide
cggguuggccaccaucaacgcc

SEQ ID NO: 15008 - RNA, 22 nt, Artificial Sequence
  ELANE RNA Guide
cguugaugguggccaacccguu

SEQ ID NO: 15009 - RNA, 22 nt, Artificial Sequence
  ELANE RNA Guide
cguuggcguugaugguggccaa

SEQ ID NO: 15010 - RNA, 22 nt, Artificial Sequence
  ELANE RNA Guide
cucaacggguuggccaccauca

SEQ ID NO: 15011 - RNA, 22 nt, Artificial Sequence
  ELANE RNA Guide
gaugguggccaacccguugagc

SEQ ID NO: 15012 - RNA, 22 nt, Artificial Sequence
  ELANE RNA Guide
gccaacccguugagcuguggcg

SEQ ID NO: 15013 - RNA, 22 nt, Artificial Sequence
  ELANE RNA Guide
gccacagcucaacggguuggcc

SEQ ID NO: 15014 - RNA, 22 nt, Artificial Sequence
  ELANE RNA Guide
gcguugaugguggccaacccgu

SEQ ID NO: 15015 - RNA, 22 nt, Artificial Sequence
  ELANE RNA Guide
gcucaacggguuggccaccauc

SEQ ID NO: 15016 - RNA, 22 nt, Artificial Sequence
  ELANE RNA Guide
ggccaacccguugagcuguggc

SEQ ID NO: 15017 - RNA, 22 nt, Artificial Sequence
  ELANE RNA Guide
ggcguugaugguggccaacccg

SEQ ID NO: 15018 - RNA, 22 nt, Artificial Sequence
  ELANE RNA Guide
ggguuggccaccaucaacgcca

SEQ ID NO: 15019 - RNA, 22 nt, Artificial Sequence
  ELANE RNA Guide
gguggccaacccguugagcugu

SEQ ID NO: 15020 - RNA, 22 nt, Artificial Sequence
  ELANE RNA Guide
gguuggccaccaucaacgccaa

SEQ ID NO: 15021 - RNA, 22 nt, Artificial Sequence
  ELANE RNA Guide
guggccaacccguugagcugug

SEQ ID NO: 15022 - RNA, 22 nt, Artificial Sequence
  ELANE RNA Guide
guugaugguggccaacccguug

SEQ ID NO: 15023 - RNA, 22 nt, Artificial Sequence
  ELANE RNA Guide
guuggccaccaucaacgccaac

SEQ ID NO: 15024 - RNA, 22 nt, Artificial Sequence
  ELANE RNA Guide
guuggcguugaugguggccaac

SEQ ID NO: 15025 - RNA, 22 nt, Artificial Sequence
  ELANE RNA Guide
ucaacggguuggccaccaucaa

SEQ ID NO: 15026 - RNA, 22 nt, Artificial Sequence
  ELANE RNA Guide
ugaugguggccaacccguugag

SEQ ID NO: 15027 - RNA, 22 nt, Artificial Sequence
  ELANE RNA Guide
uggccaacccguugagcugugg

SEQ ID NO: 15028 - RNA, 22 nt, Artificial Sequence
  ELANE RNA Guide
uggcguugaugguggccaaccc

SEQ ID NO: 15029 - RNA, 22 nt, Artificial Sequence
  ELANE RNA Guide
ugguggccaacccguugagcug

SEQ ID NO: 15030 - RNA, 22 nt, Artificial Sequence
  ELANE RNA Guide
uugaugguggccaacccguuga

SEQ ID NO: 15031 - RNA, 22 nt, Artificial Sequence
  ELANE RNA Guide
uuggccaccaucaacgccaacg

SEQ ID NO: 15032 - RNA, 22 nt, Artificial Sequence
  ELANE RNA Guide
uuggcguugaugguggccaacc

SEQ ID NO: 15033 - RNA, 20 nt, Artificial Sequence
  ELANE RNA Guide
aacgggucagccaccaucaa

SEQ ID NO: 15034 - RNA, 20 nt, Artificial Sequence
  ELANE RNA Guide
acagcucaacgggucagcca

SEQ ID NO: 15035 - RNA, 20 nt, Artificial Sequence
  ELANE RNA Guide
acgggucagccaccaucaac

SEQ ID NO: 15036 - RNA, 20 nt, Artificial Sequence
  ELANE RNA Guide
agcucaacgggucagccacc

SEQ ID NO: 15037 - RNA, 20 nt, Artificial Sequence
  ELANE RNA Guide
augguggcugacccguugag

SEQ ID NO: 15038 - RNA, 20 nt, Artificial Sequence
  ELANE RNA Guide
caacgggucagccaccauca

SEQ ID NO: 15039 - RNA, 20 nt, Artificial Sequence
  ELANE RNA Guide
cacagcucaacgggucagcc

SEQ ID NO: 15040 - RNA, 20 nt, Artificial Sequence
  ELANE RNA Guide
cagccaccaucaacgccaac

SEQ ID NO: 15041 - RNA, 20 nt, Artificial Sequence
  ELANE RNA Guide
cagcucaacgggucagccac

SEQ ID NO: 15042 - RNA, 20 nt, Artificial Sequence
  ELANE RNA Guide
ccacagcucaacgggucagc

SEQ ID NO: 15043 - RNA, 20 nt, Artificial Sequence
  ELANE RNA Guide
ccgccacagcucaacggguc

SEQ ID NO: 15044 - RNA, 20 nt, Artificial Sequence
  ELANE RNA Guide
cgccacagcucaacggguca

SEQ ID NO: 15045 - RNA, 20 nt, Artificial Sequence
  ELANE RNA Guide
cgggucagccaccaucaacg

SEQ ID NO: 15046 - RNA, 20 nt, Artificial Sequence
  ELANE RNA Guide
cguugaugguggcugacccg

SEQ ID NO: 15047 - RNA, 20 nt, Artificial Sequence
  ELANE RNA Guide
cguuggcguugaugguggcu

SEQ ID NO: 15048 - RNA, 20 nt, Artificial Sequence
  ELANE RNA Guide
cucaacgggucagccaccau

SEQ ID NO: 15049 - RNA, 20 nt, Artificial Sequence
  ELANE RNA Guide
cugacccguugagcuguggc

SEQ ID NO: 15050 - RNA, 20 nt, Artificial Sequence
  ELANE RNA Guide
gaugguggcugacccguuga

SEQ ID NO: 15051 - RNA, 20 nt, Artificial Sequence
  ELANE RNA Guide
gccacagcucaacgggucag

SEQ ID NO: 15052 - RNA, 20 nt, Artificial Sequence
  ELANE RNA Guide
gcguugaugguggcugaccc

SEQ ID NO: 15053 - RNA, 20 nt, Artificial Sequence
  ELANE RNA Guide
gcucaacgggucagccacca

SEQ ID NO: 15054 - RNA, 20 nt, Artificial Sequence
  ELANE RNA Guide
gcugacccguugagcugugg

SEQ ID NO: 15055 - RNA, 20 nt, Artificial Sequence
  ELANE RNA Guide
ggcguugaugguggcugacc

SEQ ID NO: 15056 - RNA, 20 nt, Artificial Sequence
  ELANE RNA Guide
ggcugacccguugagcugug

SEQ ID NO: 15057 - RNA, 20 nt, Artificial Sequence
  ELANE RNA Guide
gggucagccaccaucaacgc

SEQ ID NO: 15058 - RNA, 20 nt, Artificial Sequence
  ELANE RNA Guide
ggucagccaccaucaacgcc

SEQ ID NO: 15059 - RNA, 20 nt, Artificial Sequence
  ELANE RNA Guide
gguggcugacccguugagcu

SEQ ID NO: 15060 - RNA, 20 nt, Artificial Sequence
  ELANE RNA Guide
gucagccaccaucaacgcca

SEQ ID NO: 15061 - RNA, 20 nt, Artificial Sequence
  ELANE RNA Guide
guggcugacccguugagcug

SEQ ID NO: 15062 - RNA, 20 nt, Artificial Sequence
  ELANE RNA Guide
guugaugguggcugacccgu

SEQ ID NO: 15063 - RNA, 20 nt, Artificial Sequence
  ELANE RNA Guide
guuggcguugaugguggcug

SEQ ID NO: 15064 - RNA, 20 nt, Artificial Sequence
  ELANE RNA Guide
ucaacgggucagccaccauc

SEQ ID NO: 15065 - RNA, 20 nt, Artificial Sequence
  ELANE RNA Guide
ucagccaccaucaacgccaa

SEQ ID NO: 15066 - RNA, 20 nt, Artificial Sequence
  ELANE RNA Guide
ugaugguggcugacccguug

SEQ ID NO: 15067 - RNA, 20 nt, Artificial Sequence
  ELANE RNA Guide
ugcacguuggcguugauggu

SEQ ID NO: 15068 - RNA, 20 nt, Artificial Sequence
  ELANE RNA Guide
uggcguugaugguggcugac

SEQ ID NO: 15069 - RNA, 20 nt, Artificial Sequence
  ELANE RNA Guide
uggcugacccguugagcugu

SEQ ID NO: 15070 - RNA, 20 nt, Artificial Sequence
  ELANE RNA Guide
ugguggcugacccguugagc

SEQ ID NO: 15071 - RNA, 20 nt, Artificial Sequence
  ELANE RNA Guide
uugaugguggcugacccguu

SEQ ID NO: 15072 - RNA, 20 nt, Artificial Sequence
  ELANE RNA Guide
uuggcguugaugguggcuga

SEQ ID NO: 15073 - RNA, 21 nt, Artificial Sequence
  ELANE RNA Guide
aacgggucagccaccaucaac

SEQ ID NO: 15074 - RNA, 21 nt, Artificial Sequence
  ELANE RNA Guide
acagcucaacgggucagccac

SEQ ID NO: 15075 - RNA, 21 nt, Artificial Sequence
  ELANE RNA Guide
accgccacagcucaacggguc

SEQ ID NO: 15076 - RNA, 21 nt, Artificial Sequence
  ELANE RNA Guide
acgggucagccaccaucaacg

SEQ ID NO: 15077 - RNA, 21 nt, Artificial Sequence
  ELANE RNA Guide
acguuggcguugaugguggcu

SEQ ID NO: 15078 - RNA, 21 nt, Artificial Sequence
  ELANE RNA Guide
agcucaacgggucagccacca

SEQ ID NO: 15079 - RNA, 21 nt, Artificial Sequence
  ELANE RNA Guide
augguggcugacccguugagc

SEQ ID NO: 15080 - RNA, 21 nt, Artificial Sequence
  ELANE RNA Guide
caacgggucagccaccaucaa

SEQ ID NO: 15081 - RNA, 21 nt, Artificial Sequence
  ELANE RNA Guide
cacagcucaacgggucagcca

SEQ ID NO: 15082 - RNA, 21 nt, Artificial Sequence
  ELANE RNA Guide
cagccaccaucaacgccaacg

SEQ ID NO: 15083 - RNA, 21 nt, Artificial Sequence
  ELANE RNA Guide
cagcucaacgggucagccacc

SEQ ID NO: 15084 - RNA, 21 nt, Artificial Sequence
  ELANE RNA Guide
ccacagcucaacgggucagcc

SEQ ID NO: 15085 - RNA, 21 nt, Artificial Sequence
  ELANE RNA Guide
ccgccacagcucaacggguca

SEQ ID NO: 15086 - RNA, 21 nt, Artificial Sequence
  ELANE RNA Guide
cgccacagcucaacgggucag

SEQ ID NO: 15087 - RNA, 21 nt, Artificial Sequence
  ELANE RNA Guide
cgggucagccaccaucaacgc

SEQ ID NO: 15088 - RNA, 21 nt, Artificial Sequence
  ELANE RNA Guide
cguugaugguggcugacccgu

SEQ ID NO: 15089 - RNA, 21 nt, Artificial Sequence
  ELANE RNA Guide
cguuggcguugaugguggcug

SEQ ID NO: 15090 - RNA, 21 nt, Artificial Sequence
  ELANE RNA Guide
cucaacgggucagccaccauc

SEQ ID NO: 15091 - RNA, 21 nt, Artificial Sequence
  ELANE RNA Guide
cugacccguugagcuguggcg

SEQ ID NO: 15092 - RNA, 21 nt, Artificial Sequence
  ELANE RNA Guide
cugcacguuggcguugauggu

SEQ ID NO: 15093 - RNA, 21 nt, Artificial Sequence
  ELANE RNA Guide
gaugguggcugacccguugag

SEQ ID NO: 15094 - RNA, 21 nt, Artificial Sequence
  ELANE RNA Guide
gccacagcucaacgggucagc

SEQ ID NO: 15095 - RNA, 21 nt, Artificial Sequence
  ELANE RNA Guide
gcguugaugguggcugacccg

SEQ ID NO: 15096 - RNA, 21 nt, Artificial Sequence
  ELANE RNA Guide
gcucaacgggucagccaccau

SEQ ID NO: 15097 - RNA, 21 nt, Artificial Sequence
  ELANE RNA Guide
gcugacccguugagcuguggc

SEQ ID NO: 15098 - RNA, 21 nt, Artificial Sequence
  ELANE RNA Guide
ggcguugaugguggcugaccc

SEQ ID NO: 15099 - RNA, 21 nt, Artificial Sequence
  ELANE RNA Guide
ggcugacccguugagcugugg

SEQ ID NO: 15100 - RNA, 21 nt, Artificial Sequence
  ELANE RNA Guide
gggucagccaccaucaacgcc

SEQ ID NO: 15101 - RNA, 21 nt, Artificial Sequence
  ELANE RNA Guide
ggucagccaccaucaacgcca

SEQ ID NO: 15102 - RNA, 21 nt, Artificial Sequence
  ELANE RNA Guide
gguggcugacccguugagcug

SEQ ID NO: 15103 - RNA, 21 nt, Artificial Sequence
  ELANE RNA Guide
gucagccaccaucaacgccaa

SEQ ID NO: 15104 - RNA, 21 nt, Artificial Sequence
  ELANE RNA Guide
guggcugacccguugagcugu

SEQ ID NO: 15105 - RNA, 21 nt, Artificial Sequence
  ELANE RNA Guide
guugaugguggcugacccguu

SEQ ID NO: 15106 - RNA, 21 nt, Artificial Sequence
  ELANE RNA Guide
guuggcguugaugguggcuga

SEQ ID NO: 15107 - RNA, 21 nt, Artificial Sequence
  ELANE RNA Guide
ucaacgggucagccaccauca

SEQ ID NO: 15108 - RNA, 21 nt, Artificial Sequence
  ELANE RNA Guide
ucagccaccaucaacgccaac

SEQ ID NO: 15109 - RNA, 21 nt, Artificial Sequence
  ELANE RNA Guide
ugaugguggcugacccguuga

SEQ ID NO: 15110 - RNA, 21 nt, Artificial Sequence
  ELANE RNA Guide
uggcguugaugguggcugacc

SEQ ID NO: 15111 - RNA, 21 nt, Artificial Sequence
  ELANE RNA Guide
uggcugacccguugagcugug

SEQ ID NO: 15112 - RNA, 21 nt, Artificial Sequence
  ELANE RNA Guide
ugguggcugacccguugagcu

SEQ ID NO: 15113 - RNA, 21 nt, Artificial Sequence
  ELANE RNA Guide
uugaugguggcugacccguug

SEQ ID NO: 15114 - RNA, 21 nt, Artificial Sequence
  ELANE RNA Guide
uuggcguugaugguggcugac

SEQ ID NO: 15115 - RNA, 22 nt, Artificial Sequence
  ELANE RNA Guide
aacgggucagccaccaucaacg

SEQ ID NO: 15116 - RNA, 22 nt, Artificial Sequence
  ELANE RNA Guide
acagcucaacgggucagccacc

SEQ ID NO: 15117 - RNA, 22 nt, Artificial Sequence
  ELANE RNA Guide
accgccacagcucaacggguca

SEQ ID NO: 15118 - RNA, 22 nt, Artificial Sequence
  ELANE RNA Guide
acgggucagccaccaucaacgc

SEQ ID NO: 15119 - RNA, 22 nt, Artificial Sequence
  ELANE RNA Guide
acguuggcguugaugguggcug

SEQ ID NO: 15120 - RNA, 22 nt, Artificial Sequence
  ELANE RNA Guide
agcucaacgggucagccaccau

SEQ ID NO: 15121 - RNA, 22 nt, Artificial Sequence
  ELANE RNA Guide
augguggcugacccguugagcu

SEQ ID NO: 15122 - RNA, 22 nt, Artificial Sequence
  ELANE RNA Guide
caacgggucagccaccaucaac

SEQ ID NO: 15123 - RNA, 22 nt, Artificial Sequence
  ELANE RNA Guide
cacagcucaacgggucagccac

SEQ ID NO: 15124 - RNA, 22 nt, Artificial Sequence
  ELANE RNA Guide
caccgccacagcucaacggguc

SEQ ID NO: 15125 - RNA, 22 nt, Artificial Sequence
  ELANE RNA Guide
cacguuggcguugaugguggcu

SEQ ID NO: 15126 - RNA, 22 nt, Artificial Sequence
  ELANE RNA Guide
cagccaccaucaacgccaacgu

SEQ ID NO: 15127 - RNA, 22 nt, Artificial Sequence
  ELANE RNA Guide
cagcucaacgggucagccacca

SEQ ID NO: 15128 - RNA, 22 nt, Artificial Sequence
  ELANE RNA Guide
ccacagcucaacgggucagcca

SEQ ID NO: 15129 - RNA, 22 nt, Artificial Sequence
  ELANE RNA Guide
ccgccacagcucaacgggucag

SEQ ID NO: 15130 - RNA, 22 nt, Artificial Sequence
  ELANE RNA Guide
ccugcacguuggcguugauggu

SEQ ID NO: 15131 - RNA, 22 nt, Artificial Sequence
  ELANE RNA Guide
cgccacagcucaacgggucagc

SEQ ID NO: 15132 - RNA, 22 nt, Artificial Sequence
  ELANE RNA Guide
cgggucagccaccaucaacgcc

SEQ ID NO: 15133 - RNA, 22 nt, Artificial Sequence
  ELANE RNA Guide
cguugaugguggcugacccguu

SEQ ID NO: 15134 - RNA, 22 nt, Artificial Sequence
  ELANE RNA Guide
cguuggcguugaugguggcuga

SEQ ID NO: 15135 - RNA, 22 nt, Artificial Sequence
  ELANE RNA Guide
cucaacgggucagccaccauca

SEQ ID NO: 15136 - RNA, 22 nt, Artificial Sequence
  ELANE RNA Guide
cugacccguugagcuguggcgg

SEQ ID NO: 15137 - RNA, 22 nt, Artificial Sequence
  ELANE RNA Guide
gaugguggcugacccguugagc

SEQ ID NO: 15138 - RNA, 22 nt, Artificial Sequence
  ELANE RNA Guide
gccacagcucaacgggucagcc

SEQ ID NO: 15139 - RNA, 22 nt, Artificial Sequence
  ELANE RNA Guide
gcguugaugguggcugacccgu

SEQ ID NO: 15140 - RNA, 22 nt, Artificial Sequence
  ELANE RNA Guide
gcucaacgggucagccaccauc

SEQ ID NO: 15141 - RNA, 22 nt, Artificial Sequence
  ELANE RNA Guide
gcugacccguugagcuguggcg

SEQ ID NO: 15142 - RNA, 22 nt, Artificial Sequence
  ELANE RNA Guide
ggcguugaugguggcugacccg

SEQ ID NO: 15143 - RNA, 22 nt, Artificial Sequence
  ELANE RNA Guide
ggcugacccguugagcuguggc

SEQ ID NO: 15144 - RNA, 22 nt, Artificial Sequence
  ELANE RNA Guide
gggucagccaccaucaacgcca

SEQ ID NO: 15145 - RNA, 22 nt, Artificial Sequence
  ELANE RNA Guide
ggucagccaccaucaacgccaa

SEQ ID NO: 15146 - RNA, 22 nt, Artificial Sequence
  ELANE RNA Guide
gguggcugacccguugagcugu

SEQ ID NO: 15147 - RNA, 22 nt, Artificial Sequence
  ELANE RNA Guide
gucagccaccaucaacgccaac

SEQ ID NO: 15148 - RNA, 22 nt, Artificial Sequence
  ELANE RNA Guide
guggcugacccguugagcugug

SEQ ID NO: 15149 - RNA, 22 nt, Artificial Sequence
  ELANE RNA Guide
guugaugguggcugacccguug

SEQ ID NO: 15150 - RNA, 22 nt, Artificial Sequence
  ELANE RNA Guide
guuggcguugaugguggcugac

SEQ ID NO: 15151 - RNA, 22 nt, Artificial Sequence
  ELANE RNA Guide
ucaacgggucagccaccaucaa

SEQ ID NO: 15152 - RNA, 22 nt, Artificial Sequence
  ELANE RNA Guide
ucagccaccaucaacgccaacg

SEQ ID NO: 15153 - RNA, 22 nt, Artificial Sequence
  ELANE RNA Guide
ugaugguggcugacccguugag

SEQ ID NO: 15154 - RNA, 22 nt, Artificial Sequence
  ELANE RNA Guide
uggcguugaugguggcugaccc

SEQ ID NO: 15155 - RNA, 22 nt, Artificial Sequence
  ELANE RNA Guide
uggcugacccguugagcugugg

SEQ ID NO: 15156 - RNA, 22 nt, Artificial Sequence
  ELANE RNA Guide
ugguggcugacccguugagcug

SEQ ID NO: 15157 - RNA, 22 nt, Artificial Sequence
  ELANE RNA Guide
uugaugguggcugacccguuga

SEQ ID NO: 15158 - RNA, 22 nt, Artificial Sequence
  ELANE RNA Guide
uuggcguugaugguggcugacc

SEQ ID NO: 15159 - RNA, 20 nt, Artificial Sequence
  ELANE RNA Guide
aacgggucggccaucaacgc

SEQ ID NO: 15160 - RNA, 20 nt, Artificial Sequence
  ELANE RNA Guide
acagcucaacgggucggcca

SEQ ID NO: 15161 - RNA, 20 nt, Artificial Sequence
  ELANE RNA Guide
accugcacguuggcguugau

SEQ ID NO: 15162 - RNA, 20 nt, Artificial Sequence
  ELANE RNA Guide
acgggucggccaucaacgcc

SEQ ID NO: 15163 - RNA, 20 nt, Artificial Sequence
  ELANE RNA Guide
acguuggcguugauggccga

SEQ ID NO: 15164 - RNA, 20 nt, Artificial Sequence
  ELANE RNA Guide
agcucaacgggucggccauc

SEQ ID NO: 15165 - RNA, 20 nt, Artificial Sequence
  ELANE RNA Guide
auggccgacccguugagcug

SEQ ID NO: 15166 - RNA, 20 nt, Artificial Sequence
  ELANE RNA Guide
caacgggucggccaucaacg

SEQ ID NO: 15167 - RNA, 20 nt, Artificial Sequence
  ELANE RNA Guide
cacagcucaacgggucggcc

SEQ ID NO: 15168 - RNA, 20 nt, Artificial Sequence
  ELANE RNA Guide
caccugcacguuggcguuga

SEQ ID NO: 15169 - RNA, 20 nt, Artificial Sequence
  ELANE RNA Guide
cacguuggcguugauggccg

SEQ ID NO: 15170 - RNA, 20 nt, Artificial Sequence
  ELANE RNA Guide
cagcucaacgggucggccau

SEQ ID NO: 15171 - RNA, 20 nt, Artificial Sequence
  ELANE RNA Guide
ccacagcucaacgggucggc

SEQ ID NO: 15172 - RNA, 20 nt, Artificial Sequence
  ELANE RNA Guide
ccugcacguuggcguugaug

SEQ ID NO: 15173 - RNA, 20 nt, Artificial Sequence
  ELANE RNA Guide
cggccaucaacgccaacgug

SEQ ID NO: 15174 - RNA, 20 nt, Artificial Sequence
  ELANE RNA Guide
cgggucggccaucaacgcca

SEQ ID NO: 15175 - RNA, 20 nt, Artificial Sequence
  ELANE RNA Guide
cguugauggccgacccguug

SEQ ID NO: 15176 - RNA, 20 nt, Artificial Sequence
  ELANE RNA Guide
cguuggcguugauggccgac

SEQ ID NO: 15177 - RNA, 20 nt, Artificial Sequence
  ELANE RNA Guide
cucaacgggucggccaucaa

SEQ ID NO: 15178 - RNA, 20 nt, Artificial Sequence
  ELANE RNA Guide
cugcacguuggcguugaugg

SEQ ID NO: 15179 - RNA, 20 nt, Artificial Sequence
  ELANE RNA Guide
gauggccgacccguugagcu

SEQ ID NO: 15180 - RNA, 20 nt, Artificial Sequence
  ELANE RNA Guide
gcacguuggcguugauggcc

SEQ ID NO: 15181 - RNA, 20 nt, Artificial Sequence
  ELANE RNA Guide
gccacagcucaacgggucgg

SEQ ID NO: 15182 - RNA, 20 nt, Artificial Sequence
  ELANE RNA Guide
gcguugauggccgacccguu

SEQ ID NO: 15183 - RNA, 20 nt, Artificial Sequence
  ELANE RNA Guide
gcucaacgggucggccauca

SEQ ID NO: 15184 - RNA, 20 nt, Artificial Sequence
  ELANE RNA Guide
ggccaucaacgccaacgugc

SEQ ID NO: 15185 - RNA, 20 nt, Artificial Sequence
  ELANE RNA Guide
ggcguugauggccgacccgu

SEQ ID NO: 15186 - RNA, 20 nt, Artificial Sequence
  ELANE RNA Guide
gggucggccaucaacgccaa

SEQ ID NO: 15187 - RNA, 20 nt, Artificial Sequence
  ELANE RNA Guide
ggucggccaucaacgccaac

SEQ ID NO: 15188 - RNA, 20 nt, Artificial Sequence
  ELANE RNA Guide
gucggccaucaacgccaacg

SEQ ID NO: 15189 - RNA, 20 nt, Artificial Sequence
  ELANE RNA Guide
guugauggccgacccguuga

SEQ ID NO: 15190 - RNA, 20 nt, Artificial Sequence
  ELANE RNA Guide
guuggcguugauggccgacc

SEQ ID NO: 15191 - RNA, 20 nt, Artificial Sequence
  ELANE RNA Guide
ucaacgggucggccaucaac

SEQ ID NO: 15192 - RNA, 20 nt, Artificial Sequence
  ELANE RNA Guide
ucggccaucaacgccaacgu

SEQ ID NO: 15193 - RNA, 20 nt, Artificial Sequence
  ELANE RNA Guide
ugauggccgacccguugagc

SEQ ID NO: 15194 - RNA, 20 nt, Artificial Sequence
  ELANE RNA Guide
ugcacguuggcguugauggc

SEQ ID NO: 15195 - RNA, 20 nt, Artificial Sequence
  ELANE RNA Guide
uggcguugauggccgacccg

SEQ ID NO: 15196 - RNA, 20 nt, Artificial Sequence
  ELANE RNA Guide
uugauggccgacccguugag

SEQ ID NO: 15197 - RNA, 20 nt, Artificial Sequence
  ELANE RNA Guide
uuggcguugauggccgaccc

SEQ ID NO: 15198 - RNA, 21 nt, Artificial Sequence
  ELANE RNA Guide
aacgggucggccaucaacgcc

SEQ ID NO: 15199 - RNA, 21 nt, Artificial Sequence
  ELANE RNA Guide
acagcucaacgggucggccau

SEQ ID NO: 15200 - RNA, 21 nt, Artificial Sequence
  ELANE RNA Guide
accugcacguuggcguugaug

SEQ ID NO: 15201 - RNA, 21 nt, Artificial Sequence
  ELANE RNA Guide
acgggucggccaucaacgcca

SEQ ID NO: 15202 - RNA, 21 nt, Artificial Sequence
  ELANE RNA Guide
acguuggcguugauggccgac

SEQ ID NO: 15203 - RNA, 21 nt, Artificial Sequence
  ELANE RNA Guide
agcucaacgggucggccauca

SEQ ID NO: 15204 - RNA, 21 nt, Artificial Sequence
  ELANE RNA Guide
auggccgacccguugagcugu

SEQ ID NO: 15205 - RNA, 21 nt, Artificial Sequence
  ELANE RNA Guide
caacgggucggccaucaacgc

SEQ ID NO: 15206 - RNA, 21 nt, Artificial Sequence
  ELANE RNA Guide
cacagcucaacgggucggcca

SEQ ID NO: 15207 - RNA, 21 nt, Artificial Sequence
  ELANE RNA Guide
caccugcacguuggcguugau

SEQ ID NO: 15208 - RNA, 21 nt, Artificial Sequence
  ELANE RNA Guide
cacguuggcguugauggccga

SEQ ID NO: 15209 - RNA, 21 nt, Artificial Sequence
  ELANE RNA Guide
cagcucaacgggucggccauc

SEQ ID NO: 15210 - RNA, 21 nt, Artificial Sequence
  ELANE RNA Guide
ccacagcucaacgggucggcc

SEQ ID NO: 15211 - RNA, 21 nt, Artificial Sequence
  ELANE RNA Guide
ccaccugcacguuggcguuga

SEQ ID NO: 15212 - RNA, 21 nt, Artificial Sequence
  ELANE RNA Guide
ccugcacguuggcguugaugg

SEQ ID NO: 15213 - RNA, 21 nt, Artificial Sequence
  ELANE RNA Guide
cgccacagcucaacgggucgg

SEQ ID NO: 15214 - RNA, 21 nt, Artificial Sequence
  ELANE RNA Guide
cggccaucaacgccaacgugc

SEQ ID NO: 15215 - RNA, 21 nt, Artificial Sequence
  ELANE RNA Guide
cgggucggccaucaacgccaa

SEQ ID NO: 15216 - RNA, 21 nt, Artificial Sequence
  ELANE RNA Guide
cguugauggccgacccguuga

SEQ ID NO: 15217 - RNA, 21 nt, Artificial Sequence
  ELANE RNA Guide
cguuggcguugauggccgacc

SEQ ID NO: 15218 - RNA, 21 nt, Artificial Sequence
  ELANE RNA Guide
cucaacgggucggccaucaac

SEQ ID NO: 15219 - RNA, 21 nt, Artificial Sequence
  ELANE RNA Guide
cugcacguuggcguugauggc

SEQ ID NO: 15220 - RNA, 21 nt, Artificial Sequence
  ELANE RNA Guide
gauggccgacccguugagcug

SEQ ID NO: 15221 - RNA, 21 nt, Artificial Sequence
  ELANE RNA Guide
gcacguuggcguugauggccg

SEQ ID NO: 15222 - RNA, 21 nt, Artificial Sequence
  ELANE RNA Guide
gccacagcucaacgggucggc

SEQ ID NO: 15223 - RNA, 21 nt, Artificial Sequence
  ELANE RNA Guide
gcguugauggccgacccguug

SEQ ID NO: 15224 - RNA, 21 nt, Artificial Sequence
  ELANE RNA Guide
gcucaacgggucggccaucaa

SEQ ID NO: 15225 - RNA, 21 nt, Artificial Sequence
  ELANE RNA Guide
ggccaucaacgccaacgugca

SEQ ID NO: 15226 - RNA, 21 nt, Artificial Sequence
  ELANE RNA Guide
ggcguugauggccgacccguu

SEQ ID NO: 15227 - RNA, 21 nt, Artificial Sequence
  ELANE RNA Guide
gggucggccaucaacgccaac

SEQ ID NO: 15228 - RNA, 21 nt, Artificial Sequence
  ELANE RNA Guide
ggucggccaucaacgccaacg

SEQ ID NO: 15229 - RNA, 21 nt, Artificial Sequence
  ELANE RNA Guide
gucggccaucaacgccaacgu

SEQ ID NO: 15230 - RNA, 21 nt, Artificial Sequence
  ELANE RNA Guide
guugauggccgacccguugag

SEQ ID NO: 15231 - RNA, 21 nt, Artificial Sequence
  ELANE RNA Guide
guuggcguugauggccgaccc

SEQ ID NO: 15232 - RNA, 21 nt, Artificial Sequence
  ELANE RNA Guide
ucaacgggucggccaucaacg

SEQ ID NO: 15233 - RNA, 21 nt, Artificial Sequence
  ELANE RNA Guide
ucggccaucaacgccaacgug

SEQ ID NO: 15234 - RNA, 21 nt, Artificial Sequence
  ELANE RNA Guide
ugauggccgacccguugagcu

SEQ ID NO: 15235 - RNA, 21 nt, Artificial Sequence
  ELANE RNA Guide
ugcacguuggcguugauggcc

SEQ ID NO: 15236 - RNA, 21 nt, Artificial Sequence
  ELANE RNA Guide
uggcguugauggccgacccgu

SEQ ID NO: 15237 - RNA, 21 nt, Artificial Sequence
  ELANE RNA Guide
uugauggccgacccguugagc

SEQ ID NO: 15238 - RNA, 21 nt, Artificial Sequence
  ELANE RNA Guide
uuggcguugauggccgacccg

SEQ ID NO: 15239 - RNA, 22 nt, Artificial Sequence
  ELANE RNA Guide
aacgggucggccaucaacgcca

SEQ ID NO: 15240 - RNA, 22 nt, Artificial Sequence
  ELANE RNA Guide
acagcucaacgggucggccauc

SEQ ID NO: 15241 - RNA, 22 nt, Artificial Sequence
  ELANE RNA Guide
accugcacguuggcguugaugg

SEQ ID NO: 15242 - RNA, 22 nt, Artificial Sequence
  ELANE RNA Guide
acgggucggccaucaacgccaa

SEQ ID NO: 15243 - RNA, 22 nt, Artificial Sequence
  ELANE RNA Guide
acguuggcguugauggccgacc

SEQ ID NO: 15244 - RNA, 22 nt, Artificial Sequence
  ELANE RNA Guide
agcucaacgggucggccaucaa

SEQ ID NO: 15245 - RNA, 22 nt, Artificial Sequence
  ELANE RNA Guide
auggccgacccguugagcugug

SEQ ID NO: 15246 - RNA, 22 nt, Artificial Sequence
  ELANE RNA Guide
caacgggucggccaucaacgcc

SEQ ID NO: 15247 - RNA, 22 nt, Artificial Sequence
  ELANE RNA Guide
cacagcucaacgggucggccau

SEQ ID NO: 15248 - RNA, 22 nt, Artificial Sequence
  ELANE RNA Guide
caccugcacguuggcguugaug

SEQ ID NO: 15249 - RNA, 22 nt, Artificial Sequence
  ELANE RNA Guide
cacguuggcguugauggccgac

SEQ ID NO: 15250 - RNA, 22 nt, Artificial Sequence
  ELANE RNA Guide
cagcucaacgggucggccauca

SEQ ID NO: 15251 - RNA, 22 nt, Artificial Sequence
  ELANE RNA Guide
ccacagcucaacgggucggcca

SEQ ID NO: 15252 - RNA, 22 nt, Artificial Sequence
  ELANE RNA Guide
ccaccugcacguuggcguugau

SEQ ID NO: 15253 - RNA, 22 nt, Artificial Sequence
  ELANE RNA Guide
ccgccacagcucaacgggucgg

SEQ ID NO: 15254 - RNA, 22 nt, Artificial Sequence
  ELANE RNA Guide
ccugcacguuggcguugauggc

SEQ ID NO: 15255 - RNA, 22 nt, Artificial Sequence
  ELANE RNA Guide
cgccacagcucaacgggucggc

SEQ ID NO: 15256 - RNA, 22 nt, Artificial Sequence
  ELANE RNA Guide
cggccaucaacgccaacgugca

SEQ ID NO: 15257 - RNA, 22 nt, Artificial Sequence
  ELANE RNA Guide
cgggucggccaucaacgccaac

SEQ ID NO: 15258 - RNA, 22 nt, Artificial Sequence
  ELANE RNA Guide
cguugauggccgacccguugag

SEQ ID NO: 15259 - RNA, 22 nt, Artificial Sequence
  ELANE RNA Guide
cguuggcguugauggccgaccc

SEQ ID NO: 15260 - RNA, 22 nt, Artificial Sequence
  ELANE RNA Guide
cucaacgggucggccaucaacg

SEQ ID NO: 15261 - RNA, 22 nt, Artificial Sequence
  ELANE RNA Guide
cugcacguuggcguugauggcc

SEQ ID NO: 15262 - RNA, 22 nt, Artificial Sequence
  ELANE RNA Guide
gauggccgacccguugagcugu

SEQ ID NO: 15263 - RNA, 22 nt, Artificial Sequence
  ELANE RNA Guide
gcacguuggcguugauggccga

SEQ ID NO: 15264 - RNA, 22 nt, Artificial Sequence
  ELANE RNA Guide
gccacagcucaacgggucggcc

SEQ ID NO: 15265 - RNA, 22 nt, Artificial Sequence
  ELANE RNA Guide
gccaccugcacguuggcguuga

SEQ ID NO: 15266 - RNA, 22 nt, Artificial Sequence
  ELANE RNA Guide
gcguugauggccgacccguuga

SEQ ID NO: 15267 - RNA, 22 nt, Artificial Sequence
  ELANE RNA Guide
gcucaacgggucggccaucaac

SEQ ID NO: 15268 - RNA, 22 nt, Artificial Sequence
  ELANE RNA Guide
ggccaucaacgccaacgugcag

SEQ ID NO: 15269 - RNA, 22 nt, Artificial Sequence
  ELANE RNA Guide
ggcguugauggccgacccguug

SEQ ID NO: 15270 - RNA, 22 nt, Artificial Sequence
  ELANE RNA Guide
gggucggccaucaacgccaacg

SEQ ID NO: 15271 - RNA, 22 nt, Artificial Sequence
  ELANE RNA Guide
ggucggccaucaacgccaacgu

SEQ ID NO: 15272 - RNA, 22 nt, Artificial Sequence
  ELANE RNA Guide
gucggccaucaacgccaacgug

SEQ ID NO: 15273 - RNA, 22 nt, Artificial Sequence
  ELANE RNA Guide
guugauggccgacccguugagc

SEQ ID NO: 15274 - RNA, 22 nt, Artificial Sequence
  ELANE RNA Guide
guuggcguugauggccgacccg

SEQ ID NO: 15275 - RNA, 22 nt, Artificial Sequence
  ELANE RNA Guide
ucaacgggucggccaucaacgc

SEQ ID NO: 15276 - RNA, 22 nt, Artificial Sequence
  ELANE RNA Guide
ucggccaucaacgccaacgugc

SEQ ID NO: 15277 - RNA, 22 nt, Artificial Sequence
  ELANE RNA Guide
ugauggccgacccguugagcug

SEQ ID NO: 15278 - RNA, 22 nt, Artificial Sequence
  ELANE RNA Guide
ugcacguuggcguugauggccg

SEQ ID NO: 15279 - RNA, 22 nt, Artificial Sequence
  ELANE RNA Guide
uggcguugauggccgacccguu

SEQ ID NO: 15280 - RNA, 22 nt, Artificial Sequence
  ELANE RNA Guide
uugauggccgacccguugagcu

SEQ ID NO: 15281 - RNA, 22 nt, Artificial Sequence
  ELANE RNA Guide
uuggcguugauggccgacccgu

SEQ ID NO: 15282 - RNA, 20 nt, Artificial Sequence
  ELANE RNA Guide
aacgggucgcccaccaucaa

SEQ ID NO: 15283 - RNA, 20 nt, Artificial Sequence
  ELANE RNA Guide
acagcucaacgggucgccca

SEQ ID NO: 15284 - RNA, 20 nt, Artificial Sequence
  ELANE RNA Guide
acgggucgcccaccaucaac

SEQ ID NO: 15285 - RNA, 20 nt, Artificial Sequence
  ELANE RNA Guide
acguuggcguugaugguggg

SEQ ID NO: 15286 - RNA, 20 nt, Artificial Sequence
  ELANE RNA Guide
agcucaacgggucgcccacc

SEQ ID NO: 15287 - RNA, 20 nt, Artificial Sequence
  ELANE RNA Guide
auggugggcgacccguugag

SEQ ID NO: 15288 - RNA, 20 nt, Artificial Sequence
  ELANE RNA Guide
caacgggucgcccaccauca

SEQ ID NO: 15289 - RNA, 20 nt, Artificial Sequence
  ELANE RNA Guide
cacagcucaacgggucgccc

SEQ ID NO: 15290 - RNA, 20 nt, Artificial Sequence
  ELANE RNA Guide
cagcucaacgggucgcccac

SEQ ID NO: 15291 - RNA, 20 nt, Artificial Sequence
  ELANE RNA Guide
ccacagcucaacgggucgcc

SEQ ID NO: 15292 - RNA, 20 nt, Artificial Sequence
  ELANE RNA Guide
cgccacagcucaacgggucg

SEQ ID NO: 15293 - RNA, 20 nt, Artificial Sequence
  ELANE RNA Guide
cgcccaccaucaacgccaac

SEQ ID NO: 15294 - RNA, 20 nt, Artificial Sequence
  ELANE RNA Guide
cgggucgcccaccaucaacg

SEQ ID NO: 15295 - RNA, 20 nt, Artificial Sequence
  ELANE RNA Guide
cguugauggugggcgacccg

SEQ ID NO: 15296 - RNA, 20 nt, Artificial Sequence
  ELANE RNA Guide
cguuggcguugauggugggc

SEQ ID NO: 15297 - RNA, 20 nt, Artificial Sequence
  ELANE RNA Guide
cucaacgggucgcccaccau

SEQ ID NO: 15298 - RNA, 20 nt, Artificial Sequence
  ELANE RNA Guide
gauggugggcgacccguuga

SEQ ID NO: 15299 - RNA, 20 nt, Artificial Sequence
  ELANE RNA Guide
gccacagcucaacgggucgc

SEQ ID NO: 15300 - RNA, 20 nt, Artificial Sequence
  ELANE RNA Guide
gcccaccaucaacgccaacg

SEQ ID NO: 15301 - RNA, 20 nt, Artificial Sequence
  ELANE RNA Guide
gcguugauggugggcgaccc

SEQ ID NO: 15302 - RNA, 20 nt, Artificial Sequence
  ELANE RNA Guide
gcucaacgggucgcccacca

SEQ ID NO: 15303 - RNA, 20 nt, Artificial Sequence
  ELANE RNA Guide
ggcgacccguugagcugugg

SEQ ID NO: 15304 - RNA, 20 nt, Artificial Sequence
  ELANE RNA Guide
ggcguugauggugggcgacc

SEQ ID NO: 15305 - RNA, 20 nt, Artificial Sequence
  ELANE RNA Guide
gggcgacccguugagcugug

SEQ ID NO: 15306 - RNA, 20 nt, Artificial Sequence
  ELANE RNA Guide
gggucgcccaccaucaacgc

SEQ ID NO: 15307 - RNA, 20 nt, Artificial Sequence
  ELANE RNA Guide
ggucgcccaccaucaacgcc

SEQ ID NO: 15308 - RNA, 20 nt, Artificial Sequence
  ELANE RNA Guide
ggugggcgacccguugagcu

SEQ ID NO: 15309 - RNA, 20 nt, Artificial Sequence
  ELANE RNA Guide
gucgcccaccaucaacgcca

SEQ ID NO: 15310 - RNA, 20 nt, Artificial Sequence
  ELANE RNA Guide
gugggcgacccguugagcug

SEQ ID NO: 15311 - RNA, 20 nt, Artificial Sequence
  ELANE RNA Guide
guugauggugggcgacccgu

SEQ ID NO: 15312 - RNA, 20 nt, Artificial Sequence
  ELANE RNA Guide
guuggcguugauggugggcg

SEQ ID NO: 15313 - RNA, 20 nt, Artificial Sequence
  ELANE RNA Guide
ucaacgggucgcccaccauc

SEQ ID NO: 15314 - RNA, 20 nt, Artificial Sequence
  ELANE RNA Guide
ucgcccaccaucaacgccaa

SEQ ID NO: 15315 - RNA, 20 nt, Artificial Sequence
  ELANE RNA Guide
ugauggugggcgacccguug

SEQ ID NO: 15316 - RNA, 20 nt, Artificial Sequence
  ELANE RNA Guide
uggcguugauggugggcgac

SEQ ID NO: 15317 - RNA, 20 nt, Artificial Sequence
  ELANE RNA Guide
ugggcgacccguugagcugu

SEQ ID NO: 15318 - RNA, 20 nt, Artificial Sequence
  ELANE RNA Guide
uggugggcgacccguugagc

SEQ ID NO: 15319 - RNA, 20 nt, Artificial Sequence
  ELANE RNA Guide
uugauggugggcgacccguu

SEQ ID NO: 15320 - RNA, 20 nt, Artificial Sequence
  ELANE RNA Guide
uuggcguugauggugggcga

SEQ ID NO: 15321 - RNA, 21 nt, Artificial Sequence
  ELANE RNA Guide
aacgggucgcccaccaucaac

SEQ ID NO: 15322 - RNA, 21 nt, Artificial Sequence
  ELANE RNA Guide
acagcucaacgggucgcccac

SEQ ID NO: 15323 - RNA, 21 nt, Artificial Sequence
  ELANE RNA Guide
acgggucgcccaccaucaacg

SEQ ID NO: 15324 - RNA, 21 nt, Artificial Sequence
  ELANE RNA Guide
acguuggcguugauggugggc

SEQ ID NO: 15325 - RNA, 21 nt, Artificial Sequence
  ELANE RNA Guide
agcucaacgggucgcccacca

SEQ ID NO: 15326 - RNA, 21 nt, Artificial Sequence
  ELANE RNA Guide
auggugggcgacccguugagc

SEQ ID NO: 15327 - RNA, 21 nt, Artificial Sequence
  ELANE RNA Guide
caacgggucgcccaccaucaa

SEQ ID NO: 15328 - RNA, 21 nt, Artificial Sequence
  ELANE RNA Guide
cacagcucaacgggucgccca

SEQ ID NO: 15329 - RNA, 21 nt, Artificial Sequence
  ELANE RNA Guide
cacguuggcguugaugguggg

SEQ ID NO: 15330 - RNA, 21 nt, Artificial Sequence
  ELANE RNA Guide
cagcucaacgggucgcccacc

SEQ ID NO: 15331 - RNA, 21 nt, Artificial Sequence
  ELANE RNA Guide
ccacagcucaacgggucgccc

SEQ ID NO: 15332 - RNA, 21 nt, Artificial Sequence
  ELANE RNA Guide
ccgccacagcucaacgggucg

SEQ ID NO: 15333 - RNA, 21 nt, Artificial Sequence
  ELANE RNA Guide
cgccacagcucaacgggucgc

SEQ ID NO: 15334 - RNA, 21 nt, Artificial Sequence
  ELANE RNA Guide
cgcccaccaucaacgccaacg

SEQ ID NO: 15335 - RNA, 21 nt, Artificial Sequence
  ELANE RNA Guide
cgggucgcccaccaucaacgc

SEQ ID NO: 15336 - RNA, 21 nt, Artificial Sequence
  ELANE RNA Guide
cguugauggugggcgacccgu

SEQ ID NO: 15337 - RNA, 21 nt, Artificial Sequence
  ELANE RNA Guide
cguuggcguugauggugggcg

SEQ ID NO: 15338 - RNA, 21 nt, Artificial Sequence
  ELANE RNA Guide
cucaacgggucgcccaccauc

SEQ ID NO: 15339 - RNA, 21 nt, Artificial Sequence
  ELANE RNA Guide
gauggugggcgacccguugag

SEQ ID NO: 15340 - RNA, 21 nt, Artificial Sequence
  ELANE RNA Guide
gccacagcucaacgggucgcc

SEQ ID NO: 15341 - RNA, 21 nt, Artificial Sequence
  ELANE RNA Guide
gcccaccaucaacgccaacgu

SEQ ID NO: 15342 - RNA, 21 nt, Artificial Sequence
  ELANE RNA Guide
gcguugauggugggcgacccg

SEQ ID NO: 15343 - RNA, 21 nt, Artificial Sequence
  ELANE RNA Guide
gcucaacgggucgcccaccau

SEQ ID NO: 15344 - RNA, 21 nt, Artificial Sequence
  ELANE RNA Guide
ggcgacccguugagcuguggc

SEQ ID NO: 15345 - RNA, 21 nt, Artificial Sequence
  ELANE RNA Guide
ggcguugauggugggcgaccc

SEQ ID NO: 15346 - RNA, 21 nt, Artificial Sequence
  ELANE RNA Guide
gggcgacccguugagcugugg

SEQ ID NO: 15347 - RNA, 21 nt, Artificial Sequence
  ELANE RNA Guide
gggucgcccaccaucaacgcc

SEQ ID NO: 15348 - RNA, 21 nt, Artificial Sequence
  ELANE RNA Guide
ggucgcccaccaucaacgcca

SEQ ID NO: 15349 - RNA, 21 nt, Artificial Sequence
  ELANE RNA Guide
ggugggcgacccguugagcug

SEQ ID NO: 15350 - RNA, 21 nt, Artificial Sequence
  ELANE RNA Guide
gucgcccaccaucaacgccaa

SEQ ID NO: 15351 - RNA, 21 nt, Artificial Sequence
  ELANE RNA Guide
gugggcgacccguugagcugu

SEQ ID NO: 15352 - RNA, 21 nt, Artificial Sequence
  ELANE RNA Guide
guugauggugggcgacccguu

SEQ ID NO: 15353 - RNA, 21 nt, Artificial Sequence
  ELANE RNA Guide
guuggcguugauggugggcga

SEQ ID NO: 15354 - RNA, 21 nt, Artificial Sequence
  ELANE RNA Guide
ucaacgggucgcccaccauca

SEQ ID NO: 15355 - RNA, 21 nt, Artificial Sequence
  ELANE RNA Guide
ucgcccaccaucaacgccaac

SEQ ID NO: 15356 - RNA, 21 nt, Artificial Sequence
  ELANE RNA Guide
ugauggugggcgacccguuga

SEQ ID NO: 15357 - RNA, 21 nt, Artificial Sequence
  ELANE RNA Guide
uggcguugauggugggcgacc

SEQ ID NO: 15358 - RNA, 21 nt, Artificial Sequence
  ELANE RNA Guide
ugggcgacccguugagcugug

SEQ ID NO: 15359 - RNA, 21 nt, Artificial Sequence
  ELANE RNA Guide
uggugggcgacccguugagcu

SEQ ID NO: 15360 - RNA, 21 nt, Artificial Sequence
  ELANE RNA Guide
uugauggugggcgacccguug

SEQ ID NO: 15361 - RNA, 21 nt, Artificial Sequence
  ELANE RNA Guide
uuggcguugauggugggcgac

SEQ ID NO: 15362 - RNA, 22 nt, Artificial Sequence
  ELANE RNA Guide
aacgggucgcccaccaucaacg

SEQ ID NO: 15363 - RNA, 22 nt, Artificial Sequence
  ELANE RNA Guide
acagcucaacgggucgcccacc

SEQ ID NO: 15364 - RNA, 22 nt, Artificial Sequence
  ELANE RNA Guide
accgccacagcucaacgggucg

SEQ ID NO: 15365 - RNA, 22 nt, Artificial Sequence
  ELANE RNA Guide
acgggucgcccaccaucaacgc

SEQ ID NO: 15366 - RNA, 22 nt, Artificial Sequence
  ELANE RNA Guide
acguuggcguugauggugggcg

SEQ ID NO: 15367 - RNA, 22 nt, Artificial Sequence
  ELANE RNA Guide
agcucaacgggucgcccaccau

SEQ ID NO: 15368 - RNA, 22 nt, Artificial Sequence
  ELANE RNA Guide
auggugggcgacccguugagcu

SEQ ID NO: 15369 - RNA, 22 nt, Artificial Sequence
  ELANE RNA Guide
caacgggucgcccaccaucaac

SEQ ID NO: 15370 - RNA, 22 nt, Artificial Sequence
  ELANE RNA Guide
cacagcucaacgggucgcccac

SEQ ID NO: 15371 - RNA, 22 nt, Artificial Sequence
  ELANE RNA Guide
cacguuggcguugauggugggc

SEQ ID NO: 15372 - RNA, 22 nt, Artificial Sequence
  ELANE RNA Guide
cagcucaacgggucgcccacca

SEQ ID NO: 15373 - RNA, 22 nt, Artificial Sequence
  ELANE RNA Guide
ccacagcucaacgggucgccca

SEQ ID NO: 15374 - RNA, 22 nt, Artificial Sequence
  ELANE RNA Guide
ccgccacagcucaacgggucgc

SEQ ID NO: 15375 - RNA, 22 nt, Artificial Sequence
  ELANE RNA Guide
cgccacagcucaacgggucgcc

SEQ ID NO: 15376 - RNA, 22 nt, Artificial Sequence
  ELANE RNA Guide
cgcccaccaucaacgccaacgu

SEQ ID NO: 15377 - RNA, 22 nt, Artificial Sequence
  ELANE RNA Guide
cgggucgcccaccaucaacgcc

SEQ ID NO: 15378 - RNA, 22 nt, Artificial Sequence
  ELANE RNA Guide
cguugauggugggcgacccguu

SEQ ID NO: 15379 - RNA, 22 nt, Artificial Sequence
  ELANE RNA Guide
cguuggcguugauggugggcga

SEQ ID NO: 15380 - RNA, 22 nt, Artificial Sequence
  ELANE RNA Guide
cucaacgggucgcccaccauca

SEQ ID NO: 15381 - RNA, 22 nt, Artificial Sequence
  ELANE RNA Guide
gauggugggcgacccguugagc

SEQ ID NO: 15382 - RNA, 22 nt, Artificial Sequence
  ELANE RNA Guide
gcacguuggcguugaugguggg

SEQ ID NO: 15383 - RNA, 22 nt, Artificial Sequence
  ELANE RNA Guide
gccacagcucaacgggucgccc

SEQ ID NO: 15384 - RNA, 22 nt, Artificial Sequence
  ELANE RNA Guide
gcccaccaucaacgccaacgug

SEQ ID NO: 15385 - RNA, 22 nt, Artificial Sequence
  ELANE RNA Guide
gcguugauggugggcgacccgu

SEQ ID NO: 15386 - RNA, 22 nt, Artificial Sequence
  ELANE RNA Guide
gcucaacgggucgcccaccauc

SEQ ID NO: 15387 - RNA, 22 nt, Artificial Sequence
  ELANE RNA Guide
ggcgacccguugagcuguggcg

SEQ ID NO: 15388 - RNA, 22 nt, Artificial Sequence
  ELANE RNA Guide
ggcguugauggugggcgacccg

SEQ ID NO: 15389 - RNA, 22 nt, Artificial Sequence
  ELANE RNA Guide
gggcgacccguugagcuguggc

SEQ ID NO: 15390 - RNA, 22 nt, Artificial Sequence
  ELANE RNA Guide
gggucgcccaccaucaacgcca

SEQ ID NO: 15391 - RNA, 22 nt, Artificial Sequence
  ELANE RNA Guide
ggucgcccaccaucaacgccaa

SEQ ID NO: 15392 - RNA, 22 nt, Artificial Sequence
  ELANE RNA Guide
ggugggcgacccguugagcugu

SEQ ID NO: 15393 - RNA, 22 nt, Artificial Sequence
  ELANE RNA Guide
gucgcccaccaucaacgccaac

SEQ ID NO: 15394 - RNA, 22 nt, Artificial Sequence
  ELANE RNA Guide
gugggcgacccguugagcugug

SEQ ID NO: 15395 - RNA, 22 nt, Artificial Sequence
  ELANE RNA Guide
guugauggugggcgacccguug

SEQ ID NO: 15396 - RNA, 22 nt, Artificial Sequence
  ELANE RNA Guide
guuggcguugauggugggcgac

SEQ ID NO: 15397 - RNA, 22 nt, Artificial Sequence
  ELANE RNA Guide
ucaacgggucgcccaccaucaa

SEQ ID NO: 15398 - RNA, 22 nt, Artificial Sequence
  ELANE RNA Guide
ucgcccaccaucaacgccaacg

SEQ ID NO: 15399 - RNA, 22 nt, Artificial Sequence
  ELANE RNA Guide
ugauggugggcgacccguugag

SEQ ID NO: 15400 - RNA, 22 nt, Artificial Sequence
  ELANE RNA Guide
uggcguugauggugggcgaccc

SEQ ID NO: 15401 - RNA, 22 nt, Artificial Sequence
  ELANE RNA Guide
ugggcgacccguugagcugugg

SEQ ID NO: 15402 - RNA, 22 nt, Artificial Sequence
  ELANE RNA Guide
uggugggcgacccguugagcug

SEQ ID NO: 15403 - RNA, 22 nt, Artificial Sequence
  ELANE RNA Guide
uugauggugggcgacccguuga

SEQ ID NO: 15404 - RNA, 22 nt, Artificial Sequence
  ELANE RNA Guide
uuggcguugauggugggcgacc

SEQ ID NO: 15405 - RNA, 20 nt, Artificial Sequence
  ELANE RNA Guide
aacgggucggacaccaucaa

SEQ ID NO: 15406 - RNA, 20 nt, Artificial Sequence
  ELANE RNA Guide
acagcucaacgggucggaca

SEQ ID NO: 15407 - RNA, 20 nt, Artificial Sequence
  ELANE RNA Guide
acgggucggacaccaucaac

SEQ ID NO: 15408 - RNA, 20 nt, Artificial Sequence
  ELANE RNA Guide
acguuggcguugaugguguc

SEQ ID NO: 15409 - RNA, 20 nt, Artificial Sequence
  ELANE RNA Guide
agcucaacgggucggacacc

SEQ ID NO: 15410 - RNA, 20 nt, Artificial Sequence
  ELANE RNA Guide
augguguccgacccguugag

SEQ ID NO: 15411 - RNA, 20 nt, Artificial Sequence
  ELANE RNA Guide
caacgggucggacaccauca

SEQ ID NO: 15412 - RNA, 20 nt, Artificial Sequence
  ELANE RNA Guide
cacagcucaacgggucggac

SEQ ID NO: 15413 - RNA, 20 nt, Artificial Sequence
  ELANE RNA Guide
cacguuggcguugauggugu

SEQ ID NO: 15414 - RNA, 20 nt, Artificial Sequence
  ELANE RNA Guide
cagcucaacgggucggacac

SEQ ID NO: 15415 - RNA, 20 nt, Artificial Sequence
  ELANE RNA Guide
ccacagcucaacgggucgga

SEQ ID NO: 15416 - RNA, 20 nt, Artificial Sequence
  ELANE RNA Guide
cggacaccaucaacgccaac

SEQ ID NO: 15417 - RNA, 20 nt, Artificial Sequence
  ELANE RNA Guide
cgggucggacaccaucaacg

SEQ ID NO: 15418 - RNA, 20 nt, Artificial Sequence
  ELANE RNA Guide
cguugaugguguccgacccg

SEQ ID NO: 15419 - RNA, 20 nt, Artificial Sequence
  ELANE RNA Guide
cguuggcguugauggugucc

SEQ ID NO: 15420 - RNA, 20 nt, Artificial Sequence
  ELANE RNA Guide
cucaacgggucggacaccau

SEQ ID NO: 15421 - RNA, 20 nt, Artificial Sequence
  ELANE RNA Guide
gacaccaucaacgccaacgu

SEQ ID NO: 15422 - RNA, 20 nt, Artificial Sequence
  ELANE RNA Guide
gaugguguccgacccguuga

SEQ ID NO: 15423 - RNA, 20 nt, Artificial Sequence
  ELANE RNA Guide
gcguugaugguguccgaccc

SEQ ID NO: 15424 - RNA, 20 nt, Artificial Sequence
  ELANE RNA Guide
gcucaacgggucggacacca

SEQ ID NO: 15425 - RNA, 20 nt, Artificial Sequence
  ELANE RNA Guide
ggacaccaucaacgccaacg

SEQ ID NO: 15426 - RNA, 20 nt, Artificial Sequence
  ELANE RNA Guide
ggcguugaugguguccgacc

SEQ ID NO: 15427 - RNA, 20 nt, Artificial Sequence
  ELANE RNA Guide
gggucggacaccaucaacgc

SEQ ID NO: 15428 - RNA, 20 nt, Artificial Sequence
  ELANE RNA Guide
ggucggacaccaucaacgcc

SEQ ID NO: 15429 - RNA, 20 nt, Artificial Sequence
  ELANE RNA Guide
gguguccgacccguugagcu

SEQ ID NO: 15430 - RNA, 20 nt, Artificial Sequence
  ELANE RNA Guide
guccgacccguugagcugug

SEQ ID NO: 15431 - RNA, 20 nt, Artificial Sequence
  ELANE RNA Guide
gucggacaccaucaacgcca

SEQ ID NO: 15432 - RNA, 20 nt, Artificial Sequence
  ELANE RNA Guide
guguccgacccguugagcug

SEQ ID NO: 15433 - RNA, 20 nt, Artificial Sequence
  ELANE RNA Guide
guugaugguguccgacccgu

SEQ ID NO: 15434 - RNA, 20 nt, Artificial Sequence
  ELANE RNA Guide
guuggcguugaugguguccg

SEQ ID NO: 15435 - RNA, 20 nt, Artificial Sequence
  ELANE RNA Guide
ucaacgggucggacaccauc

SEQ ID NO: 15436 - RNA, 20 nt, Artificial Sequence
  ELANE RNA Guide
ucggacaccaucaacgccaa

SEQ ID NO: 15437 - RNA, 20 nt, Artificial Sequence
  ELANE RNA Guide
ugaugguguccgacccguug

SEQ ID NO: 15438 - RNA, 20 nt, Artificial Sequence
  ELANE RNA Guide
uggcguugaugguguccgac

SEQ ID NO: 15439 - RNA, 20 nt, Artificial Sequence
  ELANE RNA Guide
ugguguccgacccguugagc

SEQ ID NO: 15440 - RNA, 20 nt, Artificial Sequence
  ELANE RNA Guide
uguccgacccguugagcugu

SEQ ID NO: 15441 - RNA, 20 nt, Artificial Sequence
  ELANE RNA Guide
uugaugguguccgacccguu

SEQ ID NO: 15442 - RNA, 20 nt, Artificial Sequence
  ELANE RNA Guide
uuggcguugaugguguccga

SEQ ID NO: 15443 - RNA, 21 nt, Artificial Sequence
  ELANE RNA Guide
aacgggucggacaccaucaac

SEQ ID NO: 15444 - RNA, 21 nt, Artificial Sequence
  ELANE RNA Guide
acagcucaacgggucggacac

SEQ ID NO: 15445 - RNA, 21 nt, Artificial Sequence
  ELANE RNA Guide
acgggucggacaccaucaacg

SEQ ID NO: 15446 - RNA, 21 nt, Artificial Sequence
  ELANE RNA Guide
acguuggcguugauggugucc

SEQ ID NO: 15447 - RNA, 21 nt, Artificial Sequence
  ELANE RNA Guide
agcucaacgggucggacacca

SEQ ID NO: 15448 - RNA, 21 nt, Artificial Sequence
  ELANE RNA Guide
augguguccgacccguugagc

SEQ ID NO: 15449 - RNA, 21 nt, Artificial Sequence
  ELANE RNA Guide
caacgggucggacaccaucaa

SEQ ID NO: 15450 - RNA, 21 nt, Artificial Sequence
  ELANE RNA Guide
cacagcucaacgggucggaca

SEQ ID NO: 15451 - RNA, 21 nt, Artificial Sequence
  ELANE RNA Guide
cacguuggcguugaugguguc

SEQ ID NO: 15452 - RNA, 21 nt, Artificial Sequence
  ELANE RNA Guide
cagcucaacgggucggacacc

SEQ ID NO: 15453 - RNA, 21 nt, Artificial Sequence
  ELANE RNA Guide
ccacagcucaacgggucggac

SEQ ID NO: 15454 - RNA, 21 nt, Artificial Sequence
  ELANE RNA Guide
cggacaccaucaacgccaacg

SEQ ID NO: 15455 - RNA, 21 nt, Artificial Sequence
  ELANE RNA Guide
cgggucggacaccaucaacgc

SEQ ID NO: 15456 - RNA, 21 nt, Artificial Sequence
  ELANE RNA Guide
cguugaugguguccgacccgu

SEQ ID NO: 15457 - RNA, 21 nt, Artificial Sequence
  ELANE RNA Guide
cguuggcguugaugguguccg

SEQ ID NO: 15458 - RNA, 21 nt, Artificial Sequence
  ELANE RNA Guide
cucaacgggucggacaccauc

SEQ ID NO: 15459 - RNA, 21 nt, Artificial Sequence
  ELANE RNA Guide
gacaccaucaacgccaacgug

SEQ ID NO: 15460 - RNA, 21 nt, Artificial Sequence
  ELANE RNA Guide
gaugguguccgacccguugag

SEQ ID NO: 15461 - RNA, 21 nt, Artificial Sequence
  ELANE RNA Guide
gcacguuggcguugauggugu

SEQ ID NO: 15462 - RNA, 21 nt, Artificial Sequence
  ELANE RNA Guide
gccacagcucaacgggucgga

SEQ ID NO: 15463 - RNA, 21 nt, Artificial Sequence
  ELANE RNA Guide
gcguugaugguguccgacccg

SEQ ID NO: 15464 - RNA, 21 nt, Artificial Sequence
  ELANE RNA Guide
gcucaacgggucggacaccau

SEQ ID NO: 15465 - RNA, 21 nt, Artificial Sequence
  ELANE RNA Guide
ggacaccaucaacgccaacgu

SEQ ID NO: 15466 - RNA, 21 nt, Artificial Sequence
  ELANE RNA Guide
ggcguugaugguguccgaccc

SEQ ID NO: 15467 - RNA, 21 nt, Artificial Sequence
  ELANE RNA Guide
gggucggacaccaucaacgcc

SEQ ID NO: 15468 - RNA, 21 nt, Artificial Sequence
  ELANE RNA Guide
ggucggacaccaucaacgcca

SEQ ID NO: 15469 - RNA, 21 nt, Artificial Sequence
  ELANE RNA Guide
gguguccgacccguugagcug

SEQ ID NO: 15470 - RNA, 21 nt, Artificial Sequence
  ELANE RNA Guide
guccgacccguugagcugugg

SEQ ID NO: 15471 - RNA, 21 nt, Artificial Sequence
  ELANE RNA Guide
gucggacaccaucaacgccaa

SEQ ID NO: 15472 - RNA, 21 nt, Artificial Sequence
  ELANE RNA Guide
guguccgacccguugagcugu

SEQ ID NO: 15473 - RNA, 21 nt, Artificial Sequence
  ELANE RNA Guide
guugaugguguccgacccguu

SEQ ID NO: 15474 - RNA, 21 nt, Artificial Sequence
  ELANE RNA Guide
guuggcguugaugguguccga

SEQ ID NO: 15475 - RNA, 21 nt, Artificial Sequence
  ELANE RNA Guide
ucaacgggucggacaccauca

SEQ ID NO: 15476 - RNA, 21 nt, Artificial Sequence
  ELANE RNA Guide
ucggacaccaucaacgccaac

SEQ ID NO: 15477 - RNA, 21 nt, Artificial Sequence
  ELANE RNA Guide
ugaugguguccgacccguuga

SEQ ID NO: 15478 - RNA, 21 nt, Artificial Sequence
  ELANE RNA Guide
uggcguugaugguguccgacc

SEQ ID NO: 15479 - RNA, 21 nt, Artificial Sequence
  ELANE RNA Guide
ugguguccgacccguugagcu

SEQ ID NO: 15480 - RNA, 21 nt, Artificial Sequence
  ELANE RNA Guide
uguccgacccguugagcugug

SEQ ID NO: 15481 - RNA, 21 nt, Artificial Sequence
  ELANE RNA Guide
uugaugguguccgacccguug

SEQ ID NO: 15482 - RNA, 21 nt, Artificial Sequence
  ELANE RNA Guide
uuggcguugaugguguccgac

SEQ ID NO: 15483 - RNA, 22 nt, Artificial Sequence
  ELANE RNA Guide
aacgggucggacaccaucaacg

SEQ ID NO: 15484 - RNA, 22 nt, Artificial Sequence
  ELANE RNA Guide
acagcucaacgggucggacacc

SEQ ID NO: 15485 - RNA, 22 nt, Artificial Sequence
  ELANE RNA Guide
acgggucggacaccaucaacgc

SEQ ID NO: 15486 - RNA, 22 nt, Artificial Sequence
  ELANE RNA Guide
acguuggcguugaugguguccg

SEQ ID NO: 15487 - RNA, 22 nt, Artificial Sequence
  ELANE RNA Guide
agcucaacgggucggacaccau

SEQ ID NO: 15488 - RNA, 22 nt, Artificial Sequence
  ELANE RNA Guide
augguguccgacccguugagcu

SEQ ID NO: 15489 - RNA, 22 nt, Artificial Sequence
  ELANE RNA Guide
caacgggucggacaccaucaac

SEQ ID NO: 15490 - RNA, 22 nt, Artificial Sequence
  ELANE RNA Guide
cacagcucaacgggucggacac

SEQ ID NO: 15491 - RNA, 22 nt, Artificial Sequence
  ELANE RNA Guide
cacguuggcguugauggugucc

SEQ ID NO: 15492 - RNA, 22 nt, Artificial Sequence
  ELANE RNA Guide
cagcucaacgggucggacacca

SEQ ID NO: 15493 - RNA, 22 nt, Artificial Sequence
  ELANE RNA Guide
ccacagcucaacgggucggaca

SEQ ID NO: 15494 - RNA, 22 nt, Artificial Sequence
  ELANE RNA Guide
cgccacagcucaacgggucgga

SEQ ID NO: 15495 - RNA, 22 nt, Artificial Sequence
  ELANE RNA Guide
cggacaccaucaacgccaacgu

SEQ ID NO: 15496 - RNA, 22 nt, Artificial Sequence
  ELANE RNA Guide
cgggucggacaccaucaacgcc

SEQ ID NO: 15497 - RNA, 22 nt, Artificial Sequence
  ELANE RNA Guide
cguugaugguguccgacccguu

SEQ ID NO: 15498 - RNA, 22 nt, Artificial Sequence
  ELANE RNA Guide
cguuggcguugaugguguccga

SEQ ID NO: 15499 - RNA, 22 nt, Artificial Sequence
  ELANE RNA Guide
cucaacgggucggacaccauca

SEQ ID NO: 15500 - RNA, 22 nt, Artificial Sequence
  ELANE RNA Guide
gacaccaucaacgccaacgugc

SEQ ID NO: 15501 - RNA, 22 nt, Artificial Sequence
  ELANE RNA Guide
gaugguguccgacccguugagc

SEQ ID NO: 15502 - RNA, 22 nt, Artificial Sequence
  ELANE RNA Guide
gcacguuggcguugaugguguc

SEQ ID NO: 15503 - RNA, 22 nt, Artificial Sequence
  ELANE RNA Guide
gccacagcucaacgggucggac

SEQ ID NO: 15504 - RNA, 22 nt, Artificial Sequence
  ELANE RNA Guide
gcguugaugguguccgacccgu

SEQ ID NO: 15505 - RNA, 22 nt, Artificial Sequence
  ELANE RNA Guide
gcucaacgggucggacaccauc

SEQ ID NO: 15506 - RNA, 22 nt, Artificial Sequence
  ELANE RNA Guide
ggacaccaucaacgccaacgug

SEQ ID NO: 15507 - RNA, 22 nt, Artificial Sequence
  ELANE RNA Guide
ggcguugaugguguccgacccg

SEQ ID NO: 15508 - RNA, 22 nt, Artificial Sequence
  ELANE RNA Guide
gggucggacaccaucaacgcca

SEQ ID NO: 15509 - RNA, 22 nt, Artificial Sequence
  ELANE RNA Guide
ggucggacaccaucaacgccaa

SEQ ID NO: 15510 - RNA, 22 nt, Artificial Sequence
  ELANE RNA Guide
gguguccgacccguugagcugu

SEQ ID NO: 15511 - RNA, 22 nt, Artificial Sequence
  ELANE RNA Guide
guccgacccguugagcuguggc

SEQ ID NO: 15512 - RNA, 22 nt, Artificial Sequence
  ELANE RNA Guide
gucggacaccaucaacgccaac

SEQ ID NO: 15513 - RNA, 22 nt, Artificial Sequence
  ELANE RNA Guide
guguccgacccguugagcugug

SEQ ID NO: 15514 - RNA, 22 nt, Artificial Sequence
  ELANE RNA Guide
guugaugguguccgacccguug

SEQ ID NO: 15515 - RNA, 22 nt, Artificial Sequence
  ELANE RNA Guide
guuggcguugaugguguccgac

SEQ ID NO: 15516 - RNA, 22 nt, Artificial Sequence
  ELANE RNA Guide
ucaacgggucggacaccaucaa

SEQ ID NO: 15517 - RNA, 22 nt, Artificial Sequence
  ELANE RNA Guide
ucggacaccaucaacgccaacg

SEQ ID NO: 15518 - RNA, 22 nt, Artificial Sequence
  ELANE RNA Guide
ugaugguguccgacccguugag

SEQ ID NO: 15519 - RNA, 22 nt, Artificial Sequence
  ELANE RNA Guide
ugcacguuggcguugauggugu

SEQ ID NO: 15520 - RNA, 22 nt, Artificial Sequence
  ELANE RNA Guide
uggcguugaugguguccgaccc

SEQ ID NO: 15521 - RNA, 22 nt, Artificial Sequence
  ELANE RNA Guide
ugguguccgacccguugagcug

SEQ ID NO: 15522 - RNA, 22 nt, Artificial Sequence
  ELANE RNA Guide
uguccgacccguugagcugugg

SEQ ID NO: 15523 - RNA, 22 nt, Artificial Sequence
  ELANE RNA Guide
uugaugguguccgacccguuga

SEQ ID NO: 15524 - RNA, 22 nt, Artificial Sequence
  ELANE RNA Guide
uuggcguugaugguguccgacc

SEQ ID NO: 15525 - RNA, 20 nt, Artificial Sequence
  ELANE RNA Guide
aacgggucggccaucaucaa

SEQ ID NO: 15526 - RNA, 20 nt, Artificial Sequence
  ELANE RNA Guide
acgggucggccaucaucaac

SEQ ID NO: 15527 - RNA, 20 nt, Artificial Sequence
  ELANE RNA Guide
acguuggcguugaugauggc

SEQ ID NO: 15528 - RNA, 20 nt, Artificial Sequence
  ELANE RNA Guide
aucaucaacgccaacgugca

SEQ ID NO: 15529 - RNA, 20 nt, Artificial Sequence
  ELANE RNA Guide
augauggccgacccguugag

SEQ ID NO: 15530 - RNA, 20 nt, Artificial Sequence
  ELANE RNA Guide
caacgggucggccaucauca

SEQ ID NO: 15531 - RNA, 20 nt, Artificial Sequence
  ELANE RNA Guide
cacguuggcguugaugaugg

SEQ ID NO: 15532 - RNA, 20 nt, Artificial Sequence
  ELANE RNA Guide
caucaucaacgccaacgugc

SEQ ID NO: 15533 - RNA, 20 nt, Artificial Sequence
  ELANE RNA Guide
ccaccugcacguuggcguug

SEQ ID NO: 15534 - RNA, 20 nt, Artificial Sequence
  ELANE RNA Guide
ccaucaucaacgccaacgug

SEQ ID NO: 15535 - RNA, 20 nt, Artificial Sequence
  ELANE RNA Guide
cggccaucaucaacgccaac

SEQ ID NO: 15536 - RNA, 20 nt, Artificial Sequence
  ELANE RNA Guide
cgggucggccaucaucaacg

SEQ ID NO: 15537 - RNA, 20 nt, Artificial Sequence
  ELANE RNA Guide
cguugaugauggccgacccg

SEQ ID NO: 15538 - RNA, 20 nt, Artificial Sequence
  ELANE RNA Guide
cguuggcguugaugauggcc

SEQ ID NO: 15539 - RNA, 20 nt, Artificial Sequence
  ELANE RNA Guide
cucaacgggucggccaucau

SEQ ID NO: 15540 - RNA, 20 nt, Artificial Sequence
  ELANE RNA Guide
cugcacguuggcguugauga

SEQ ID NO: 15541 - RNA, 20 nt, Artificial Sequence
  ELANE RNA Guide
gaugauggccgacccguuga

SEQ ID NO: 15542 - RNA, 20 nt, Artificial Sequence
  ELANE RNA Guide
gcacguuggcguugaugaug

SEQ ID NO: 15543 - RNA, 20 nt, Artificial Sequence
  ELANE RNA Guide
gccaucaucaacgccaacgu

SEQ ID NO: 15544 - RNA, 20 nt, Artificial Sequence
  ELANE RNA Guide
gcguugaugauggccgaccc

SEQ ID NO: 15545 - RNA, 20 nt, Artificial Sequence
  ELANE RNA Guide
ggccaucaucaacgccaacg

SEQ ID NO: 15546 - RNA, 20 nt, Artificial Sequence
  ELANE RNA Guide
ggcguugaugauggccgacc

SEQ ID NO: 15547 - RNA, 20 nt, Artificial Sequence
  ELANE RNA Guide
gggucggccaucaucaacgc

SEQ ID NO: 15548 - RNA, 20 nt, Artificial Sequence
  ELANE RNA Guide
ggucggccaucaucaacgcc

SEQ ID NO: 15549 - RNA, 20 nt, Artificial Sequence
  ELANE RNA Guide
gucggccaucaucaacgcca

SEQ ID NO: 15550 - RNA, 20 nt, Artificial Sequence
  ELANE RNA Guide
guugaugauggccgacccgu

SEQ ID NO: 15551 - RNA, 20 nt, Artificial Sequence
  ELANE RNA Guide
guuggcguugaugauggccg

SEQ ID NO: 15552 - RNA, 20 nt, Artificial Sequence
  ELANE RNA Guide
ucaacgggucggccaucauc

SEQ ID NO: 15553 - RNA, 20 nt, Artificial Sequence
  ELANE RNA Guide
ucggccaucaucaacgccaa

SEQ ID NO: 15554 - RNA, 20 nt, Artificial Sequence
  ELANE RNA Guide
ugaugauggccgacccguug

SEQ ID NO: 15555 - RNA, 20 nt, Artificial Sequence
  ELANE RNA Guide
ugcacguuggcguugaugau

SEQ ID NO: 15556 - RNA, 20 nt, Artificial Sequence
  ELANE RNA Guide
uggcguugaugauggccgac

SEQ ID NO: 15557 - RNA, 20 nt, Artificial Sequence
  ELANE RNA Guide
uugaugauggccgacccguu

SEQ ID NO: 15558 - RNA, 20 nt, Artificial Sequence
  ELANE RNA Guide
uuggcguugaugauggccga

SEQ ID NO: 15559 - RNA, 21 nt, Artificial Sequence
  ELANE RNA Guide
aacgggucggccaucaucaac

SEQ ID NO: 15560 - RNA, 21 nt, Artificial Sequence
  ELANE RNA Guide
acgggucggccaucaucaacg

SEQ ID NO: 15561 - RNA, 21 nt, Artificial Sequence
  ELANE RNA Guide
acguuggcguugaugauggcc

SEQ ID NO: 15562 - RNA, 21 nt, Artificial Sequence
  ELANE RNA Guide
aucaucaacgccaacgugcag

SEQ ID NO: 15563 - RNA, 21 nt, Artificial Sequence
  ELANE RNA Guide
augauggccgacccguugagc

SEQ ID NO: 15564 - RNA, 21 nt, Artificial Sequence
  ELANE RNA Guide
caacgggucggccaucaucaa

SEQ ID NO: 15565 - RNA, 21 nt, Artificial Sequence
  ELANE RNA Guide
cacguuggcguugaugauggc

SEQ ID NO: 15566 - RNA, 21 nt, Artificial Sequence
  ELANE RNA Guide
caucaucaacgccaacgugca

SEQ ID NO: 15567 - RNA, 21 nt, Artificial Sequence
  ELANE RNA Guide
ccaucaucaacgccaacgugc

SEQ ID NO: 15568 - RNA, 21 nt, Artificial Sequence
  ELANE RNA Guide
ccugcacguuggcguugauga

SEQ ID NO: 15569 - RNA, 21 nt, Artificial Sequence
  ELANE RNA Guide
cggccaucaucaacgccaacg

SEQ ID NO: 15570 - RNA, 21 nt, Artificial Sequence
  ELANE RNA Guide
cgggucggccaucaucaacgc

SEQ ID NO: 15571 - RNA, 21 nt, Artificial Sequence
  ELANE RNA Guide
cguugaugauggccgacccgu

SEQ ID NO: 15572 - RNA, 21 nt, Artificial Sequence
  ELANE RNA Guide
cguuggcguugaugauggccg

SEQ ID NO: 15573 - RNA, 21 nt, Artificial Sequence
  ELANE RNA Guide
cucaacgggucggccaucauc

SEQ ID NO: 15574 - RNA, 21 nt, Artificial Sequence
  ELANE RNA Guide
cugcacguuggcguugaugau

SEQ ID NO: 15575 - RNA, 21 nt, Artificial Sequence
  ELANE RNA Guide
gaugauggccgacccguugag

SEQ ID NO: 15576 - RNA, 21 nt, Artificial Sequence
  ELANE RNA Guide
gcacguuggcguugaugaugg

SEQ ID NO: 15577 - RNA, 21 nt, Artificial Sequence
  ELANE RNA Guide
gccaccugcacguuggcguug

SEQ ID NO: 15578 - RNA, 21 nt, Artificial Sequence
  ELANE RNA Guide
gccaucaucaacgccaacgug

SEQ ID NO: 15579 - RNA, 21 nt, Artificial Sequence
  ELANE RNA Guide
gcguugaugauggccgacccg

SEQ ID NO: 15580 - RNA, 21 nt, Artificial Sequence
  ELANE RNA Guide
gcucaacgggucggccaucau

SEQ ID NO: 15581 - RNA, 21 nt, Artificial Sequence
  ELANE RNA Guide
ggccaucaucaacgccaacgu

SEQ ID NO: 15582 - RNA, 21 nt, Artificial Sequence
  ELANE RNA Guide
ggcguugaugauggccgaccc

SEQ ID NO: 15583 - RNA, 21 nt, Artificial Sequence
  ELANE RNA Guide
gggucggccaucaucaacgcc

SEQ ID NO: 15584 - RNA, 21 nt, Artificial Sequence
  ELANE RNA Guide
ggucggccaucaucaacgcca

SEQ ID NO: 15585 - RNA, 21 nt, Artificial Sequence
  ELANE RNA Guide
gucggccaucaucaacgccaa

SEQ ID NO: 15586 - RNA, 21 nt, Artificial Sequence
  ELANE RNA Guide
guugaugauggccgacccguu

SEQ ID NO: 15587 - RNA, 21 nt, Artificial Sequence
  ELANE RNA Guide
guuggcguugaugauggccga

SEQ ID NO: 15588 - RNA, 21 nt, Artificial Sequence
  ELANE RNA Guide
ucaacgggucggccaucauca

SEQ ID NO: 15589 - RNA, 21 nt, Artificial Sequence
  ELANE RNA Guide
ucggccaucaucaacgccaac

SEQ ID NO: 15590 - RNA, 21 nt, Artificial Sequence
  ELANE RNA Guide
ugaugauggccgacccguuga

SEQ ID NO: 15591 - RNA, 21 nt, Artificial Sequence
  ELANE RNA Guide
ugcacguuggcguugaugaug

SEQ ID NO: 15592 - RNA, 21 nt, Artificial Sequence
  ELANE RNA Guide
uggcguugaugauggccgacc

SEQ ID NO: 15593 - RNA, 21 nt, Artificial Sequence
  ELANE RNA Guide
uugaugauggccgacccguug

SEQ ID NO: 15594 - RNA, 21 nt, Artificial Sequence
  ELANE RNA Guide
uuggcguugaugauggccgac

SEQ ID NO: 15595 - RNA, 22 nt, Artificial Sequence
  ELANE RNA Guide
aacgggucggccaucaucaacg

SEQ ID NO: 15596 - RNA, 22 nt, Artificial Sequence
  ELANE RNA Guide
accugcacguuggcguugauga

SEQ ID NO: 15597 - RNA, 22 nt, Artificial Sequence
  ELANE RNA Guide
acgggucggccaucaucaacgc

SEQ ID NO: 15598 - RNA, 22 nt, Artificial Sequence
  ELANE RNA Guide
acguuggcguugaugauggccg

SEQ ID NO: 15599 - RNA, 22 nt, Artificial Sequence
  ELANE RNA Guide
agcucaacgggucggccaucau

SEQ ID NO: 15600 - RNA, 22 nt, Artificial Sequence
  ELANE RNA Guide
aucaucaacgccaacgugcagg

SEQ ID NO: 15601 - RNA, 22 nt, Artificial Sequence
  ELANE RNA Guide
augauggccgacccguugagcu

SEQ ID NO: 15602 - RNA, 22 nt, Artificial Sequence
  ELANE RNA Guide
caacgggucggccaucaucaac

SEQ ID NO: 15603 - RNA, 22 nt, Artificial Sequence
  ELANE RNA Guide
cacguuggcguugaugauggcc

SEQ ID NO: 15604 - RNA, 22 nt, Artificial Sequence
  ELANE RNA Guide
caucaucaacgccaacgugcag

SEQ ID NO: 15605 - RNA, 22 nt, Artificial Sequence
  ELANE RNA Guide
ccaucaucaacgccaacgugca

SEQ ID NO: 15606 - RNA, 22 nt, Artificial Sequence
  ELANE RNA Guide
ccugcacguuggcguugaugau

SEQ ID NO: 15607 - RNA, 22 nt, Artificial Sequence
  ELANE RNA Guide
cggccaucaucaacgccaacgu

SEQ ID NO: 15608 - RNA, 22 nt, Artificial Sequence
  ELANE RNA Guide
cgggucggccaucaucaacgcc

SEQ ID NO: 15609 - RNA, 22 nt, Artificial Sequence
  ELANE RNA Guide
cguugaugauggccgacccguu

SEQ ID NO: 15610 - RNA, 22 nt, Artificial Sequence
  ELANE RNA Guide
cguuggcguugaugauggccga

SEQ ID NO: 15611 - RNA, 22 nt, Artificial Sequence
  ELANE RNA Guide
cucaacgggucggccaucauca

SEQ ID NO: 15612 - RNA, 22 nt, Artificial Sequence
  ELANE RNA Guide
cugcacguuggcguugaugaug

SEQ ID NO: 15613 - RNA, 22 nt, Artificial Sequence
  ELANE RNA Guide
gaugauggccgacccguugagc

SEQ ID NO: 15614 - RNA, 22 nt, Artificial Sequence
  ELANE RNA Guide
gcacguuggcguugaugauggc

SEQ ID NO: 15615 - RNA, 22 nt, Artificial Sequence
  ELANE RNA Guide
gccaucaucaacgccaacgugc

SEQ ID NO: 15616 - RNA, 22 nt, Artificial Sequence
  ELANE RNA Guide
gcguugaugauggccgacccgu

SEQ ID NO: 15617 - RNA, 22 nt, Artificial Sequence
  ELANE RNA Guide
gcucaacgggucggccaucauc

SEQ ID NO: 15618 - RNA, 22 nt, Artificial Sequence
  ELANE RNA Guide
ggccaccugcacguuggcguug

SEQ ID NO: 15619 - RNA, 22 nt, Artificial Sequence
  ELANE RNA Guide
ggccaucaucaacgccaacgug

SEQ ID NO: 15620 - RNA, 22 nt, Artificial Sequence
  ELANE RNA Guide
ggcguugaugauggccgacccg

SEQ ID NO: 15621 - RNA, 22 nt, Artificial Sequence
  ELANE RNA Guide
gggucggccaucaucaacgcca

SEQ ID NO: 15622 - RNA, 22 nt, Artificial Sequence
  ELANE RNA Guide
ggucggccaucaucaacgccaa

SEQ ID NO: 15623 - RNA, 22 nt, Artificial Sequence
  ELANE RNA Guide
gucggccaucaucaacgccaac

SEQ ID NO: 15624 - RNA, 22 nt, Artificial Sequence
  ELANE RNA Guide
guugaugauggccgacccguug

SEQ ID NO: 15625 - RNA, 22 nt, Artificial Sequence
  ELANE RNA Guide
guuggcguugaugauggccgac

SEQ ID NO: 15626 - RNA, 22 nt, Artificial Sequence
  ELANE RNA Guide
ucaacgggucggccaucaucaa

SEQ ID NO: 15627 - RNA, 22 nt, Artificial Sequence
  ELANE RNA Guide
ucggccaucaucaacgccaacg

SEQ ID NO: 15628 - RNA, 22 nt, Artificial Sequence
  ELANE RNA Guide
ugaugauggccgacccguugag

SEQ ID NO: 15629 - RNA, 22 nt, Artificial Sequence
  ELANE RNA Guide
ugcacguuggcguugaugaugg

SEQ ID NO: 15630 - RNA, 22 nt, Artificial Sequence
  ELANE RNA Guide
uggcguugaugauggccgaccc

SEQ ID NO: 15631 - RNA, 22 nt, Artificial Sequence
  ELANE RNA Guide
uugaugauggccgacccguuga

SEQ ID NO: 15632 - RNA, 22 nt, Artificial Sequence
  ELANE RNA Guide
uuggcguugaugauggccgacc

SEQ ID NO: 15633 - RNA, 20 nt, Artificial Sequence
  ELANE RNA Guide
aacgggucggccaccaacgc

SEQ ID NO: 15634 - RNA, 20 nt, Artificial Sequence
  ELANE RNA Guide
accaacgccaacgugcaggu

SEQ ID NO: 15635 - RNA, 20 nt, Artificial Sequence
  ELANE RNA Guide
accugcacguuggcguuggu

SEQ ID NO: 15636 - RNA, 20 nt, Artificial Sequence
  ELANE RNA Guide
acgggucggccaccaacgcc

SEQ ID NO: 15637 - RNA, 20 nt, Artificial Sequence
  ELANE RNA Guide
acguuggcguugguggccga

SEQ ID NO: 15638 - RNA, 20 nt, Artificial Sequence
  ELANE RNA Guide
agcucaacgggucggccacc

SEQ ID NO: 15639 - RNA, 20 nt, Artificial Sequence
  ELANE RNA Guide
caacgggucggccaccaacg

SEQ ID NO: 15640 - RNA, 20 nt, Artificial Sequence
  ELANE RNA Guide
caccaacgccaacgugcagg

SEQ ID NO: 15641 - RNA, 20 nt, Artificial Sequence
  ELANE RNA Guide
caccugcacguuggcguugg

SEQ ID NO: 15642 - RNA, 20 nt, Artificial Sequence
  ELANE RNA Guide
cacguuggcguugguggccg

SEQ ID NO: 15643 - RNA, 20 nt, Artificial Sequence
  ELANE RNA Guide
cagcucaacgggucggccac

SEQ ID NO: 15644 - RNA, 20 nt, Artificial Sequence
  ELANE RNA Guide
ccaacgccaacgugcaggug

SEQ ID NO: 15645 - RNA, 20 nt, Artificial Sequence
  ELANE RNA Guide
ccaccaacgccaacgugcag

SEQ ID NO: 15646 - RNA, 20 nt, Artificial Sequence
  ELANE RNA Guide
ccugcacguuggcguuggug

SEQ ID NO: 15647 - RNA, 20 nt, Artificial Sequence
  ELANE RNA Guide
cggccaccaacgccaacgug

SEQ ID NO: 15648 - RNA, 20 nt, Artificial Sequence
  ELANE RNA Guide
cgggucggccaccaacgcca

SEQ ID NO: 15649 - RNA, 20 nt, Artificial Sequence
  ELANE RNA Guide
cguuggcguugguggccgac

SEQ ID NO: 15650 - RNA, 20 nt, Artificial Sequence
  ELANE RNA Guide
cguugguggccgacccguug

SEQ ID NO: 15651 - RNA, 20 nt, Artificial Sequence
  ELANE RNA Guide
cucaacgggucggccaccaa

SEQ ID NO: 15652 - RNA, 20 nt, Artificial Sequence
  ELANE RNA Guide
cugcacguuggcguuggugg

SEQ ID NO: 15653 - RNA, 20 nt, Artificial Sequence
  ELANE RNA Guide
gcacguuggcguugguggcc

SEQ ID NO: 15654 - RNA, 20 nt, Artificial Sequence
  ELANE RNA Guide
gccaccaacgccaacgugca

SEQ ID NO: 15655 - RNA, 20 nt, Artificial Sequence
  ELANE RNA Guide
gccaccugcacguuggcguu

SEQ ID NO: 15656 - RNA, 20 nt, Artificial Sequence
  ELANE RNA Guide
gcguugguggccgacccguu

SEQ ID NO: 15657 - RNA, 20 nt, Artificial Sequence
  ELANE RNA Guide
gcucaacgggucggccacca

SEQ ID NO: 15658 - RNA, 20 nt, Artificial Sequence
  ELANE RNA Guide
ggccaccaacgccaacgugc

SEQ ID NO: 15659 - RNA, 20 nt, Artificial Sequence
  ELANE RNA Guide
ggccaccugcacguuggcgu

SEQ ID NO: 15660 - RNA, 20 nt, Artificial Sequence
  ELANE RNA Guide
ggcguugguggccgacccgu

SEQ ID NO: 15661 - RNA, 20 nt, Artificial Sequence
  ELANE RNA Guide
gggccaccugcacguuggcg

SEQ ID NO: 15662 - RNA, 20 nt, Artificial Sequence
  ELANE RNA Guide
gggucggccaccaacgccaa

SEQ ID NO: 15663 - RNA, 20 nt, Artificial Sequence
  ELANE RNA Guide
ggucggccaccaacgccaac

SEQ ID NO: 15664 - RNA, 20 nt, Artificial Sequence
  ELANE RNA Guide
gucggccaccaacgccaacg

SEQ ID NO: 15665 - RNA, 20 nt, Artificial Sequence
  ELANE RNA Guide
guuggcguugguggccgacc

SEQ ID NO: 15666 - RNA, 20 nt, Artificial Sequence
  ELANE RNA Guide
guugguggccgacccguuga

SEQ ID NO: 15667 - RNA, 20 nt, Artificial Sequence
  ELANE RNA Guide
ucaacgggucggccaccaac

SEQ ID NO: 15668 - RNA, 20 nt, Artificial Sequence
  ELANE RNA Guide
ucggccaccaacgccaacgu

SEQ ID NO: 15669 - RNA, 20 nt, Artificial Sequence
  ELANE RNA Guide
ugcacguuggcguugguggc

SEQ ID NO: 15670 - RNA, 20 nt, Artificial Sequence
  ELANE RNA Guide
uggcguugguggccgacccg

SEQ ID NO: 15671 - RNA, 20 nt, Artificial Sequence
  ELANE RNA Guide
uuggcguugguggccgaccc

SEQ ID NO: 15672 - RNA, 20 nt, Artificial Sequence
  ELANE RNA Guide
uugguggccgacccguugag

SEQ ID NO: 15673 - RNA, 21 nt, Artificial Sequence
  ELANE RNA Guide
aacgggucggccaccaacgcc

SEQ ID NO: 15674 - RNA, 21 nt, Artificial Sequence
  ELANE RNA Guide
acagcucaacgggucggccac

SEQ ID NO: 15675 - RNA, 21 nt, Artificial Sequence
  ELANE RNA Guide
accaacgccaacgugcaggug

SEQ ID NO: 15676 - RNA, 21 nt, Artificial Sequence
  ELANE RNA Guide
accugcacguuggcguuggug

SEQ ID NO: 15677 - RNA, 21 nt, Artificial Sequence
  ELANE RNA Guide
acgggucggccaccaacgcca

SEQ ID NO: 15678 - RNA, 21 nt, Artificial Sequence
  ELANE RNA Guide
acguuggcguugguggccgac

SEQ ID NO: 15679 - RNA, 21 nt, Artificial Sequence
  ELANE RNA Guide
agcucaacgggucggccacca

SEQ ID NO: 15680 - RNA, 21 nt, Artificial Sequence
  ELANE RNA Guide
caacgggucggccaccaacgc

SEQ ID NO: 15681 - RNA, 21 nt, Artificial Sequence
  ELANE RNA Guide
caccaacgccaacgugcaggu

SEQ ID NO: 15682 - RNA, 21 nt, Artificial Sequence
  ELANE RNA Guide
caccugcacguuggcguuggu

SEQ ID NO: 15683 - RNA, 21 nt, Artificial Sequence
  ELANE RNA Guide
cacguuggcguugguggccga

SEQ ID NO: 15684 - RNA, 21 nt, Artificial Sequence
  ELANE RNA Guide
cagcucaacgggucggccacc

SEQ ID NO: 15685 - RNA, 21 nt, Artificial Sequence
  ELANE RNA Guide
ccaacgccaacgugcaggugg

SEQ ID NO: 15686 - RNA, 21 nt, Artificial Sequence
  ELANE RNA Guide
ccaccaacgccaacgugcagg

SEQ ID NO: 15687 - RNA, 21 nt, Artificial Sequence
  ELANE RNA Guide
ccaccugcacguuggcguugg

SEQ ID NO: 15688 - RNA, 21 nt, Artificial Sequence
  ELANE RNA Guide
ccugcacguuggcguuggugg

SEQ ID NO: 15689 - RNA, 21 nt, Artificial Sequence
  ELANE RNA Guide
cggccaccaacgccaacgugc

SEQ ID NO: 15690 - RNA, 21 nt, Artificial Sequence
  ELANE RNA Guide
cgggucggccaccaacgccaa

SEQ ID NO: 15691 - RNA, 21 nt, Artificial Sequence
  ELANE RNA Guide
cguuggcguugguggccgacc

SEQ ID NO: 15692 - RNA, 21 nt, Artificial Sequence
  ELANE RNA Guide
cguugguggccgacccguuga

SEQ ID NO: 15693 - RNA, 21 nt, Artificial Sequence
  ELANE RNA Guide
cucaacgggucggccaccaac

SEQ ID NO: 15694 - RNA, 21 nt, Artificial Sequence
  ELANE RNA Guide
cugcacguuggcguugguggc

SEQ ID NO: 15695 - RNA, 21 nt, Artificial Sequence
  ELANE RNA Guide
gcacguuggcguugguggccg

SEQ ID NO: 15696 - RNA, 21 nt, Artificial Sequence
  ELANE RNA Guide
gccaccaacgccaacgugcag

SEQ ID NO: 15697 - RNA, 21 nt, Artificial Sequence
  ELANE RNA Guide
gcguugguggccgacccguug

SEQ ID NO: 15698 - RNA, 21 nt, Artificial Sequence
  ELANE RNA Guide
gcucaacgggucggccaccaa

SEQ ID NO: 15699 - RNA, 21 nt, Artificial Sequence
  ELANE RNA Guide
ggccaccaacgccaacgugca

SEQ ID NO: 15700 - RNA, 21 nt, Artificial Sequence
  ELANE RNA Guide
ggccaccugcacguuggcguu

SEQ ID NO: 15701 - RNA, 21 nt, Artificial Sequence
  ELANE RNA Guide
ggcguugguggccgacccguu

SEQ ID NO: 15702 - RNA, 21 nt, Artificial Sequence
  ELANE RNA Guide
gggccaccugcacguuggcgu

SEQ ID NO: 15703 - RNA, 21 nt, Artificial Sequence
  ELANE RNA Guide
gggucggccaccaacgccaac

SEQ ID NO: 15704 - RNA, 21 nt, Artificial Sequence
  ELANE RNA Guide
ggucggccaccaacgccaacg

SEQ ID NO: 15705 - RNA, 21 nt, Artificial Sequence
  ELANE RNA Guide
gucggccaccaacgccaacgu

SEQ ID NO: 15706 - RNA, 21 nt, Artificial Sequence
  ELANE RNA Guide
guuggcguugguggccgaccc

SEQ ID NO: 15707 - RNA, 21 nt, Artificial Sequence
  ELANE RNA Guide
guugguggccgacccguugag

SEQ ID NO: 15708 - RNA, 21 nt, Artificial Sequence
  ELANE RNA Guide
ucaacgggucggccaccaacg

SEQ ID NO: 15709 - RNA, 21 nt, Artificial Sequence
  ELANE RNA Guide
ucggccaccaacgccaacgug

SEQ ID NO: 15710 - RNA, 21 nt, Artificial Sequence
  ELANE RNA Guide
ugcacguuggcguugguggcc

SEQ ID NO: 15711 - RNA, 21 nt, Artificial Sequence
  ELANE RNA Guide
uggcguugguggccgacccgu

SEQ ID NO: 15712 - RNA, 21 nt, Artificial Sequence
  ELANE RNA Guide
ugggccaccugcacguuggcg

SEQ ID NO: 15713 - RNA, 21 nt, Artificial Sequence
  ELANE RNA Guide
uuggcguugguggccgacccg

SEQ ID NO: 15714 - RNA, 21 nt, Artificial Sequence
  ELANE RNA Guide
uugguggccgacccguugagc

SEQ ID NO: 15715 - RNA, 22 nt, Artificial Sequence
  ELANE RNA Guide
aacgggucggccaccaacgcca

SEQ ID NO: 15716 - RNA, 22 nt, Artificial Sequence
  ELANE RNA Guide
acagcucaacgggucggccacc

SEQ ID NO: 15717 - RNA, 22 nt, Artificial Sequence
  ELANE RNA Guide
accaacgccaacgugcaggugg

SEQ ID NO: 15718 - RNA, 22 nt, Artificial Sequence
  ELANE RNA Guide
accugcacguuggcguuggugg

SEQ ID NO: 15719 - RNA, 22 nt, Artificial Sequence
  ELANE RNA Guide
acgggucggccaccaacgccaa

SEQ ID NO: 15720 - RNA, 22 nt, Artificial Sequence
  ELANE RNA Guide
acguuggcguugguggccgacc

SEQ ID NO: 15721 - RNA, 22 nt, Artificial Sequence
  ELANE RNA Guide
agcucaacgggucggccaccaa

SEQ ID NO: 15722 - RNA, 22 nt, Artificial Sequence
  ELANE RNA Guide
caacgggucggccaccaacgcc

SEQ ID NO: 15723 - RNA, 22 nt, Artificial Sequence
  ELANE RNA Guide
cacagcucaacgggucggccac

SEQ ID NO: 15724 - RNA, 22 nt, Artificial Sequence
  ELANE RNA Guide
caccaacgccaacgugcaggug

SEQ ID NO: 15725 - RNA, 22 nt, Artificial Sequence
  ELANE RNA Guide
caccugcacguuggcguuggug

SEQ ID NO: 15726 - RNA, 22 nt, Artificial Sequence
  ELANE RNA Guide
cacguuggcguugguggccgac

SEQ ID NO: 15727 - RNA, 22 nt, Artificial Sequence
  ELANE RNA Guide
cagcucaacgggucggccacca

SEQ ID NO: 15728 - RNA, 22 nt, Artificial Sequence
  ELANE RNA Guide
ccaacgccaacgugcagguggc

SEQ ID NO: 15729 - RNA, 22 nt, Artificial Sequence
  ELANE RNA Guide
ccaccaacgccaacgugcaggu

SEQ ID NO: 15730 - RNA, 22 nt, Artificial Sequence
  ELANE RNA Guide
ccaccugcacguuggcguuggu

SEQ ID NO: 15731 - RNA, 22 nt, Artificial Sequence
  ELANE RNA Guide
ccugcacguuggcguugguggc

SEQ ID NO: 15732 - RNA, 22 nt, Artificial Sequence
  ELANE RNA Guide
cggccaccaacgccaacgugca

SEQ ID NO: 15733 - RNA, 22 nt, Artificial Sequence
  ELANE RNA Guide
cgggucggccaccaacgccaac

SEQ ID NO: 15734 - RNA, 22 nt, Artificial Sequence
  ELANE RNA Guide
cguuggcguugguggccgaccc

SEQ ID NO: 15735 - RNA, 22 nt, Artificial Sequence
  ELANE RNA Guide
cguugguggccgacccguugag

SEQ ID NO: 15736 - RNA, 22 nt, Artificial Sequence
  ELANE RNA Guide
cucaacgggucggccaccaacg

SEQ ID NO: 15737 - RNA, 22 nt, Artificial Sequence
  ELANE RNA Guide
cugcacguuggcguugguggcc

SEQ ID NO: 15738 - RNA, 22 nt, Artificial Sequence
  ELANE RNA Guide
cugggccaccugcacguuggcg

SEQ ID NO: 15739 - RNA, 22 nt, Artificial Sequence
  ELANE RNA Guide
gcacguuggcguugguggccga

SEQ ID NO: 15740 - RNA, 22 nt, Artificial Sequence
  ELANE RNA Guide
gccaccaacgccaacgugcagg

SEQ ID NO: 15741 - RNA, 22 nt, Artificial Sequence
  ELANE RNA Guide
gccaccugcacguuggcguugg

SEQ ID NO: 15742 - RNA, 22 nt, Artificial Sequence
  ELANE RNA Guide
gcguugguggccgacccguuga

SEQ ID NO: 15743 - RNA, 22 nt, Artificial Sequence
  ELANE RNA Guide
gcucaacgggucggccaccaac

SEQ ID NO: 15744 - RNA, 22 nt, Artificial Sequence
  ELANE RNA Guide
ggccaccaacgccaacgugcag

SEQ ID NO: 15745 - RNA, 22 nt, Artificial Sequence
  ELANE RNA Guide
ggcguugguggccgacccguug

SEQ ID NO: 15746 - RNA, 22 nt, Artificial Sequence
  ELANE RNA Guide
gggccaccugcacguuggcguu

SEQ ID NO: 15747 - RNA, 22 nt, Artificial Sequence
  ELANE RNA Guide
gggucggccaccaacgccaacg

SEQ ID NO: 15748 - RNA, 22 nt, Artificial Sequence
  ELANE RNA Guide
ggucggccaccaacgccaacgu

SEQ ID NO: 15749 - RNA, 22 nt, Artificial Sequence
  ELANE RNA Guide
gucggccaccaacgccaacgug

SEQ ID NO: 15750 - RNA, 22 nt, Artificial Sequence
  ELANE RNA Guide
guuggcguugguggccgacccg

SEQ ID NO: 15751 - RNA, 22 nt, Artificial Sequence
  ELANE RNA Guide
guugguggccgacccguugagc

SEQ ID NO: 15752 - RNA, 22 nt, Artificial Sequence
  ELANE RNA Guide
ucaacgggucggccaccaacgc

SEQ ID NO: 15753 - RNA, 22 nt, Artificial Sequence
  ELANE RNA Guide
ucggccaccaacgccaacgugc

SEQ ID NO: 15754 - RNA, 22 nt, Artificial Sequence
  ELANE RNA Guide
ugcacguuggcguugguggccg

SEQ ID NO: 15755 - RNA, 22 nt, Artificial Sequence
  ELANE RNA Guide
uggcguugguggccgacccguu

SEQ ID NO: 15756 - RNA, 22 nt, Artificial Sequence
  ELANE RNA Guide
ugggccaccugcacguuggcgu

SEQ ID NO: 15757 - RNA, 22 nt, Artificial Sequence
  ELANE RNA Guide
uuggcguugguggccgacccgu

SEQ ID NO: 15758 - RNA, 22 nt, Artificial Sequence
  ELANE RNA Guide
uugguggccgacccguugagcu

SEQ ID NO: 15759 - RNA, 20 nt, Artificial Sequence
  ELANE RNA Guide
aacaccaacgugcagguggc

SEQ ID NO: 15760 - RNA, 20 nt, Artificial Sequence
  ELANE RNA Guide
aacgggucggccaccaucaa

SEQ ID NO: 15761 - RNA, 20 nt, Artificial Sequence
  ELANE RNA Guide
acaccaacgugcagguggcc

SEQ ID NO: 15762 - RNA, 20 nt, Artificial Sequence
  ELANE RNA Guide
accaucaacaccaacgugca

SEQ ID NO: 15763 - RNA, 20 nt, Artificial Sequence
  ELANE RNA Guide
accugcacguugguguugau

SEQ ID NO: 15764 - RNA, 20 nt, Artificial Sequence
  ELANE RNA Guide
acgggucggccaccaucaac

SEQ ID NO: 15765 - RNA, 20 nt, Artificial Sequence
  ELANE RNA Guide
acguugguguugaugguggc

SEQ ID NO: 15766 - RNA, 20 nt, Artificial Sequence
  ELANE RNA Guide
agcugggccaccugcacguu

SEQ ID NO: 15767 - RNA, 20 nt, Artificial Sequence
  ELANE RNA Guide
aucaacaccaacgugcaggu

SEQ ID NO: 15768 - RNA, 20 nt, Artificial Sequence
  ELANE RNA Guide
caacaccaacgugcaggugg

SEQ ID NO: 15769 - RNA, 20 nt, Artificial Sequence
  ELANE RNA Guide
caacgggucggccaccauca

SEQ ID NO: 15770 - RNA, 20 nt, Artificial Sequence
  ELANE RNA Guide
caccaacgugcagguggccc

SEQ ID NO: 15771 - RNA, 20 nt, Artificial Sequence
  ELANE RNA Guide
caccaucaacaccaacgugc

SEQ ID NO: 15772 - RNA, 20 nt, Artificial Sequence
  ELANE RNA Guide
caccugcacguugguguuga

SEQ ID NO: 15773 - RNA, 20 nt, Artificial Sequence
  ELANE RNA Guide
cacguugguguugauggugg

SEQ ID NO: 15774 - RNA, 20 nt, Artificial Sequence
  ELANE RNA Guide
cagcugggccaccugcacgu

SEQ ID NO: 15775 - RNA, 20 nt, Artificial Sequence
  ELANE RNA Guide
caucaacaccaacgugcagg

SEQ ID NO: 15776 - RNA, 20 nt, Artificial Sequence
  ELANE RNA Guide
ccaccaucaacaccaacgug

SEQ ID NO: 15777 - RNA, 20 nt, Artificial Sequence
  ELANE RNA Guide
ccaccugcacguugguguug

SEQ ID NO: 15778 - RNA, 20 nt, Artificial Sequence
  ELANE RNA Guide
ccaucaacaccaacgugcag

SEQ ID NO: 15779 - RNA, 20 nt, Artificial Sequence
  ELANE RNA Guide
ccugcacguugguguugaug

SEQ ID NO: 15780 - RNA, 20 nt, Artificial Sequence
  ELANE RNA Guide
cggccaccaucaacaccaac

SEQ ID NO: 15781 - RNA, 20 nt, Artificial Sequence
  ELANE RNA Guide
cgggucggccaccaucaaca

SEQ ID NO: 15782 - RNA, 20 nt, Artificial Sequence
  ELANE RNA Guide
cguugguguugaugguggcc

SEQ ID NO: 15783 - RNA, 20 nt, Artificial Sequence
  ELANE RNA Guide
cugcacguugguguugaugg

SEQ ID NO: 15784 - RNA, 20 nt, Artificial Sequence
  ELANE RNA Guide
cugggccaccugcacguugg

SEQ ID NO: 15785 - RNA, 20 nt, Artificial Sequence
  ELANE RNA Guide
gcacguugguguugauggug

SEQ ID NO: 15786 - RNA, 20 nt, Artificial Sequence
  ELANE RNA Guide
gccaccaucaacaccaacgu

SEQ ID NO: 15787 - RNA, 20 nt, Artificial Sequence
  ELANE RNA Guide
gccaccugcacguugguguu

SEQ ID NO: 15788 - RNA, 20 nt, Artificial Sequence
  ELANE RNA Guide
gcugggccaccugcacguug

SEQ ID NO: 15789 - RNA, 20 nt, Artificial Sequence
  ELANE RNA Guide
ggccaccaucaacaccaacg

SEQ ID NO: 15790 - RNA, 20 nt, Artificial Sequence
  ELANE RNA Guide
ggccaccugcacguuggugu

SEQ ID NO: 15791 - RNA, 20 nt, Artificial Sequence
  ELANE RNA Guide
gggccaccugcacguuggug

SEQ ID NO: 15792 - RNA, 20 nt, Artificial Sequence
  ELANE RNA Guide
gggucggccaccaucaacac

SEQ ID NO: 15793 - RNA, 20 nt, Artificial Sequence
  ELANE RNA Guide
ggucggccaccaucaacacc

SEQ ID NO: 15794 - RNA, 20 nt, Artificial Sequence
  ELANE RNA Guide
gguguugaugguggccgacc

SEQ ID NO: 15795 - RNA, 20 nt, Artificial Sequence
  ELANE RNA Guide
gucggccaccaucaacacca

SEQ ID NO: 15796 - RNA, 20 nt, Artificial Sequence
  ELANE RNA Guide
guguugaugguggccgaccc

SEQ ID NO: 15797 - RNA, 20 nt, Artificial Sequence
  ELANE RNA Guide
guugguguugaugguggccg

SEQ ID NO: 15798 - RNA, 20 nt, Artificial Sequence
  ELANE RNA Guide
ucaacaccaacgugcaggug

SEQ ID NO: 15799 - RNA, 20 nt, Artificial Sequence
  ELANE RNA Guide
ucaacgggucggccaccauc

SEQ ID NO: 15800 - RNA, 20 nt, Artificial Sequence
  ELANE RNA Guide
ucggccaccaucaacaccaa

SEQ ID NO: 15801 - RNA, 20 nt, Artificial Sequence
  ELANE RNA Guide
ugcacguugguguugauggu

SEQ ID NO: 15802 - RNA, 20 nt, Artificial Sequence
  ELANE RNA Guide
ugggccaccugcacguuggu

SEQ ID NO: 15803 - RNA, 20 nt, Artificial Sequence
  ELANE RNA Guide
ugguguugaugguggccgac

SEQ ID NO: 15804 - RNA, 20 nt, Artificial Sequence
  ELANE RNA Guide
uugguguugaugguggccga

SEQ ID NO: 15805 - RNA, 21 nt, Artificial Sequence
  ELANE RNA Guide
aacaccaacgugcagguggcc

SEQ ID NO: 15806 - RNA, 21 nt, Artificial Sequence
  ELANE RNA Guide
aacgggucggccaccaucaac

SEQ ID NO: 15807 - RNA, 21 nt, Artificial Sequence
  ELANE RNA Guide
acaccaacgugcagguggccc

SEQ ID NO: 15808 - RNA, 21 nt, Artificial Sequence
  ELANE RNA Guide
accaucaacaccaacgugcag

SEQ ID NO: 15809 - RNA, 21 nt, Artificial Sequence
  ELANE RNA Guide
accugcacguugguguugaug

SEQ ID NO: 15810 - RNA, 21 nt, Artificial Sequence
  ELANE RNA Guide
acgggucggccaccaucaaca

SEQ ID NO: 15811 - RNA, 21 nt, Artificial Sequence
  ELANE RNA Guide
acguugguguugaugguggcc

SEQ ID NO: 15812 - RNA, 21 nt, Artificial Sequence
  ELANE RNA Guide
agcugggccaccugcacguug

SEQ ID NO: 15813 - RNA, 21 nt, Artificial Sequence
  ELANE RNA Guide
aucaacaccaacgugcaggug

SEQ ID NO: 15814 - RNA, 21 nt, Artificial Sequence
  ELANE RNA Guide
caacaccaacgugcagguggc

SEQ ID NO: 15815 - RNA, 21 nt, Artificial Sequence
  ELANE RNA Guide
caacgggucggccaccaucaa

SEQ ID NO: 15816 - RNA, 21 nt, Artificial Sequence
  ELANE RNA Guide
caccaacgugcagguggccca

SEQ ID NO: 15817 - RNA, 21 nt, Artificial Sequence
  ELANE RNA Guide
caccaucaacaccaacgugca

SEQ ID NO: 15818 - RNA, 21 nt, Artificial Sequence
  ELANE RNA Guide
caccugcacguugguguugau

SEQ ID NO: 15819 - RNA, 21 nt, Artificial Sequence
  ELANE RNA Guide
cacguugguguugaugguggc

SEQ ID NO: 15820 - RNA, 21 nt, Artificial Sequence
  ELANE RNA Guide
cagcugggccaccugcacguu

SEQ ID NO: 15821 - RNA, 21 nt, Artificial Sequence
  ELANE RNA Guide
caucaacaccaacgugcaggu

SEQ ID NO: 15822 - RNA, 21 nt, Artificial Sequence
  ELANE RNA Guide
ccaccaucaacaccaacgugc

SEQ ID NO: 15823 - RNA, 21 nt, Artificial Sequence
  ELANE RNA Guide
ccaccugcacguugguguuga

SEQ ID NO: 15824 - RNA, 21 nt, Artificial Sequence
  ELANE RNA Guide
ccaucaacaccaacgugcagg

SEQ ID NO: 15825 - RNA, 21 nt, Artificial Sequence
  ELANE RNA Guide
ccugcacguugguguugaugg

SEQ ID NO: 15826 - RNA, 21 nt, Artificial Sequence
  ELANE RNA Guide
cggccaccaucaacaccaacg

SEQ ID NO: 15827 - RNA, 21 nt, Artificial Sequence
  ELANE RNA Guide
cgggucggccaccaucaacac

SEQ ID NO: 15828 - RNA, 21 nt, Artificial Sequence
  ELANE RNA Guide
cguugguguugaugguggccg

SEQ ID NO: 15829 - RNA, 21 nt, Artificial Sequence
  ELANE RNA Guide
cucaacgggucggccaccauc

SEQ ID NO: 15830 - RNA, 21 nt, Artificial Sequence
  ELANE RNA Guide
cugcacguugguguugauggu

SEQ ID NO: 15831 - RNA, 21 nt, Artificial Sequence
  ELANE RNA Guide
cugggccaccugcacguuggu

SEQ ID NO: 15832 - RNA, 21 nt, Artificial Sequence
  ELANE RNA Guide
gcacguugguguugauggugg

SEQ ID NO: 15833 - RNA, 21 nt, Artificial Sequence
  ELANE RNA Guide
gcagcugggccaccugcacgu

SEQ ID NO: 15834 - RNA, 21 nt, Artificial Sequence
  ELANE RNA Guide
gccaccaucaacaccaacgug

SEQ ID NO: 15835 - RNA, 21 nt, Artificial Sequence
  ELANE RNA Guide
gccaccugcacguugguguug

SEQ ID NO: 15836 - RNA, 21 nt, Artificial Sequence
  ELANE RNA Guide
gcugggccaccugcacguugg

SEQ ID NO: 15837 - RNA, 21 nt, Artificial Sequence
  ELANE RNA Guide
ggccaccaucaacaccaacgu

SEQ ID NO: 15838 - RNA, 21 nt, Artificial Sequence
  ELANE RNA Guide
ggccaccugcacguugguguu

SEQ ID NO: 15839 - RNA, 21 nt, Artificial Sequence
  ELANE RNA Guide
gggccaccugcacguuggugu

SEQ ID NO: 15840 - RNA, 21 nt, Artificial Sequence
  ELANE RNA Guide
gggucggccaccaucaacacc

SEQ ID NO: 15841 - RNA, 21 nt, Artificial Sequence
  ELANE RNA Guide
ggucggccaccaucaacacca

SEQ ID NO: 15842 - RNA, 21 nt, Artificial Sequence
  ELANE RNA Guide
gguguugaugguggccgaccc

SEQ ID NO: 15843 - RNA, 21 nt, Artificial Sequence
  ELANE RNA Guide
gucggccaccaucaacaccaa

SEQ ID NO: 15844 - RNA, 21 nt, Artificial Sequence
  ELANE RNA Guide
guguugaugguggccgacccg

SEQ ID NO: 15845 - RNA, 21 nt, Artificial Sequence
  ELANE RNA Guide
guugguguugaugguggccga

SEQ ID NO: 15846 - RNA, 21 nt, Artificial Sequence
  ELANE RNA Guide
ucaacaccaacgugcaggugg

SEQ ID NO: 15847 - RNA, 21 nt, Artificial Sequence
  ELANE RNA Guide
ucaacgggucggccaccauca

SEQ ID NO: 15848 - RNA, 21 nt, Artificial Sequence
  ELANE RNA Guide
ucggccaccaucaacaccaac

SEQ ID NO: 15849 - RNA, 21 nt, Artificial Sequence
  ELANE RNA Guide
ugcacguugguguugauggug

SEQ ID NO: 15850 - RNA, 21 nt, Artificial Sequence
  ELANE RNA Guide
ugggccaccugcacguuggug

SEQ ID NO: 15851 - RNA, 21 nt, Artificial Sequence
  ELANE RNA Guide
ugguguugaugguggccgacc

SEQ ID NO: 15852 - RNA, 21 nt, Artificial Sequence
  ELANE RNA Guide
uugguguugaugguggccgac

SEQ ID NO: 15853 - RNA, 22 nt, Artificial Sequence
  ELANE RNA Guide
aacaccaacgugcagguggccc

SEQ ID NO: 15854 - RNA, 22 nt, Artificial Sequence
  ELANE RNA Guide
aacgggucggccaccaucaaca

SEQ ID NO: 15855 - RNA, 22 nt, Artificial Sequence
  ELANE RNA Guide
acaccaacgugcagguggccca

SEQ ID NO: 15856 - RNA, 22 nt, Artificial Sequence
  ELANE RNA Guide
accaucaacaccaacgugcagg

SEQ ID NO: 15857 - RNA, 22 nt, Artificial Sequence
  ELANE RNA Guide
accugcacguugguguugaugg

SEQ ID NO: 15858 - RNA, 22 nt, Artificial Sequence
  ELANE RNA Guide
acgggucggccaccaucaacac

SEQ ID NO: 15859 - RNA, 22 nt, Artificial Sequence
  ELANE RNA Guide
acguugguguugaugguggccg

SEQ ID NO: 15860 - RNA, 22 nt, Artificial Sequence
  ELANE RNA Guide
agcugggccaccugcacguugg

SEQ ID NO: 15861 - RNA, 22 nt, Artificial Sequence
  ELANE RNA Guide
aucaacaccaacgugcaggugg

SEQ ID NO: 15862 - RNA, 22 nt, Artificial Sequence
  ELANE RNA Guide
caacaccaacgugcagguggcc

SEQ ID NO: 15863 - RNA, 22 nt, Artificial Sequence
  ELANE RNA Guide
caacgggucggccaccaucaac

SEQ ID NO: 15864 - RNA, 22 nt, Artificial Sequence
  ELANE RNA Guide
caccaacgugcagguggcccag

SEQ ID NO: 15865 - RNA, 22 nt, Artificial Sequence
  ELANE RNA Guide
caccaucaacaccaacgugcag

SEQ ID NO: 15866 - RNA, 22 nt, Artificial Sequence
  ELANE RNA Guide
caccugcacguugguguugaug

SEQ ID NO: 15867 - RNA, 22 nt, Artificial Sequence
  ELANE RNA Guide
cacguugguguugaugguggcc

SEQ ID NO: 15868 - RNA, 22 nt, Artificial Sequence
  ELANE RNA Guide
cagcugggccaccugcacguug

SEQ ID NO: 15869 - RNA, 22 nt, Artificial Sequence
  ELANE RNA Guide
caucaacaccaacgugcaggug

SEQ ID NO: 15870 - RNA, 22 nt, Artificial Sequence
  ELANE RNA Guide
ccaccaucaacaccaacgugca

SEQ ID NO: 15871 - RNA, 22 nt, Artificial Sequence
  ELANE RNA Guide
ccaccugcacguugguguugau

SEQ ID NO: 15872 - RNA, 22 nt, Artificial Sequence
  ELANE RNA Guide
ccaucaacaccaacgugcaggu

SEQ ID NO: 15873 - RNA, 22 nt, Artificial Sequence
  ELANE RNA Guide
ccugcacguugguguugauggu

SEQ ID NO: 15874 - RNA, 22 nt, Artificial Sequence
  ELANE RNA Guide
cggccaccaucaacaccaacgu

SEQ ID NO: 15875 - RNA, 22 nt, Artificial Sequence
  ELANE RNA Guide
cgggucggccaccaucaacacc

SEQ ID NO: 15876 - RNA, 22 nt, Artificial Sequence
  ELANE RNA Guide
cguugguguugaugguggccga

SEQ ID NO: 15877 - RNA, 22 nt, Artificial Sequence
  ELANE RNA Guide
cucaacgggucggccaccauca

SEQ ID NO: 15878 - RNA, 22 nt, Artificial Sequence
  ELANE RNA Guide
cugcacguugguguugauggug

SEQ ID NO: 15879 - RNA, 22 nt, Artificial Sequence
  ELANE RNA Guide
cugggccaccugcacguuggug

SEQ ID NO: 15880 - RNA, 22 nt, Artificial Sequence
  ELANE RNA Guide
gcacguugguguugaugguggc

SEQ ID NO: 15881 - RNA, 22 nt, Artificial Sequence
  ELANE RNA Guide
gcagcugggccaccugcacguu

SEQ ID NO: 15882 - RNA, 22 nt, Artificial Sequence
  ELANE RNA Guide
gccaccaucaacaccaacgugc

SEQ ID NO: 15883 - RNA, 22 nt, Artificial Sequence
  ELANE RNA Guide
gccaccugcacguugguguuga

SEQ ID NO: 15884 - RNA, 22 nt, Artificial Sequence
  ELANE RNA Guide
gcucaacgggucggccaccauc

SEQ ID NO: 15885 - RNA, 22 nt, Artificial Sequence
  ELANE RNA Guide
gcugggccaccugcacguuggu

SEQ ID NO: 15886 - RNA, 22 nt, Artificial Sequence
  ELANE RNA Guide
ggcagcugggccaccugcacgu

SEQ ID NO: 15887 - RNA, 22 nt, Artificial Sequence
  ELANE RNA Guide
ggccaccaucaacaccaacgug

SEQ ID NO: 15888 - RNA, 22 nt, Artificial Sequence
  ELANE RNA Guide
ggccaccugcacguugguguug

SEQ ID NO: 15889 - RNA, 22 nt, Artificial Sequence
  ELANE RNA Guide
gggccaccugcacguugguguu

SEQ ID NO: 15890 - RNA, 22 nt, Artificial Sequence
  ELANE RNA Guide
gggucggccaccaucaacacca

SEQ ID NO: 15891 - RNA, 22 nt, Artificial Sequence
  ELANE RNA Guide
ggucggccaccaucaacaccaa

SEQ ID NO: 15892 - RNA, 22 nt, Artificial Sequence
  ELANE RNA Guide
gguguugaugguggccgacccg

SEQ ID NO: 15893 - RNA, 22 nt, Artificial Sequence
  ELANE RNA Guide
gucggccaccaucaacaccaac

SEQ ID NO: 15894 - RNA, 22 nt, Artificial Sequence
  ELANE RNA Guide
guguugaugguggccgacccgu

SEQ ID NO: 15895 - RNA, 22 nt, Artificial Sequence
  ELANE RNA Guide
guugguguugaugguggccgac

SEQ ID NO: 15896 - RNA, 22 nt, Artificial Sequence
  ELANE RNA Guide
ucaacaccaacgugcagguggc

SEQ ID NO: 15897 - RNA, 22 nt, Artificial Sequence
  ELANE RNA Guide
ucaacgggucggccaccaucaa

SEQ ID NO: 15898 - RNA, 22 nt, Artificial Sequence
  ELANE RNA Guide
ucggccaccaucaacaccaacg

SEQ ID NO: 15899 - RNA, 22 nt, Artificial Sequence
  ELANE RNA Guide
ugcacguugguguugauggugg

SEQ ID NO: 15900 - RNA, 22 nt, Artificial Sequence
  ELANE RNA Guide
ugggccaccugcacguuggugu

SEQ ID NO: 15901 - RNA, 22 nt, Artificial Sequence
  ELANE RNA Guide
ugguguugaugguggccgaccc

SEQ ID NO: 15902 - RNA, 22 nt, Artificial Sequence
  ELANE RNA Guide
uugguguugaugguggccgacc

SEQ ID NO: 15903 - RNA, 20 nt, Artificial Sequence
  ELANE RNA Guide
aacgcccacgugcagguggc

SEQ ID NO: 15904 - RNA, 20 nt, Artificial Sequence
  ELANE RNA Guide
accaucaacgcccacgugca

SEQ ID NO: 15905 - RNA, 20 nt, Artificial Sequence
  ELANE RNA Guide
accugcacgugggcguugau

SEQ ID NO: 15906 - RNA, 20 nt, Artificial Sequence
  ELANE RNA Guide
acgcccacgugcagguggcc

SEQ ID NO: 15907 - RNA, 20 nt, Artificial Sequence
  ELANE RNA Guide
acgugggcguugaugguggc

SEQ ID NO: 15908 - RNA, 20 nt, Artificial Sequence
  ELANE RNA Guide
agcugggccaccugcacgug

SEQ ID NO: 15909 - RNA, 20 nt, Artificial Sequence
  ELANE RNA Guide
aucaacgcccacgugcaggu

SEQ ID NO: 15910 - RNA, 20 nt, Artificial Sequence
  ELANE RNA Guide
caacgcccacgugcaggugg

SEQ ID NO: 15911 - RNA, 20 nt, Artificial Sequence
  ELANE RNA Guide
caccaucaacgcccacgugc

SEQ ID NO: 15912 - RNA, 20 nt, Artificial Sequence
  ELANE RNA Guide
caccugcacgugggcguuga

SEQ ID NO: 15913 - RNA, 20 nt, Artificial Sequence
  ELANE RNA Guide
cacgugggcguugauggugg

SEQ ID NO: 15914 - RNA, 20 nt, Artificial Sequence
  ELANE RNA Guide
caucaacgcccacgugcagg

SEQ ID NO: 15915 - RNA, 20 nt, Artificial Sequence
  ELANE RNA Guide
ccaccaucaacgcccacgug

SEQ ID NO: 15916 - RNA, 20 nt, Artificial Sequence
  ELANE RNA Guide
ccaccugcacgugggcguug

SEQ ID NO: 15917 - RNA, 20 nt, Artificial Sequence
  ELANE RNA Guide
ccacgugcagguggcccagc

SEQ ID NO: 15918 - RNA, 20 nt, Artificial Sequence
  ELANE RNA Guide
ccaucaacgcccacgugcag

SEQ ID NO: 15919 - RNA, 20 nt, Artificial Sequence
  ELANE RNA Guide
cccacgugcagguggcccag

SEQ ID NO: 15920 - RNA, 20 nt, Artificial Sequence
  ELANE RNA Guide
ccugcacgugggcguugaug

SEQ ID NO: 15921 - RNA, 20 nt, Artificial Sequence
  ELANE RNA Guide
cgcccacgugcagguggccc

SEQ ID NO: 15922 - RNA, 20 nt, Artificial Sequence
  ELANE RNA Guide
cggcagcugggccaccugca

SEQ ID NO: 15923 - RNA, 20 nt, Artificial Sequence
  ELANE RNA Guide
cggccaccaucaacgcccac

SEQ ID NO: 15924 - RNA, 20 nt, Artificial Sequence
  ELANE RNA Guide
cgggucggccaccaucaacg

SEQ ID NO: 15925 - RNA, 20 nt, Artificial Sequence
  ELANE RNA Guide
cgugggcguugaugguggcc

SEQ ID NO: 15926 - RNA, 20 nt, Artificial Sequence
  ELANE RNA Guide
cugcacgugggcguugaugg

SEQ ID NO: 15927 - RNA, 20 nt, Artificial Sequence
  ELANE RNA Guide
cugggccaccugcacguggg

SEQ ID NO: 15928 - RNA, 20 nt, Artificial Sequence
  ELANE RNA Guide
gcacgugggcguugauggug

SEQ ID NO: 15929 - RNA, 20 nt, Artificial Sequence
  ELANE RNA Guide
gcagcugggccaccugcacg

SEQ ID NO: 15930 - RNA, 20 nt, Artificial Sequence
  ELANE RNA Guide
gccaccaucaacgcccacgu

SEQ ID NO: 15931 - RNA, 20 nt, Artificial Sequence
  ELANE RNA Guide
gccaccugcacgugggcguu

SEQ ID NO: 15932 - RNA, 20 nt, Artificial Sequence
  ELANE RNA Guide
gcccacgugcagguggccca

SEQ ID NO: 15933 - RNA, 20 nt, Artificial Sequence
  ELANE RNA Guide
gcugggccaccugcacgugg

SEQ ID NO: 15934 - RNA, 20 nt, Artificial Sequence
  ELANE RNA Guide
ggcagcugggccaccugcac

SEQ ID NO: 15935 - RNA, 20 nt, Artificial Sequence
  ELANE RNA Guide
ggccaccaucaacgcccacg

SEQ ID NO: 15936 - RNA, 20 nt, Artificial Sequence
  ELANE RNA Guide
ggccaccugcacgugggcgu

SEQ ID NO: 15937 - RNA, 20 nt, Artificial Sequence
  ELANE RNA Guide
gggccaccugcacgugggcg

SEQ ID NO: 15938 - RNA, 20 nt, Artificial Sequence
  ELANE RNA Guide
gggucggccaccaucaacgc

SEQ ID NO: 15939 - RNA, 20 nt, Artificial Sequence
  ELANE RNA Guide
ggucggccaccaucaacgcc

SEQ ID NO: 15940 - RNA, 20 nt, Artificial Sequence
  ELANE RNA Guide
gucggccaccaucaacgccc

SEQ ID NO: 15941 - RNA, 20 nt, Artificial Sequence
  ELANE RNA Guide
gugggcguugaugguggccg

SEQ ID NO: 15942 - RNA, 20 nt, Artificial Sequence
  ELANE RNA Guide
ucaacgcccacgugcaggug

SEQ ID NO: 15943 - RNA, 20 nt, Artificial Sequence
  ELANE RNA Guide
ucggccaccaucaacgccca

SEQ ID NO: 15944 - RNA, 20 nt, Artificial Sequence
  ELANE RNA Guide
ugcacgugggcguugauggu

SEQ ID NO: 15945 - RNA, 20 nt, Artificial Sequence
  ELANE RNA Guide
ugggccaccugcacgugggc

SEQ ID NO: 15946 - RNA, 20 nt, Artificial Sequence
  ELANE RNA Guide
ugggcguugaugguggccga

SEQ ID NO: 15947 - RNA, 21 nt, Artificial Sequence
  ELANE RNA Guide
aacgcccacgugcagguggcc

SEQ ID NO: 15948 - RNA, 21 nt, Artificial Sequence
  ELANE RNA Guide
accaucaacgcccacgugcag

SEQ ID NO: 15949 - RNA, 21 nt, Artificial Sequence
  ELANE RNA Guide
accugcacgugggcguugaug

SEQ ID NO: 15950 - RNA, 21 nt, Artificial Sequence
  ELANE RNA Guide
acgcccacgugcagguggccc

SEQ ID NO: 15951 - RNA, 21 nt, Artificial Sequence
  ELANE RNA Guide
acgggucggccaccaucaacg

SEQ ID NO: 15952 - RNA, 21 nt, Artificial Sequence
  ELANE RNA Guide
acgugggcguugaugguggcc

SEQ ID NO: 15953 - RNA, 21 nt, Artificial Sequence
  ELANE RNA Guide
agcugggccaccugcacgugg

SEQ ID NO: 15954 - RNA, 21 nt, Artificial Sequence
  ELANE RNA Guide
aucaacgcccacgugcaggug

SEQ ID NO: 15955 - RNA, 21 nt, Artificial Sequence
  ELANE RNA Guide
caacgcccacgugcagguggc

SEQ ID NO: 15956 - RNA, 21 nt, Artificial Sequence
  ELANE RNA Guide
caccaucaacgcccacgugca

SEQ ID NO: 15957 - RNA, 21 nt, Artificial Sequence
  ELANE RNA Guide
caccugcacgugggcguugau

SEQ ID NO: 15958 - RNA, 21 nt, Artificial Sequence
  ELANE RNA Guide
cacgugggcguugaugguggc

SEQ ID NO: 15959 - RNA, 21 nt, Artificial Sequence
  ELANE RNA Guide
cagcugggccaccugcacgug

SEQ ID NO: 15960 - RNA, 21 nt, Artificial Sequence
  ELANE RNA Guide
caucaacgcccacgugcaggu

SEQ ID NO: 15961 - RNA, 21 nt, Artificial Sequence
  ELANE RNA Guide
ccaccaucaacgcccacgugc

SEQ ID NO: 15962 - RNA, 21 nt, Artificial Sequence
  ELANE RNA Guide
ccaccugcacgugggcguuga

SEQ ID NO: 15963 - RNA, 21 nt, Artificial Sequence
  ELANE RNA Guide
ccacgugcagguggcccagcu

SEQ ID NO: 15964 - RNA, 21 nt, Artificial Sequence
  ELANE RNA Guide
ccaucaacgcccacgugcagg

SEQ ID NO: 15965 - RNA, 21 nt, Artificial Sequence
  ELANE RNA Guide
cccacgugcagguggcccagc

SEQ ID NO: 15966 - RNA, 21 nt, Artificial Sequence
  ELANE RNA Guide
ccggcagcugggccaccugca

SEQ ID NO: 15967 - RNA, 21 nt, Artificial Sequence
  ELANE RNA Guide
ccugcacgugggcguugaugg

SEQ ID NO: 15968 - RNA, 21 nt, Artificial Sequence
  ELANE RNA Guide
cgcccacgugcagguggccca

SEQ ID NO: 15969 - RNA, 21 nt, Artificial Sequence
  ELANE RNA Guide
cggcagcugggccaccugcac

SEQ ID NO: 15970 - RNA, 21 nt, Artificial Sequence
  ELANE RNA Guide
cggccaccaucaacgcccacg

SEQ ID NO: 15971 - RNA, 21 nt, Artificial Sequence
  ELANE RNA Guide
cgggucggccaccaucaacgc

SEQ ID NO: 15972 - RNA, 21 nt, Artificial Sequence
  ELANE RNA Guide
cgugggcguugaugguggccg

SEQ ID NO: 15973 - RNA, 21 nt, Artificial Sequence
  ELANE RNA Guide
cugcacgugggcguugauggu

SEQ ID NO: 15974 - RNA, 21 nt, Artificial Sequence
  ELANE RNA Guide
cugggccaccugcacgugggc

SEQ ID NO: 15975 - RNA, 21 nt, Artificial Sequence
  ELANE RNA Guide
gcacgugggcguugauggugg

SEQ ID NO: 15976 - RNA, 21 nt, Artificial Sequence
  ELANE RNA Guide
gccaccaucaacgcccacgug

SEQ ID NO: 15977 - RNA, 21 nt, Artificial Sequence
  ELANE RNA Guide
gccaccugcacgugggcguug

SEQ ID NO: 15978 - RNA, 21 nt, Artificial Sequence
  ELANE RNA Guide
gcccacgugcagguggcccag

SEQ ID NO: 15979 - RNA, 21 nt, Artificial Sequence
  ELANE RNA Guide
gcugggccaccugcacguggg

SEQ ID NO: 15980 - RNA, 21 nt, Artificial Sequence
  ELANE RNA Guide
ggcagcugggccaccugcacg

SEQ ID NO: 15981 - RNA, 21 nt, Artificial Sequence
  ELANE RNA Guide
ggccaccaucaacgcccacgu

SEQ ID NO: 15982 - RNA, 21 nt, Artificial Sequence
  ELANE RNA Guide
ggccaccugcacgugggcguu

SEQ ID NO: 15983 - RNA, 21 nt, Artificial Sequence
  ELANE RNA Guide
gggccaccugcacgugggcgu

SEQ ID NO: 15984 - RNA, 21 nt, Artificial Sequence
  ELANE RNA Guide
gggucggccaccaucaacgcc

SEQ ID NO: 15985 - RNA, 21 nt, Artificial Sequence
  ELANE RNA Guide
ggucggccaccaucaacgccc

SEQ ID NO: 15986 - RNA, 21 nt, Artificial Sequence
  ELANE RNA Guide
gucggccaccaucaacgccca

SEQ ID NO: 15987 - RNA, 21 nt, Artificial Sequence
  ELANE RNA Guide
gugggcguugaugguggccga

SEQ ID NO: 15988 - RNA, 21 nt, Artificial Sequence
  ELANE RNA Guide
ucaacgcccacgugcaggugg

SEQ ID NO: 15989 - RNA, 21 nt, Artificial Sequence
  ELANE RNA Guide
ucggccaccaucaacgcccac

SEQ ID NO: 15990 - RNA, 21 nt, Artificial Sequence
  ELANE RNA Guide
ugcacgugggcguugauggug

SEQ ID NO: 15991 - RNA, 21 nt, Artificial Sequence
  ELANE RNA Guide
ugggccaccugcacgugggcg

SEQ ID NO: 15992 - RNA, 21 nt, Artificial Sequence
  ELANE RNA Guide
ugggcguugaugguggccgac

SEQ ID NO: 15993 - RNA, 22 nt, Artificial Sequence
  ELANE RNA Guide
aacgcccacgugcagguggccc

SEQ ID NO: 15994 - RNA, 22 nt, Artificial Sequence
  ELANE RNA Guide
aacgggucggccaccaucaacg

SEQ ID NO: 15995 - RNA, 22 nt, Artificial Sequence
  ELANE RNA Guide
accaucaacgcccacgugcagg

SEQ ID NO: 15996 - RNA, 22 nt, Artificial Sequence
  ELANE RNA Guide
accugcacgugggcguugaugg

SEQ ID NO: 15997 - RNA, 22 nt, Artificial Sequence
  ELANE RNA Guide
acgcccacgugcagguggccca

SEQ ID NO: 15998 - RNA, 22 nt, Artificial Sequence
  ELANE RNA Guide
acgggucggccaccaucaacgc

SEQ ID NO: 15999 - RNA, 22 nt, Artificial Sequence
  ELANE RNA Guide
acgugggcguugaugguggccg

SEQ ID NO: 16000 - RNA, 22 nt, Artificial Sequence
  ELANE RNA Guide
agcugggccaccugcacguggg

SEQ ID NO: 16001 - RNA, 22 nt, Artificial Sequence
  ELANE RNA Guide
aucaacgcccacgugcaggugg

SEQ ID NO: 16002 - RNA, 22 nt, Artificial Sequence
  ELANE RNA Guide
caacgcccacgugcagguggcc

SEQ ID NO: 16003 - RNA, 22 nt, Artificial Sequence
  ELANE RNA Guide
caccaucaacgcccacgugcag

SEQ ID NO: 16004 - RNA, 22 nt, Artificial Sequence
  ELANE RNA Guide
caccugcacgugggcguugaug

SEQ ID NO: 16005 - RNA, 22 nt, Artificial Sequence
  ELANE RNA Guide
cacgugggcguugaugguggcc

SEQ ID NO: 16006 - RNA, 22 nt, Artificial Sequence
  ELANE RNA Guide
cagcugggccaccugcacgugg

SEQ ID NO: 16007 - RNA, 22 nt, Artificial Sequence
  ELANE RNA Guide
caucaacgcccacgugcaggug

SEQ ID NO: 16008 - RNA, 22 nt, Artificial Sequence
  ELANE RNA Guide
ccaccaucaacgcccacgugca

SEQ ID NO: 16009 - RNA, 22 nt, Artificial Sequence
  ELANE RNA Guide
ccaccugcacgugggcguugau

SEQ ID NO: 16010 - RNA, 22 nt, Artificial Sequence
  ELANE RNA Guide
ccacgugcagguggcccagcug

SEQ ID NO: 16011 - RNA, 22 nt, Artificial Sequence
  ELANE RNA Guide
ccaucaacgcccacgugcaggu

SEQ ID NO: 16012 - RNA, 22 nt, Artificial Sequence
  ELANE RNA Guide
cccacgugcagguggcccagcu

SEQ ID NO: 16013 - RNA, 22 nt, Artificial Sequence
  ELANE RNA Guide
ccggcagcugggccaccugcac

SEQ ID NO: 16014 - RNA, 22 nt, Artificial Sequence
  ELANE RNA Guide
ccugcacgugggcguugauggu

SEQ ID NO: 16015 - RNA, 22 nt, Artificial Sequence
  ELANE RNA Guide
cgcccacgugcagguggcccag

SEQ ID NO: 16016 - RNA, 22 nt, Artificial Sequence
  ELANE RNA Guide
cggcagcugggccaccugcacg

SEQ ID NO: 16017 - RNA, 22 nt, Artificial Sequence
  ELANE RNA Guide
cggccaccaucaacgcccacgu

SEQ ID NO: 16018 - RNA, 22 nt, Artificial Sequence
  ELANE RNA Guide
cgggucggccaccaucaacgcc

SEQ ID NO: 16019 - RNA, 22 nt, Artificial Sequence
  ELANE RNA Guide
cgugggcguugaugguggccga

SEQ ID NO: 16020 - RNA, 22 nt, Artificial Sequence
  ELANE RNA Guide
cugcacgugggcguugauggug

SEQ ID NO: 16021 - RNA, 22 nt, Artificial Sequence
  ELANE RNA Guide
cugggccaccugcacgugggcg

SEQ ID NO: 16022 - RNA, 22 nt, Artificial Sequence
  ELANE RNA Guide
gcacgugggcguugaugguggc

SEQ ID NO: 16023 - RNA, 22 nt, Artificial Sequence
  ELANE RNA Guide
gcagcugggccaccugcacgug

SEQ ID NO: 16024 - RNA, 22 nt, Artificial Sequence
  ELANE RNA Guide
gccaccaucaacgcccacgugc

SEQ ID NO: 16025 - RNA, 22 nt, Artificial Sequence
  ELANE RNA Guide
gccaccugcacgugggcguuga

SEQ ID NO: 16026 - RNA, 22 nt, Artificial Sequence
  ELANE RNA Guide
gcccacgugcagguggcccagc

SEQ ID NO: 16027 - RNA, 22 nt, Artificial Sequence
  ELANE RNA Guide
gccggcagcugggccaccugca

SEQ ID NO: 16028 - RNA, 22 nt, Artificial Sequence
  ELANE RNA Guide
gcugggccaccugcacgugggc

SEQ ID NO: 16029 - RNA, 22 nt, Artificial Sequence
  ELANE RNA Guide
ggccaccaucaacgcccacgug

SEQ ID NO: 16030 - RNA, 22 nt, Artificial Sequence
  ELANE RNA Guide
ggccaccugcacgugggcguug

SEQ ID NO: 16031 - RNA, 22 nt, Artificial Sequence
  ELANE RNA Guide
gggccaccugcacgugggcguu

SEQ ID NO: 16032 - RNA, 22 nt, Artificial Sequence
  ELANE RNA Guide
gggucggccaccaucaacgccc

SEQ ID NO: 16033 - RNA, 22 nt, Artificial Sequence
  ELANE RNA Guide
ggucggccaccaucaacgccca

SEQ ID NO: 16034 - RNA, 22 nt, Artificial Sequence
  ELANE RNA Guide
gucggccaccaucaacgcccac

SEQ ID NO: 16035 - RNA, 22 nt, Artificial Sequence
  ELANE RNA Guide
gugggcguugaugguggccgac

SEQ ID NO: 16036 - RNA, 22 nt, Artificial Sequence
  ELANE RNA Guide
ucaacgcccacgugcagguggc

SEQ ID NO: 16037 - RNA, 22 nt, Artificial Sequence
  ELANE RNA Guide
ucggccaccaucaacgcccacg

SEQ ID NO: 16038 - RNA, 22 nt, Artificial Sequence
  ELANE RNA Guide
ugcacgugggcguugauggugg

SEQ ID NO: 16039 - RNA, 22 nt, Artificial Sequence
  ELANE RNA Guide
ugggccaccugcacgugggcgu

SEQ ID NO: 16040 - RNA, 22 nt, Artificial Sequence
  ELANE RNA Guide
ugggcguugaugguggccgacc

SEQ ID NO: 16041 - RNA, 20 nt, Artificial Sequence
  ELANE RNA Guide
aacgccaacgugcaggugga

SEQ ID NO: 16042 - RNA, 20 nt, Artificial Sequence
  ELANE RNA Guide
aacgugcagguggaccagcu

SEQ ID NO: 16043 - RNA, 20 nt, Artificial Sequence
  ELANE RNA Guide
acgccaacgugcagguggac

SEQ ID NO: 16044 - RNA, 20 nt, Artificial Sequence
  ELANE RNA Guide
acgugcagguggaccagcug

SEQ ID NO: 16045 - RNA, 20 nt, Artificial Sequence
  ELANE RNA Guide
agccggcagcugguccaccu

SEQ ID NO: 16046 - RNA, 20 nt, Artificial Sequence
  ELANE RNA Guide
agcugguccaccugcacguu

SEQ ID NO: 16047 - RNA, 20 nt, Artificial Sequence
  ELANE RNA Guide
agguggaccagcugccggcu

SEQ ID NO: 16048 - RNA, 20 nt, Artificial Sequence
  ELANE RNA Guide
aucaacgccaacgugcaggu

SEQ ID NO: 16049 - RNA, 20 nt, Artificial Sequence
  ELANE RNA Guide
caacgccaacgugcaggugg

SEQ ID NO: 16050 - RNA, 20 nt, Artificial Sequence
  ELANE RNA Guide
caacgugcagguggaccagc

SEQ ID NO: 16051 - RNA, 20 nt, Artificial Sequence
  ELANE RNA Guide
cagcugguccaccugcacgu

SEQ ID NO: 16052 - RNA, 20 nt, Artificial Sequence
  ELANE RNA Guide
cagguggaccagcugccggc

SEQ ID NO: 16053 - RNA, 20 nt, Artificial Sequence
  ELANE RNA Guide
caucaacgccaacgugcagg

SEQ ID NO: 16054 - RNA, 20 nt, Artificial Sequence
  ELANE RNA Guide
ccaacgugcagguggaccag

SEQ ID NO: 16055 - RNA, 20 nt, Artificial Sequence
  ELANE RNA Guide
cccugagccggcagcugguc

SEQ ID NO: 16056 - RNA, 20 nt, Artificial Sequence
  ELANE RNA Guide
ccggcagcugguccaccugc

SEQ ID NO: 16057 - RNA, 20 nt, Artificial Sequence
  ELANE RNA Guide
ccugagccggcagcuggucc

SEQ ID NO: 16058 - RNA, 20 nt, Artificial Sequence
  ELANE RNA Guide
cgccaacgugcagguggacc

SEQ ID NO: 16059 - RNA, 20 nt, Artificial Sequence
  ELANE RNA Guide
cggcagcugguccaccugca

SEQ ID NO: 16060 - RNA, 20 nt, Artificial Sequence
  ELANE RNA Guide
cgucccugagccggcagcug

SEQ ID NO: 16061 - RNA, 20 nt, Artificial Sequence
  ELANE RNA Guide
cgugcagguggaccagcugc

SEQ ID NO: 16062 - RNA, 20 nt, Artificial Sequence
  ELANE RNA Guide
cugagccggcagcuggucca

SEQ ID NO: 16063 - RNA, 20 nt, Artificial Sequence
  ELANE RNA Guide
cugguccaccugcacguugg

SEQ ID NO: 16064 - RNA, 20 nt, Artificial Sequence
  ELANE RNA Guide
gaccagcugccggcucaggg

SEQ ID NO: 16065 - RNA, 20 nt, Artificial Sequence
  ELANE RNA Guide
gagccggcagcugguccacc

SEQ ID NO: 16066 - RNA, 20 nt, Artificial Sequence
  ELANE RNA Guide
gcagcugguccaccugcacg

SEQ ID NO: 16067 - RNA, 20 nt, Artificial Sequence
  ELANE RNA Guide
gcagguggaccagcugccgg

SEQ ID NO: 16068 - RNA, 20 nt, Artificial Sequence
  ELANE RNA Guide
gccaacgugcagguggacca

SEQ ID NO: 16069 - RNA, 20 nt, Artificial Sequence
  ELANE RNA Guide
gccggcagcugguccaccug

SEQ ID NO: 16070 - RNA, 20 nt, Artificial Sequence
  ELANE RNA Guide
gcgucccugagccggcagcu

SEQ ID NO: 16071 - RNA, 20 nt, Artificial Sequence
  ELANE RNA Guide
gcugguccaccugcacguug

SEQ ID NO: 16072 - RNA, 20 nt, Artificial Sequence
  ELANE RNA Guide
ggaccagcugccggcucagg

SEQ ID NO: 16073 - RNA, 20 nt, Artificial Sequence
  ELANE RNA Guide
ggcagcugguccaccugcac

SEQ ID NO: 16074 - RNA, 20 nt, Artificial Sequence
  ELANE RNA Guide
ggcgucccugagccggcagc

SEQ ID NO: 16075 - RNA, 20 nt, Artificial Sequence
  ELANE RNA Guide
gguccaccugcacguuggcg

SEQ ID NO: 16076 - RNA, 20 nt, Artificial Sequence
  ELANE RNA Guide
gguggaccagcugccggcuc

SEQ ID NO: 16077 - RNA, 20 nt, Artificial Sequence
  ELANE RNA Guide
guccaccugcacguuggcgu

SEQ ID NO: 16078 - RNA, 20 nt, Artificial Sequence
  ELANE RNA Guide
gucccugagccggcagcugg

SEQ ID NO: 16079 - RNA, 20 nt, Artificial Sequence
  ELANE RNA Guide
gugcagguggaccagcugcc

SEQ ID NO: 16080 - RNA, 20 nt, Artificial Sequence
  ELANE RNA Guide
guggaccagcugccggcuca

SEQ ID NO: 16081 - RNA, 20 nt, Artificial Sequence
  ELANE RNA Guide
ucaacgccaacgugcaggug

SEQ ID NO: 16082 - RNA, 20 nt, Artificial Sequence
  ELANE RNA Guide
ucccugagccggcagcuggu

SEQ ID NO: 16083 - RNA, 20 nt, Artificial Sequence
  ELANE RNA Guide
ugagccggcagcugguccac

SEQ ID NO: 16084 - RNA, 20 nt, Artificial Sequence
  ELANE RNA Guide
ugcagguggaccagcugccg

SEQ ID NO: 16085 - RNA, 20 nt, Artificial Sequence
  ELANE RNA Guide
uggaccagcugccggcucag

SEQ ID NO: 16086 - RNA, 20 nt, Artificial Sequence
  ELANE RNA Guide
ugguccaccugcacguuggc

SEQ ID NO: 16087 - RNA, 21 nt, Artificial Sequence
  ELANE RNA Guide
aacgccaacgugcagguggac

SEQ ID NO: 16088 - RNA, 21 nt, Artificial Sequence
  ELANE RNA Guide
aacgugcagguggaccagcug

SEQ ID NO: 16089 - RNA, 21 nt, Artificial Sequence
  ELANE RNA Guide
acgccaacgugcagguggacc

SEQ ID NO: 16090 - RNA, 21 nt, Artificial Sequence
  ELANE RNA Guide
acgugcagguggaccagcugc

SEQ ID NO: 16091 - RNA, 21 nt, Artificial Sequence
  ELANE RNA Guide
agccggcagcugguccaccug

SEQ ID NO: 16092 - RNA, 21 nt, Artificial Sequence
  ELANE RNA Guide
agcugguccaccugcacguug

SEQ ID NO: 16093 - RNA, 21 nt, Artificial Sequence
  ELANE RNA Guide
agguggaccagcugccggcuc

SEQ ID NO: 16094 - RNA, 21 nt, Artificial Sequence
  ELANE RNA Guide
aucaacgccaacgugcaggug

SEQ ID NO: 16095 - RNA, 21 nt, Artificial Sequence
  ELANE RNA Guide
caacgccaacgugcaggugga

SEQ ID NO: 16096 - RNA, 21 nt, Artificial Sequence
  ELANE RNA Guide
caacgugcagguggaccagcu

SEQ ID NO: 16097 - RNA, 21 nt, Artificial Sequence
  ELANE RNA Guide
cagcugguccaccugcacguu

SEQ ID NO: 16098 - RNA, 21 nt, Artificial Sequence
  ELANE RNA Guide
cagguggaccagcugccggcu

SEQ ID NO: 16099 - RNA, 21 nt, Artificial Sequence
  ELANE RNA Guide
caucaacgccaacgugcaggu

SEQ ID NO: 16100 - RNA, 21 nt, Artificial Sequence
  ELANE RNA Guide
ccaacgugcagguggaccagc

SEQ ID NO: 16101 - RNA, 21 nt, Artificial Sequence
  ELANE RNA Guide
ccaucaacgccaacgugcagg

SEQ ID NO: 16102 - RNA, 21 nt, Artificial Sequence
  ELANE RNA Guide
cccugagccggcagcuggucc

SEQ ID NO: 16103 - RNA, 21 nt, Artificial Sequence
  ELANE RNA Guide
ccggcagcugguccaccugca

SEQ ID NO: 16104 - RNA, 21 nt, Artificial Sequence
  ELANE RNA Guide
ccugagccggcagcuggucca

SEQ ID NO: 16105 - RNA, 21 nt, Artificial Sequence
  ELANE RNA Guide
cgccaacgugcagguggacca

SEQ ID NO: 16106 - RNA, 21 nt, Artificial Sequence
  ELANE RNA Guide
cggcagcugguccaccugcac

SEQ ID NO: 16107 - RNA, 21 nt, Artificial Sequence
  ELANE RNA Guide
cgucccugagccggcagcugg

SEQ ID NO: 16108 - RNA, 21 nt, Artificial Sequence
  ELANE RNA Guide
cgugcagguggaccagcugcc

SEQ ID NO: 16109 - RNA, 21 nt, Artificial Sequence
  ELANE RNA Guide
cugagccggcagcugguccac

SEQ ID NO: 16110 - RNA, 21 nt, Artificial Sequence
  ELANE RNA Guide
cugguccaccugcacguuggc

SEQ ID NO: 16111 - RNA, 21 nt, Artificial Sequence
  ELANE RNA Guide
gaccagcugccggcucaggga

SEQ ID NO: 16112 - RNA, 21 nt, Artificial Sequence
  ELANE RNA Guide
gagccggcagcugguccaccu

SEQ ID NO: 16113 - RNA, 21 nt, Artificial Sequence
  ELANE RNA Guide
gcagcugguccaccugcacgu

SEQ ID NO: 16114 - RNA, 21 nt, Artificial Sequence
  ELANE RNA Guide
gcagguggaccagcugccggc

SEQ ID NO: 16115 - RNA, 21 nt, Artificial Sequence
  ELANE RNA Guide
gccaacgugcagguggaccag

SEQ ID NO: 16116 - RNA, 21 nt, Artificial Sequence
  ELANE RNA Guide
gccggcagcugguccaccugc

SEQ ID NO: 16117 - RNA, 21 nt, Artificial Sequence
  ELANE RNA Guide
gcgucccugagccggcagcug

SEQ ID NO: 16118 - RNA, 21 nt, Artificial Sequence
  ELANE RNA Guide
gcugguccaccugcacguugg

SEQ ID NO: 16119 - RNA, 21 nt, Artificial Sequence
  ELANE RNA Guide
ggaccagcugccggcucaggg

SEQ ID NO: 16120 - RNA, 21 nt, Artificial Sequence
  ELANE RNA Guide
ggcagcugguccaccugcacg

SEQ ID NO: 16121 - RNA, 21 nt, Artificial Sequence
  ELANE RNA Guide
ggcgucccugagccggcagcu

SEQ ID NO: 16122 - RNA, 21 nt, Artificial Sequence
  ELANE RNA Guide
gguccaccugcacguuggcgu

SEQ ID NO: 16123 - RNA, 21 nt, Artificial Sequence
  ELANE RNA Guide
gguggaccagcugccggcuca

SEQ ID NO: 16124 - RNA, 21 nt, Artificial Sequence
  ELANE RNA Guide
guccaccugcacguuggcguu

SEQ ID NO: 16125 - RNA, 21 nt, Artificial Sequence
  ELANE RNA Guide
gucccugagccggcagcuggu

SEQ ID NO: 16126 - RNA, 21 nt, Artificial Sequence
  ELANE RNA Guide
gugcagguggaccagcugccg

SEQ ID NO: 16127 - RNA, 21 nt, Artificial Sequence
  ELANE RNA Guide
guggaccagcugccggcucag

SEQ ID NO: 16128 - RNA, 21 nt, Artificial Sequence
  ELANE RNA Guide
ucaacgccaacgugcaggugg

SEQ ID NO: 16129 - RNA, 21 nt, Artificial Sequence
  ELANE RNA Guide
ucccugagccggcagcugguc

SEQ ID NO: 16130 - RNA, 21 nt, Artificial Sequence
  ELANE RNA Guide
ugagccggcagcugguccacc

SEQ ID NO: 16131 - RNA, 21 nt, Artificial Sequence
  ELANE RNA Guide
ugcagguggaccagcugccgg

SEQ ID NO: 16132 - RNA, 21 nt, Artificial Sequence
  ELANE RNA Guide
uggaccagcugccggcucagg

SEQ ID NO: 16133 - RNA, 21 nt, Artificial Sequence
  ELANE RNA Guide
ugguccaccugcacguuggcg

SEQ ID NO: 16134 - RNA, 22 nt, Artificial Sequence
  ELANE RNA Guide
aacgccaacgugcagguggacc

SEQ ID NO: 16135 - RNA, 22 nt, Artificial Sequence
  ELANE RNA Guide
aacgugcagguggaccagcugc

SEQ ID NO: 16136 - RNA, 22 nt, Artificial Sequence
  ELANE RNA Guide
accaucaacgccaacgugcagg

SEQ ID NO: 16137 - RNA, 22 nt, Artificial Sequence
  ELANE RNA Guide
acgccaacgugcagguggacca

SEQ ID NO: 16138 - RNA, 22 nt, Artificial Sequence
  ELANE RNA Guide
acgugcagguggaccagcugcc

SEQ ID NO: 16139 - RNA, 22 nt, Artificial Sequence
  ELANE RNA Guide
agccggcagcugguccaccugc

SEQ ID NO: 16140 - RNA, 22 nt, Artificial Sequence
  ELANE RNA Guide
agcugguccaccugcacguugg

SEQ ID NO: 16141 - RNA, 22 nt, Artificial Sequence
  ELANE RNA Guide
agguggaccagcugccggcuca

SEQ ID NO: 16142 - RNA, 22 nt, Artificial Sequence
  ELANE RNA Guide
aucaacgccaacgugcaggugg

SEQ ID NO: 16143 - RNA, 22 nt, Artificial Sequence
  ELANE RNA Guide
caacgccaacgugcagguggac

SEQ ID NO: 16144 - RNA, 22 nt, Artificial Sequence
  ELANE RNA Guide
caacgugcagguggaccagcug

SEQ ID NO: 16145 - RNA, 22 nt, Artificial Sequence
  ELANE RNA Guide
cagcugguccaccugcacguug

SEQ ID NO: 16146 - RNA, 22 nt, Artificial Sequence
  ELANE RNA Guide
cagguggaccagcugccggcuc

SEQ ID NO: 16147 - RNA, 22 nt, Artificial Sequence
  ELANE RNA Guide
caucaacgccaacgugcaggug

SEQ ID NO: 16148 - RNA, 22 nt, Artificial Sequence
  ELANE RNA Guide
ccaacgugcagguggaccagcu

SEQ ID NO: 16149 - RNA, 22 nt, Artificial Sequence
  ELANE RNA Guide
ccaucaacgccaacgugcaggu

SEQ ID NO: 16150 - RNA, 22 nt, Artificial Sequence
  ELANE RNA Guide
cccugagccggcagcuggucca

SEQ ID NO: 16151 - RNA, 22 nt, Artificial Sequence
  ELANE RNA Guide
ccggcagcugguccaccugcac

SEQ ID NO: 16152 - RNA, 22 nt, Artificial Sequence
  ELANE RNA Guide
ccugagccggcagcugguccac

SEQ ID NO: 16153 - RNA, 22 nt, Artificial Sequence
  ELANE RNA Guide
cgccaacgugcagguggaccag

SEQ ID NO: 16154 - RNA, 22 nt, Artificial Sequence
  ELANE RNA Guide
cggcagcugguccaccugcacg

SEQ ID NO: 16155 - RNA, 22 nt, Artificial Sequence
  ELANE RNA Guide
cggcgucccugagccggcagcu

SEQ ID NO: 16156 - RNA, 22 nt, Artificial Sequence
  ELANE RNA Guide
cgucccugagccggcagcuggu

SEQ ID NO: 16157 - RNA, 22 nt, Artificial Sequence
  ELANE RNA Guide
cgugcagguggaccagcugccg

SEQ ID NO: 16158 - RNA, 22 nt, Artificial Sequence
  ELANE RNA Guide
cugagccggcagcugguccacc

SEQ ID NO: 16159 - RNA, 22 nt, Artificial Sequence
  ELANE RNA Guide
cugguccaccugcacguuggcg

SEQ ID NO: 16160 - RNA, 22 nt, Artificial Sequence
  ELANE RNA Guide
gaccagcugccggcucagggac

SEQ ID NO: 16161 - RNA, 22 nt, Artificial Sequence
  ELANE RNA Guide
gagccggcagcugguccaccug

SEQ ID NO: 16162 - RNA, 22 nt, Artificial Sequence
  ELANE RNA Guide
gcagcugguccaccugcacguu

SEQ ID NO: 16163 - RNA, 22 nt, Artificial Sequence
  ELANE RNA Guide
gcagguggaccagcugccggcu

SEQ ID NO: 16164 - RNA, 22 nt, Artificial Sequence
  ELANE RNA Guide
gccaacgugcagguggaccagc

SEQ ID NO: 16165 - RNA, 22 nt, Artificial Sequence
  ELANE RNA Guide
gccggcagcugguccaccugca

SEQ ID NO: 16166 - RNA, 22 nt, Artificial Sequence
  ELANE RNA Guide
gcgucccugagccggcagcugg

SEQ ID NO: 16167 - RNA, 22 nt, Artificial Sequence
  ELANE RNA Guide
gcugguccaccugcacguuggc

SEQ ID NO: 16168 - RNA, 22 nt, Artificial Sequence
  ELANE RNA Guide
ggaccagcugccggcucaggga

SEQ ID NO: 16169 - RNA, 22 nt, Artificial Sequence
  ELANE RNA Guide
ggcagcugguccaccugcacgu

SEQ ID NO: 16170 - RNA, 22 nt, Artificial Sequence
  ELANE RNA Guide
ggcgucccugagccggcagcug

SEQ ID NO: 16171 - RNA, 22 nt, Artificial Sequence
  ELANE RNA Guide
gguccaccugcacguuggcguu

SEQ ID NO: 16172 - RNA, 22 nt, Artificial Sequence
  ELANE RNA Guide
gguggaccagcugccggcucag

SEQ ID NO: 16173 - RNA, 22 nt, Artificial Sequence
  ELANE RNA Guide
guccaccugcacguuggcguug

SEQ ID NO: 16174 - RNA, 22 nt, Artificial Sequence
  ELANE RNA Guide
gucccugagccggcagcugguc

SEQ ID NO: 16175 - RNA, 22 nt, Artificial Sequence
  ELANE RNA Guide
gugcagguggaccagcugccgg

SEQ ID NO: 16176 - RNA, 22 nt, Artificial Sequence
  ELANE RNA Guide
guggaccagcugccggcucagg

SEQ ID NO: 16177 - RNA, 22 nt, Artificial Sequence
  ELANE RNA Guide
ucaacgccaacgugcaggugga

SEQ ID NO: 16178 - RNA, 22 nt, Artificial Sequence
  ELANE RNA Guide
ucccugagccggcagcuggucc

SEQ ID NO: 16179 - RNA, 22 nt, Artificial Sequence
  ELANE RNA Guide
ugagccggcagcugguccaccu

SEQ ID NO: 16180 - RNA, 22 nt, Artificial Sequence
  ELANE RNA Guide
ugcagguggaccagcugccggc

SEQ ID NO: 16181 - RNA, 22 nt, Artificial Sequence
  ELANE RNA Guide
uggaccagcugccggcucaggg

SEQ ID NO: 16182 - RNA, 22 nt, Artificial Sequence
  ELANE RNA Guide
ugguccaccugcacguuggcgu

SEQ ID NO: 16183 - RNA, 20 nt, Artificial Sequence
  ELANE RNA Guide
aacgccaacgugcagguggu

SEQ ID NO: 16184 - RNA, 20 nt, Artificial Sequence
  ELANE RNA Guide
aacgugcaggugguccagcu

SEQ ID NO: 16185 - RNA, 20 nt, Artificial Sequence
  ELANE RNA Guide
acgccaacgugcaggugguc

SEQ ID NO: 16186 - RNA, 20 nt, Artificial Sequence
  ELANE RNA Guide
acgugcaggugguccagcug

SEQ ID NO: 16187 - RNA, 20 nt, Artificial Sequence
  ELANE RNA Guide
agccggcagcuggaccaccu

SEQ ID NO: 16188 - RNA, 20 nt, Artificial Sequence
  ELANE RNA Guide
agcuggaccaccugcacguu

SEQ ID NO: 16189 - RNA, 20 nt, Artificial Sequence
  ELANE RNA Guide
aggugguccagcugccggcu

SEQ ID NO: 16190 - RNA, 20 nt, Artificial Sequence
  ELANE RNA Guide
caacgugcaggugguccagc

SEQ ID NO: 16191 - RNA, 20 nt, Artificial Sequence
  ELANE RNA Guide
cagcuggaccaccugcacgu

SEQ ID NO: 16192 - RNA, 20 nt, Artificial Sequence
  ELANE RNA Guide
caggugguccagcugccggc

SEQ ID NO: 16193 - RNA, 20 nt, Artificial Sequence
  ELANE RNA Guide
ccaacgugcaggugguccag

SEQ ID NO: 16194 - RNA, 20 nt, Artificial Sequence
  ELANE RNA Guide
cccugagccggcagcuggac

SEQ ID NO: 16195 - RNA, 20 nt, Artificial Sequence
  ELANE RNA Guide
ccggcagcuggaccaccugc

SEQ ID NO: 16196 - RNA, 20 nt, Artificial Sequence
  ELANE RNA Guide
ccugagccggcagcuggacc

SEQ ID NO: 16197 - RNA, 20 nt, Artificial Sequence
  ELANE RNA Guide
cgccaacgugcagguggucc

SEQ ID NO: 16198 - RNA, 20 nt, Artificial Sequence
  ELANE RNA Guide
cggcagcuggaccaccugca

SEQ ID NO: 16199 - RNA, 20 nt, Artificial Sequence
  ELANE RNA Guide
cgugcaggugguccagcugc

SEQ ID NO: 16200 - RNA, 20 nt, Artificial Sequence
  ELANE RNA Guide
cugagccggcagcuggacca

SEQ ID NO: 16201 - RNA, 20 nt, Artificial Sequence
  ELANE RNA Guide
cuggaccaccugcacguugg

SEQ ID NO: 16202 - RNA, 20 nt, Artificial Sequence
  ELANE RNA Guide
gaccaccugcacguuggcgu

SEQ ID NO: 16203 - RNA, 20 nt, Artificial Sequence
  ELANE RNA Guide
gagccggcagcuggaccacc

SEQ ID NO: 16204 - RNA, 20 nt, Artificial Sequence
  ELANE RNA Guide
gcagcuggaccaccugcacg

SEQ ID NO: 16205 - RNA, 20 nt, Artificial Sequence
  ELANE RNA Guide
gcaggugguccagcugccgg

SEQ ID NO: 16206 - RNA, 20 nt, Artificial Sequence
  ELANE RNA Guide
gccaacgugcagguggucca

SEQ ID NO: 16207 - RNA, 20 nt, Artificial Sequence
  ELANE RNA Guide
gccggcagcuggaccaccug

SEQ ID NO: 16208 - RNA, 20 nt, Artificial Sequence
  ELANE RNA Guide
gcuggaccaccugcacguug

SEQ ID NO: 16209 - RNA, 20 nt, Artificial Sequence
  ELANE RNA Guide
ggaccaccugcacguuggcg

SEQ ID NO: 16210 - RNA, 20 nt, Artificial Sequence
  ELANE RNA Guide
ggcagcuggaccaccugcac

SEQ ID NO: 16211 - RNA, 20 nt, Artificial Sequence
  ELANE RNA Guide
gguccagcugccggcucagg

SEQ ID NO: 16212 - RNA, 20 nt, Artificial Sequence
  ELANE RNA Guide
ggugguccagcugccggcuc

SEQ ID NO: 16213 - RNA, 20 nt, Artificial Sequence
  ELANE RNA Guide
guccagcugccggcucaggg

SEQ ID NO: 16214 - RNA, 20 nt, Artificial Sequence
  ELANE RNA Guide
gugcaggugguccagcugcc

SEQ ID NO: 16215 - RNA, 20 nt, Artificial Sequence
  ELANE RNA Guide
gugguccagcugccggcuca

SEQ ID NO: 16216 - RNA, 20 nt, Artificial Sequence
  ELANE RNA Guide
ucccugagccggcagcugga

SEQ ID NO: 16217 - RNA, 20 nt, Artificial Sequence
  ELANE RNA Guide
ugagccggcagcuggaccac

SEQ ID NO: 16218 - RNA, 20 nt, Artificial Sequence
  ELANE RNA Guide
ugcaggugguccagcugccg

SEQ ID NO: 16219 - RNA, 20 nt, Artificial Sequence
  ELANE RNA Guide
uggaccaccugcacguuggc

SEQ ID NO: 16220 - RNA, 20 nt, Artificial Sequence
  ELANE RNA Guide
ugguccagcugccggcucag

SEQ ID NO: 16221 - RNA, 21 nt, Artificial Sequence
  ELANE RNA Guide
aacgccaacgugcaggugguc

SEQ ID NO: 16222 - RNA, 21 nt, Artificial Sequence
  ELANE RNA Guide
aacgugcaggugguccagcug

SEQ ID NO: 16223 - RNA, 21 nt, Artificial Sequence
  ELANE RNA Guide
acgccaacgugcagguggucc

SEQ ID NO: 16224 - RNA, 21 nt, Artificial Sequence
  ELANE RNA Guide
acgugcaggugguccagcugc

SEQ ID NO: 16225 - RNA, 21 nt, Artificial Sequence
  ELANE RNA Guide
agccggcagcuggaccaccug

SEQ ID NO: 16226 - RNA, 21 nt, Artificial Sequence
  ELANE RNA Guide
agcuggaccaccugcacguug

SEQ ID NO: 16227 - RNA, 21 nt, Artificial Sequence
  ELANE RNA Guide
aggugguccagcugccggcuc

SEQ ID NO: 16228 - RNA, 21 nt, Artificial Sequence
  ELANE RNA Guide
caacgccaacgugcagguggu

SEQ ID NO: 16229 - RNA, 21 nt, Artificial Sequence
  ELANE RNA Guide
caacgugcaggugguccagcu

SEQ ID NO: 16230 - RNA, 21 nt, Artificial Sequence
  ELANE RNA Guide
cagcuggaccaccugcacguu

SEQ ID NO: 16231 - RNA, 21 nt, Artificial Sequence
  ELANE RNA Guide
caggugguccagcugccggcu

SEQ ID NO: 16232 - RNA, 21 nt, Artificial Sequence
  ELANE RNA Guide
ccaacgugcaggugguccagc

SEQ ID NO: 16233 - RNA, 21 nt, Artificial Sequence
  ELANE RNA Guide
cccugagccggcagcuggacc

SEQ ID NO: 16234 - RNA, 21 nt, Artificial Sequence
  ELANE RNA Guide
ccggcagcuggaccaccugca

SEQ ID NO: 16235 - RNA, 21 nt, Artificial Sequence
  ELANE RNA Guide
ccugagccggcagcuggacca

SEQ ID NO: 16236 - RNA, 21 nt, Artificial Sequence
  ELANE RNA Guide
cgccaacgugcagguggucca

SEQ ID NO: 16237 - RNA, 21 nt, Artificial Sequence
  ELANE RNA Guide
cggcagcuggaccaccugcac

SEQ ID NO: 16238 - RNA, 21 nt, Artificial Sequence
  ELANE RNA Guide
cgugcaggugguccagcugcc

SEQ ID NO: 16239 - RNA, 21 nt, Artificial Sequence
  ELANE RNA Guide
cugagccggcagcuggaccac

SEQ ID NO: 16240 - RNA, 21 nt, Artificial Sequence
  ELANE RNA Guide
cuggaccaccugcacguuggc

SEQ ID NO: 16241 - RNA, 21 nt, Artificial Sequence
  ELANE RNA Guide
gaccaccugcacguuggcguu

SEQ ID NO: 16242 - RNA, 21 nt, Artificial Sequence
  ELANE RNA Guide
gagccggcagcuggaccaccu

SEQ ID NO: 16243 - RNA, 21 nt, Artificial Sequence
  ELANE RNA Guide
gcagcuggaccaccugcacgu

SEQ ID NO: 16244 - RNA, 21 nt, Artificial Sequence
  ELANE RNA Guide
gcaggugguccagcugccggc

SEQ ID NO: 16245 - RNA, 21 nt, Artificial Sequence
  ELANE RNA Guide
gccaacgugcaggugguccag

SEQ ID NO: 16246 - RNA, 21 nt, Artificial Sequence
  ELANE RNA Guide
gccggcagcuggaccaccugc

SEQ ID NO: 16247 - RNA, 21 nt, Artificial Sequence
  ELANE RNA Guide
gcuggaccaccugcacguugg

SEQ ID NO: 16248 - RNA, 21 nt, Artificial Sequence
  ELANE RNA Guide
ggaccaccugcacguuggcgu

SEQ ID NO: 16249 - RNA, 21 nt, Artificial Sequence
  ELANE RNA Guide
ggcagcuggaccaccugcacg

SEQ ID NO: 16250 - RNA, 21 nt, Artificial Sequence
  ELANE RNA Guide
gguccagcugccggcucaggg

SEQ ID NO: 16251 - RNA, 21 nt, Artificial Sequence
  ELANE RNA Guide
ggugguccagcugccggcuca

SEQ ID NO: 16252 - RNA, 21 nt, Artificial Sequence
  ELANE RNA Guide
guccagcugccggcucaggga

SEQ ID NO: 16253 - RNA, 21 nt, Artificial Sequence
  ELANE RNA Guide
gucccugagccggcagcugga

SEQ ID NO: 16254 - RNA, 21 nt, Artificial Sequence
  ELANE RNA Guide
gugcaggugguccagcugccg

SEQ ID NO: 16255 - RNA, 21 nt, Artificial Sequence
  ELANE RNA Guide
gugguccagcugccggcucag

SEQ ID NO: 16256 - RNA, 21 nt, Artificial Sequence
  ELANE RNA Guide
ucccugagccggcagcuggac

SEQ ID NO: 16257 - RNA, 21 nt, Artificial Sequence
  ELANE RNA Guide
ugagccggcagcuggaccacc

SEQ ID NO: 16258 - RNA, 21 nt, Artificial Sequence
  ELANE RNA Guide
ugcaggugguccagcugccgg

SEQ ID NO: 16259 - RNA, 21 nt, Artificial Sequence
  ELANE RNA Guide
uggaccaccugcacguuggcg

SEQ ID NO: 16260 - RNA, 21 nt, Artificial Sequence
  ELANE RNA Guide
ugguccagcugccggcucagg

SEQ ID NO: 16261 - RNA, 22 nt, Artificial Sequence
  ELANE RNA Guide
aacgccaacgugcagguggucc

SEQ ID NO: 16262 - RNA, 22 nt, Artificial Sequence
  ELANE RNA Guide
aacgugcaggugguccagcugc

SEQ ID NO: 16263 - RNA, 22 nt, Artificial Sequence
  ELANE RNA Guide
acgccaacgugcagguggucca

SEQ ID NO: 16264 - RNA, 22 nt, Artificial Sequence
  ELANE RNA Guide
acgugcaggugguccagcugcc

SEQ ID NO: 16265 - RNA, 22 nt, Artificial Sequence
  ELANE RNA Guide
agccggcagcuggaccaccugc

SEQ ID NO: 16266 - RNA, 22 nt, Artificial Sequence
  ELANE RNA Guide
agcuggaccaccugcacguugg

SEQ ID NO: 16267 - RNA, 22 nt, Artificial Sequence
  ELANE RNA Guide
aggugguccagcugccggcuca

SEQ ID NO: 16268 - RNA, 22 nt, Artificial Sequence
  ELANE RNA Guide
caacgccaacgugcaggugguc

SEQ ID NO: 16269 - RNA, 22 nt, Artificial Sequence
  ELANE RNA Guide
caacgugcaggugguccagcug

SEQ ID NO: 16270 - RNA, 22 nt, Artificial Sequence
  ELANE RNA Guide
cagcuggaccaccugcacguug

SEQ ID NO: 16271 - RNA, 22 nt, Artificial Sequence
  ELANE RNA Guide
caggugguccagcugccggcuc

SEQ ID NO: 16272 - RNA, 22 nt, Artificial Sequence
  ELANE RNA Guide
ccaacgugcaggugguccagcu

SEQ ID NO: 16273 - RNA, 22 nt, Artificial Sequence
  ELANE RNA Guide
cccugagccggcagcuggacca

SEQ ID NO: 16274 - RNA, 22 nt, Artificial Sequence
  ELANE RNA Guide
ccggcagcuggaccaccugcac

SEQ ID NO: 16275 - RNA, 22 nt, Artificial Sequence
  ELANE RNA Guide
ccugagccggcagcuggaccac

SEQ ID NO: 16276 - RNA, 22 nt, Artificial Sequence
  ELANE RNA Guide
cgccaacgugcaggugguccag

SEQ ID NO: 16277 - RNA, 22 nt, Artificial Sequence
  ELANE RNA Guide
cggcagcuggaccaccugcacg

SEQ ID NO: 16278 - RNA, 22 nt, Artificial Sequence
  ELANE RNA Guide
cgucccugagccggcagcugga

SEQ ID NO: 16279 - RNA, 22 nt, Artificial Sequence
  ELANE RNA Guide
cgugcaggugguccagcugccg

SEQ ID NO: 16280 - RNA, 22 nt, Artificial Sequence
  ELANE RNA Guide
cugagccggcagcuggaccacc

SEQ ID NO: 16281 - RNA, 22 nt, Artificial Sequence
  ELANE RNA Guide
cuggaccaccugcacguuggcg

SEQ ID NO: 16282 - RNA, 22 nt, Artificial Sequence
  ELANE RNA Guide
gaccaccugcacguuggcguug

SEQ ID NO: 16283 - RNA, 22 nt, Artificial Sequence
  ELANE RNA Guide
gagccggcagcuggaccaccug

SEQ ID NO: 16284 - RNA, 22 nt, Artificial Sequence
  ELANE RNA Guide
gcagcuggaccaccugcacguu

SEQ ID NO: 16285 - RNA, 22 nt, Artificial Sequence
  ELANE RNA Guide
gcaggugguccagcugccggcu

SEQ ID NO: 16286 - RNA, 22 nt, Artificial Sequence
  ELANE RNA Guide
gccaacgugcaggugguccagc

SEQ ID NO: 16287 - RNA, 22 nt, Artificial Sequence
  ELANE RNA Guide
gccggcagcuggaccaccugca

SEQ ID NO: 16288 - RNA, 22 nt, Artificial Sequence
  ELANE RNA Guide
gcuggaccaccugcacguuggc

SEQ ID NO: 16289 - RNA, 22 nt, Artificial Sequence
  ELANE RNA Guide
ggaccaccugcacguuggcguu

SEQ ID NO: 16290 - RNA, 22 nt, Artificial Sequence
  ELANE RNA Guide
ggcagcuggaccaccugcacgu

SEQ ID NO: 16291 - RNA, 22 nt, Artificial Sequence
  ELANE RNA Guide
gguccagcugccggcucaggga

SEQ ID NO: 16292 - RNA, 22 nt, Artificial Sequence
  ELANE RNA Guide
ggugguccagcugccggcucag

SEQ ID NO: 16293 - RNA, 22 nt, Artificial Sequence
  ELANE RNA Guide
guccagcugccggcucagggac

SEQ ID NO: 16294 - RNA, 22 nt, Artificial Sequence
  ELANE RNA Guide
gucccugagccggcagcuggac

SEQ ID NO: 16295 - RNA, 22 nt, Artificial Sequence
  ELANE RNA Guide
gugcaggugguccagcugccgg

SEQ ID NO: 16296 - RNA, 22 nt, Artificial Sequence
  ELANE RNA Guide
gugguccagcugccggcucagg

SEQ ID NO: 16297 - RNA, 22 nt, Artificial Sequence
  ELANE RNA Guide
ucaacgccaacgugcagguggu

SEQ ID NO: 16298 - RNA, 22 nt, Artificial Sequence
  ELANE RNA Guide
ucccugagccggcagcuggacc

SEQ ID NO: 16299 - RNA, 22 nt, Artificial Sequence
  ELANE RNA Guide
ugagccggcagcuggaccaccu

SEQ ID NO: 16300 - RNA, 22 nt, Artificial Sequence
  ELANE RNA Guide
ugcaggugguccagcugccggc

SEQ ID NO: 16301 - RNA, 22 nt, Artificial Sequence
  ELANE RNA Guide
uggaccaccugcacguuggcgu

SEQ ID NO: 16302 - RNA, 22 nt, Artificial Sequence
  ELANE RNA Guide
ugguccagcugccggcucaggg

SEQ ID NO: 16303 - RNA, 20 nt, Artificial Sequence
  ELANE RNA Guide
aacgugcagguggcccagcu

SEQ ID NO: 16304 - RNA, 20 nt, Artificial Sequence
  ELANE RNA Guide
acgugcagguggcccagcug

SEQ ID NO: 16305 - RNA, 20 nt, Artificial Sequence
  ELANE RNA Guide
agcccgcagcugggccaccu

SEQ ID NO: 16306 - RNA, 20 nt, Artificial Sequence
  ELANE RNA Guide
agcugcgggcucagggacgc

SEQ ID NO: 16307 - RNA, 20 nt, Artificial Sequence
  ELANE RNA Guide
aggcggcgucccugagcccg

SEQ ID NO: 16308 - RNA, 20 nt, Artificial Sequence
  ELANE RNA Guide
agguggcccagcugcgggcu

SEQ ID NO: 16309 - RNA, 20 nt, Artificial Sequence
  ELANE RNA Guide
caacgugcagguggcccagc

SEQ ID NO: 16310 - RNA, 20 nt, Artificial Sequence
  ELANE RNA Guide
cagcugcgggcucagggacg

SEQ ID NO: 16311 - RNA, 20 nt, Artificial Sequence
  ELANE RNA Guide
caggcggcgucccugagccc

SEQ ID NO: 16312 - RNA, 20 nt, Artificial Sequence
  ELANE RNA Guide
cagguggcccagcugcgggc

SEQ ID NO: 16313 - RNA, 20 nt, Artificial Sequence
  ELANE RNA Guide
ccagcugcgggcucagggac

SEQ ID NO: 16314 - RNA, 20 nt, Artificial Sequence
  ELANE RNA Guide
ccaggcggcgucccugagcc

SEQ ID NO: 16315 - RNA, 20 nt, Artificial Sequence
  ELANE RNA Guide
cccagcugcgggcucaggga

SEQ ID NO: 16316 - RNA, 20 nt, Artificial Sequence
  ELANE RNA Guide
cccaggcggcgucccugagc

SEQ ID NO: 16317 - RNA, 20 nt, Artificial Sequence
  ELANE RNA Guide
cccgcagcugggccaccugc

SEQ ID NO: 16318 - RNA, 20 nt, Artificial Sequence
  ELANE RNA Guide
cccugagcccgcagcugggc

SEQ ID NO: 16319 - RNA, 20 nt, Artificial Sequence
  ELANE RNA Guide
ccgcagcugggccaccugca

SEQ ID NO: 16320 - RNA, 20 nt, Artificial Sequence
  ELANE RNA Guide
ccugagcccgcagcugggcc

SEQ ID NO: 16321 - RNA, 20 nt, Artificial Sequence
  ELANE RNA Guide
cggcgucccugagcccgcag

SEQ ID NO: 16322 - RNA, 20 nt, Artificial Sequence
  ELANE RNA Guide
cgggcucagggacgccgccu

SEQ ID NO: 16323 - RNA, 20 nt, Artificial Sequence
  ELANE RNA Guide
cgucccugagcccgcagcug

SEQ ID NO: 16324 - RNA, 20 nt, Artificial Sequence
  ELANE RNA Guide
cgugcagguggcccagcugc

SEQ ID NO: 16325 - RNA, 20 nt, Artificial Sequence
  ELANE RNA Guide
cugagcccgcagcugggcca

SEQ ID NO: 16326 - RNA, 20 nt, Artificial Sequence
  ELANE RNA Guide
cugcgggcucagggacgccg

SEQ ID NO: 16327 - RNA, 20 nt, Artificial Sequence
  ELANE RNA Guide
gagcccgcagcugggccacc

SEQ ID NO: 16328 - RNA, 20 nt, Artificial Sequence
  ELANE RNA Guide
gcagguggcccagcugcggg

SEQ ID NO: 16329 - RNA, 20 nt, Artificial Sequence
  ELANE RNA Guide
gcccagcugcgggcucaggg

SEQ ID NO: 16330 - RNA, 20 nt, Artificial Sequence
  ELANE RNA Guide
gcccaggcggcgucccugag

SEQ ID NO: 16331 - RNA, 20 nt, Artificial Sequence
  ELANE RNA Guide
gcccgcagcugggccaccug

SEQ ID NO: 16332 - RNA, 20 nt, Artificial Sequence
  ELANE RNA Guide
gcggcgucccugagcccgca

SEQ ID NO: 16333 - RNA, 20 nt, Artificial Sequence
  ELANE RNA Guide
gcgucccugagcccgcagcu

SEQ ID NO: 16334 - RNA, 20 nt, Artificial Sequence
  ELANE RNA Guide
gcugcgggcucagggacgcc

SEQ ID NO: 16335 - RNA, 20 nt, Artificial Sequence
  ELANE RNA Guide
ggcccagcugcgggcucagg

SEQ ID NO: 16336 - RNA, 20 nt, Artificial Sequence
  ELANE RNA Guide
ggcgucccugagcccgcagc

SEQ ID NO: 16337 - RNA, 20 nt, Artificial Sequence
  ELANE RNA Guide
gguggcccagcugcgggcuc

SEQ ID NO: 16338 - RNA, 20 nt, Artificial Sequence
  ELANE RNA Guide
gucccugagcccgcagcugg

SEQ ID NO: 16339 - RNA, 20 nt, Artificial Sequence
  ELANE RNA Guide
gugcagguggcccagcugcg

SEQ ID NO: 16340 - RNA, 20 nt, Artificial Sequence
  ELANE RNA Guide
guggcccagcugcgggcuca

SEQ ID NO: 16341 - RNA, 20 nt, Artificial Sequence
  ELANE RNA Guide
ucccugagcccgcagcuggg

SEQ ID NO: 16342 - RNA, 20 nt, Artificial Sequence
  ELANE RNA Guide
ugagcccgcagcugggccac

SEQ ID NO: 16343 - RNA, 20 nt, Artificial Sequence
  ELANE RNA Guide
ugcagguggcccagcugcgg

SEQ ID NO: 16344 - RNA, 20 nt, Artificial Sequence
  ELANE RNA Guide
ugcccaggcggcgucccuga

SEQ ID NO: 16345 - RNA, 20 nt, Artificial Sequence
  ELANE RNA Guide
ugcgggcucagggacgccgc

SEQ ID NO: 16346 - RNA, 20 nt, Artificial Sequence
  ELANE RNA Guide
uggcccagcugcgggcucag

SEQ ID NO: 16347 - RNA, 21 nt, Artificial Sequence
  ELANE RNA Guide
aacgugcagguggcccagcug

SEQ ID NO: 16348 - RNA, 21 nt, Artificial Sequence
  ELANE RNA Guide
acgugcagguggcccagcugc

SEQ ID NO: 16349 - RNA, 21 nt, Artificial Sequence
  ELANE RNA Guide
agcccgcagcugggccaccug

SEQ ID NO: 16350 - RNA, 21 nt, Artificial Sequence
  ELANE RNA Guide
agcugcgggcucagggacgcc

SEQ ID NO: 16351 - RNA, 21 nt, Artificial Sequence
  ELANE RNA Guide
agguggcccagcugcgggcuc

SEQ ID NO: 16352 - RNA, 21 nt, Artificial Sequence
  ELANE RNA Guide
caacgugcagguggcccagcu

SEQ ID NO: 16353 - RNA, 21 nt, Artificial Sequence
  ELANE RNA Guide
cagcugcgggcucagggacgc

SEQ ID NO: 16354 - RNA, 21 nt, Artificial Sequence
  ELANE RNA Guide
cagguggcccagcugcgggcu

SEQ ID NO: 16355 - RNA, 21 nt, Artificial Sequence
  ELANE RNA Guide
ccaacgugcagguggcccagc

SEQ ID NO: 16356 - RNA, 21 nt, Artificial Sequence
  ELANE RNA Guide
ccagcugcgggcucagggacg

SEQ ID NO: 16357 - RNA, 21 nt, Artificial Sequence
  ELANE RNA Guide
cccagcugcgggcucagggac

SEQ ID NO: 16358 - RNA, 21 nt, Artificial Sequence
  ELANE RNA Guide
cccgcagcugggccaccugca

SEQ ID NO: 16359 - RNA, 21 nt, Artificial Sequence
  ELANE RNA Guide
ccgcagcugggccaccugcac

SEQ ID NO: 16360 - RNA, 21 nt, Artificial Sequence
  ELANE RNA Guide
ccugagcccgcagcugggcca

SEQ ID NO: 16361 - RNA, 21 nt, Artificial Sequence
  ELANE RNA Guide
cgucccugagcccgcagcugg

SEQ ID NO: 16362 - RNA, 21 nt, Artificial Sequence
  ELANE RNA Guide
cgugcagguggcccagcugcg

SEQ ID NO: 16363 - RNA, 21 nt, Artificial Sequence
  ELANE RNA Guide
cugagcccgcagcugggccac

SEQ ID NO: 16364 - RNA, 21 nt, Artificial Sequence
  ELANE RNA Guide
gagcccgcagcugggccaccu

SEQ ID NO: 16365 - RNA, 21 nt, Artificial Sequence
  ELANE RNA Guide
gcccagcugcgggcucaggga

SEQ ID NO: 16366 - RNA, 21 nt, Artificial Sequence
  ELANE RNA Guide
gcgucccugagcccgcagcug

SEQ ID NO: 16367 - RNA, 21 nt, Artificial Sequence
  ELANE RNA Guide
ggcgucccugagcccgcagcu

SEQ ID NO: 16368 - RNA, 21 nt, Artificial Sequence
  ELANE RNA Guide
gguggcccagcugcgggcuca

SEQ ID NO: 16369 - RNA, 21 nt, Artificial Sequence
  ELANE RNA Guide
gucccugagcccgcagcuggg

SEQ ID NO: 16370 - RNA, 21 nt, Artificial Sequence
  ELANE RNA Guide
gugcagguggcccagcugcgg

SEQ ID NO: 16371 - RNA, 21 nt, Artificial Sequence
  ELANE RNA Guide
guggcccagcugcgggcucag

SEQ ID NO: 16372 - RNA, 21 nt, Artificial Sequence
  ELANE RNA Guide
ucccugagcccgcagcugggc

SEQ ID NO: 16373 - RNA, 21 nt, Artificial Sequence
  ELANE RNA Guide
ugagcccgcagcugggccacc

SEQ ID NO: 16374 - RNA, 21 nt, Artificial Sequence
  ELANE RNA Guide
ugcagguggcccagcugcggg

SEQ ID NO: 16375 - RNA, 21 nt, Artificial Sequence
  ELANE RNA Guide
ugcccaggcggcgucccugag

SEQ ID NO: 16376 - RNA, 21 nt, Artificial Sequence
  ELANE RNA Guide
uggcccagcugcgggcucagg

SEQ ID NO: 16377 - RNA, 21 nt, Artificial Sequence
  ELANE RNA Guide
uugcccaggcggcgucccuga

SEQ ID NO: 16378 - RNA, 22 nt, Artificial Sequence
  ELANE RNA Guide
aacgugcagguggcccagcugc

SEQ ID NO: 16379 - RNA, 22 nt, Artificial Sequence
  ELANE RNA Guide
acgugcagguggcccagcugcg

SEQ ID NO: 16380 - RNA, 22 nt, Artificial Sequence
  ELANE RNA Guide
agcccgcagcugggccaccugc

SEQ ID NO: 16381 - RNA, 22 nt, Artificial Sequence
  ELANE RNA Guide
agcugcgggcucagggacgccg

SEQ ID NO: 16382 - RNA, 22 nt, Artificial Sequence
  ELANE RNA Guide
aggcggcgucccugagcccgca

SEQ ID NO: 16383 - RNA, 22 nt, Artificial Sequence
  ELANE RNA Guide
agguggcccagcugcgggcuca

SEQ ID NO: 16384 - RNA, 22 nt, Artificial Sequence
  ELANE RNA Guide
caacgugcagguggcccagcug

SEQ ID NO: 16385 - RNA, 22 nt, Artificial Sequence
  ELANE RNA Guide
cagcugcgggcucagggacgcc

SEQ ID NO: 16386 - RNA, 22 nt, Artificial Sequence
  ELANE RNA Guide
cagguggcccagcugcgggcuc

SEQ ID NO: 16387 - RNA, 22 nt, Artificial Sequence
  ELANE RNA Guide
ccaacgugcagguggcccagcu

SEQ ID NO: 16388 - RNA, 22 nt, Artificial Sequence
  ELANE RNA Guide
ccagcugcgggcucagggacgc

SEQ ID NO: 16389 - RNA, 22 nt, Artificial Sequence
  ELANE RNA Guide
cccagcugcgggcucagggacg

SEQ ID NO: 16390 - RNA, 22 nt, Artificial Sequence
  ELANE RNA Guide
cccgcagcugggccaccugcac

SEQ ID NO: 16391 - RNA, 22 nt, Artificial Sequence
  ELANE RNA Guide
cccugagcccgcagcugggcca

SEQ ID NO: 16392 - RNA, 22 nt, Artificial Sequence
  ELANE RNA Guide
ccgcagcugggccaccugcacg

SEQ ID NO: 16393 - RNA, 22 nt, Artificial Sequence
  ELANE RNA Guide
ccugagcccgcagcugggccac

SEQ ID NO: 16394 - RNA, 22 nt, Artificial Sequence
  ELANE RNA Guide
cggcgucccugagcccgcagcu

SEQ ID NO: 16395 - RNA, 22 nt, Artificial Sequence
  ELANE RNA Guide
cgucccugagcccgcagcuggg

SEQ ID NO: 16396 - RNA, 22 nt, Artificial Sequence
  ELANE RNA Guide
cgugcagguggcccagcugcgg

SEQ ID NO: 16397 - RNA, 22 nt, Artificial Sequence
  ELANE RNA Guide
cugagcccgcagcugggccacc

SEQ ID NO: 16398 - RNA, 22 nt, Artificial Sequence
  ELANE RNA Guide
gagcccgcagcugggccaccug

SEQ ID NO: 16399 - RNA, 22 nt, Artificial Sequence
  ELANE RNA Guide
gcagguggcccagcugcgggcu

SEQ ID NO: 16400 - RNA, 22 nt, Artificial Sequence
  ELANE RNA Guide
gccaacgugcagguggcccagc

SEQ ID NO: 16401 - RNA, 22 nt, Artificial Sequence
  ELANE RNA Guide
gcccagcugcgggcucagggac

SEQ ID NO: 16402 - RNA, 22 nt, Artificial Sequence
  ELANE RNA Guide
gcccgcagcugggccaccugca

SEQ ID NO: 16403 - RNA, 22 nt, Artificial Sequence
  ELANE RNA Guide
gcgucccugagcccgcagcugg

SEQ ID NO: 16404 - RNA, 22 nt, Artificial Sequence
  ELANE RNA Guide
ggcccagcugcgggcucaggga

SEQ ID NO: 16405 - RNA, 22 nt, Artificial Sequence
  ELANE RNA Guide
ggcgucccugagcccgcagcug

SEQ ID NO: 16406 - RNA, 22 nt, Artificial Sequence
  ELANE RNA Guide
gguggcccagcugcgggcucag

SEQ ID NO: 16407 - RNA, 22 nt, Artificial Sequence
  ELANE RNA Guide
gucccugagcccgcagcugggc

SEQ ID NO: 16408 - RNA, 22 nt, Artificial Sequence
  ELANE RNA Guide
gugcagguggcccagcugcggg

SEQ ID NO: 16409 - RNA, 22 nt, Artificial Sequence
  ELANE RNA Guide
guggcccagcugcgggcucagg

SEQ ID NO: 16410 - RNA, 22 nt, Artificial Sequence
  ELANE RNA Guide
guugcccaggcggcgucccuga

SEQ ID NO: 16411 - RNA, 22 nt, Artificial Sequence
  ELANE RNA Guide
ucccugagcccgcagcugggcc

SEQ ID NO: 16412 - RNA, 22 nt, Artificial Sequence
  ELANE RNA Guide
ugagcccgcagcugggccaccu

SEQ ID NO: 16413 - RNA, 22 nt, Artificial Sequence
  ELANE RNA Guide
ugcagguggcccagcugcgggc

SEQ ID NO: 16414 - RNA, 22 nt, Artificial Sequence
  ELANE RNA Guide
ugcccaggcggcgucccugagc

SEQ ID NO: 16415 - RNA, 22 nt, Artificial Sequence
  ELANE RNA Guide
ugcgggcucagggacgccgccu

SEQ ID NO: 16416 - RNA, 22 nt, Artificial Sequence
  ELANE RNA Guide
uggcccagcugcgggcucaggg

SEQ ID NO: 16417 - RNA, 22 nt, Artificial Sequence
  ELANE RNA Guide
uugcccaggcggcgucccugag

SEQ ID NO: 16418 - RNA, 20 nt, Artificial Sequence
  ELANE RNA Guide
agccagcagcugggccaccu

SEQ ID NO: 16419 - RNA, 20 nt, Artificial Sequence
  ELANE RNA Guide
agcugcuggcucagggacgc

SEQ ID NO: 16420 - RNA, 20 nt, Artificial Sequence
  ELANE RNA Guide
aggcggcgucccugagccag

SEQ ID NO: 16421 - RNA, 20 nt, Artificial Sequence
  ELANE RNA Guide
agguggcccagcugcuggcu

SEQ ID NO: 16422 - RNA, 20 nt, Artificial Sequence
  ELANE RNA Guide
cagcagcugggccaccugca

SEQ ID NO: 16423 - RNA, 20 nt, Artificial Sequence
  ELANE RNA Guide
cagcugcuggcucagggacg

SEQ ID NO: 16424 - RNA, 20 nt, Artificial Sequence
  ELANE RNA Guide
caggcggcgucccugagcca

SEQ ID NO: 16425 - RNA, 20 nt, Artificial Sequence
  ELANE RNA Guide
cagguggcccagcugcuggc

SEQ ID NO: 16426 - RNA, 20 nt, Artificial Sequence
  ELANE RNA Guide
ccagcagcugggccaccugc

SEQ ID NO: 16427 - RNA, 20 nt, Artificial Sequence
  ELANE RNA Guide
ccagcugcuggcucagggac

SEQ ID NO: 16428 - RNA, 20 nt, Artificial Sequence
  ELANE RNA Guide
cccagcugcuggcucaggga

SEQ ID NO: 16429 - RNA, 20 nt, Artificial Sequence
  ELANE RNA Guide
cccugagccagcagcugggc

SEQ ID NO: 16430 - RNA, 20 nt, Artificial Sequence
  ELANE RNA Guide
ccugagccagcagcugggcc

SEQ ID NO: 16431 - RNA, 20 nt, Artificial Sequence
  ELANE RNA Guide
cggcgucccugagccagcag

SEQ ID NO: 16432 - RNA, 20 nt, Artificial Sequence
  ELANE RNA Guide
cgucccugagccagcagcug

SEQ ID NO: 16433 - RNA, 20 nt, Artificial Sequence
  ELANE RNA Guide
cugagccagcagcugggcca

SEQ ID NO: 16434 - RNA, 20 nt, Artificial Sequence
  ELANE RNA Guide
cugcuggcucagggacgccg

SEQ ID NO: 16435 - RNA, 20 nt, Artificial Sequence
  ELANE RNA Guide
cuggcucagggacgccgccu

SEQ ID NO: 16436 - RNA, 20 nt, Artificial Sequence
  ELANE RNA Guide
gagccagcagcugggccacc

SEQ ID NO: 16437 - RNA, 20 nt, Artificial Sequence
  ELANE RNA Guide
gcagguggcccagcugcugg

SEQ ID NO: 16438 - RNA, 20 nt, Artificial Sequence
  ELANE RNA Guide
gccagcagcugggccaccug

SEQ ID NO: 16439 - RNA, 20 nt, Artificial Sequence
  ELANE RNA Guide
gcccagcugcuggcucaggg

SEQ ID NO: 16440 - RNA, 20 nt, Artificial Sequence
  ELANE RNA Guide
gcggcgucccugagccagca

SEQ ID NO: 16441 - RNA, 20 nt, Artificial Sequence
  ELANE RNA Guide
gcgucccugagccagcagcu

SEQ ID NO: 16442 - RNA, 20 nt, Artificial Sequence
  ELANE RNA Guide
gcugcuggcucagggacgcc

SEQ ID NO: 16443 - RNA, 20 nt, Artificial Sequence
  ELANE RNA Guide
gcuggcucagggacgccgcc

SEQ ID NO: 16444 - RNA, 20 nt, Artificial Sequence
  ELANE RNA Guide
ggcccagcugcuggcucagg

SEQ ID NO: 16445 - RNA, 20 nt, Artificial Sequence
  ELANE RNA Guide
ggcggcgucccugagccagc

SEQ ID NO: 16446 - RNA, 20 nt, Artificial Sequence
  ELANE RNA Guide
ggcgucccugagccagcagc

SEQ ID NO: 16447 - RNA, 20 nt, Artificial Sequence
  ELANE RNA Guide
gguggcccagcugcuggcuc

SEQ ID NO: 16448 - RNA, 20 nt, Artificial Sequence
  ELANE RNA Guide
gucccugagccagcagcugg

SEQ ID NO: 16449 - RNA, 20 nt, Artificial Sequence
  ELANE RNA Guide
gugcagguggcccagcugcu

SEQ ID NO: 16450 - RNA, 20 nt, Artificial Sequence
  ELANE RNA Guide
guggcccagcugcuggcuca

SEQ ID NO: 16451 - RNA, 20 nt, Artificial Sequence
  ELANE RNA Guide
ucccugagccagcagcuggg

SEQ ID NO: 16452 - RNA, 20 nt, Artificial Sequence
  ELANE RNA Guide
ugagccagcagcugggccac

SEQ ID NO: 16453 - RNA, 20 nt, Artificial Sequence
  ELANE RNA Guide
ugcagguggcccagcugcug

SEQ ID NO: 16454 - RNA, 20 nt, Artificial Sequence
  ELANE RNA Guide
ugcuggcucagggacgccgc

SEQ ID NO: 16455 - RNA, 20 nt, Artificial Sequence
  ELANE RNA Guide
uggcccagcugcuggcucag

SEQ ID NO: 16456 - RNA, 21 nt, Artificial Sequence
  ELANE RNA Guide
agccagcagcugggccaccug

SEQ ID NO: 16457 - RNA, 21 nt, Artificial Sequence
  ELANE RNA Guide
agcugcuggcucagggacgcc

SEQ ID NO: 16458 - RNA, 21 nt, Artificial Sequence
  ELANE RNA Guide
aggcggcgucccugagccagc

SEQ ID NO: 16459 - RNA, 21 nt, Artificial Sequence
  ELANE RNA Guide
agguggcccagcugcuggcuc

SEQ ID NO: 16460 - RNA, 21 nt, Artificial Sequence
  ELANE RNA Guide
cagcagcugggccaccugcac

SEQ ID NO: 16461 - RNA, 21 nt, Artificial Sequence
  ELANE RNA Guide
cagcugcuggcucagggacgc

SEQ ID NO: 16462 - RNA, 21 nt, Artificial Sequence
  ELANE RNA Guide
caggcggcgucccugagccag

SEQ ID NO: 16463 - RNA, 21 nt, Artificial Sequence
  ELANE RNA Guide
cagguggcccagcugcuggcu

SEQ ID NO: 16464 - RNA, 21 nt, Artificial Sequence
  ELANE RNA Guide
ccagcagcugggccaccugca

SEQ ID NO: 16465 - RNA, 21 nt, Artificial Sequence
  ELANE RNA Guide
ccagcugcuggcucagggacg

SEQ ID NO: 16466 - RNA, 21 nt, Artificial Sequence
  ELANE RNA Guide
ccaggcggcgucccugagcca

SEQ ID NO: 16467 - RNA, 21 nt, Artificial Sequence
  ELANE RNA Guide
cccagcugcuggcucagggac

SEQ ID NO: 16468 - RNA, 21 nt, Artificial Sequence
  ELANE RNA Guide
cccugagccagcagcugggcc

SEQ ID NO: 16469 - RNA, 21 nt, Artificial Sequence
  ELANE RNA Guide
ccugagccagcagcugggcca

SEQ ID NO: 16470 - RNA, 21 nt, Artificial Sequence
  ELANE RNA Guide
cggcgucccugagccagcagc

SEQ ID NO: 16471 - RNA, 21 nt, Artificial Sequence
  ELANE RNA Guide
cgucccugagccagcagcugg

SEQ ID NO: 16472 - RNA, 21 nt, Artificial Sequence
  ELANE RNA Guide
cgugcagguggcccagcugcu

SEQ ID NO: 16473 - RNA, 21 nt, Artificial Sequence
  ELANE RNA Guide
cugagccagcagcugggccac

SEQ ID NO: 16474 - RNA, 21 nt, Artificial Sequence
  ELANE RNA Guide
cugcuggcucagggacgccgc

SEQ ID NO: 16475 - RNA, 21 nt, Artificial Sequence
  ELANE RNA Guide
cuggcucagggacgccgccug

SEQ ID NO: 16476 - RNA, 21 nt, Artificial Sequence
  ELANE RNA Guide
gagccagcagcugggccaccu

SEQ ID NO: 16477 - RNA, 21 nt, Artificial Sequence
  ELANE RNA Guide
gcagguggcccagcugcuggc

SEQ ID NO: 16478 - RNA, 21 nt, Artificial Sequence
  ELANE RNA Guide
gccagcagcugggccaccugc

SEQ ID NO: 16479 - RNA, 21 nt, Artificial Sequence
  ELANE RNA Guide
gcccagcugcuggcucaggga

SEQ ID NO: 16480 - RNA, 21 nt, Artificial Sequence
  ELANE RNA Guide
gcggcgucccugagccagcag

SEQ ID NO: 16481 - RNA, 21 nt, Artificial Sequence
  ELANE RNA Guide
gcgucccugagccagcagcug

SEQ ID NO: 16482 - RNA, 21 nt, Artificial Sequence
  ELANE RNA Guide
gcugcuggcucagggacgccg

SEQ ID NO: 16483 - RNA, 21 nt, Artificial Sequence
  ELANE RNA Guide
gcuggcucagggacgccgccu

SEQ ID NO: 16484 - RNA, 21 nt, Artificial Sequence
  ELANE RNA Guide
ggcccagcugcuggcucaggg

SEQ ID NO: 16485 - RNA, 21 nt, Artificial Sequence
  ELANE RNA Guide
ggcggcgucccugagccagca

SEQ ID NO: 16486 - RNA, 21 nt, Artificial Sequence
  ELANE RNA Guide
ggcgucccugagccagcagcu

SEQ ID NO: 16487 - RNA, 21 nt, Artificial Sequence
  ELANE RNA Guide
gguggcccagcugcuggcuca

SEQ ID NO: 16488 - RNA, 21 nt, Artificial Sequence
  ELANE RNA Guide
gucccugagccagcagcuggg

SEQ ID NO: 16489 - RNA, 21 nt, Artificial Sequence
  ELANE RNA Guide
gugcagguggcccagcugcug

SEQ ID NO: 16490 - RNA, 21 nt, Artificial Sequence
  ELANE RNA Guide
guggcccagcugcuggcucag

SEQ ID NO: 16491 - RNA, 21 nt, Artificial Sequence
  ELANE RNA Guide
ucccugagccagcagcugggc

SEQ ID NO: 16492 - RNA, 21 nt, Artificial Sequence
  ELANE RNA Guide
ugagccagcagcugggccacc

SEQ ID NO: 16493 - RNA, 21 nt, Artificial Sequence
  ELANE RNA Guide
ugcagguggcccagcugcugg

SEQ ID NO: 16494 - RNA, 21 nt, Artificial Sequence
  ELANE RNA Guide
ugcuggcucagggacgccgcc

SEQ ID NO: 16495 - RNA, 21 nt, Artificial Sequence
  ELANE RNA Guide
uggcccagcugcuggcucagg

SEQ ID NO: 16496 - RNA, 22 nt, Artificial Sequence
  ELANE RNA Guide
acgugcagguggcccagcugcu

SEQ ID NO: 16497 - RNA, 22 nt, Artificial Sequence
  ELANE RNA Guide
agccagcagcugggccaccugc

SEQ ID NO: 16498 - RNA, 22 nt, Artificial Sequence
  ELANE RNA Guide
agcugcuggcucagggacgccg

SEQ ID NO: 16499 - RNA, 22 nt, Artificial Sequence
  ELANE RNA Guide
aggcggcgucccugagccagca

SEQ ID NO: 16500 - RNA, 22 nt, Artificial Sequence
  ELANE RNA Guide
agguggcccagcugcuggcuca

SEQ ID NO: 16501 - RNA, 22 nt, Artificial Sequence
  ELANE RNA Guide
cagcagcugggccaccugcacg

SEQ ID NO: 16502 - RNA, 22 nt, Artificial Sequence
  ELANE RNA Guide
cagcugcuggcucagggacgcc

SEQ ID NO: 16503 - RNA, 22 nt, Artificial Sequence
  ELANE RNA Guide
caggcggcgucccugagccagc

SEQ ID NO: 16504 - RNA, 22 nt, Artificial Sequence
  ELANE RNA Guide
cagguggcccagcugcuggcuc

SEQ ID NO: 16505 - RNA, 22 nt, Artificial Sequence
  ELANE RNA Guide
ccagcagcugggccaccugcac

SEQ ID NO: 16506 - RNA, 22 nt, Artificial Sequence
  ELANE RNA Guide
ccagcugcuggcucagggacgc

SEQ ID NO: 16507 - RNA, 22 nt, Artificial Sequence
  ELANE RNA Guide
ccaggcggcgucccugagccag

SEQ ID NO: 16508 - RNA, 22 nt, Artificial Sequence
  ELANE RNA Guide
cccagcugcuggcucagggacg

SEQ ID NO: 16509 - RNA, 22 nt, Artificial Sequence
  ELANE RNA Guide
cccaggcggcgucccugagcca

SEQ ID NO: 16510 - RNA, 22 nt, Artificial Sequence
  ELANE RNA Guide
cccugagccagcagcugggcca

SEQ ID NO: 16511 - RNA, 22 nt, Artificial Sequence
  ELANE RNA Guide
ccugagccagcagcugggccac

SEQ ID NO: 16512 - RNA, 22 nt, Artificial Sequence
  ELANE RNA Guide
cggcgucccugagccagcagcu

SEQ ID NO: 16513 - RNA, 22 nt, Artificial Sequence
  ELANE RNA Guide
cgucccugagccagcagcuggg

SEQ ID NO: 16514 - RNA, 22 nt, Artificial Sequence
  ELANE RNA Guide
cgugcagguggcccagcugcug

SEQ ID NO: 16515 - RNA, 22 nt, Artificial Sequence
  ELANE RNA Guide
cugagccagcagcugggccacc

SEQ ID NO: 16516 - RNA, 22 nt, Artificial Sequence
  ELANE RNA Guide
cugcuggcucagggacgccgcc

SEQ ID NO: 16517 - RNA, 22 nt, Artificial Sequence
  ELANE RNA Guide
cuggcucagggacgccgccugg

SEQ ID NO: 16518 - RNA, 22 nt, Artificial Sequence
  ELANE RNA Guide
gagccagcagcugggccaccug

SEQ ID NO: 16519 - RNA, 22 nt, Artificial Sequence
  ELANE RNA Guide
gcagguggcccagcugcuggcu

SEQ ID NO: 16520 - RNA, 22 nt, Artificial Sequence
  ELANE RNA Guide
gccagcagcugggccaccugca

SEQ ID NO: 16521 - RNA, 22 nt, Artificial Sequence
  ELANE RNA Guide
gcccagcugcuggcucagggac

SEQ ID NO: 16522 - RNA, 22 nt, Artificial Sequence
  ELANE RNA Guide
gcggcgucccugagccagcagc

SEQ ID NO: 16523 - RNA, 22 nt, Artificial Sequence
  ELANE RNA Guide
gcgucccugagccagcagcugg

SEQ ID NO: 16524 - RNA, 22 nt, Artificial Sequence
  ELANE RNA Guide
gcugcuggcucagggacgccgc

SEQ ID NO: 16525 - RNA, 22 nt, Artificial Sequence
  ELANE RNA Guide
gcuggcucagggacgccgccug

SEQ ID NO: 16526 - RNA, 22 nt, Artificial Sequence
  ELANE RNA Guide
ggcccagcugcuggcucaggga

SEQ ID NO: 16527 - RNA, 22 nt, Artificial Sequence
  ELANE RNA Guide
ggcggcgucccugagccagcag

SEQ ID NO: 16528 - RNA, 22 nt, Artificial Sequence
  ELANE RNA Guide
ggcgucccugagccagcagcug

SEQ ID NO: 16529 - RNA, 22 nt, Artificial Sequence
  ELANE RNA Guide
gguggcccagcugcuggcucag

SEQ ID NO: 16530 - RNA, 22 nt, Artificial Sequence
  ELANE RNA Guide
gucccugagccagcagcugggc

SEQ ID NO: 16531 - RNA, 22 nt, Artificial Sequence
  ELANE RNA Guide
gugcagguggcccagcugcugg

SEQ ID NO: 16532 - RNA, 22 nt, Artificial Sequence
  ELANE RNA Guide
guggcccagcugcuggcucagg

SEQ ID NO: 16533 - RNA, 22 nt, Artificial Sequence
  ELANE RNA Guide
ucccugagccagcagcugggcc

SEQ ID NO: 16534 - RNA, 22 nt, Artificial Sequence
  ELANE RNA Guide
ugagccagcagcugggccaccu

SEQ ID NO: 16535 - RNA, 22 nt, Artificial Sequence
  ELANE RNA Guide
ugcagguggcccagcugcuggc

SEQ ID NO: 16536 - RNA, 22 nt, Artificial Sequence
  ELANE RNA Guide
ugcuggcucagggacgccgccu

SEQ ID NO: 16537 - RNA, 22 nt, Artificial Sequence
  ELANE RNA Guide
uggcccagcugcuggcucaggg

SEQ ID NO: 16538 - RNA, 20 nt, Artificial Sequence
  ELANE RNA Guide
aaccggcagcugggccaccu

SEQ ID NO: 16539 - RNA, 20 nt, Artificial Sequence
  ELANE RNA Guide
agcugccgguucagggacgc

SEQ ID NO: 16540 - RNA, 20 nt, Artificial Sequence
  ELANE RNA Guide
aggcggcgucccugaaccgg

SEQ ID NO: 16541 - RNA, 20 nt, Artificial Sequence
  ELANE RNA Guide
agguggcccagcugccgguu

SEQ ID NO: 16542 - RNA, 20 nt, Artificial Sequence
  ELANE RNA Guide
cagcugccgguucagggacg

SEQ ID NO: 16543 - RNA, 20 nt, Artificial Sequence
  ELANE RNA Guide
caggcggcgucccugaaccg

SEQ ID NO: 16544 - RNA, 20 nt, Artificial Sequence
  ELANE RNA Guide
cagguggcccagcugccggu

SEQ ID NO: 16545 - RNA, 20 nt, Artificial Sequence
  ELANE RNA Guide
ccagcugccgguucagggac

SEQ ID NO: 16546 - RNA, 20 nt, Artificial Sequence
  ELANE RNA Guide
ccaggcggcgucccugaacc

SEQ ID NO: 16547 - RNA, 20 nt, Artificial Sequence
  ELANE RNA Guide
cccagcugccgguucaggga

SEQ ID NO: 16548 - RNA, 20 nt, Artificial Sequence
  ELANE RNA Guide
cccaggcggcgucccugaac

SEQ ID NO: 16549 - RNA, 20 nt, Artificial Sequence
  ELANE RNA Guide
cccugaaccggcagcugggc

SEQ ID NO: 16550 - RNA, 20 nt, Artificial Sequence
  ELANE RNA Guide
ccgguucagggacgccgccu

SEQ ID NO: 16551 - RNA, 20 nt, Artificial Sequence
  ELANE RNA Guide
ccugaaccggcagcugggcc

SEQ ID NO: 16552 - RNA, 20 nt, Artificial Sequence
  ELANE RNA Guide
cggcgucccugaaccggcag

SEQ ID NO: 16553 - RNA, 20 nt, Artificial Sequence
  ELANE RNA Guide
cgguucagggacgccgccug

SEQ ID NO: 16554 - RNA, 20 nt, Artificial Sequence
  ELANE RNA Guide
cgucccugaaccggcagcug

SEQ ID NO: 16555 - RNA, 20 nt, Artificial Sequence
  ELANE RNA Guide
cguugcccaggcggcguccc

SEQ ID NO: 16556 - RNA, 20 nt, Artificial Sequence
  ELANE RNA Guide
cugaaccggcagcugggcca

SEQ ID NO: 16557 - RNA, 20 nt, Artificial Sequence
  ELANE RNA Guide
cugccgguucagggacgccg

SEQ ID NO: 16558 - RNA, 20 nt, Artificial Sequence
  ELANE RNA Guide
gaaccggcagcugggccacc

SEQ ID NO: 16559 - RNA, 20 nt, Artificial Sequence
  ELANE RNA Guide
gcagguggcccagcugccgg

SEQ ID NO: 16560 - RNA, 20 nt, Artificial Sequence
  ELANE RNA Guide
gcccagcugccgguucaggg

SEQ ID NO: 16561 - RNA, 20 nt, Artificial Sequence
  ELANE RNA Guide
gcccaggcggcgucccugaa

SEQ ID NO: 16562 - RNA, 20 nt, Artificial Sequence
  ELANE RNA Guide
gccgguucagggacgccgcc

SEQ ID NO: 16563 - RNA, 20 nt, Artificial Sequence
  ELANE RNA Guide
gcggcgucccugaaccggca

SEQ ID NO: 16564 - RNA, 20 nt, Artificial Sequence
  ELANE RNA Guide
gcgucccugaaccggcagcu

SEQ ID NO: 16565 - RNA, 20 nt, Artificial Sequence
  ELANE RNA Guide
gcugccgguucagggacgcc

SEQ ID NO: 16566 - RNA, 20 nt, Artificial Sequence
  ELANE RNA Guide
ggcccagcugccgguucagg

SEQ ID NO: 16567 - RNA, 20 nt, Artificial Sequence
  ELANE RNA Guide
ggcggcgucccugaaccggc

SEQ ID NO: 16568 - RNA, 20 nt, Artificial Sequence
  ELANE RNA Guide
ggcgucccugaaccggcagc

SEQ ID NO: 16569 - RNA, 20 nt, Artificial Sequence
  ELANE RNA Guide
gguggcccagcugccgguuc

SEQ ID NO: 16570 - RNA, 20 nt, Artificial Sequence
  ELANE RNA Guide
gguucagggacgccgccugg

SEQ ID NO: 16571 - RNA, 20 nt, Artificial Sequence
  ELANE RNA Guide
gucccugaaccggcagcugg

SEQ ID NO: 16572 - RNA, 20 nt, Artificial Sequence
  ELANE RNA Guide
gugcagguggcccagcugcc

SEQ ID NO: 16573 - RNA, 20 nt, Artificial Sequence
  ELANE RNA Guide
guggcccagcugccgguuca

SEQ ID NO: 16574 - RNA, 20 nt, Artificial Sequence
  ELANE RNA Guide
guucagggacgccgccuggg

SEQ ID NO: 16575 - RNA, 20 nt, Artificial Sequence
  ELANE RNA Guide
guugcccaggcggcgucccu

SEQ ID NO: 16576 - RNA, 20 nt, Artificial Sequence
  ELANE RNA Guide
ucccugaaccggcagcuggg

SEQ ID NO: 16577 - RNA, 20 nt, Artificial Sequence
  ELANE RNA Guide
ugaaccggcagcugggccac

SEQ ID NO: 16578 - RNA, 20 nt, Artificial Sequence
  ELANE RNA Guide
ugcagguggcccagcugccg

SEQ ID NO: 16579 - RNA, 20 nt, Artificial Sequence
  ELANE RNA Guide
ugccgguucagggacgccgc

SEQ ID NO: 16580 - RNA, 20 nt, Artificial Sequence
  ELANE RNA Guide
uggcccagcugccgguucag

SEQ ID NO: 16581 - RNA, 20 nt, Artificial Sequence
  ELANE RNA Guide
uugcccaggcggcgucccug

SEQ ID NO: 16582 - RNA, 21 nt, Artificial Sequence
  ELANE RNA Guide
aaccggcagcugggccaccug

SEQ ID NO: 16583 - RNA, 21 nt, Artificial Sequence
  ELANE RNA Guide
agcugccgguucagggacgcc

SEQ ID NO: 16584 - RNA, 21 nt, Artificial Sequence
  ELANE RNA Guide
aggcggcgucccugaaccggc

SEQ ID NO: 16585 - RNA, 21 nt, Artificial Sequence
  ELANE RNA Guide
agguggcccagcugccgguuc

SEQ ID NO: 16586 - RNA, 21 nt, Artificial Sequence
  ELANE RNA Guide
cagcugccgguucagggacgc

SEQ ID NO: 16587 - RNA, 21 nt, Artificial Sequence
  ELANE RNA Guide
caggcggcgucccugaaccgg

SEQ ID NO: 16588 - RNA, 21 nt, Artificial Sequence
  ELANE RNA Guide
cagguggcccagcugccgguu

SEQ ID NO: 16589 - RNA, 21 nt, Artificial Sequence
  ELANE RNA Guide
ccagcugccgguucagggacg

SEQ ID NO: 16590 - RNA, 21 nt, Artificial Sequence
  ELANE RNA Guide
ccaggcggcgucccugaaccg

SEQ ID NO: 16591 - RNA, 21 nt, Artificial Sequence
  ELANE RNA Guide
cccagcugccgguucagggac

SEQ ID NO: 16592 - RNA, 21 nt, Artificial Sequence
  ELANE RNA Guide
cccaggcggcgucccugaacc

SEQ ID NO: 16593 - RNA, 21 nt, Artificial Sequence
  ELANE RNA Guide
cccugaaccggcagcugggcc

SEQ ID NO: 16594 - RNA, 21 nt, Artificial Sequence
  ELANE RNA Guide
ccgguucagggacgccgccug

SEQ ID NO: 16595 - RNA, 21 nt, Artificial Sequence
  ELANE RNA Guide
ccugaaccggcagcugggcca

SEQ ID NO: 16596 - RNA, 21 nt, Artificial Sequence
  ELANE RNA Guide
cggcgucccugaaccggcagc

SEQ ID NO: 16597 - RNA, 21 nt, Artificial Sequence
  ELANE RNA Guide
cgguucagggacgccgccugg

SEQ ID NO: 16598 - RNA, 21 nt, Artificial Sequence
  ELANE RNA Guide
cgucccugaaccggcagcugg

SEQ ID NO: 16599 - RNA, 21 nt, Artificial Sequence
  ELANE RNA Guide
cgugcagguggcccagcugcc

SEQ ID NO: 16600 - RNA, 21 nt, Artificial Sequence
  ELANE RNA Guide
cguugcccaggcggcgucccu

SEQ ID NO: 16601 - RNA, 21 nt, Artificial Sequence
  ELANE RNA Guide
cugaaccggcagcugggccac

SEQ ID NO: 16602 - RNA, 21 nt, Artificial Sequence
  ELANE RNA Guide
cugccgguucagggacgccgc

SEQ ID NO: 16603 - RNA, 21 nt, Artificial Sequence
  ELANE RNA Guide
gaaccggcagcugggccaccu

SEQ ID NO: 16604 - RNA, 21 nt, Artificial Sequence
  ELANE RNA Guide
gcagguggcccagcugccggu

SEQ ID NO: 16605 - RNA, 21 nt, Artificial Sequence
  ELANE RNA Guide
gcccagcugccgguucaggga

SEQ ID NO: 16606 - RNA, 21 nt, Artificial Sequence
  ELANE RNA Guide
gcccaggcggcgucccugaac

SEQ ID NO: 16607 - RNA, 21 nt, Artificial Sequence
  ELANE RNA Guide
gccgguucagggacgccgccu

SEQ ID NO: 16608 - RNA, 21 nt, Artificial Sequence
  ELANE RNA Guide
gcggcgucccugaaccggcag

SEQ ID NO: 16609 - RNA, 21 nt, Artificial Sequence
  ELANE RNA Guide
gcgucccugaaccggcagcug

SEQ ID NO: 16610 - RNA, 21 nt, Artificial Sequence
  ELANE RNA Guide
gcugccgguucagggacgccg

SEQ ID NO: 16611 - RNA, 21 nt, Artificial Sequence
  ELANE RNA Guide
ggcccagcugccgguucaggg

SEQ ID NO: 16612 - RNA, 21 nt, Artificial Sequence
  ELANE RNA Guide
ggcggcgucccugaaccggca

SEQ ID NO: 16613 - RNA, 21 nt, Artificial Sequence
  ELANE RNA Guide
ggcgucccugaaccggcagcu

SEQ ID NO: 16614 - RNA, 21 nt, Artificial Sequence
  ELANE RNA Guide
gguggcccagcugccgguuca

SEQ ID NO: 16615 - RNA, 21 nt, Artificial Sequence
  ELANE RNA Guide
gguucagggacgccgccuggg

SEQ ID NO: 16616 - RNA, 21 nt, Artificial Sequence
  ELANE RNA Guide
gucccugaaccggcagcuggg

SEQ ID NO: 16617 - RNA, 21 nt, Artificial Sequence
  ELANE RNA Guide
gugcagguggcccagcugccg

SEQ ID NO: 16618 - RNA, 21 nt, Artificial Sequence
  ELANE RNA Guide
guggcccagcugccgguucag

SEQ ID NO: 16619 - RNA, 21 nt, Artificial Sequence
  ELANE RNA Guide
guucagggacgccgccugggc

SEQ ID NO: 16620 - RNA, 21 nt, Artificial Sequence
  ELANE RNA Guide
guugcccaggcggcgucccug

SEQ ID NO: 16621 - RNA, 21 nt, Artificial Sequence
  ELANE RNA Guide
ucccugaaccggcagcugggc

SEQ ID NO: 16622 - RNA, 21 nt, Artificial Sequence
  ELANE RNA Guide
ugaaccggcagcugggccacc

SEQ ID NO: 16623 - RNA, 21 nt, Artificial Sequence
  ELANE RNA Guide
ugcagguggcccagcugccgg

SEQ ID NO: 16624 - RNA, 21 nt, Artificial Sequence
  ELANE RNA Guide
ugcccaggcggcgucccugaa

SEQ ID NO: 16625 - RNA, 21 nt, Artificial Sequence
  ELANE RNA Guide
ugccgguucagggacgccgcc

SEQ ID NO: 16626 - RNA, 21 nt, Artificial Sequence
  ELANE RNA Guide
uggcccagcugccgguucagg

SEQ ID NO: 16627 - RNA, 22 nt, Artificial Sequence
  ELANE RNA Guide
aaccggcagcugggccaccugc

SEQ ID NO: 16628 - RNA, 22 nt, Artificial Sequence
  ELANE RNA Guide
acgugcagguggcccagcugcc

SEQ ID NO: 16629 - RNA, 22 nt, Artificial Sequence
  ELANE RNA Guide
agcugccgguucagggacgccg

SEQ ID NO: 16630 - RNA, 22 nt, Artificial Sequence
  ELANE RNA Guide
aggcggcgucccugaaccggca

SEQ ID NO: 16631 - RNA, 22 nt, Artificial Sequence
  ELANE RNA Guide
agguggcccagcugccgguuca

SEQ ID NO: 16632 - RNA, 22 nt, Artificial Sequence
  ELANE RNA Guide
cagcugccgguucagggacgcc

SEQ ID NO: 16633 - RNA, 22 nt, Artificial Sequence
  ELANE RNA Guide
caggcggcgucccugaaccggc

SEQ ID NO: 16634 - RNA, 22 nt, Artificial Sequence
  ELANE RNA Guide
cagguggcccagcugccgguuc

SEQ ID NO: 16635 - RNA, 22 nt, Artificial Sequence
  ELANE RNA Guide
ccagcugccgguucagggacgc

SEQ ID NO: 16636 - RNA, 22 nt, Artificial Sequence
  ELANE RNA Guide
ccaggcggcgucccugaaccgg

SEQ ID NO: 16637 - RNA, 22 nt, Artificial Sequence
  ELANE RNA Guide
cccagcugccgguucagggacg

SEQ ID NO: 16638 - RNA, 22 nt, Artificial Sequence
  ELANE RNA Guide
cccaggcggcgucccugaaccg

SEQ ID NO: 16639 - RNA, 22 nt, Artificial Sequence
  ELANE RNA Guide
cccugaaccggcagcugggcca

SEQ ID NO: 16640 - RNA, 22 nt, Artificial Sequence
  ELANE RNA Guide
ccgguucagggacgccgccugg

SEQ ID NO: 16641 - RNA, 22 nt, Artificial Sequence
  ELANE RNA Guide
ccguugcccaggcggcgucccu

SEQ ID NO: 16642 - RNA, 22 nt, Artificial Sequence
  ELANE RNA Guide
ccugaaccggcagcugggccac

SEQ ID NO: 16643 - RNA, 22 nt, Artificial Sequence
  ELANE RNA Guide
cggcgucccugaaccggcagcu

SEQ ID NO: 16644 - RNA, 22 nt, Artificial Sequence
  ELANE RNA Guide
cgguucagggacgccgccuggg

SEQ ID NO: 16645 - RNA, 22 nt, Artificial Sequence
  ELANE RNA Guide
cgucccugaaccggcagcuggg

SEQ ID NO: 16646 - RNA, 22 nt, Artificial Sequence
  ELANE RNA Guide
cgugcagguggcccagcugccg

SEQ ID NO: 16647 - RNA, 22 nt, Artificial Sequence
  ELANE RNA Guide
cguugcccaggcggcgucccug

SEQ ID NO: 16648 - RNA, 22 nt, Artificial Sequence
  ELANE RNA Guide
cugaaccggcagcugggccacc

SEQ ID NO: 16649 - RNA, 22 nt, Artificial Sequence
  ELANE RNA Guide
cugccgguucagggacgccgcc

SEQ ID NO: 16650 - RNA, 22 nt, Artificial Sequence
  ELANE RNA Guide
gaaccggcagcugggccaccug

SEQ ID NO: 16651 - RNA, 22 nt, Artificial Sequence
  ELANE RNA Guide
gcagguggcccagcugccgguu

SEQ ID NO: 16652 - RNA, 22 nt, Artificial Sequence
  ELANE RNA Guide
gcccagcugccgguucagggac

SEQ ID NO: 16653 - RNA, 22 nt, Artificial Sequence
  ELANE RNA Guide
gcccaggcggcgucccugaacc

SEQ ID NO: 16654 - RNA, 22 nt, Artificial Sequence
  ELANE RNA Guide
gccgguucagggacgccgccug

SEQ ID NO: 16655 - RNA, 22 nt, Artificial Sequence
  ELANE RNA Guide
gcggcgucccugaaccggcagc

SEQ ID NO: 16656 - RNA, 22 nt, Artificial Sequence
  ELANE RNA Guide
gcgucccugaaccggcagcugg

SEQ ID NO: 16657 - RNA, 22 nt, Artificial Sequence
  ELANE RNA Guide
gcugccgguucagggacgccgc

SEQ ID NO: 16658 - RNA, 22 nt, Artificial Sequence
  ELANE RNA Guide
ggcccagcugccgguucaggga

SEQ ID NO: 16659 - RNA, 22 nt, Artificial Sequence
  ELANE RNA Guide
ggcggcgucccugaaccggcag

SEQ ID NO: 16660 - RNA, 22 nt, Artificial Sequence
  ELANE RNA Guide
ggcgucccugaaccggcagcug

SEQ ID NO: 16661 - RNA, 22 nt, Artificial Sequence
  ELANE RNA Guide
gguggcccagcugccgguucag

SEQ ID NO: 16662 - RNA, 22 nt, Artificial Sequence
  ELANE RNA Guide
gguucagggacgccgccugggc

SEQ ID NO: 16663 - RNA, 22 nt, Artificial Sequence
  ELANE RNA Guide
gucccugaaccggcagcugggc

SEQ ID NO: 16664 - RNA, 22 nt, Artificial Sequence
  ELANE RNA Guide
gugcagguggcccagcugccgg

SEQ ID NO: 16665 - RNA, 22 nt, Artificial Sequence
  ELANE RNA Guide
guggcccagcugccgguucagg

SEQ ID NO: 16666 - RNA, 22 nt, Artificial Sequence
  ELANE RNA Guide
guucagggacgccgccugggca

SEQ ID NO: 16667 - RNA, 22 nt, Artificial Sequence
  ELANE RNA Guide
ucccugaaccggcagcugggcc

SEQ ID NO: 16668 - RNA, 22 nt, Artificial Sequence
  ELANE RNA Guide
ugaaccggcagcugggccaccu

SEQ ID NO: 16669 - RNA, 22 nt, Artificial Sequence
  ELANE RNA Guide
ugcagguggcccagcugccggu

SEQ ID NO: 16670 - RNA, 22 nt, Artificial Sequence
  ELANE RNA Guide
ugcccaggcggcgucccugaac

SEQ ID NO: 16671 - RNA, 22 nt, Artificial Sequence
  ELANE RNA Guide
ugccgguucagggacgccgccu

SEQ ID NO: 16672 - RNA, 22 nt, Artificial Sequence
  ELANE RNA Guide
uggcccagcugccgguucaggg

SEQ ID NO: 16673 - RNA, 22 nt, Artificial Sequence
  ELANE RNA Guide
uugcccaggcggcgucccugaa

SEQ ID NO: 16674 - RNA, 20 nt, Artificial Sequence
  ELANE RNA Guide
accccguugcccaggcggca

SEQ ID NO: 16675 - RNA, 20 nt, Artificial Sequence
  ELANE RNA Guide
agcugccggcucagggaugc

SEQ ID NO: 16676 - RNA, 20 nt, Artificial Sequence
  ELANE RNA Guide
aggcggcaucccugagccgg

SEQ ID NO: 16677 - RNA, 20 nt, Artificial Sequence
  ELANE RNA Guide
agggaugccgccugggcaac

SEQ ID NO: 16678 - RNA, 20 nt, Artificial Sequence
  ELANE RNA Guide
augccgccugggcaacgggg

SEQ ID NO: 16679 - RNA, 20 nt, Artificial Sequence
  ELANE RNA Guide
caccccguugcccaggcggc

SEQ ID NO: 16680 - RNA, 20 nt, Artificial Sequence
  ELANE RNA Guide
cagcugccggcucagggaug

SEQ ID NO: 16681 - RNA, 20 nt, Artificial Sequence
  ELANE RNA Guide
caggcggcaucccugagccg

SEQ ID NO: 16682 - RNA, 20 nt, Artificial Sequence
  ELANE RNA Guide
cagggaugccgccugggcaa

SEQ ID NO: 16683 - RNA, 20 nt, Artificial Sequence
  ELANE RNA Guide
caucccugagccggcagcug

SEQ ID NO: 16684 - RNA, 20 nt, Artificial Sequence
  ELANE RNA Guide
ccagcugccggcucagggau

SEQ ID NO: 16685 - RNA, 20 nt, Artificial Sequence
  ELANE RNA Guide
ccaggcggcaucccugagcc

SEQ ID NO: 16686 - RNA, 20 nt, Artificial Sequence
  ELANE RNA Guide
cccagcugccggcucaggga

SEQ ID NO: 16687 - RNA, 20 nt, Artificial Sequence
  ELANE RNA Guide
cccaggcggcaucccugagc

SEQ ID NO: 16688 - RNA, 20 nt, Artificial Sequence
  ELANE RNA Guide
ccccguugcccaggcggcau

SEQ ID NO: 16689 - RNA, 20 nt, Artificial Sequence
  ELANE RNA Guide
cccguugcccaggcggcauc

SEQ ID NO: 16690 - RNA, 20 nt, Artificial Sequence
  ELANE RNA Guide
ccggcucagggaugccgccu

SEQ ID NO: 16691 - RNA, 20 nt, Artificial Sequence
  ELANE RNA Guide
ccguugcccaggcggcaucc

SEQ ID NO: 16692 - RNA, 20 nt, Artificial Sequence
  ELANE RNA Guide
cggcaucccugagccggcag

SEQ ID NO: 16693 - RNA, 20 nt, Artificial Sequence
  ELANE RNA Guide
cggcucagggaugccgccug

SEQ ID NO: 16694 - RNA, 20 nt, Artificial Sequence
  ELANE RNA Guide
cguugcccaggcggcauccc

SEQ ID NO: 16695 - RNA, 20 nt, Artificial Sequence
  ELANE RNA Guide
cucagggaugccgccugggc

SEQ ID NO: 16696 - RNA, 20 nt, Artificial Sequence
  ELANE RNA Guide
cugcaccccguugcccaggc

SEQ ID NO: 16697 - RNA, 20 nt, Artificial Sequence
  ELANE RNA Guide
cugccggcucagggaugccg

SEQ ID NO: 16698 - RNA, 20 nt, Artificial Sequence
  ELANE RNA Guide
gaugccgccugggcaacggg

SEQ ID NO: 16699 - RNA, 20 nt, Artificial Sequence
  ELANE RNA Guide
gcaccccguugcccaggcgg

SEQ ID NO: 16700 - RNA, 20 nt, Artificial Sequence
  ELANE RNA Guide
gcaucccugagccggcagcu

SEQ ID NO: 16701 - RNA, 20 nt, Artificial Sequence
  ELANE RNA Guide
gcccagcugccggcucaggg

SEQ ID NO: 16702 - RNA, 20 nt, Artificial Sequence
  ELANE RNA Guide
gcccaggcggcaucccugag

SEQ ID NO: 16703 - RNA, 20 nt, Artificial Sequence
  ELANE RNA Guide
gccggcucagggaugccgcc

SEQ ID NO: 16704 - RNA, 20 nt, Artificial Sequence
  ELANE RNA Guide
gcggcaucccugagccggca

SEQ ID NO: 16705 - RNA, 20 nt, Artificial Sequence
  ELANE RNA Guide
gcucagggaugccgccuggg

SEQ ID NO: 16706 - RNA, 20 nt, Artificial Sequence
  ELANE RNA Guide
gcugccggcucagggaugcc

SEQ ID NO: 16707 - RNA, 20 nt, Artificial Sequence
  ELANE RNA Guide
ggaugccgccugggcaacgg

SEQ ID NO: 16708 - RNA, 20 nt, Artificial Sequence
  ELANE RNA Guide
ggcaucccugagccggcagc

SEQ ID NO: 16709 - RNA, 20 nt, Artificial Sequence
  ELANE RNA Guide
ggcccagcugccggcucagg

SEQ ID NO: 16710 - RNA, 20 nt, Artificial Sequence
  ELANE RNA Guide
ggcggcaucccugagccggc

SEQ ID NO: 16711 - RNA, 20 nt, Artificial Sequence
  ELANE RNA Guide
ggcucagggaugccgccugg

SEQ ID NO: 16712 - RNA, 20 nt, Artificial Sequence
  ELANE RNA Guide
gggaugccgccugggcaacg

SEQ ID NO: 16713 - RNA, 20 nt, Artificial Sequence
  ELANE RNA Guide
guugcccaggcggcaucccu

SEQ ID NO: 16714 - RNA, 20 nt, Artificial Sequence
  ELANE RNA Guide
ucagggaugccgccugggca

SEQ ID NO: 16715 - RNA, 20 nt, Artificial Sequence
  ELANE RNA Guide
ugcaccccguugcccaggcg

SEQ ID NO: 16716 - RNA, 20 nt, Artificial Sequence
  ELANE RNA Guide
ugcccaggcggcaucccuga

SEQ ID NO: 16717 - RNA, 20 nt, Artificial Sequence
  ELANE RNA Guide
ugccggcucagggaugccgc

SEQ ID NO: 16718 - RNA, 20 nt, Artificial Sequence
  ELANE RNA Guide
uggcccagcugccggcucag

SEQ ID NO: 16719 - RNA, 20 nt, Artificial Sequence
  ELANE RNA Guide
uugcccaggcggcaucccug

SEQ ID NO: 16720 - RNA, 21 nt, Artificial Sequence
  ELANE RNA Guide
accccguugcccaggcggcau

SEQ ID NO: 16721 - RNA, 21 nt, Artificial Sequence
  ELANE RNA Guide
acugcaccccguugcccaggc

SEQ ID NO: 16722 - RNA, 21 nt, Artificial Sequence
  ELANE RNA Guide
agcugccggcucagggaugcc

SEQ ID NO: 16723 - RNA, 21 nt, Artificial Sequence
  ELANE RNA Guide
aggcggcaucccugagccggc

SEQ ID NO: 16724 - RNA, 21 nt, Artificial Sequence
  ELANE RNA Guide
agggaugccgccugggcaacg

SEQ ID NO: 16725 - RNA, 21 nt, Artificial Sequence
  ELANE RNA Guide
augccgccugggcaacggggu

SEQ ID NO: 16726 - RNA, 21 nt, Artificial Sequence
  ELANE RNA Guide
caccccguugcccaggcggca

SEQ ID NO: 16727 - RNA, 21 nt, Artificial Sequence
  ELANE RNA Guide
cagcugccggcucagggaugc

SEQ ID NO: 16728 - RNA, 21 nt, Artificial Sequence
  ELANE RNA Guide
caggcggcaucccugagccgg

SEQ ID NO: 16729 - RNA, 21 nt, Artificial Sequence
  ELANE RNA Guide
cagggaugccgccugggcaac

SEQ ID NO: 16730 - RNA, 21 nt, Artificial Sequence
  ELANE RNA Guide
caucccugagccggcagcugg

SEQ ID NO: 16731 - RNA, 21 nt, Artificial Sequence
  ELANE RNA Guide
ccagcugccggcucagggaug

SEQ ID NO: 16732 - RNA, 21 nt, Artificial Sequence
  ELANE RNA Guide
ccaggcggcaucccugagccg

SEQ ID NO: 16733 - RNA, 21 nt, Artificial Sequence
  ELANE RNA Guide
cccagcugccggcucagggau

SEQ ID NO: 16734 - RNA, 21 nt, Artificial Sequence
  ELANE RNA Guide
cccaggcggcaucccugagcc

SEQ ID NO: 16735 - RNA, 21 nt, Artificial Sequence
  ELANE RNA Guide
ccccguugcccaggcggcauc

SEQ ID NO: 16736 - RNA, 21 nt, Artificial Sequence
  ELANE RNA Guide
cccguugcccaggcggcaucc

SEQ ID NO: 16737 - RNA, 21 nt, Artificial Sequence
  ELANE RNA Guide
ccggcucagggaugccgccug

SEQ ID NO: 16738 - RNA, 21 nt, Artificial Sequence
  ELANE RNA Guide
ccguugcccaggcggcauccc

SEQ ID NO: 16739 - RNA, 21 nt, Artificial Sequence
  ELANE RNA Guide
cggcaucccugagccggcagc

SEQ ID NO: 16740 - RNA, 21 nt, Artificial Sequence
  ELANE RNA Guide
cggcucagggaugccgccugg

SEQ ID NO: 16741 - RNA, 21 nt, Artificial Sequence
  ELANE RNA Guide
cguugcccaggcggcaucccu

SEQ ID NO: 16742 - RNA, 21 nt, Artificial Sequence
  ELANE RNA Guide
cucagggaugccgccugggca

SEQ ID NO: 16743 - RNA, 21 nt, Artificial Sequence
  ELANE RNA Guide
cugcaccccguugcccaggcg

SEQ ID NO: 16744 - RNA, 21 nt, Artificial Sequence
  ELANE RNA Guide
cugccggcucagggaugccgc

SEQ ID NO: 16745 - RNA, 21 nt, Artificial Sequence
  ELANE RNA Guide
gaugccgccugggcaacgggg

SEQ ID NO: 16746 - RNA, 21 nt, Artificial Sequence
  ELANE RNA Guide
gcaucccugagccggcagcug

SEQ ID NO: 16747 - RNA, 21 nt, Artificial Sequence
  ELANE RNA Guide
gcccagcugccggcucaggga

SEQ ID NO: 16748 - RNA, 21 nt, Artificial Sequence
  ELANE RNA Guide
gcccaggcggcaucccugagc

SEQ ID NO: 16749 - RNA, 21 nt, Artificial Sequence
  ELANE RNA Guide
gccggcucagggaugccgccu

SEQ ID NO: 16750 - RNA, 21 nt, Artificial Sequence
  ELANE RNA Guide
gcggcaucccugagccggcag

SEQ ID NO: 16751 - RNA, 21 nt, Artificial Sequence
  ELANE RNA Guide
gcucagggaugccgccugggc

SEQ ID NO: 16752 - RNA, 21 nt, Artificial Sequence
  ELANE RNA Guide
gcugccggcucagggaugccg

SEQ ID NO: 16753 - RNA, 21 nt, Artificial Sequence
  ELANE RNA Guide
ggaugccgccugggcaacggg

SEQ ID NO: 16754 - RNA, 21 nt, Artificial Sequence
  ELANE RNA Guide
ggcaucccugagccggcagcu

SEQ ID NO: 16755 - RNA, 21 nt, Artificial Sequence
  ELANE RNA Guide
ggcggcaucccugagccggca

SEQ ID NO: 16756 - RNA, 21 nt, Artificial Sequence
  ELANE RNA Guide
ggcucagggaugccgccuggg

SEQ ID NO: 16757 - RNA, 21 nt, Artificial Sequence
  ELANE RNA Guide
gggaugccgccugggcaacgg

SEQ ID NO: 16758 - RNA, 21 nt, Artificial Sequence
  ELANE RNA Guide
guggcccagcugccggcucag

SEQ ID NO: 16759 - RNA, 21 nt, Artificial Sequence
  ELANE RNA Guide
guugcccaggcggcaucccug

SEQ ID NO: 16760 - RNA, 21 nt, Artificial Sequence
  ELANE RNA Guide
ucagggaugccgccugggcaa

SEQ ID NO: 16761 - RNA, 21 nt, Artificial Sequence
  ELANE RNA Guide
ugcaccccguugcccaggcgg

SEQ ID NO: 16762 - RNA, 21 nt, Artificial Sequence
  ELANE RNA Guide
ugcccaggcggcaucccugag

SEQ ID NO: 16763 - RNA, 21 nt, Artificial Sequence
  ELANE RNA Guide
ugccggcucagggaugccgcc

SEQ ID NO: 16764 - RNA, 21 nt, Artificial Sequence
  ELANE RNA Guide
uggcccagcugccggcucagg

SEQ ID NO: 16765 - RNA, 21 nt, Artificial Sequence
  ELANE RNA Guide
uugcccaggcggcaucccuga

SEQ ID NO: 16766 - RNA, 22 nt, Artificial Sequence
  ELANE RNA Guide
accccguugcccaggcggcauc

SEQ ID NO: 16767 - RNA, 22 nt, Artificial Sequence
  ELANE RNA Guide
acugcaccccguugcccaggcg

SEQ ID NO: 16768 - RNA, 22 nt, Artificial Sequence
  ELANE RNA Guide
agcugccggcucagggaugccg

SEQ ID NO: 16769 - RNA, 22 nt, Artificial Sequence
  ELANE RNA Guide
aggcggcaucccugagccggca

SEQ ID NO: 16770 - RNA, 22 nt, Artificial Sequence
  ELANE RNA Guide
agggaugccgccugggcaacgg

SEQ ID NO: 16771 - RNA, 22 nt, Artificial Sequence
  ELANE RNA Guide
augccgccugggcaacggggug

SEQ ID NO: 16772 - RNA, 22 nt, Artificial Sequence
  ELANE RNA Guide
caccccguugcccaggcggcau

SEQ ID NO: 16773 - RNA, 22 nt, Artificial Sequence
  ELANE RNA Guide
cacugcaccccguugcccaggc

SEQ ID NO: 16774 - RNA, 22 nt, Artificial Sequence
  ELANE RNA Guide
cagcugccggcucagggaugcc

SEQ ID NO: 16775 - RNA, 22 nt, Artificial Sequence
  ELANE RNA Guide
caggcggcaucccugagccggc

SEQ ID NO: 16776 - RNA, 22 nt, Artificial Sequence
  ELANE RNA Guide
cagggaugccgccugggcaacg

SEQ ID NO: 16777 - RNA, 22 nt, Artificial Sequence
  ELANE RNA Guide
caucccugagccggcagcuggg

SEQ ID NO: 16778 - RNA, 22 nt, Artificial Sequence
  ELANE RNA Guide
ccagcugccggcucagggaugc

SEQ ID NO: 16779 - RNA, 22 nt, Artificial Sequence
  ELANE RNA Guide
ccaggcggcaucccugagccgg

SEQ ID NO: 16780 - RNA, 22 nt, Artificial Sequence
  ELANE RNA Guide
cccagcugccggcucagggaug

SEQ ID NO: 16781 - RNA, 22 nt, Artificial Sequence
  ELANE RNA Guide
cccaggcggcaucccugagccg

SEQ ID NO: 16782 - RNA, 22 nt, Artificial Sequence
  ELANE RNA Guide
ccccguugcccaggcggcaucc

SEQ ID NO: 16783 - RNA, 22 nt, Artificial Sequence
  ELANE RNA Guide
cccguugcccaggcggcauccc

SEQ ID NO: 16784 - RNA, 22 nt, Artificial Sequence
  ELANE RNA Guide
ccggcucagggaugccgccugg

SEQ ID NO: 16785 - RNA, 22 nt, Artificial Sequence
  ELANE RNA Guide
ccguugcccaggcggcaucccu

SEQ ID NO: 16786 - RNA, 22 nt, Artificial Sequence
  ELANE RNA Guide
cggcaucccugagccggcagcu

SEQ ID NO: 16787 - RNA, 22 nt, Artificial Sequence
  ELANE RNA Guide
cggcucagggaugccgccuggg

SEQ ID NO: 16788 - RNA, 22 nt, Artificial Sequence
  ELANE RNA Guide
cguugcccaggcggcaucccug

SEQ ID NO: 16789 - RNA, 22 nt, Artificial Sequence
  ELANE RNA Guide
cucagggaugccgccugggcaa

SEQ ID NO: 16790 - RNA, 22 nt, Artificial Sequence
  ELANE RNA Guide
cugcaccccguugcccaggcgg

SEQ ID NO: 16791 - RNA, 22 nt, Artificial Sequence
  ELANE RNA Guide
cugccggcucagggaugccgcc

SEQ ID NO: 16792 - RNA, 22 nt, Artificial Sequence
  ELANE RNA Guide
gaugccgccugggcaacggggu

SEQ ID NO: 16793 - RNA, 22 nt, Artificial Sequence
  ELANE RNA Guide
gcaccccguugcccaggcggca

SEQ ID NO: 16794 - RNA, 22 nt, Artificial Sequence
  ELANE RNA Guide
gcaucccugagccggcagcugg

SEQ ID NO: 16795 - RNA, 22 nt, Artificial Sequence
  ELANE RNA Guide
gcccagcugccggcucagggau

SEQ ID NO: 16796 - RNA, 22 nt, Artificial Sequence
  ELANE RNA Guide
gcccaggcggcaucccugagcc

SEQ ID NO: 16797 - RNA, 22 nt, Artificial Sequence
  ELANE RNA Guide
gccggcucagggaugccgccug

SEQ ID NO: 16798 - RNA, 22 nt, Artificial Sequence
  ELANE RNA Guide
gcggcaucccugagccggcagc

SEQ ID NO: 16799 - RNA, 22 nt, Artificial Sequence
  ELANE RNA Guide
gcucagggaugccgccugggca

SEQ ID NO: 16800 - RNA, 22 nt, Artificial Sequence
  ELANE RNA Guide
gcugccggcucagggaugccgc

SEQ ID NO: 16801 - RNA, 22 nt, Artificial Sequence
  ELANE RNA Guide
ggaugccgccugggcaacgggg

SEQ ID NO: 16802 - RNA, 22 nt, Artificial Sequence
  ELANE RNA Guide
ggcaucccugagccggcagcug

SEQ ID NO: 16803 - RNA, 22 nt, Artificial Sequence
  ELANE RNA Guide
ggcccagcugccggcucaggga

SEQ ID NO: 16804 - RNA, 22 nt, Artificial Sequence
  ELANE RNA Guide
ggcggcaucccugagccggcag

SEQ ID NO: 16805 - RNA, 22 nt, Artificial Sequence
  ELANE RNA Guide
ggcucagggaugccgccugggc

SEQ ID NO: 16806 - RNA, 22 nt, Artificial Sequence
  ELANE RNA Guide
gggaugccgccugggcaacggg

SEQ ID NO: 16807 - RNA, 22 nt, Artificial Sequence
  ELANE RNA Guide
gguggcccagcugccggcucag

SEQ ID NO: 16808 - RNA, 22 nt, Artificial Sequence
  ELANE RNA Guide
guggcccagcugccggcucagg

SEQ ID NO: 16809 - RNA, 22 nt, Artificial Sequence
  ELANE RNA Guide
guugcccaggcggcaucccuga

SEQ ID NO: 16810 - RNA, 22 nt, Artificial Sequence
  ELANE RNA Guide
ucagggaugccgccugggcaac

SEQ ID NO: 16811 - RNA, 22 nt, Artificial Sequence
  ELANE RNA Guide
ugcaccccguugcccaggcggc

SEQ ID NO: 16812 - RNA, 22 nt, Artificial Sequence
  ELANE RNA Guide
ugcccaggcggcaucccugagc

SEQ ID NO: 16813 - RNA, 22 nt, Artificial Sequence
  ELANE RNA Guide
ugccggcucagggaugccgccu

SEQ ID NO: 16814 - RNA, 22 nt, Artificial Sequence
  ELANE RNA Guide
uggcccagcugccggcucaggg

SEQ ID NO: 16815 - RNA, 22 nt, Artificial Sequence
  ELANE RNA Guide
uugcccaggcggcaucccugag

SEQ ID NO: 16816 - RNA, 20 nt, Artificial Sequence
  ELANE RNA Guide
acaccgccugggcaacgggg

SEQ ID NO: 16817 - RNA, 20 nt, Artificial Sequence
  ELANE RNA Guide
accccguugcccaggcggug

SEQ ID NO: 16818 - RNA, 20 nt, Artificial Sequence
  ELANE RNA Guide
acugcaccccguugcccagg

SEQ ID NO: 16819 - RNA, 20 nt, Artificial Sequence
  ELANE RNA Guide
agcugccggcucagggacac

SEQ ID NO: 16820 - RNA, 20 nt, Artificial Sequence
  ELANE RNA Guide
aggcggugucccugagccgg

SEQ ID NO: 16821 - RNA, 20 nt, Artificial Sequence
  ELANE RNA Guide
agggacaccgccugggcaac

SEQ ID NO: 16822 - RNA, 20 nt, Artificial Sequence
  ELANE RNA Guide
caccccguugcccaggcggu

SEQ ID NO: 16823 - RNA, 20 nt, Artificial Sequence
  ELANE RNA Guide
caccgccugggcaacggggu

SEQ ID NO: 16824 - RNA, 20 nt, Artificial Sequence
  ELANE RNA Guide
cagcugccggcucagggaca

SEQ ID NO: 16825 - RNA, 20 nt, Artificial Sequence
  ELANE RNA Guide
caggcggugucccugagccg

SEQ ID NO: 16826 - RNA, 20 nt, Artificial Sequence
  ELANE RNA Guide
cagggacaccgccugggcaa

SEQ ID NO: 16827 - RNA, 20 nt, Artificial Sequence
  ELANE RNA Guide
ccagcugccggcucagggac

SEQ ID NO: 16828 - RNA, 20 nt, Artificial Sequence
  ELANE RNA Guide
ccaggcggugucccugagcc

SEQ ID NO: 16829 - RNA, 20 nt, Artificial Sequence
  ELANE RNA Guide
cccaggcggugucccugagc

SEQ ID NO: 16830 - RNA, 20 nt, Artificial Sequence
  ELANE RNA Guide
ccccguugcccaggcggugu

SEQ ID NO: 16831 - RNA, 20 nt, Artificial Sequence
  ELANE RNA Guide
cccguugcccaggcgguguc

SEQ ID NO: 16832 - RNA, 20 nt, Artificial Sequence
  ELANE RNA Guide
ccggcucagggacaccgccu

SEQ ID NO: 16833 - RNA, 20 nt, Artificial Sequence
  ELANE RNA Guide
ccguugcccaggcggugucc

SEQ ID NO: 16834 - RNA, 20 nt, Artificial Sequence
  ELANE RNA Guide
cggcucagggacaccgccug

SEQ ID NO: 16835 - RNA, 20 nt, Artificial Sequence
  ELANE RNA Guide
cggugucccugagccggcag

SEQ ID NO: 16836 - RNA, 20 nt, Artificial Sequence
  ELANE RNA Guide
cguugcccaggcgguguccc

SEQ ID NO: 16837 - RNA, 20 nt, Artificial Sequence
  ELANE RNA Guide
cucagggacaccgccugggc

SEQ ID NO: 16838 - RNA, 20 nt, Artificial Sequence
  ELANE RNA Guide
cugccggcucagggacaccg

SEQ ID NO: 16839 - RNA, 20 nt, Artificial Sequence
  ELANE RNA Guide
gacaccgccugggcaacggg

SEQ ID NO: 16840 - RNA, 20 nt, Artificial Sequence
  ELANE RNA Guide
gcccaggcggugucccugag

SEQ ID NO: 16841 - RNA, 20 nt, Artificial Sequence
  ELANE RNA Guide
gccggcucagggacaccgcc

SEQ ID NO: 16842 - RNA, 20 nt, Artificial Sequence
  ELANE RNA Guide
gcggugucccugagccggca

SEQ ID NO: 16843 - RNA, 20 nt, Artificial Sequence
  ELANE RNA Guide
gcucagggacaccgccuggg

SEQ ID NO: 16844 - RNA, 20 nt, Artificial Sequence
  ELANE RNA Guide
gcugccggcucagggacacc

SEQ ID NO: 16845 - RNA, 20 nt, Artificial Sequence
  ELANE RNA Guide
ggacaccgccugggcaacgg

SEQ ID NO: 16846 - RNA, 20 nt, Artificial Sequence
  ELANE RNA Guide
ggcggugucccugagccggc

SEQ ID NO: 16847 - RNA, 20 nt, Artificial Sequence
  ELANE RNA Guide
ggcucagggacaccgccugg

SEQ ID NO: 16848 - RNA, 20 nt, Artificial Sequence
  ELANE RNA Guide
gggacaccgccugggcaacg

SEQ ID NO: 16849 - RNA, 20 nt, Artificial Sequence
  ELANE RNA Guide
ggugucccugagccggcagc

SEQ ID NO: 16850 - RNA, 20 nt, Artificial Sequence
  ELANE RNA Guide
gugucccugagccggcagcu

SEQ ID NO: 16851 - RNA, 20 nt, Artificial Sequence
  ELANE RNA Guide
guugcccaggcggugucccu

SEQ ID NO: 16852 - RNA, 20 nt, Artificial Sequence
  ELANE RNA Guide
ucagggacaccgccugggca

SEQ ID NO: 16853 - RNA, 20 nt, Artificial Sequence
  ELANE RNA Guide
ugcccaggcggugucccuga

SEQ ID NO: 16854 - RNA, 20 nt, Artificial Sequence
  ELANE RNA Guide
ugccggcucagggacaccgc

SEQ ID NO: 16855 - RNA, 20 nt, Artificial Sequence
  ELANE RNA Guide
uugcccaggcggugucccug

SEQ ID NO: 16856 - RNA, 21 nt, Artificial Sequence
  ELANE RNA Guide
acaccgccugggcaacggggu

SEQ ID NO: 16857 - RNA, 21 nt, Artificial Sequence
  ELANE RNA Guide
accccguugcccaggcggugu

SEQ ID NO: 16858 - RNA, 21 nt, Artificial Sequence
  ELANE RNA Guide
agcugccggcucagggacacc

SEQ ID NO: 16859 - RNA, 21 nt, Artificial Sequence
  ELANE RNA Guide
aggcggugucccugagccggc

SEQ ID NO: 16860 - RNA, 21 nt, Artificial Sequence
  ELANE RNA Guide
agggacaccgccugggcaacg

SEQ ID NO: 16861 - RNA, 21 nt, Artificial Sequence
  ELANE RNA Guide
caccccguugcccaggcggug

SEQ ID NO: 16862 - RNA, 21 nt, Artificial Sequence
  ELANE RNA Guide
caccgccugggcaacggggug

SEQ ID NO: 16863 - RNA, 21 nt, Artificial Sequence
  ELANE RNA Guide
cacugcaccccguugcccagg

SEQ ID NO: 16864 - RNA, 21 nt, Artificial Sequence
  ELANE RNA Guide
cagcugccggcucagggacac

SEQ ID NO: 16865 - RNA, 21 nt, Artificial Sequence
  ELANE RNA Guide
caggcggugucccugagccgg

SEQ ID NO: 16866 - RNA, 21 nt, Artificial Sequence
  ELANE RNA Guide
cagggacaccgccugggcaac

SEQ ID NO: 16867 - RNA, 21 nt, Artificial Sequence
  ELANE RNA Guide
ccagcugccggcucagggaca

SEQ ID NO: 16868 - RNA, 21 nt, Artificial Sequence
  ELANE RNA Guide
ccaggcggugucccugagccg

SEQ ID NO: 16869 - RNA, 21 nt, Artificial Sequence
  ELANE RNA Guide
cccagcugccggcucagggac

SEQ ID NO: 16870 - RNA, 21 nt, Artificial Sequence
  ELANE RNA Guide
cccaggcggugucccugagcc

SEQ ID NO: 16871 - RNA, 21 nt, Artificial Sequence
  ELANE RNA Guide
ccccguugcccaggcgguguc

SEQ ID NO: 16872 - RNA, 21 nt, Artificial Sequence
  ELANE RNA Guide
cccguugcccaggcggugucc

SEQ ID NO: 16873 - RNA, 21 nt, Artificial Sequence
  ELANE RNA Guide
ccggcucagggacaccgccug

SEQ ID NO: 16874 - RNA, 21 nt, Artificial Sequence
  ELANE RNA Guide
ccguugcccaggcgguguccc

SEQ ID NO: 16875 - RNA, 21 nt, Artificial Sequence
  ELANE RNA Guide
cggcucagggacaccgccugg

SEQ ID NO: 16876 - RNA, 21 nt, Artificial Sequence
  ELANE RNA Guide
cggugucccugagccggcagc

SEQ ID NO: 16877 - RNA, 21 nt, Artificial Sequence
  ELANE RNA Guide
cguugcccaggcggugucccu

SEQ ID NO: 16878 - RNA, 21 nt, Artificial Sequence
  ELANE RNA Guide
cucagggacaccgccugggca

SEQ ID NO: 16879 - RNA, 21 nt, Artificial Sequence
  ELANE RNA Guide
cugccggcucagggacaccgc

SEQ ID NO: 16880 - RNA, 21 nt, Artificial Sequence
  ELANE RNA Guide
gacaccgccugggcaacgggg

SEQ ID NO: 16881 - RNA, 21 nt, Artificial Sequence
  ELANE RNA Guide
gcaccccguugcccaggcggu

SEQ ID NO: 16882 - RNA, 21 nt, Artificial Sequence
  ELANE RNA Guide
gcccaggcggugucccugagc

SEQ ID NO: 16883 - RNA, 21 nt, Artificial Sequence
  ELANE RNA Guide
gccggcucagggacaccgccu

SEQ ID NO: 16884 - RNA, 21 nt, Artificial Sequence
  ELANE RNA Guide
gcggugucccugagccggcag

SEQ ID NO: 16885 - RNA, 21 nt, Artificial Sequence
  ELANE RNA Guide
gcucagggacaccgccugggc

SEQ ID NO: 16886 - RNA, 21 nt, Artificial Sequence
  ELANE RNA Guide
gcugccggcucagggacaccg

SEQ ID NO: 16887 - RNA, 21 nt, Artificial Sequence
  ELANE RNA Guide
ggacaccgccugggcaacggg

SEQ ID NO: 16888 - RNA, 21 nt, Artificial Sequence
  ELANE RNA Guide
ggcggugucccugagccggca

SEQ ID NO: 16889 - RNA, 21 nt, Artificial Sequence
  ELANE RNA Guide
ggcucagggacaccgccuggg

SEQ ID NO: 16890 - RNA, 21 nt, Artificial Sequence
  ELANE RNA Guide
gggacaccgccugggcaacgg

SEQ ID NO: 16891 - RNA, 21 nt, Artificial Sequence
  ELANE RNA Guide
ggugucccugagccggcagcu

SEQ ID NO: 16892 - RNA, 21 nt, Artificial Sequence
  ELANE RNA Guide
gugucccugagccggcagcug

SEQ ID NO: 16893 - RNA, 21 nt, Artificial Sequence
  ELANE RNA Guide
guugcccaggcggugucccug

SEQ ID NO: 16894 - RNA, 21 nt, Artificial Sequence
  ELANE RNA Guide
ucagggacaccgccugggcaa

SEQ ID NO: 16895 - RNA, 21 nt, Artificial Sequence
  ELANE RNA Guide
ugcccaggcggugucccugag

SEQ ID NO: 16896 - RNA, 21 nt, Artificial Sequence
  ELANE RNA Guide
ugccggcucagggacaccgcc

SEQ ID NO: 16897 - RNA, 21 nt, Artificial Sequence
  ELANE RNA Guide
uugcccaggcggugucccuga

SEQ ID NO: 16898 - RNA, 22 nt, Artificial Sequence
  ELANE RNA Guide
acaccgccugggcaacggggug

SEQ ID NO: 16899 - RNA, 22 nt, Artificial Sequence
  ELANE RNA Guide
accccguugcccaggcgguguc

SEQ ID NO: 16900 - RNA, 22 nt, Artificial Sequence
  ELANE RNA Guide
agcugccggcucagggacaccg

SEQ ID NO: 16901 - RNA, 22 nt, Artificial Sequence
  ELANE RNA Guide
aggcggugucccugagccggca

SEQ ID NO: 16902 - RNA, 22 nt, Artificial Sequence
  ELANE RNA Guide
agggacaccgccugggcaacgg

SEQ ID NO: 16903 - RNA, 22 nt, Artificial Sequence
  ELANE RNA Guide
caccccguugcccaggcggugu

SEQ ID NO: 16904 - RNA, 22 nt, Artificial Sequence
  ELANE RNA Guide
caccgccugggcaacggggugc

SEQ ID NO: 16905 - RNA, 22 nt, Artificial Sequence
  ELANE RNA Guide
cagcugccggcucagggacacc

SEQ ID NO: 16906 - RNA, 22 nt, Artificial Sequence
  ELANE RNA Guide
caggcggugucccugagccggc

SEQ ID NO: 16907 - RNA, 22 nt, Artificial Sequence
  ELANE RNA Guide
cagggacaccgccugggcaacg

SEQ ID NO: 16908 - RNA, 22 nt, Artificial Sequence
  ELANE RNA Guide
ccagcugccggcucagggacac

SEQ ID NO: 16909 - RNA, 22 nt, Artificial Sequence
  ELANE RNA Guide
ccaggcggugucccugagccgg

SEQ ID NO: 16910 - RNA, 22 nt, Artificial Sequence
  ELANE RNA Guide
cccagcugccggcucagggaca

SEQ ID NO: 16911 - RNA, 22 nt, Artificial Sequence
  ELANE RNA Guide
cccaggcggugucccugagccg

SEQ ID NO: 16912 - RNA, 22 nt, Artificial Sequence
  ELANE RNA Guide
ccccguugcccaggcggugucc

SEQ ID NO: 16913 - RNA, 22 nt, Artificial Sequence
  ELANE RNA Guide
cccguugcccaggcgguguccc

SEQ ID NO: 16914 - RNA, 22 nt, Artificial Sequence
  ELANE RNA Guide
ccggcucagggacaccgccugg

SEQ ID NO: 16915 - RNA, 22 nt, Artificial Sequence
  ELANE RNA Guide
ccguugcccaggcggugucccu

SEQ ID NO: 16916 - RNA, 22 nt, Artificial Sequence
  ELANE RNA Guide
cggcucagggacaccgccuggg

SEQ ID NO: 16917 - RNA, 22 nt, Artificial Sequence
  ELANE RNA Guide
cggugucccugagccggcagcu

SEQ ID NO: 16918 - RNA, 22 nt, Artificial Sequence
  ELANE RNA Guide
cguugcccaggcggugucccug

SEQ ID NO: 16919 - RNA, 22 nt, Artificial Sequence
  ELANE RNA Guide
cucagggacaccgccugggcaa

SEQ ID NO: 16920 - RNA, 22 nt, Artificial Sequence
  ELANE RNA Guide
cugccggcucagggacaccgcc

SEQ ID NO: 16921 - RNA, 22 nt, Artificial Sequence
  ELANE RNA Guide
gacaccgccugggcaacggggu

SEQ ID NO: 16922 - RNA, 22 nt, Artificial Sequence
  ELANE RNA Guide
gcaccccguugcccaggcggug

SEQ ID NO: 16923 - RNA, 22 nt, Artificial Sequence
  ELANE RNA Guide
gcacugcaccccguugcccagg

SEQ ID NO: 16924 - RNA, 22 nt, Artificial Sequence
  ELANE RNA Guide
gcccagcugccggcucagggac

SEQ ID NO: 16925 - RNA, 22 nt, Artificial Sequence
  ELANE RNA Guide
gcccaggcggugucccugagcc

SEQ ID NO: 16926 - RNA, 22 nt, Artificial Sequence
  ELANE RNA Guide
gccggcucagggacaccgccug

SEQ ID NO: 16927 - RNA, 22 nt, Artificial Sequence
  ELANE RNA Guide
gcggugucccugagccggcagc

SEQ ID NO: 16928 - RNA, 22 nt, Artificial Sequence
  ELANE RNA Guide
gcucagggacaccgccugggca

SEQ ID NO: 16929 - RNA, 22 nt, Artificial Sequence
  ELANE RNA Guide
gcugccggcucagggacaccgc

SEQ ID NO: 16930 - RNA, 22 nt, Artificial Sequence
  ELANE RNA Guide
ggacaccgccugggcaacgggg

SEQ ID NO: 16931 - RNA, 22 nt, Artificial Sequence
  ELANE RNA Guide
ggcggugucccugagccggcag

SEQ ID NO: 16932 - RNA, 22 nt, Artificial Sequence
  ELANE RNA Guide
ggcucagggacaccgccugggc

SEQ ID NO: 16933 - RNA, 22 nt, Artificial Sequence
  ELANE RNA Guide
gggacaccgccugggcaacggg

SEQ ID NO: 16934 - RNA, 22 nt, Artificial Sequence
  ELANE RNA Guide
ggugucccugagccggcagcug

SEQ ID NO: 16935 - RNA, 22 nt, Artificial Sequence
  ELANE RNA Guide
gugucccugagccggcagcugg

SEQ ID NO: 16936 - RNA, 22 nt, Artificial Sequence
  ELANE RNA Guide
guugcccaggcggugucccuga

SEQ ID NO: 16937 - RNA, 22 nt, Artificial Sequence
  ELANE RNA Guide
ucagggacaccgccugggcaac

SEQ ID NO: 16938 - RNA, 22 nt, Artificial Sequence
  ELANE RNA Guide
ugcaccccguugcccaggcggu

SEQ ID NO: 16939 - RNA, 22 nt, Artificial Sequence
  ELANE RNA Guide
ugcccaggcggugucccugagc

SEQ ID NO: 16940 - RNA, 22 nt, Artificial Sequence
  ELANE RNA Guide
ugccggcucagggacaccgccu

SEQ ID NO: 16941 - RNA, 22 nt, Artificial Sequence
  ELANE RNA Guide
uugcccaggcggugucccugag

SEQ ID NO: 16942 - RNA, 20 nt, Artificial Sequence
  ELANE RNA Guide
accccguugcccaggcagcg

SEQ ID NO: 16943 - RNA, 20 nt, Artificial Sequence
  ELANE RNA Guide
acgcugccugggcaacgggg

SEQ ID NO: 16944 - RNA, 20 nt, Artificial Sequence
  ELANE RNA Guide
agcugccggcucagggacgc

SEQ ID NO: 16945 - RNA, 20 nt, Artificial Sequence
  ELANE RNA Guide
aggcagcgucccugagccgg

SEQ ID NO: 16946 - RNA, 20 nt, Artificial Sequence
  ELANE RNA Guide
agggacgcugccugggcaac

SEQ ID NO: 16947 - RNA, 20 nt, Artificial Sequence
  ELANE RNA Guide
caccccguugcccaggcagc

SEQ ID NO: 16948 - RNA, 20 nt, Artificial Sequence
  ELANE RNA Guide
cacugcaccccguugcccag

SEQ ID NO: 16949 - RNA, 20 nt, Artificial Sequence
  ELANE RNA Guide
cagcgucccugagccggcag

SEQ ID NO: 16950 - RNA, 20 nt, Artificial Sequence
  ELANE RNA Guide
cagcugccggcucagggacg

SEQ ID NO: 16951 - RNA, 20 nt, Artificial Sequence
  ELANE RNA Guide
caggcagcgucccugagccg

SEQ ID NO: 16952 - RNA, 20 nt, Artificial Sequence
  ELANE RNA Guide
cagggacgcugccugggcaa

SEQ ID NO: 16953 - RNA, 20 nt, Artificial Sequence
  ELANE RNA Guide
ccaggcagcgucccugagcc

SEQ ID NO: 16954 - RNA, 20 nt, Artificial Sequence
  ELANE RNA Guide
cccaggcagcgucccugagc

SEQ ID NO: 16955 - RNA, 20 nt, Artificial Sequence
  ELANE RNA Guide
ccccguugcccaggcagcgu

SEQ ID NO: 16956 - RNA, 20 nt, Artificial Sequence
  ELANE RNA Guide
cccguugcccaggcagcguc

SEQ ID NO: 16957 - RNA, 20 nt, Artificial Sequence
  ELANE RNA Guide
ccggcucagggacgcugccu

SEQ ID NO: 16958 - RNA, 20 nt, Artificial Sequence
  ELANE RNA Guide
ccguugcccaggcagcgucc

SEQ ID NO: 16959 - RNA, 20 nt, Artificial Sequence
  ELANE RNA Guide
cgcugccugggcaacggggu

SEQ ID NO: 16960 - RNA, 20 nt, Artificial Sequence
  ELANE RNA Guide
cggcucagggacgcugccug

SEQ ID NO: 16961 - RNA, 20 nt, Artificial Sequence
  ELANE RNA Guide
cguugcccaggcagcguccc

SEQ ID NO: 16962 - RNA, 20 nt, Artificial Sequence
  ELANE RNA Guide
cucagggacgcugccugggc

SEQ ID NO: 16963 - RNA, 20 nt, Artificial Sequence
  ELANE RNA Guide
cugccggcucagggacgcug

SEQ ID NO: 16964 - RNA, 20 nt, Artificial Sequence
  ELANE RNA Guide
cugccugggcaacggggugc

SEQ ID NO: 16965 - RNA, 20 nt, Artificial Sequence
  ELANE RNA Guide
gacgcugccugggcaacggg

SEQ ID NO: 16966 - RNA, 20 nt, Artificial Sequence
  ELANE RNA Guide
gcaccccguugcccaggcag

SEQ ID NO: 16967 - RNA, 20 nt, Artificial Sequence
  ELANE RNA Guide
gcacugcaccccguugccca

SEQ ID NO: 16968 - RNA, 20 nt, Artificial Sequence
  ELANE RNA Guide
gcagcgucccugagccggca

SEQ ID NO: 16969 - RNA, 20 nt, Artificial Sequence
  ELANE RNA Guide
gcccaggcagcgucccugag

SEQ ID NO: 16970 - RNA, 20 nt, Artificial Sequence
  ELANE RNA Guide
gccggcucagggacgcugcc

SEQ ID NO: 16971 - RNA, 20 nt, Artificial Sequence
  ELANE RNA Guide
gcucagggacgcugccuggg

SEQ ID NO: 16972 - RNA, 20 nt, Artificial Sequence
  ELANE RNA Guide
gcugccggcucagggacgcu

SEQ ID NO: 16973 - RNA, 20 nt, Artificial Sequence
  ELANE RNA Guide
gcugccugggcaacggggug

SEQ ID NO: 16974 - RNA, 20 nt, Artificial Sequence
  ELANE RNA Guide
ggacgcugccugggcaacgg

SEQ ID NO: 16975 - RNA, 20 nt, Artificial Sequence
  ELANE RNA Guide
ggcagcgucccugagccggc

SEQ ID NO: 16976 - RNA, 20 nt, Artificial Sequence
  ELANE RNA Guide
ggcucagggacgcugccugg

SEQ ID NO: 16977 - RNA, 20 nt, Artificial Sequence
  ELANE RNA Guide
gggacgcugccugggcaacg

SEQ ID NO: 16978 - RNA, 20 nt, Artificial Sequence
  ELANE RNA Guide
guugcccaggcagcgucccu

SEQ ID NO: 16979 - RNA, 20 nt, Artificial Sequence
  ELANE RNA Guide
ucagggacgcugccugggca

SEQ ID NO: 16980 - RNA, 20 nt, Artificial Sequence
  ELANE RNA Guide
ugcaccccguugcccaggca

SEQ ID NO: 16981 - RNA, 20 nt, Artificial Sequence
  ELANE RNA Guide
ugcccaggcagcgucccuga

SEQ ID NO: 16982 - RNA, 20 nt, Artificial Sequence
  ELANE RNA Guide
ugccggcucagggacgcugc

SEQ ID NO: 16983 - RNA, 20 nt, Artificial Sequence
  ELANE RNA Guide
uugcccaggcagcgucccug

SEQ ID NO: 16984 - RNA, 21 nt, Artificial Sequence
  ELANE RNA Guide
accccguugcccaggcagcgu

SEQ ID NO: 16985 - RNA, 21 nt, Artificial Sequence
  ELANE RNA Guide
acgcugccugggcaacggggu

SEQ ID NO: 16986 - RNA, 21 nt, Artificial Sequence
  ELANE RNA Guide
agcugccggcucagggacgcu

SEQ ID NO: 16987 - RNA, 21 nt, Artificial Sequence
  ELANE RNA Guide
aggcagcgucccugagccggc

SEQ ID NO: 16988 - RNA, 21 nt, Artificial Sequence
  ELANE RNA Guide
agggacgcugccugggcaacg

SEQ ID NO: 16989 - RNA, 21 nt, Artificial Sequence
  ELANE RNA Guide
caccccguugcccaggcagcg

SEQ ID NO: 16990 - RNA, 21 nt, Artificial Sequence
  ELANE RNA Guide
cagcgucccugagccggcagc

SEQ ID NO: 16991 - RNA, 21 nt, Artificial Sequence
  ELANE RNA Guide
cagcugccggcucagggacgc

SEQ ID NO: 16992 - RNA, 21 nt, Artificial Sequence
  ELANE RNA Guide
caggcagcgucccugagccgg

SEQ ID NO: 16993 - RNA, 21 nt, Artificial Sequence
  ELANE RNA Guide
cagggacgcugccugggcaac

SEQ ID NO: 16994 - RNA, 21 nt, Artificial Sequence
  ELANE RNA Guide
ccagcugccggcucagggacg

SEQ ID NO: 16995 - RNA, 21 nt, Artificial Sequence
  ELANE RNA Guide
ccaggcagcgucccugagccg

SEQ ID NO: 16996 - RNA, 21 nt, Artificial Sequence
  ELANE RNA Guide
cccaggcagcgucccugagcc

SEQ ID NO: 16997 - RNA, 21 nt, Artificial Sequence
  ELANE RNA Guide
ccccguugcccaggcagcguc

SEQ ID NO: 16998 - RNA, 21 nt, Artificial Sequence
  ELANE RNA Guide
cccguugcccaggcagcgucc

SEQ ID NO: 16999 - RNA, 21 nt, Artificial Sequence
  ELANE RNA Guide
ccggcucagggacgcugccug

SEQ ID NO: 17000 - RNA, 21 nt, Artificial Sequence
  ELANE RNA Guide
ccguugcccaggcagcguccc

SEQ ID NO: 17001 - RNA, 21 nt, Artificial Sequence
  ELANE RNA Guide
cgcugccugggcaacggggug

SEQ ID NO: 17002 - RNA, 21 nt, Artificial Sequence
  ELANE RNA Guide
cggcucagggacgcugccugg

SEQ ID NO: 17003 - RNA, 21 nt, Artificial Sequence
  ELANE RNA Guide
cguugcccaggcagcgucccu

SEQ ID NO: 17004 - RNA, 21 nt, Artificial Sequence
  ELANE RNA Guide
cucagggacgcugccugggca

SEQ ID NO: 17005 - RNA, 21 nt, Artificial Sequence
  ELANE RNA Guide
cugcaccccguugcccaggca

SEQ ID NO: 17006 - RNA, 21 nt, Artificial Sequence
  ELANE RNA Guide
cugccggcucagggacgcugc

SEQ ID NO: 17007 - RNA, 21 nt, Artificial Sequence
  ELANE RNA Guide
cugccugggcaacggggugca

SEQ ID NO: 17008 - RNA, 21 nt, Artificial Sequence
  ELANE RNA Guide
gacgcugccugggcaacgggg

SEQ ID NO: 17009 - RNA, 21 nt, Artificial Sequence
  ELANE RNA Guide
gcaccccguugcccaggcagc

SEQ ID NO: 17010 - RNA, 21 nt, Artificial Sequence
  ELANE RNA Guide
gcacugcaccccguugcccag

SEQ ID NO: 17011 - RNA, 21 nt, Artificial Sequence
  ELANE RNA Guide
gcagcgucccugagccggcag

SEQ ID NO: 17012 - RNA, 21 nt, Artificial Sequence
  ELANE RNA Guide
gcccaggcagcgucccugagc

SEQ ID NO: 17013 - RNA, 21 nt, Artificial Sequence
  ELANE RNA Guide
gccggcucagggacgcugccu

SEQ ID NO: 17014 - RNA, 21 nt, Artificial Sequence
  ELANE RNA Guide
gcucagggacgcugccugggc

SEQ ID NO: 17015 - RNA, 21 nt, Artificial Sequence
  ELANE RNA Guide
gcugccggcucagggacgcug

SEQ ID NO: 17016 - RNA, 21 nt, Artificial Sequence
  ELANE RNA Guide
gcugccugggcaacggggugc

SEQ ID NO: 17017 - RNA, 21 nt, Artificial Sequence
  ELANE RNA Guide
ggacgcugccugggcaacggg

SEQ ID NO: 17018 - RNA, 21 nt, Artificial Sequence
  ELANE RNA Guide
ggcacugcaccccguugccca

SEQ ID NO: 17019 - RNA, 21 nt, Artificial Sequence
  ELANE RNA Guide
ggcagcgucccugagccggca

SEQ ID NO: 17020 - RNA, 21 nt, Artificial Sequence
  ELANE RNA Guide
ggcucagggacgcugccuggg

SEQ ID NO: 17021 - RNA, 21 nt, Artificial Sequence
  ELANE RNA Guide
gggacgcugccugggcaacgg

SEQ ID NO: 17022 - RNA, 21 nt, Artificial Sequence
  ELANE RNA Guide
guugcccaggcagcgucccug

SEQ ID NO: 17023 - RNA, 21 nt, Artificial Sequence
  ELANE RNA Guide
ucagggacgcugccugggcaa

SEQ ID NO: 17024 - RNA, 21 nt, Artificial Sequence
  ELANE RNA Guide
ugcaccccguugcccaggcag

SEQ ID NO: 17025 - RNA, 21 nt, Artificial Sequence
  ELANE RNA Guide
ugcccaggcagcgucccugag

SEQ ID NO: 17026 - RNA, 21 nt, Artificial Sequence
  ELANE RNA Guide
ugccggcucagggacgcugcc

SEQ ID NO: 17027 - RNA, 21 nt, Artificial Sequence
  ELANE RNA Guide
uugcccaggcagcgucccuga

SEQ ID NO: 17028 - RNA, 22 nt, Artificial Sequence
  ELANE RNA Guide
accccguugcccaggcagcguc

SEQ ID NO: 17029 - RNA, 22 nt, Artificial Sequence
  ELANE RNA Guide
acgcugccugggcaacggggug

SEQ ID NO: 17030 - RNA, 22 nt, Artificial Sequence
  ELANE RNA Guide
acugcaccccguugcccaggca

SEQ ID NO: 17031 - RNA, 22 nt, Artificial Sequence
  ELANE RNA Guide
agcugccggcucagggacgcug

SEQ ID NO: 17032 - RNA, 22 nt, Artificial Sequence
  ELANE RNA Guide
aggcacugcaccccguugccca

SEQ ID NO: 17033 - RNA, 22 nt, Artificial Sequence
  ELANE RNA Guide
aggcagcgucccugagccggca

SEQ ID NO: 17034 - RNA, 22 nt, Artificial Sequence
  ELANE RNA Guide
agggacgcugccugggcaacgg

SEQ ID NO: 17035 - RNA, 22 nt, Artificial Sequence
  ELANE RNA Guide
caccccguugcccaggcagcgu

SEQ ID NO: 17036 - RNA, 22 nt, Artificial Sequence
  ELANE RNA Guide
cagcgucccugagccggcagcu

SEQ ID NO: 17037 - RNA, 22 nt, Artificial Sequence
  ELANE RNA Guide
cagcugccggcucagggacgcu

SEQ ID NO: 17038 - RNA, 22 nt, Artificial Sequence
  ELANE RNA Guide
caggcagcgucccugagccggc

SEQ ID NO: 17039 - RNA, 22 nt, Artificial Sequence
  ELANE RNA Guide
cagggacgcugccugggcaacg

SEQ ID NO: 17040 - RNA, 22 nt, Artificial Sequence
  ELANE RNA Guide
ccagcugccggcucagggacgc

SEQ ID NO: 17041 - RNA, 22 nt, Artificial Sequence
  ELANE RNA Guide
ccaggcagcgucccugagccgg

SEQ ID NO: 17042 - RNA, 22 nt, Artificial Sequence
  ELANE RNA Guide
cccagcugccggcucagggacg

SEQ ID NO: 17043 - RNA, 22 nt, Artificial Sequence
  ELANE RNA Guide
cccaggcagcgucccugagccg

SEQ ID NO: 17044 - RNA, 22 nt, Artificial Sequence
  ELANE RNA Guide
ccccguugcccaggcagcgucc

SEQ ID NO: 17045 - RNA, 22 nt, Artificial Sequence
  ELANE RNA Guide
cccguugcccaggcagcguccc

SEQ ID NO: 17046 - RNA, 22 nt, Artificial Sequence
  ELANE RNA Guide
ccggcucagggacgcugccugg

SEQ ID NO: 17047 - RNA, 22 nt, Artificial Sequence
  ELANE RNA Guide
ccguugcccaggcagcgucccu

SEQ ID NO: 17048 - RNA, 22 nt, Artificial Sequence
  ELANE RNA Guide
cgcugccugggcaacggggugc

SEQ ID NO: 17049 - RNA, 22 nt, Artificial Sequence
  ELANE RNA Guide
cggcucagggacgcugccuggg

SEQ ID NO: 17050 - RNA, 22 nt, Artificial Sequence
  ELANE RNA Guide
cguugcccaggcagcgucccug

SEQ ID NO: 17051 - RNA, 22 nt, Artificial Sequence
  ELANE RNA Guide
cucagggacgcugccugggcaa

SEQ ID NO: 17052 - RNA, 22 nt, Artificial Sequence
  ELANE RNA Guide
cugcaccccguugcccaggcag

SEQ ID NO: 17053 - RNA, 22 nt, Artificial Sequence
  ELANE RNA Guide
cugccggcucagggacgcugcc

SEQ ID NO: 17054 - RNA, 22 nt, Artificial Sequence
  ELANE RNA Guide
cugccugggcaacggggugcag

SEQ ID NO: 17055 - RNA, 22 nt, Artificial Sequence
  ELANE RNA Guide
gacgcugccugggcaacggggu

SEQ ID NO: 17056 - RNA, 22 nt, Artificial Sequence
  ELANE RNA Guide
gcaccccguugcccaggcagcg

SEQ ID NO: 17057 - RNA, 22 nt, Artificial Sequence
  ELANE RNA Guide
gcagcgucccugagccggcagc

SEQ ID NO: 17058 - RNA, 22 nt, Artificial Sequence
  ELANE RNA Guide
gcccaggcagcgucccugagcc

SEQ ID NO: 17059 - RNA, 22 nt, Artificial Sequence
  ELANE RNA Guide
gccggcucagggacgcugccug

SEQ ID NO: 17060 - RNA, 22 nt, Artificial Sequence
  ELANE RNA Guide
gcucagggacgcugccugggca

SEQ ID NO: 17061 - RNA, 22 nt, Artificial Sequence
  ELANE RNA Guide
gcugccggcucagggacgcugc

SEQ ID NO: 17062 - RNA, 22 nt, Artificial Sequence
  ELANE RNA Guide
gcugccugggcaacggggugca

SEQ ID NO: 17063 - RNA, 22 nt, Artificial Sequence
  ELANE RNA Guide
ggacgcugccugggcaacgggg

SEQ ID NO: 17064 - RNA, 22 nt, Artificial Sequence
  ELANE RNA Guide
ggcacugcaccccguugcccag

SEQ ID NO: 17065 - RNA, 22 nt, Artificial Sequence
  ELANE RNA Guide
ggcagcgucccugagccggcag

SEQ ID NO: 17066 - RNA, 22 nt, Artificial Sequence
  ELANE RNA Guide
ggcucagggacgcugccugggc

SEQ ID NO: 17067 - RNA, 22 nt, Artificial Sequence
  ELANE RNA Guide
gggacgcugccugggcaacggg

SEQ ID NO: 17068 - RNA, 22 nt, Artificial Sequence
  ELANE RNA Guide
guugcccaggcagcgucccuga

SEQ ID NO: 17069 - RNA, 22 nt, Artificial Sequence
  ELANE RNA Guide
ucagggacgcugccugggcaac

SEQ ID NO: 17070 - RNA, 22 nt, Artificial Sequence
  ELANE RNA Guide
ugcaccccguugcccaggcagc

SEQ ID NO: 17071 - RNA, 22 nt, Artificial Sequence
  ELANE RNA Guide
ugcccaggcagcgucccugagc

SEQ ID NO: 17072 - RNA, 22 nt, Artificial Sequence
  ELANE RNA Guide
ugccggcucagggacgcugccu

SEQ ID NO: 17073 - RNA, 22 nt, Artificial Sequence
  ELANE RNA Guide
uugcccaggcagcgucccugag

SEQ ID NO: 17074 - RNA, 20 nt, Artificial Sequence
  ELANE RNA Guide
accccguugcccagguggcg

SEQ ID NO: 17075 - RNA, 20 nt, Artificial Sequence
  ELANE RNA Guide
acgccaccugggcaacgggg

SEQ ID NO: 17076 - RNA, 20 nt, Artificial Sequence
  ELANE RNA Guide
agggacgccaccugggcaac

SEQ ID NO: 17077 - RNA, 20 nt, Artificial Sequence
  ELANE RNA Guide
agguggcgucccugagccgg

SEQ ID NO: 17078 - RNA, 20 nt, Artificial Sequence
  ELANE RNA Guide
caccccguugcccagguggc

SEQ ID NO: 17079 - RNA, 20 nt, Artificial Sequence
  ELANE RNA Guide
caccugggcaacggggugca

SEQ ID NO: 17080 - RNA, 20 nt, Artificial Sequence
  ELANE RNA Guide
cagggacgccaccugggcaa

SEQ ID NO: 17081 - RNA, 20 nt, Artificial Sequence
  ELANE RNA Guide
cagguggcgucccugagccg

SEQ ID NO: 17082 - RNA, 20 nt, Artificial Sequence
  ELANE RNA Guide
ccaccugggcaacggggugc

SEQ ID NO: 17083 - RNA, 20 nt, Artificial Sequence
  ELANE RNA Guide
ccagguggcgucccugagcc

SEQ ID NO: 17084 - RNA, 20 nt, Artificial Sequence
  ELANE RNA Guide
cccagguggcgucccugagc

SEQ ID NO: 17085 - RNA, 20 nt, Artificial Sequence
  ELANE RNA Guide
ccccguugcccagguggcgu

SEQ ID NO: 17086 - RNA, 20 nt, Artificial Sequence
  ELANE RNA Guide
cccguugcccagguggcguc

SEQ ID NO: 17087 - RNA, 20 nt, Artificial Sequence
  ELANE RNA Guide
ccggcucagggacgccaccu

SEQ ID NO: 17088 - RNA, 20 nt, Artificial Sequence
  ELANE RNA Guide
ccguugcccagguggcgucc

SEQ ID NO: 17089 - RNA, 20 nt, Artificial Sequence
  ELANE RNA Guide
cgccaccugggcaacggggu

SEQ ID NO: 17090 - RNA, 20 nt, Artificial Sequence
  ELANE RNA Guide
cggcucagggacgccaccug

SEQ ID NO: 17091 - RNA, 20 nt, Artificial Sequence
  ELANE RNA Guide
cguugcccagguggcguccc

SEQ ID NO: 17092 - RNA, 20 nt, Artificial Sequence
  ELANE RNA Guide
cucagggacgccaccugggc

SEQ ID NO: 17093 - RNA, 20 nt, Artificial Sequence
  ELANE RNA Guide
cugcaccccguugcccaggu

SEQ ID NO: 17094 - RNA, 20 nt, Artificial Sequence
  ELANE RNA Guide
cugccggcucagggacgcca

SEQ ID NO: 17095 - RNA, 20 nt, Artificial Sequence
  ELANE RNA Guide
gacgccaccugggcaacggg

SEQ ID NO: 17096 - RNA, 20 nt, Artificial Sequence
  ELANE RNA Guide
gcaccccguugcccaggugg

SEQ ID NO: 17097 - RNA, 20 nt, Artificial Sequence
  ELANE RNA Guide
gccaccugggcaacggggug

SEQ ID NO: 17098 - RNA, 20 nt, Artificial Sequence
  ELANE RNA Guide
gcccagguggcgucccugag

SEQ ID NO: 17099 - RNA, 20 nt, Artificial Sequence
  ELANE RNA Guide
gccggcucagggacgccacc

SEQ ID NO: 17100 - RNA, 20 nt, Artificial Sequence
  ELANE RNA Guide
gcucagggacgccaccuggg

SEQ ID NO: 17101 - RNA, 20 nt, Artificial Sequence
  ELANE RNA Guide
gcugccggcucagggacgcc

SEQ ID NO: 17102 - RNA, 20 nt, Artificial Sequence
  ELANE RNA Guide
ggacgccaccugggcaacgg

SEQ ID NO: 17103 - RNA, 20 nt, Artificial Sequence
  ELANE RNA Guide
ggcacugcaccccguugccc

SEQ ID NO: 17104 - RNA, 20 nt, Artificial Sequence
  ELANE RNA Guide
ggcucagggacgccaccugg

SEQ ID NO: 17105 - RNA, 20 nt, Artificial Sequence
  ELANE RNA Guide
gggacgccaccugggcaacg

SEQ ID NO: 17106 - RNA, 20 nt, Artificial Sequence
  ELANE RNA Guide
gguggcgucccugagccggc

SEQ ID NO: 17107 - RNA, 20 nt, Artificial Sequence
  ELANE RNA Guide
guggcgucccugagccggca

SEQ ID NO: 17108 - RNA, 20 nt, Artificial Sequence
  ELANE RNA Guide
guugcccagguggcgucccu

SEQ ID NO: 17109 - RNA, 20 nt, Artificial Sequence
  ELANE RNA Guide
ucagggacgccaccugggca

SEQ ID NO: 17110 - RNA, 20 nt, Artificial Sequence
  ELANE RNA Guide
ugcaccccguugcccaggug

SEQ ID NO: 17111 - RNA, 20 nt, Artificial Sequence
  ELANE RNA Guide
ugcccagguggcgucccuga

SEQ ID NO: 17112 - RNA, 20 nt, Artificial Sequence
  ELANE RNA Guide
ugccggcucagggacgccac

SEQ ID NO: 17113 - RNA, 20 nt, Artificial Sequence
  ELANE RNA Guide
uugcccagguggcgucccug

SEQ ID NO: 17114 - RNA, 21 nt, Artificial Sequence
  ELANE RNA Guide
accccguugcccagguggcgu

SEQ ID NO: 17115 - RNA, 21 nt, Artificial Sequence
  ELANE RNA Guide
acgccaccugggcaacggggu

SEQ ID NO: 17116 - RNA, 21 nt, Artificial Sequence
  ELANE RNA Guide
acugcaccccguugcccaggu

SEQ ID NO: 17117 - RNA, 21 nt, Artificial Sequence
  ELANE RNA Guide
agcugccggcucagggacgcc

SEQ ID NO: 17118 - RNA, 21 nt, Artificial Sequence
  ELANE RNA Guide
aggcacugcaccccguugccc

SEQ ID NO: 17119 - RNA, 21 nt, Artificial Sequence
  ELANE RNA Guide
agggacgccaccugggcaacg

SEQ ID NO: 17120 - RNA, 21 nt, Artificial Sequence
  ELANE RNA Guide
agguggcgucccugagccggc

SEQ ID NO: 17121 - RNA, 21 nt, Artificial Sequence
  ELANE RNA Guide
caccccguugcccagguggcg

SEQ ID NO: 17122 - RNA, 21 nt, Artificial Sequence
  ELANE RNA Guide
caccugggcaacggggugcag

SEQ ID NO: 17123 - RNA, 21 nt, Artificial Sequence
  ELANE RNA Guide
cagggacgccaccugggcaac

SEQ ID NO: 17124 - RNA, 21 nt, Artificial Sequence
  ELANE RNA Guide
cagguggcgucccugagccgg

SEQ ID NO: 17125 - RNA, 21 nt, Artificial Sequence
  ELANE RNA Guide
ccaccugggcaacggggugca

SEQ ID NO: 17126 - RNA, 21 nt, Artificial Sequence
  ELANE RNA Guide
ccagguggcgucccugagccg

SEQ ID NO: 17127 - RNA, 21 nt, Artificial Sequence
  ELANE RNA Guide
cccagguggcgucccugagcc

SEQ ID NO: 17128 - RNA, 21 nt, Artificial Sequence
  ELANE RNA Guide
ccccguugcccagguggcguc

SEQ ID NO: 17129 - RNA, 21 nt, Artificial Sequence
  ELANE RNA Guide
cccguugcccagguggcgucc

SEQ ID NO: 17130 - RNA, 21 nt, Artificial Sequence
  ELANE RNA Guide
ccggcucagggacgccaccug

SEQ ID NO: 17131 - RNA, 21 nt, Artificial Sequence
  ELANE RNA Guide
ccguugcccagguggcguccc

SEQ ID NO: 17132 - RNA, 21 nt, Artificial Sequence
  ELANE RNA Guide
cgccaccugggcaacggggug

SEQ ID NO: 17133 - RNA, 21 nt, Artificial Sequence
  ELANE RNA Guide
cggcucagggacgccaccugg

SEQ ID NO: 17134 - RNA, 21 nt, Artificial Sequence
  ELANE RNA Guide
cguugcccagguggcgucccu

SEQ ID NO: 17135 - RNA, 21 nt, Artificial Sequence
  ELANE RNA Guide
cucagggacgccaccugggca

SEQ ID NO: 17136 - RNA, 21 nt, Artificial Sequence
  ELANE RNA Guide
cugcaccccguugcccaggug

SEQ ID NO: 17137 - RNA, 21 nt, Artificial Sequence
  ELANE RNA Guide
cugccggcucagggacgccac

SEQ ID NO: 17138 - RNA, 21 nt, Artificial Sequence
  ELANE RNA Guide
gacgccaccugggcaacgggg

SEQ ID NO: 17139 - RNA, 21 nt, Artificial Sequence
  ELANE RNA Guide
gcaccccguugcccagguggc

SEQ ID NO: 17140 - RNA, 21 nt, Artificial Sequence
  ELANE RNA Guide
gccaccugggcaacggggugc

SEQ ID NO: 17141 - RNA, 21 nt, Artificial Sequence
  ELANE RNA Guide
gcccagguggcgucccugagc

SEQ ID NO: 17142 - RNA, 21 nt, Artificial Sequence
  ELANE RNA Guide
gccggcucagggacgccaccu

SEQ ID NO: 17143 - RNA, 21 nt, Artificial Sequence
  ELANE RNA Guide
gcucagggacgccaccugggc

SEQ ID NO: 17144 - RNA, 21 nt, Artificial Sequence
  ELANE RNA Guide
gcugccggcucagggacgcca

SEQ ID NO: 17145 - RNA, 21 nt, Artificial Sequence
  ELANE RNA Guide
ggacgccaccugggcaacggg

SEQ ID NO: 17146 - RNA, 21 nt, Artificial Sequence
  ELANE RNA Guide
ggcucagggacgccaccuggg

SEQ ID NO: 17147 - RNA, 21 nt, Artificial Sequence
  ELANE RNA Guide
gggacgccaccugggcaacgg

SEQ ID NO: 17148 - RNA, 21 nt, Artificial Sequence
  ELANE RNA Guide
gguggcgucccugagccggca

SEQ ID NO: 17149 - RNA, 21 nt, Artificial Sequence
  ELANE RNA Guide
guggcgucccugagccggcag

SEQ ID NO: 17150 - RNA, 21 nt, Artificial Sequence
  ELANE RNA Guide
guugcccagguggcgucccug

SEQ ID NO: 17151 - RNA, 21 nt, Artificial Sequence
  ELANE RNA Guide
ucagggacgccaccugggcaa

SEQ ID NO: 17152 - RNA, 21 nt, Artificial Sequence
  ELANE RNA Guide
ugcaccccguugcccaggugg

SEQ ID NO: 17153 - RNA, 21 nt, Artificial Sequence
  ELANE RNA Guide
ugcccagguggcgucccugag

SEQ ID NO: 17154 - RNA, 21 nt, Artificial Sequence
  ELANE RNA Guide
ugccggcucagggacgccacc

SEQ ID NO: 17155 - RNA, 21 nt, Artificial Sequence
  ELANE RNA Guide
uugcccagguggcgucccuga

SEQ ID NO: 17156 - RNA, 22 nt, Artificial Sequence
  ELANE RNA Guide
accccguugcccagguggcguc

SEQ ID NO: 17157 - RNA, 22 nt, Artificial Sequence
  ELANE RNA Guide
acgccaccugggcaacggggug

SEQ ID NO: 17158 - RNA, 22 nt, Artificial Sequence
  ELANE RNA Guide
acugcaccccguugcccaggug

SEQ ID NO: 17159 - RNA, 22 nt, Artificial Sequence
  ELANE RNA Guide
agcugccggcucagggacgcca

SEQ ID NO: 17160 - RNA, 22 nt, Artificial Sequence
  ELANE RNA Guide
agggacgccaccugggcaacgg

SEQ ID NO: 17161 - RNA, 22 nt, Artificial Sequence
  ELANE RNA Guide
agguggcgucccugagccggca

SEQ ID NO: 17162 - RNA, 22 nt, Artificial Sequence
  ELANE RNA Guide
caccccguugcccagguggcgu

SEQ ID NO: 17163 - RNA, 22 nt, Artificial Sequence
  ELANE RNA Guide
caccugggcaacggggugcagu

SEQ ID NO: 17164 - RNA, 22 nt, Artificial Sequence
  ELANE RNA Guide
cacugcaccccguugcccaggu

SEQ ID NO: 17165 - RNA, 22 nt, Artificial Sequence
  ELANE RNA Guide
cagcugccggcucagggacgcc

SEQ ID NO: 17166 - RNA, 22 nt, Artificial Sequence
  ELANE RNA Guide
caggcacugcaccccguugccc

SEQ ID NO: 17167 - RNA, 22 nt, Artificial Sequence
  ELANE RNA Guide
cagggacgccaccugggcaacg

SEQ ID NO: 17168 - RNA, 22 nt, Artificial Sequence
  ELANE RNA Guide
cagguggcgucccugagccggc

SEQ ID NO: 17169 - RNA, 22 nt, Artificial Sequence
  ELANE RNA Guide
ccaccugggcaacggggugcag

SEQ ID NO: 17170 - RNA, 22 nt, Artificial Sequence
  ELANE RNA Guide
ccagguggcgucccugagccgg

SEQ ID NO: 17171 - RNA, 22 nt, Artificial Sequence
  ELANE RNA Guide
cccagguggcgucccugagccg

SEQ ID NO: 17172 - RNA, 22 nt, Artificial Sequence
  ELANE RNA Guide
ccccguugcccagguggcgucc

SEQ ID NO: 17173 - RNA, 22 nt, Artificial Sequence
  ELANE RNA Guide
cccguugcccagguggcguccc

SEQ ID NO: 17174 - RNA, 22 nt, Artificial Sequence
  ELANE RNA Guide
ccggcucagggacgccaccugg

SEQ ID NO: 17175 - RNA, 22 nt, Artificial Sequence
  ELANE RNA Guide
ccguugcccagguggcgucccu

SEQ ID NO: 17176 - RNA, 22 nt, Artificial Sequence
  ELANE RNA Guide
cgccaccugggcaacggggugc

SEQ ID NO: 17177 - RNA, 22 nt, Artificial Sequence
  ELANE RNA Guide
cggcucagggacgccaccuggg

SEQ ID NO: 17178 - RNA, 22 nt, Artificial Sequence
  ELANE RNA Guide
cguugcccagguggcgucccug

SEQ ID NO: 17179 - RNA, 22 nt, Artificial Sequence
  ELANE RNA Guide
cucagggacgccaccugggcaa

SEQ ID NO: 17180 - RNA, 22 nt, Artificial Sequence
  ELANE RNA Guide
cugcaccccguugcccaggugg

SEQ ID NO: 17181 - RNA, 22 nt, Artificial Sequence
  ELANE RNA Guide
cugccggcucagggacgccacc

SEQ ID NO: 17182 - RNA, 22 nt, Artificial Sequence
  ELANE RNA Guide
gacgccaccugggcaacggggu

SEQ ID NO: 17183 - RNA, 22 nt, Artificial Sequence
  ELANE RNA Guide
gcaccccguugcccagguggcg

SEQ ID NO: 17184 - RNA, 22 nt, Artificial Sequence
  ELANE RNA Guide
gccaccugggcaacggggugca

SEQ ID NO: 17185 - RNA, 22 nt, Artificial Sequence
  ELANE RNA Guide
gcccagguggcgucccugagcc

SEQ ID NO: 17186 - RNA, 22 nt, Artificial Sequence
  ELANE RNA Guide
gccggcucagggacgccaccug

SEQ ID NO: 17187 - RNA, 22 nt, Artificial Sequence
  ELANE RNA Guide
gcucagggacgccaccugggca

SEQ ID NO: 17188 - RNA, 22 nt, Artificial Sequence
  ELANE RNA Guide
gcugccggcucagggacgccac

SEQ ID NO: 17189 - RNA, 22 nt, Artificial Sequence
  ELANE RNA Guide
ggacgccaccugggcaacgggg

SEQ ID NO: 17190 - RNA, 22 nt, Artificial Sequence
  ELANE RNA Guide
ggcucagggacgccaccugggc

SEQ ID NO: 17191 - RNA, 22 nt, Artificial Sequence
  ELANE RNA Guide
gggacgccaccugggcaacggg

SEQ ID NO: 17192 - RNA, 22 nt, Artificial Sequence
  ELANE RNA Guide
gguggcgucccugagccggcag

SEQ ID NO: 17193 - RNA, 22 nt, Artificial Sequence
  ELANE RNA Guide
guggcgucccugagccggcagc

SEQ ID NO: 17194 - RNA, 22 nt, Artificial Sequence
  ELANE RNA Guide
guugcccagguggcgucccuga

SEQ ID NO: 17195 - RNA, 22 nt, Artificial Sequence
  ELANE RNA Guide
ucagggacgccaccugggcaac

SEQ ID NO: 17196 - RNA, 22 nt, Artificial Sequence
  ELANE RNA Guide
ugcaccccguugcccagguggc

SEQ ID NO: 17197 - RNA, 22 nt, Artificial Sequence
  ELANE RNA Guide
ugcccagguggcgucccugagc

SEQ ID NO: 17198 - RNA, 22 nt, Artificial Sequence
  ELANE RNA Guide
ugccggcucagggacgccaccu

SEQ ID NO: 17199 - RNA, 22 nt, Artificial Sequence
  ELANE RNA Guide
uugcccagguggcgucccugag

SEQ ID NO: 17200 - RNA, 20 nt, Artificial Sequence
  ELANE RNA Guide
accccguuguccaggcggcg

SEQ ID NO: 17201 - RNA, 20 nt, Artificial Sequence
  ELANE RNA Guide
acgccgccuggacaacgggg

SEQ ID NO: 17202 - RNA, 20 nt, Artificial Sequence
  ELANE RNA Guide
acugcaccccguuguccagg

SEQ ID NO: 17203 - RNA, 20 nt, Artificial Sequence
  ELANE RNA Guide
aggcacugcaccccguuguc

SEQ ID NO: 17204 - RNA, 20 nt, Artificial Sequence
  ELANE RNA Guide
agggacgccgccuggacaac

SEQ ID NO: 17205 - RNA, 20 nt, Artificial Sequence
  ELANE RNA Guide
caccccguuguccaggcggc

SEQ ID NO: 17206 - RNA, 20 nt, Artificial Sequence
  ELANE RNA Guide
cacugcaccccguuguccag

SEQ ID NO: 17207 - RNA, 20 nt, Artificial Sequence
  ELANE RNA Guide
caggcacugcaccccguugu

SEQ ID NO: 17208 - RNA, 20 nt, Artificial Sequence
  ELANE RNA Guide
cagggacgccgccuggacaa

SEQ ID NO: 17209 - RNA, 20 nt, Artificial Sequence
  ELANE RNA Guide
ccaggcacugcaccccguug

SEQ ID NO: 17210 - RNA, 20 nt, Artificial Sequence
  ELANE RNA Guide
ccccguuguccaggcggcgu

SEQ ID NO: 17211 - RNA, 20 nt, Artificial Sequence
  ELANE RNA Guide
cccguuguccaggcggcguc

SEQ ID NO: 17212 - RNA, 20 nt, Artificial Sequence
  ELANE RNA Guide
ccgccuggacaacggggugc

SEQ ID NO: 17213 - RNA, 20 nt, Artificial Sequence
  ELANE RNA Guide
ccggcucagggacgccgccu

SEQ ID NO: 17214 - RNA, 20 nt, Artificial Sequence
  ELANE RNA Guide
ccguuguccaggcggcgucc

SEQ ID NO: 17215 - RNA, 20 nt, Artificial Sequence
  ELANE RNA Guide
ccuggacaacggggugcagu

SEQ ID NO: 17216 - RNA, 20 nt, Artificial Sequence
  ELANE RNA Guide
cgccgccuggacaacggggu

SEQ ID NO: 17217 - RNA, 20 nt, Artificial Sequence
  ELANE RNA Guide
cgccuggacaacggggugca

SEQ ID NO: 17218 - RNA, 20 nt, Artificial Sequence
  ELANE RNA Guide
cggcucagggacgccgccug

SEQ ID NO: 17219 - RNA, 20 nt, Artificial Sequence
  ELANE RNA Guide
cguuguccaggcggcguccc

SEQ ID NO: 17220 - RNA, 20 nt, Artificial Sequence
  ELANE RNA Guide
cucagggacgccgccuggac

SEQ ID NO: 17221 - RNA, 20 nt, Artificial Sequence
  ELANE RNA Guide
cugcaccccguuguccaggc

SEQ ID NO: 17222 - RNA, 20 nt, Artificial Sequence
  ELANE RNA Guide
cuggacaacggggugcagug

SEQ ID NO: 17223 - RNA, 20 nt, Artificial Sequence
  ELANE RNA Guide
gacaacggggugcagugccu

SEQ ID NO: 17224 - RNA, 20 nt, Artificial Sequence
  ELANE RNA Guide
gacgccgccuggacaacggg

SEQ ID NO: 17225 - RNA, 20 nt, Artificial Sequence
  ELANE RNA Guide
gcaccccguuguccaggcgg

SEQ ID NO: 17226 - RNA, 20 nt, Artificial Sequence
  ELANE RNA Guide
gcacugcaccccguugucca

SEQ ID NO: 17227 - RNA, 20 nt, Artificial Sequence
  ELANE RNA Guide
gccaggcacugcaccccguu

SEQ ID NO: 17228 - RNA, 20 nt, Artificial Sequence
  ELANE RNA Guide
gccgccuggacaacggggug

SEQ ID NO: 17229 - RNA, 20 nt, Artificial Sequence
  ELANE RNA Guide
gccuggacaacggggugcag

SEQ ID NO: 17230 - RNA, 20 nt, Artificial Sequence
  ELANE RNA Guide
gcucagggacgccgccugga

SEQ ID NO: 17231 - RNA, 20 nt, Artificial Sequence
  ELANE RNA Guide
ggacaacggggugcagugcc

SEQ ID NO: 17232 - RNA, 20 nt, Artificial Sequence
  ELANE RNA Guide
ggacgccgccuggacaacgg

SEQ ID NO: 17233 - RNA, 20 nt, Artificial Sequence
  ELANE RNA Guide
ggcacugcaccccguugucc

SEQ ID NO: 17234 - RNA, 20 nt, Artificial Sequence
  ELANE RNA Guide
ggccaggcacugcaccccgu

SEQ ID NO: 17235 - RNA, 20 nt, Artificial Sequence
  ELANE RNA Guide
ggcucagggacgccgccugg

SEQ ID NO: 17236 - RNA, 20 nt, Artificial Sequence
  ELANE RNA Guide
gggacgccgccuggacaacg

SEQ ID NO: 17237 - RNA, 20 nt, Artificial Sequence
  ELANE RNA Guide
guccaggcggcgucccugag

SEQ ID NO: 17238 - RNA, 20 nt, Artificial Sequence
  ELANE RNA Guide
guuguccaggcggcgucccu

SEQ ID NO: 17239 - RNA, 20 nt, Artificial Sequence
  ELANE RNA Guide
ucagggacgccgccuggaca

SEQ ID NO: 17240 - RNA, 20 nt, Artificial Sequence
  ELANE RNA Guide
ugcaccccguuguccaggcg

SEQ ID NO: 17241 - RNA, 20 nt, Artificial Sequence
  ELANE RNA Guide
uggacaacggggugcagugc

SEQ ID NO: 17242 - RNA, 20 nt, Artificial Sequence
  ELANE RNA Guide
uggccaggcacugcaccccg

SEQ ID NO: 17243 - RNA, 20 nt, Artificial Sequence
  ELANE RNA Guide
uguccaggcggcgucccuga

SEQ ID NO: 17244 - RNA, 20 nt, Artificial Sequence
  ELANE RNA Guide
uuguccaggcggcgucccug

SEQ ID NO: 17245 - RNA, 21 nt, Artificial Sequence
  ELANE RNA Guide
accccguuguccaggcggcgu

SEQ ID NO: 17246 - RNA, 21 nt, Artificial Sequence
  ELANE RNA Guide
acgccgccuggacaacggggu

SEQ ID NO: 17247 - RNA, 21 nt, Artificial Sequence
  ELANE RNA Guide
acugcaccccguuguccaggc

SEQ ID NO: 17248 - RNA, 21 nt, Artificial Sequence
  ELANE RNA Guide
aggcacugcaccccguugucc

SEQ ID NO: 17249 - RNA, 21 nt, Artificial Sequence
  ELANE RNA Guide
agggacgccgccuggacaacg

SEQ ID NO: 17250 - RNA, 21 nt, Artificial Sequence
  ELANE RNA Guide
auggccaggcacugcaccccg

SEQ ID NO: 17251 - RNA, 21 nt, Artificial Sequence
  ELANE RNA Guide
caccccguuguccaggcggcg

SEQ ID NO: 17252 - RNA, 21 nt, Artificial Sequence
  ELANE RNA Guide
cacugcaccccguuguccagg

SEQ ID NO: 17253 - RNA, 21 nt, Artificial Sequence
  ELANE RNA Guide
caggcacugcaccccguuguc

SEQ ID NO: 17254 - RNA, 21 nt, Artificial Sequence
  ELANE RNA Guide
cagggacgccgccuggacaac

SEQ ID NO: 17255 - RNA, 21 nt, Artificial Sequence
  ELANE RNA Guide
ccaggcacugcaccccguugu

SEQ ID NO: 17256 - RNA, 21 nt, Artificial Sequence
  ELANE RNA Guide
ccccguuguccaggcggcguc

SEQ ID NO: 17257 - RNA, 21 nt, Artificial Sequence
  ELANE RNA Guide
cccguuguccaggcggcgucc

SEQ ID NO: 17258 - RNA, 21 nt, Artificial Sequence
  ELANE RNA Guide
ccgccuggacaacggggugca

SEQ ID NO: 17259 - RNA, 21 nt, Artificial Sequence
  ELANE RNA Guide
ccguuguccaggcggcguccc

SEQ ID NO: 17260 - RNA, 21 nt, Artificial Sequence
  ELANE RNA Guide
ccuggacaacggggugcagug

SEQ ID NO: 17261 - RNA, 21 nt, Artificial Sequence
  ELANE RNA Guide
cgccgccuggacaacggggug

SEQ ID NO: 17262 - RNA, 21 nt, Artificial Sequence
  ELANE RNA Guide
cgccuggacaacggggugcag

SEQ ID NO: 17263 - RNA, 21 nt, Artificial Sequence
  ELANE RNA Guide
cguuguccaggcggcgucccu

SEQ ID NO: 17264 - RNA, 21 nt, Artificial Sequence
  ELANE RNA Guide
cucagggacgccgccuggaca

SEQ ID NO: 17265 - RNA, 21 nt, Artificial Sequence
  ELANE RNA Guide
cugcaccccguuguccaggcg

SEQ ID NO: 17266 - RNA, 21 nt, Artificial Sequence
  ELANE RNA Guide
cuggacaacggggugcagugc

SEQ ID NO: 17267 - RNA, 21 nt, Artificial Sequence
  ELANE RNA Guide
gacaacggggugcagugccug

SEQ ID NO: 17268 - RNA, 21 nt, Artificial Sequence
  ELANE RNA Guide
gacgccgccuggacaacgggg

SEQ ID NO: 17269 - RNA, 21 nt, Artificial Sequence
  ELANE RNA Guide
gcaccccguuguccaggcggc

SEQ ID NO: 17270 - RNA, 21 nt, Artificial Sequence
  ELANE RNA Guide
gcacugcaccccguuguccag

SEQ ID NO: 17271 - RNA, 21 nt, Artificial Sequence
  ELANE RNA Guide
gccaggcacugcaccccguug

SEQ ID NO: 17272 - RNA, 21 nt, Artificial Sequence
  ELANE RNA Guide
gccgccuggacaacggggugc

SEQ ID NO: 17273 - RNA, 21 nt, Artificial Sequence
  ELANE RNA Guide
gccuggacaacggggugcagu

SEQ ID NO: 17274 - RNA, 21 nt, Artificial Sequence
  ELANE RNA Guide
gcucagggacgccgccuggac

SEQ ID NO: 17275 - RNA, 21 nt, Artificial Sequence
  ELANE RNA Guide
ggacaacggggugcagugccu

SEQ ID NO: 17276 - RNA, 21 nt, Artificial Sequence
  ELANE RNA Guide
ggacgccgccuggacaacggg

SEQ ID NO: 17277 - RNA, 21 nt, Artificial Sequence
  ELANE RNA Guide
ggcacugcaccccguugucca

SEQ ID NO: 17278 - RNA, 21 nt, Artificial Sequence
  ELANE RNA Guide
ggccaggcacugcaccccguu

SEQ ID NO: 17279 - RNA, 21 nt, Artificial Sequence
  ELANE RNA Guide
ggcucagggacgccgccugga

SEQ ID NO: 17280 - RNA, 21 nt, Artificial Sequence
  ELANE RNA Guide
gggacgccgccuggacaacgg

SEQ ID NO: 17281 - RNA, 21 nt, Artificial Sequence
  ELANE RNA Guide
guccaggcggcgucccugagc

SEQ ID NO: 17282 - RNA, 21 nt, Artificial Sequence
  ELANE RNA Guide
guuguccaggcggcgucccug

SEQ ID NO: 17283 - RNA, 21 nt, Artificial Sequence
  ELANE RNA Guide
ucagggacgccgccuggacaa

SEQ ID NO: 17284 - RNA, 21 nt, Artificial Sequence
  ELANE RNA Guide
ugcaccccguuguccaggcgg

SEQ ID NO: 17285 - RNA, 21 nt, Artificial Sequence
  ELANE RNA Guide
uggacaacggggugcagugcc

SEQ ID NO: 17286 - RNA, 21 nt, Artificial Sequence
  ELANE RNA Guide
uggccaggcacugcaccccgu

SEQ ID NO: 17287 - RNA, 21 nt, Artificial Sequence
  ELANE RNA Guide
uguccaggcggcgucccugag

SEQ ID NO: 17288 - RNA, 21 nt, Artificial Sequence
  ELANE RNA Guide
uuguccaggcggcgucccuga

SEQ ID NO: 17289 - RNA, 22 nt, Artificial Sequence
  ELANE RNA Guide
accccguuguccaggcggcguc

SEQ ID NO: 17290 - RNA, 22 nt, Artificial Sequence
  ELANE RNA Guide
acgccgccuggacaacggggug

SEQ ID NO: 17291 - RNA, 22 nt, Artificial Sequence
  ELANE RNA Guide
acugcaccccguuguccaggcg

SEQ ID NO: 17292 - RNA, 22 nt, Artificial Sequence
  ELANE RNA Guide
aggcacugcaccccguugucca

SEQ ID NO: 17293 - RNA, 22 nt, Artificial Sequence
  ELANE RNA Guide
agggacgccgccuggacaacgg

SEQ ID NO: 17294 - RNA, 22 nt, Artificial Sequence
  ELANE RNA Guide
auggccaggcacugcaccccgu

SEQ ID NO: 17295 - RNA, 22 nt, Artificial Sequence
  ELANE RNA Guide
caccccguuguccaggcggcgu

SEQ ID NO: 17296 - RNA, 22 nt, Artificial Sequence
  ELANE RNA Guide
cacugcaccccguuguccaggc

SEQ ID NO: 17297 - RNA, 22 nt, Artificial Sequence
  ELANE RNA Guide
caggcacugcaccccguugucc

SEQ ID NO: 17298 - RNA, 22 nt, Artificial Sequence
  ELANE RNA Guide
cagggacgccgccuggacaacg

SEQ ID NO: 17299 - RNA, 22 nt, Artificial Sequence
  ELANE RNA Guide
cauggccaggcacugcaccccg

SEQ ID NO: 17300 - RNA, 22 nt, Artificial Sequence
  ELANE RNA Guide
ccaggcacugcaccccguuguc

SEQ ID NO: 17301 - RNA, 22 nt, Artificial Sequence
  ELANE RNA Guide
ccccguuguccaggcggcgucc

SEQ ID NO: 17302 - RNA, 22 nt, Artificial Sequence
  ELANE RNA Guide
cccguuguccaggcggcguccc

SEQ ID NO: 17303 - RNA, 22 nt, Artificial Sequence
  ELANE RNA Guide
ccgccuggacaacggggugcag

SEQ ID NO: 17304 - RNA, 22 nt, Artificial Sequence
  ELANE RNA Guide
ccguuguccaggcggcgucccu

SEQ ID NO: 17305 - RNA, 22 nt, Artificial Sequence
  ELANE RNA Guide
ccuggacaacggggugcagugc

SEQ ID NO: 17306 - RNA, 22 nt, Artificial Sequence
  ELANE RNA Guide
cgccgccuggacaacggggugc

SEQ ID NO: 17307 - RNA, 22 nt, Artificial Sequence
  ELANE RNA Guide
cgccuggacaacggggugcagu

SEQ ID NO: 17308 - RNA, 22 nt, Artificial Sequence
  ELANE RNA Guide
cggcucagggacgccgccugga

SEQ ID NO: 17309 - RNA, 22 nt, Artificial Sequence
  ELANE RNA Guide
cguuguccaggcggcgucccug

SEQ ID NO: 17310 - RNA, 22 nt, Artificial Sequence
  ELANE RNA Guide
cucagggacgccgccuggacaa

SEQ ID NO: 17311 - RNA, 22 nt, Artificial Sequence
  ELANE RNA Guide
cugcaccccguuguccaggcgg

SEQ ID NO: 17312 - RNA, 22 nt, Artificial Sequence
  ELANE RNA Guide
cuggacaacggggugcagugcc

SEQ ID NO: 17313 - RNA, 22 nt, Artificial Sequence
  ELANE RNA Guide
gacaacggggugcagugccugg

SEQ ID NO: 17314 - RNA, 22 nt, Artificial Sequence
  ELANE RNA Guide
gacgccgccuggacaacggggu

SEQ ID NO: 17315 - RNA, 22 nt, Artificial Sequence
  ELANE RNA Guide
gcaccccguuguccaggcggcg

SEQ ID NO: 17316 - RNA, 22 nt, Artificial Sequence
  ELANE RNA Guide
gcacugcaccccguuguccagg

SEQ ID NO: 17317 - RNA, 22 nt, Artificial Sequence
  ELANE RNA Guide
gccaggcacugcaccccguugu

SEQ ID NO: 17318 - RNA, 22 nt, Artificial Sequence
  ELANE RNA Guide
gccgccuggacaacggggugca

SEQ ID NO: 17319 - RNA, 22 nt, Artificial Sequence
  ELANE RNA Guide
gccuggacaacggggugcagug

SEQ ID NO: 17320 - RNA, 22 nt, Artificial Sequence
  ELANE RNA Guide
gcucagggacgccgccuggaca

SEQ ID NO: 17321 - RNA, 22 nt, Artificial Sequence
  ELANE RNA Guide
ggacaacggggugcagugccug

SEQ ID NO: 17322 - RNA, 22 nt, Artificial Sequence
  ELANE RNA Guide
ggacgccgccuggacaacgggg

SEQ ID NO: 17323 - RNA, 22 nt, Artificial Sequence
  ELANE RNA Guide
ggcacugcaccccguuguccag

SEQ ID NO: 17324 - RNA, 22 nt, Artificial Sequence
  ELANE RNA Guide
ggccaggcacugcaccccguug

SEQ ID NO: 17325 - RNA, 22 nt, Artificial Sequence
  ELANE RNA Guide
ggcucagggacgccgccuggac

SEQ ID NO: 17326 - RNA, 22 nt, Artificial Sequence
  ELANE RNA Guide
gggacgccgccuggacaacggg

SEQ ID NO: 17327 - RNA, 22 nt, Artificial Sequence
  ELANE RNA Guide
guccaggcggcgucccugagcc

SEQ ID NO: 17328 - RNA, 22 nt, Artificial Sequence
  ELANE RNA Guide
guuguccaggcggcgucccuga

SEQ ID NO: 17329 - RNA, 22 nt, Artificial Sequence
  ELANE RNA Guide
ucagggacgccgccuggacaac

SEQ ID NO: 17330 - RNA, 22 nt, Artificial Sequence
  ELANE RNA Guide
ugcaccccguuguccaggcggc

SEQ ID NO: 17331 - RNA, 22 nt, Artificial Sequence
  ELANE RNA Guide
ugccggcucagggacgccgccu

SEQ ID NO: 17332 - RNA, 22 nt, Artificial Sequence
  ELANE RNA Guide
uggacaacggggugcagugccu

SEQ ID NO: 17333 - RNA, 22 nt, Artificial Sequence
  ELANE RNA Guide
uggccaggcacugcaccccguu

SEQ ID NO: 17334 - RNA, 22 nt, Artificial Sequence
  ELANE RNA Guide
uguccaggcggcgucccugagc

SEQ ID NO: 17335 - RNA, 22 nt, Artificial Sequence
  ELANE RNA Guide
uuguccaggcggcgucccugag

SEQ ID NO: 17336 - RNA, 20 nt, Artificial Sequence
  ELANE RNA Guide
aacagggugcagugccuggc

SEQ ID NO: 17337 - RNA, 20 nt, Artificial Sequence
  ELANE RNA Guide
acagggugcagugccuggcc

SEQ ID NO: 17338 - RNA, 20 nt, Artificial Sequence
  ELANE RNA Guide
acccuguugcccaggcggcg

SEQ ID NO: 17339 - RNA, 20 nt, Artificial Sequence
  ELANE RNA Guide
acgccgccugggcaacaggg

SEQ ID NO: 17340 - RNA, 20 nt, Artificial Sequence
  ELANE RNA Guide
acugcacccuguugcccagg

SEQ ID NO: 17341 - RNA, 20 nt, Artificial Sequence
  ELANE RNA Guide
aggcacugcacccuguugcc

SEQ ID NO: 17342 - RNA, 20 nt, Artificial Sequence
  ELANE RNA Guide
agggacgccgccugggcaac

SEQ ID NO: 17343 - RNA, 20 nt, Artificial Sequence
  ELANE RNA Guide
auggccaggcacugcacccu

SEQ ID NO: 17344 - RNA, 20 nt, Artificial Sequence
  ELANE RNA Guide
caacagggugcagugccugg

SEQ ID NO: 17345 - RNA, 20 nt, Artificial Sequence
  ELANE RNA Guide
cacccuguugcccaggcggc

SEQ ID NO: 17346 - RNA, 20 nt, Artificial Sequence
  ELANE RNA Guide
cacugcacccuguugcccag

SEQ ID NO: 17347 - RNA, 20 nt, Artificial Sequence
  ELANE RNA Guide
caggcacugcacccuguugc

SEQ ID NO: 17348 - RNA, 20 nt, Artificial Sequence
  ELANE RNA Guide
cagggacgccgccugggcaa

SEQ ID NO: 17349 - RNA, 20 nt, Artificial Sequence
  ELANE RNA Guide
cagggugcagugccuggcca

SEQ ID NO: 17350 - RNA, 20 nt, Artificial Sequence
  ELANE RNA Guide
cauggccaggcacugcaccc

SEQ ID NO: 17351 - RNA, 20 nt, Artificial Sequence
  ELANE RNA Guide
ccaggcacugcacccuguug

SEQ ID NO: 17352 - RNA, 20 nt, Artificial Sequence
  ELANE RNA Guide
ccauggccaggcacugcacc

SEQ ID NO: 17353 - RNA, 20 nt, Artificial Sequence
  ELANE RNA Guide
cccauggccaggcacugcac

SEQ ID NO: 17354 - RNA, 20 nt, Artificial Sequence
  ELANE RNA Guide
cccuguugcccaggcggcgu

SEQ ID NO: 17355 - RNA, 20 nt, Artificial Sequence
  ELANE RNA Guide
ccgccugggcaacagggugc

SEQ ID NO: 17356 - RNA, 20 nt, Artificial Sequence
  ELANE RNA Guide
ccugggcaacagggugcagu

SEQ ID NO: 17357 - RNA, 20 nt, Artificial Sequence
  ELANE RNA Guide
ccuguugcccaggcggcguc

SEQ ID NO: 17358 - RNA, 20 nt, Artificial Sequence
  ELANE RNA Guide
cgccgccugggcaacagggu

SEQ ID NO: 17359 - RNA, 20 nt, Artificial Sequence
  ELANE RNA Guide
cgccugggcaacagggugca

SEQ ID NO: 17360 - RNA, 20 nt, Artificial Sequence
  ELANE RNA Guide
cucagggacgccgccugggc

SEQ ID NO: 17361 - RNA, 20 nt, Artificial Sequence
  ELANE RNA Guide
cugcacccuguugcccaggc

SEQ ID NO: 17362 - RNA, 20 nt, Artificial Sequence
  ELANE RNA Guide
cugggcaacagggugcagug

SEQ ID NO: 17363 - RNA, 20 nt, Artificial Sequence
  ELANE RNA Guide
cuguugcccaggcggcgucc

SEQ ID NO: 17364 - RNA, 20 nt, Artificial Sequence
  ELANE RNA Guide
gacgccgccugggcaacagg

SEQ ID NO: 17365 - RNA, 20 nt, Artificial Sequence
  ELANE RNA Guide
gcaacagggugcagugccug

SEQ ID NO: 17366 - RNA, 20 nt, Artificial Sequence
  ELANE RNA Guide
gcacccuguugcccaggcgg

SEQ ID NO: 17367 - RNA, 20 nt, Artificial Sequence
  ELANE RNA Guide
gcacugcacccuguugccca

SEQ ID NO: 17368 - RNA, 20 nt, Artificial Sequence
  ELANE RNA Guide
gccaggcacugcacccuguu

SEQ ID NO: 17369 - RNA, 20 nt, Artificial Sequence
  ELANE RNA Guide
gcccauggccaggcacugca

SEQ ID NO: 17370 - RNA, 20 nt, Artificial Sequence
  ELANE RNA Guide
gccgccugggcaacagggug

SEQ ID NO: 17371 - RNA, 20 nt, Artificial Sequence
  ELANE RNA Guide
gccugggcaacagggugcag

SEQ ID NO: 17372 - RNA, 20 nt, Artificial Sequence
  ELANE RNA Guide
ggacgccgccugggcaacag

SEQ ID NO: 17373 - RNA, 20 nt, Artificial Sequence
  ELANE RNA Guide
ggcaacagggugcagugccu

SEQ ID NO: 17374 - RNA, 20 nt, Artificial Sequence
  ELANE RNA Guide
ggcacugcacccuguugccc

SEQ ID NO: 17375 - RNA, 20 nt, Artificial Sequence
  ELANE RNA Guide
ggccaggcacugcacccugu

SEQ ID NO: 17376 - RNA, 20 nt, Artificial Sequence
  ELANE RNA Guide
gggacgccgccugggcaaca

SEQ ID NO: 17377 - RNA, 20 nt, Artificial Sequence
  ELANE RNA Guide
gggcaacagggugcagugcc

SEQ ID NO: 17378 - RNA, 20 nt, Artificial Sequence
  ELANE RNA Guide
ucagggacgccgccugggca

SEQ ID NO: 17379 - RNA, 20 nt, Artificial Sequence
  ELANE RNA Guide
ugcacccuguugcccaggcg

SEQ ID NO: 17380 - RNA, 20 nt, Artificial Sequence
  ELANE RNA Guide
uggccaggcacugcacccug

SEQ ID NO: 17381 - RNA, 20 nt, Artificial Sequence
  ELANE RNA Guide
ugggcaacagggugcagugc

SEQ ID NO: 17382 - RNA, 21 nt, Artificial Sequence
  ELANE RNA Guide
aacagggugcagugccuggcc

SEQ ID NO: 17383 - RNA, 21 nt, Artificial Sequence
  ELANE RNA Guide
acagggugcagugccuggcca

SEQ ID NO: 17384 - RNA, 21 nt, Artificial Sequence
  ELANE RNA Guide
acccuguugcccaggcggcgu

SEQ ID NO: 17385 - RNA, 21 nt, Artificial Sequence
  ELANE RNA Guide
acgccgccugggcaacagggu

SEQ ID NO: 17386 - RNA, 21 nt, Artificial Sequence
  ELANE RNA Guide
acugcacccuguugcccaggc

SEQ ID NO: 17387 - RNA, 21 nt, Artificial Sequence
  ELANE RNA Guide
agcccauggccaggcacugca

SEQ ID NO: 17388 - RNA, 21 nt, Artificial Sequence
  ELANE RNA Guide
aggcacugcacccuguugccc

SEQ ID NO: 17389 - RNA, 21 nt, Artificial Sequence
  ELANE RNA Guide
agggacgccgccugggcaaca

SEQ ID NO: 17390 - RNA, 21 nt, Artificial Sequence
  ELANE RNA Guide
auggccaggcacugcacccug

SEQ ID NO: 17391 - RNA, 21 nt, Artificial Sequence
  ELANE RNA Guide
caacagggugcagugccuggc

SEQ ID NO: 17392 - RNA, 21 nt, Artificial Sequence
  ELANE RNA Guide
cacccuguugcccaggcggcg

SEQ ID NO: 17393 - RNA, 21 nt, Artificial Sequence
  ELANE RNA Guide
cacugcacccuguugcccagg

SEQ ID NO: 17394 - RNA, 21 nt, Artificial Sequence
  ELANE RNA Guide
caggcacugcacccuguugcc

SEQ ID NO: 17395 - RNA, 21 nt, Artificial Sequence
  ELANE RNA Guide
cagggacgccgccugggcaac

SEQ ID NO: 17396 - RNA, 21 nt, Artificial Sequence
  ELANE RNA Guide
cagggugcagugccuggccau

SEQ ID NO: 17397 - RNA, 21 nt, Artificial Sequence
  ELANE RNA Guide
cauggccaggcacugcacccu

SEQ ID NO: 17398 - RNA, 21 nt, Artificial Sequence
  ELANE RNA Guide
ccaggcacugcacccuguugc

SEQ ID NO: 17399 - RNA, 21 nt, Artificial Sequence
  ELANE RNA Guide
ccauggccaggcacugcaccc

SEQ ID NO: 17400 - RNA, 21 nt, Artificial Sequence
  ELANE RNA Guide
cccauggccaggcacugcacc

SEQ ID NO: 17401 - RNA, 21 nt, Artificial Sequence
  ELANE RNA Guide
cccuguugcccaggcggcguc

SEQ ID NO: 17402 - RNA, 21 nt, Artificial Sequence
  ELANE RNA Guide
ccgccugggcaacagggugca

SEQ ID NO: 17403 - RNA, 21 nt, Artificial Sequence
  ELANE RNA Guide
ccugggcaacagggugcagug

SEQ ID NO: 17404 - RNA, 21 nt, Artificial Sequence
  ELANE RNA Guide
ccuguugcccaggcggcgucc

SEQ ID NO: 17405 - RNA, 21 nt, Artificial Sequence
  ELANE RNA Guide
cgccgccugggcaacagggug

SEQ ID NO: 17406 - RNA, 21 nt, Artificial Sequence
  ELANE RNA Guide
cgccugggcaacagggugcag

SEQ ID NO: 17407 - RNA, 21 nt, Artificial Sequence
  ELANE RNA Guide
cucagggacgccgccugggca

SEQ ID NO: 17408 - RNA, 21 nt, Artificial Sequence
  ELANE RNA Guide
cugcacccuguugcccaggcg

SEQ ID NO: 17409 - RNA, 21 nt, Artificial Sequence
  ELANE RNA Guide
cugggcaacagggugcagugc

SEQ ID NO: 17410 - RNA, 21 nt, Artificial Sequence
  ELANE RNA Guide
cuguugcccaggcggcguccc

SEQ ID NO: 17411 - RNA, 21 nt, Artificial Sequence
  ELANE RNA Guide
gacgccgccugggcaacaggg

SEQ ID NO: 17412 - RNA, 21 nt, Artificial Sequence
  ELANE RNA Guide
gcaacagggugcagugccugg

SEQ ID NO: 17413 - RNA, 21 nt, Artificial Sequence
  ELANE RNA Guide
gcacccuguugcccaggcggc

SEQ ID NO: 17414 - RNA, 21 nt, Artificial Sequence
  ELANE RNA Guide
gcacugcacccuguugcccag

SEQ ID NO: 17415 - RNA, 21 nt, Artificial Sequence
  ELANE RNA Guide
gccaggcacugcacccuguug

SEQ ID NO: 17416 - RNA, 21 nt, Artificial Sequence
  ELANE RNA Guide
gcccauggccaggcacugcac

SEQ ID NO: 17417 - RNA, 21 nt, Artificial Sequence
  ELANE RNA Guide
gccgccugggcaacagggugc

SEQ ID NO: 17418 - RNA, 21 nt, Artificial Sequence
  ELANE RNA Guide
gccugggcaacagggugcagu

SEQ ID NO: 17419 - RNA, 21 nt, Artificial Sequence
  ELANE RNA Guide
ggacgccgccugggcaacagg

SEQ ID NO: 17420 - RNA, 21 nt, Artificial Sequence
  ELANE RNA Guide
ggcaacagggugcagugccug

SEQ ID NO: 17421 - RNA, 21 nt, Artificial Sequence
  ELANE RNA Guide
ggcacugcacccuguugccca

SEQ ID NO: 17422 - RNA, 21 nt, Artificial Sequence
  ELANE RNA Guide
ggccaggcacugcacccuguu

SEQ ID NO: 17423 - RNA, 21 nt, Artificial Sequence
  ELANE RNA Guide
gggacgccgccugggcaacag

SEQ ID NO: 17424 - RNA, 21 nt, Artificial Sequence
  ELANE RNA Guide
gggcaacagggugcagugccu

SEQ ID NO: 17425 - RNA, 21 nt, Artificial Sequence
  ELANE RNA Guide
ucagggacgccgccugggcaa

SEQ ID NO: 17426 - RNA, 21 nt, Artificial Sequence
  ELANE RNA Guide
ugcacccuguugcccaggcgg

SEQ ID NO: 17427 - RNA, 21 nt, Artificial Sequence
  ELANE RNA Guide
uggccaggcacugcacccugu

SEQ ID NO: 17428 - RNA, 21 nt, Artificial Sequence
  ELANE RNA Guide
ugggcaacagggugcagugcc

SEQ ID NO: 17429 - RNA, 22 nt, Artificial Sequence
  ELANE RNA Guide
aacagggugcagugccuggcca

SEQ ID NO: 17430 - RNA, 22 nt, Artificial Sequence
  ELANE RNA Guide
acagggugcagugccuggccau

SEQ ID NO: 17431 - RNA, 22 nt, Artificial Sequence
  ELANE RNA Guide
acccuguugcccaggcggcguc

SEQ ID NO: 17432 - RNA, 22 nt, Artificial Sequence
  ELANE RNA Guide
acgccgccugggcaacagggug

SEQ ID NO: 17433 - RNA, 22 nt, Artificial Sequence
  ELANE RNA Guide
acugcacccuguugcccaggcg

SEQ ID NO: 17434 - RNA, 22 nt, Artificial Sequence
  ELANE RNA Guide
agcccauggccaggcacugcac

SEQ ID NO: 17435 - RNA, 22 nt, Artificial Sequence
  ELANE RNA Guide
aggcacugcacccuguugccca

SEQ ID NO: 17436 - RNA, 22 nt, Artificial Sequence
  ELANE RNA Guide
agggacgccgccugggcaacag

SEQ ID NO: 17437 - RNA, 22 nt, Artificial Sequence
  ELANE RNA Guide
auggccaggcacugcacccugu

SEQ ID NO: 17438 - RNA, 22 nt, Artificial Sequence
  ELANE RNA Guide
caacagggugcagugccuggcc

SEQ ID NO: 17439 - RNA, 22 nt, Artificial Sequence
  ELANE RNA Guide
cacccuguugcccaggcggcgu

SEQ ID NO: 17440 - RNA, 22 nt, Artificial Sequence
  ELANE RNA Guide
cacugcacccuguugcccaggc

SEQ ID NO: 17441 - RNA, 22 nt, Artificial Sequence
  ELANE RNA Guide
cagcccauggccaggcacugca

SEQ ID NO: 17442 - RNA, 22 nt, Artificial Sequence
  ELANE RNA Guide
caggcacugcacccuguugccc

SEQ ID NO: 17443 - RNA, 22 nt, Artificial Sequence
  ELANE RNA Guide
cagggacgccgccugggcaaca

SEQ ID NO: 17444 - RNA, 22 nt, Artificial Sequence
  ELANE RNA Guide
cagggugcagugccuggccaug

SEQ ID NO: 17445 - RNA, 22 nt, Artificial Sequence
  ELANE RNA Guide
cauggccaggcacugcacccug

SEQ ID NO: 17446 - RNA, 22 nt, Artificial Sequence
  ELANE RNA Guide
ccaggcacugcacccuguugcc

SEQ ID NO: 17447 - RNA, 22 nt, Artificial Sequence
  ELANE RNA Guide
ccauggccaggcacugcacccu

SEQ ID NO: 17448 - RNA, 22 nt, Artificial Sequence
  ELANE RNA Guide
cccauggccaggcacugcaccc

SEQ ID NO: 17449 - RNA, 22 nt, Artificial Sequence
  ELANE RNA Guide
cccuguugcccaggcggcgucc

SEQ ID NO: 17450 - RNA, 22 nt, Artificial Sequence
  ELANE RNA Guide
ccgccugggcaacagggugcag

SEQ ID NO: 17451 - RNA, 22 nt, Artificial Sequence
  ELANE RNA Guide
ccugggcaacagggugcagugc

SEQ ID NO: 17452 - RNA, 22 nt, Artificial Sequence
  ELANE RNA Guide
ccuguugcccaggcggcguccc

SEQ ID NO: 17453 - RNA, 22 nt, Artificial Sequence
  ELANE RNA Guide
cgccgccugggcaacagggugc

SEQ ID NO: 17454 - RNA, 22 nt, Artificial Sequence
  ELANE RNA Guide
cgccugggcaacagggugcagu

SEQ ID NO: 17455 - RNA, 22 nt, Artificial Sequence
  ELANE RNA Guide
cucagggacgccgccugggcaa

SEQ ID NO: 17456 - RNA, 22 nt, Artificial Sequence
  ELANE RNA Guide
cugcacccuguugcccaggcgg

SEQ ID NO: 17457 - RNA, 22 nt, Artificial Sequence
  ELANE RNA Guide
cugggcaacagggugcagugcc

SEQ ID NO: 17458 - RNA, 22 nt, Artificial Sequence
  ELANE RNA Guide
cuguugcccaggcggcgucccu

SEQ ID NO: 17459 - RNA, 22 nt, Artificial Sequence
  ELANE RNA Guide
gacgccgccugggcaacagggu

SEQ ID NO: 17460 - RNA, 22 nt, Artificial Sequence
  ELANE RNA Guide
gcaacagggugcagugccuggc

SEQ ID NO: 17461 - RNA, 22 nt, Artificial Sequence
  ELANE RNA Guide
gcacccuguugcccaggcggcg

SEQ ID NO: 17462 - RNA, 22 nt, Artificial Sequence
  ELANE RNA Guide
gcacugcacccuguugcccagg

SEQ ID NO: 17463 - RNA, 22 nt, Artificial Sequence
  ELANE RNA Guide
gccaggcacugcacccuguugc

SEQ ID NO: 17464 - RNA, 22 nt, Artificial Sequence
  ELANE RNA Guide
gcccauggccaggcacugcacc

SEQ ID NO: 17465 - RNA, 22 nt, Artificial Sequence
  ELANE RNA Guide
gccgccugggcaacagggugca

SEQ ID NO: 17466 - RNA, 22 nt, Artificial Sequence
  ELANE RNA Guide
gccugggcaacagggugcagug

SEQ ID NO: 17467 - RNA, 22 nt, Artificial Sequence
  ELANE RNA Guide
gcucagggacgccgccugggca

SEQ ID NO: 17468 - RNA, 22 nt, Artificial Sequence
  ELANE RNA Guide
ggacgccgccugggcaacaggg

SEQ ID NO: 17469 - RNA, 22 nt, Artificial Sequence
  ELANE RNA Guide
ggcaacagggugcagugccugg

SEQ ID NO: 17470 - RNA, 22 nt, Artificial Sequence
  ELANE RNA Guide
ggcacugcacccuguugcccag

SEQ ID NO: 17471 - RNA, 22 nt, Artificial Sequence
  ELANE RNA Guide
ggccaggcacugcacccuguug

SEQ ID NO: 17472 - RNA, 22 nt, Artificial Sequence
  ELANE RNA Guide
gggacgccgccugggcaacagg

SEQ ID NO: 17473 - RNA, 22 nt, Artificial Sequence
  ELANE RNA Guide
gggcaacagggugcagugccug

SEQ ID NO: 17474 - RNA, 22 nt, Artificial Sequence
  ELANE RNA Guide
ucagggacgccgccugggcaac

SEQ ID NO: 17475 - RNA, 22 nt, Artificial Sequence
  ELANE RNA Guide
ugcacccuguugcccaggcggc

SEQ ID NO: 17476 - RNA, 22 nt, Artificial Sequence
  ELANE RNA Guide
uggccaggcacugcacccuguu

SEQ ID NO: 17477 - RNA, 22 nt, Artificial Sequence
  ELANE RNA Guide
ugggcaacagggugcagugccu

SEQ ID NO: 17478 - RNA, 20 nt, Artificial Sequence
  ELANE RNA Guide
aacggggugcagagccuggc

SEQ ID NO: 17479 - RNA, 20 nt, Artificial Sequence
  ELANE RNA Guide
aaggccccagcccauggcca

SEQ ID NO: 17480 - RNA, 20 nt, Artificial Sequence
  ELANE RNA Guide
acggggugcagagccuggcc

SEQ ID NO: 17481 - RNA, 20 nt, Artificial Sequence
  ELANE RNA Guide
agagccuggccaugggcugg

SEQ ID NO: 17482 - RNA, 20 nt, Artificial Sequence
  ELANE RNA Guide
agcccauggccaggcucugc

SEQ ID NO: 17483 - RNA, 20 nt, Artificial Sequence
  ELANE RNA Guide
aggccccagcccauggccag

SEQ ID NO: 17484 - RNA, 20 nt, Artificial Sequence
  ELANE RNA Guide
aggcucugcaccccguugcc

SEQ ID NO: 17485 - RNA, 20 nt, Artificial Sequence
  ELANE RNA Guide
auggccaggcucugcacccc

SEQ ID NO: 17486 - RNA, 20 nt, Artificial Sequence
  ELANE RNA Guide
caacggggugcagagccugg

SEQ ID NO: 17487 - RNA, 20 nt, Artificial Sequence
  ELANE RNA Guide
cagagccuggccaugggcug

SEQ ID NO: 17488 - RNA, 20 nt, Artificial Sequence
  ELANE RNA Guide
cagcccauggccaggcucug

SEQ ID NO: 17489 - RNA, 20 nt, Artificial Sequence
  ELANE RNA Guide
caggcucugcaccccguugc

SEQ ID NO: 17490 - RNA, 20 nt, Artificial Sequence
  ELANE RNA Guide
cauggccaggcucugcaccc

SEQ ID NO: 17491 - RNA, 20 nt, Artificial Sequence
  ELANE RNA Guide
ccagcccauggccaggcucu

SEQ ID NO: 17492 - RNA, 20 nt, Artificial Sequence
  ELANE RNA Guide
ccaggcucugcaccccguug

SEQ ID NO: 17493 - RNA, 20 nt, Artificial Sequence
  ELANE RNA Guide
ccauggccaggcucugcacc

SEQ ID NO: 17494 - RNA, 20 nt, Artificial Sequence
  ELANE RNA Guide
cccagcccauggccaggcuc

SEQ ID NO: 17495 - RNA, 20 nt, Artificial Sequence
  ELANE RNA Guide
cccauggccaggcucugcac

SEQ ID NO: 17496 - RNA, 20 nt, Artificial Sequence
  ELANE RNA Guide
ccccagcccauggccaggcu

SEQ ID NO: 17497 - RNA, 20 nt, Artificial Sequence
  ELANE RNA Guide
ccgccugggcaacggggugc

SEQ ID NO: 17498 - RNA, 20 nt, Artificial Sequence
  ELANE RNA Guide
ccugggcaacggggugcaga

SEQ ID NO: 17499 - RNA, 20 nt, Artificial Sequence
  ELANE RNA Guide
cgccugggcaacggggugca

SEQ ID NO: 17500 - RNA, 20 nt, Artificial Sequence
  ELANE RNA Guide
cggggugcagagccuggcca

SEQ ID NO: 17501 - RNA, 20 nt, Artificial Sequence
  ELANE RNA Guide
cucugcaccccguugcccag

SEQ ID NO: 17502 - RNA, 20 nt, Artificial Sequence
  ELANE RNA Guide
cugggcaacggggugcagag

SEQ ID NO: 17503 - RNA, 20 nt, Artificial Sequence
  ELANE RNA Guide
gagccuggccaugggcuggg

SEQ ID NO: 17504 - RNA, 20 nt, Artificial Sequence
  ELANE RNA Guide
gcaacggggugcagagccug

SEQ ID NO: 17505 - RNA, 20 nt, Artificial Sequence
  ELANE RNA Guide
gcagagccuggccaugggcu

SEQ ID NO: 17506 - RNA, 20 nt, Artificial Sequence
  ELANE RNA Guide
gccaggcucugcaccccguu

SEQ ID NO: 17507 - RNA, 20 nt, Artificial Sequence
  ELANE RNA Guide
gcccauggccaggcucugca

SEQ ID NO: 17508 - RNA, 20 nt, Artificial Sequence
  ELANE RNA Guide
gccccagcccauggccaggc

SEQ ID NO: 17509 - RNA, 20 nt, Artificial Sequence
  ELANE RNA Guide
gccgccugggcaacggggug

SEQ ID NO: 17510 - RNA, 20 nt, Artificial Sequence
  ELANE RNA Guide
gccugggcaacggggugcag

SEQ ID NO: 17511 - RNA, 20 nt, Artificial Sequence
  ELANE RNA Guide
gcucugcaccccguugccca

SEQ ID NO: 17512 - RNA, 20 nt, Artificial Sequence
  ELANE RNA Guide
ggcaacggggugcagagccu

SEQ ID NO: 17513 - RNA, 20 nt, Artificial Sequence
  ELANE RNA Guide
ggccaggcucugcaccccgu

SEQ ID NO: 17514 - RNA, 20 nt, Artificial Sequence
  ELANE RNA Guide
ggccccagcccauggccagg

SEQ ID NO: 17515 - RNA, 20 nt, Artificial Sequence
  ELANE RNA Guide
ggcucugcaccccguugccc

SEQ ID NO: 17516 - RNA, 20 nt, Artificial Sequence
  ELANE RNA Guide
gggcaacggggugcagagcc

SEQ ID NO: 17517 - RNA, 20 nt, Artificial Sequence
  ELANE RNA Guide
ggggugcagagccuggccau

SEQ ID NO: 17518 - RNA, 20 nt, Artificial Sequence
  ELANE RNA Guide
gggugcagagccuggccaug

SEQ ID NO: 17519 - RNA, 20 nt, Artificial Sequence
  ELANE RNA Guide
ggugcagagccuggccaugg

SEQ ID NO: 17520 - RNA, 20 nt, Artificial Sequence
  ELANE RNA Guide
gugcagagccuggccauggg

SEQ ID NO: 17521 - RNA, 20 nt, Artificial Sequence
  ELANE RNA Guide
ugcagagccuggccaugggc

SEQ ID NO: 17522 - RNA, 20 nt, Artificial Sequence
  ELANE RNA Guide
uggccaggcucugcaccccg

SEQ ID NO: 17523 - RNA, 20 nt, Artificial Sequence
  ELANE RNA Guide
ugggcaacggggugcagagc

SEQ ID NO: 17524 - RNA, 21 nt, Artificial Sequence
  ELANE RNA Guide
aacggggugcagagccuggcc

SEQ ID NO: 17525 - RNA, 21 nt, Artificial Sequence
  ELANE RNA Guide
aaggccccagcccauggccag

SEQ ID NO: 17526 - RNA, 21 nt, Artificial Sequence
  ELANE RNA Guide
acggggugcagagccuggcca

SEQ ID NO: 17527 - RNA, 21 nt, Artificial Sequence
  ELANE RNA Guide
agagccuggccaugggcuggg

SEQ ID NO: 17528 - RNA, 21 nt, Artificial Sequence
  ELANE RNA Guide
agcccauggccaggcucugca

SEQ ID NO: 17529 - RNA, 21 nt, Artificial Sequence
  ELANE RNA Guide
aggccccagcccauggccagg

SEQ ID NO: 17530 - RNA, 21 nt, Artificial Sequence
  ELANE RNA Guide
aggcucugcaccccguugccc

SEQ ID NO: 17531 - RNA, 21 nt, Artificial Sequence
  ELANE RNA Guide
auggccaggcucugcaccccg

SEQ ID NO: 17532 - RNA, 21 nt, Artificial Sequence
  ELANE RNA Guide
caacggggugcagagccuggc

SEQ ID NO: 17533 - RNA, 21 nt, Artificial Sequence
  ELANE RNA Guide
cagagccuggccaugggcugg

SEQ ID NO: 17534 - RNA, 21 nt, Artificial Sequence
  ELANE RNA Guide
cagcccauggccaggcucugc

SEQ ID NO: 17535 - RNA, 21 nt, Artificial Sequence
  ELANE RNA Guide
caggcucugcaccccguugcc

SEQ ID NO: 17536 - RNA, 21 nt, Artificial Sequence
  ELANE RNA Guide
cauggccaggcucugcacccc

SEQ ID NO: 17537 - RNA, 21 nt, Artificial Sequence
  ELANE RNA Guide
ccagcccauggccaggcucug

SEQ ID NO: 17538 - RNA, 21 nt, Artificial Sequence
  ELANE RNA Guide
ccaggcucugcaccccguugc

SEQ ID NO: 17539 - RNA, 21 nt, Artificial Sequence
  ELANE RNA Guide
ccauggccaggcucugcaccc

SEQ ID NO: 17540 - RNA, 21 nt, Artificial Sequence
  ELANE RNA Guide
cccagcccauggccaggcucu

SEQ ID NO: 17541 - RNA, 21 nt, Artificial Sequence
  ELANE RNA Guide
cccauggccaggcucugcacc

SEQ ID NO: 17542 - RNA, 21 nt, Artificial Sequence
  ELANE RNA Guide
ccccagcccauggccaggcuc

SEQ ID NO: 17543 - RNA, 21 nt, Artificial Sequence
  ELANE RNA Guide
ccgccugggcaacggggugca

SEQ ID NO: 17544 - RNA, 21 nt, Artificial Sequence
  ELANE RNA Guide
ccugggcaacggggugcagag

SEQ ID NO: 17545 - RNA, 21 nt, Artificial Sequence
  ELANE RNA Guide
cgccugggcaacggggugcag

SEQ ID NO: 17546 - RNA, 21 nt, Artificial Sequence
  ELANE RNA Guide
cggggugcagagccuggccau

SEQ ID NO: 17547 - RNA, 21 nt, Artificial Sequence
  ELANE RNA Guide
cucugcaccccguugcccagg

SEQ ID NO: 17548 - RNA, 21 nt, Artificial Sequence
  ELANE RNA Guide
cugggcaacggggugcagagc

SEQ ID NO: 17549 - RNA, 21 nt, Artificial Sequence
  ELANE RNA Guide
gaaggccccagcccauggcca

SEQ ID NO: 17550 - RNA, 21 nt, Artificial Sequence
  ELANE RNA Guide
gagccuggccaugggcugggg

SEQ ID NO: 17551 - RNA, 21 nt, Artificial Sequence
  ELANE RNA Guide
gcaacggggugcagagccugg

SEQ ID NO: 17552 - RNA, 21 nt, Artificial Sequence
  ELANE RNA Guide
gcagagccuggccaugggcug

SEQ ID NO: 17553 - RNA, 21 nt, Artificial Sequence
  ELANE RNA Guide
gccaggcucugcaccccguug

SEQ ID NO: 17554 - RNA, 21 nt, Artificial Sequence
  ELANE RNA Guide
gcccauggccaggcucugcac

SEQ ID NO: 17555 - RNA, 21 nt, Artificial Sequence
  ELANE RNA Guide
gccccagcccauggccaggcu

SEQ ID NO: 17556 - RNA, 21 nt, Artificial Sequence
  ELANE RNA Guide
gccugggcaacggggugcaga

SEQ ID NO: 17557 - RNA, 21 nt, Artificial Sequence
  ELANE RNA Guide
gcucugcaccccguugcccag

SEQ ID NO: 17558 - RNA, 21 nt, Artificial Sequence
  ELANE RNA Guide
ggcaacggggugcagagccug

SEQ ID NO: 17559 - RNA, 21 nt, Artificial Sequence
  ELANE RNA Guide
ggccaggcucugcaccccguu

SEQ ID NO: 17560 - RNA, 21 nt, Artificial Sequence
  ELANE RNA Guide
ggcucugcaccccguugccca

SEQ ID NO: 17561 - RNA, 21 nt, Artificial Sequence
  ELANE RNA Guide
gggcaacggggugcagagccu

SEQ ID NO: 17562 - RNA, 21 nt, Artificial Sequence
  ELANE RNA Guide
ggggugcagagccuggccaug

SEQ ID NO: 17563 - RNA, 21 nt, Artificial Sequence
  ELANE RNA Guide
gggugcagagccuggccaugg

SEQ ID NO: 17564 - RNA, 21 nt, Artificial Sequence
  ELANE RNA Guide
ggugcagagccuggccauggg

SEQ ID NO: 17565 - RNA, 21 nt, Artificial Sequence
  ELANE RNA Guide
gugcagagccuggccaugggc

SEQ ID NO: 17566 - RNA, 21 nt, Artificial Sequence
  ELANE RNA Guide
ugcagagccuggccaugggcu

SEQ ID NO: 17567 - RNA, 21 nt, Artificial Sequence
  ELANE RNA Guide
uggccaggcucugcaccccgu

SEQ ID NO: 17568 - RNA, 21 nt, Artificial Sequence
  ELANE RNA Guide
ugggcaacggggugcagagcc

SEQ ID NO: 17569 - RNA, 22 nt, Artificial Sequence
  ELANE RNA Guide
aacggggugcagagccuggcca

SEQ ID NO: 17570 - RNA, 22 nt, Artificial Sequence
  ELANE RNA Guide
aaggccccagcccauggccagg

SEQ ID NO: 17571 - RNA, 22 nt, Artificial Sequence
  ELANE RNA Guide
acgccgccugggcaacggggug

SEQ ID NO: 17572 - RNA, 22 nt, Artificial Sequence
  ELANE RNA Guide
acggggugcagagccuggccau

SEQ ID NO: 17573 - RNA, 22 nt, Artificial Sequence
  ELANE RNA Guide
agaaggccccagcccauggcca

SEQ ID NO: 17574 - RNA, 22 nt, Artificial Sequence
  ELANE RNA Guide
agagccuggccaugggcugggg

SEQ ID NO: 17575 - RNA, 22 nt, Artificial Sequence
  ELANE RNA Guide
agcccauggccaggcucugcac

SEQ ID NO: 17576 - RNA, 22 nt, Artificial Sequence
  ELANE RNA Guide
aggccccagcccauggccaggc

SEQ ID NO: 17577 - RNA, 22 nt, Artificial Sequence
  ELANE RNA Guide
aggcucugcaccccguugccca

SEQ ID NO: 17578 - RNA, 22 nt, Artificial Sequence
  ELANE RNA Guide
auggccaggcucugcaccccgu

SEQ ID NO: 17579 - RNA, 22 nt, Artificial Sequence
  ELANE RNA Guide
caacggggugcagagccuggcc

SEQ ID NO: 17580 - RNA, 22 nt, Artificial Sequence
  ELANE RNA Guide
cagagccuggccaugggcuggg

SEQ ID NO: 17581 - RNA, 22 nt, Artificial Sequence
  ELANE RNA Guide
cagcccauggccaggcucugca

SEQ ID NO: 17582 - RNA, 22 nt, Artificial Sequence
  ELANE RNA Guide
caggcucugcaccccguugccc

SEQ ID NO: 17583 - RNA, 22 nt, Artificial Sequence
  ELANE RNA Guide
cauggccaggcucugcaccccg

SEQ ID NO: 17584 - RNA, 22 nt, Artificial Sequence
  ELANE RNA Guide
ccagcccauggccaggcucugc

SEQ ID NO: 17585 - RNA, 22 nt, Artificial Sequence
  ELANE RNA Guide
ccaggcucugcaccccguugcc

SEQ ID NO: 17586 - RNA, 22 nt, Artificial Sequence
  ELANE RNA Guide
ccauggccaggcucugcacccc

SEQ ID NO: 17587 - RNA, 22 nt, Artificial Sequence
  ELANE RNA Guide
cccagcccauggccaggcucug

SEQ ID NO: 17588 - RNA, 22 nt, Artificial Sequence
  ELANE RNA Guide
cccauggccaggcucugcaccc

SEQ ID NO: 17589 - RNA, 22 nt, Artificial Sequence
  ELANE RNA Guide
ccccagcccauggccaggcucu

SEQ ID NO: 17590 - RNA, 22 nt, Artificial Sequence
  ELANE RNA Guide
ccgccugggcaacggggugcag

SEQ ID NO: 17591 - RNA, 22 nt, Artificial Sequence
  ELANE RNA Guide
ccugggcaacggggugcagagc

SEQ ID NO: 17592 - RNA, 22 nt, Artificial Sequence
  ELANE RNA Guide
cgccugggcaacggggugcaga

SEQ ID NO: 17593 - RNA, 22 nt, Artificial Sequence
  ELANE RNA Guide
cggggugcagagccuggccaug

SEQ ID NO: 17594 - RNA, 22 nt, Artificial Sequence
  ELANE RNA Guide
cucugcaccccguugcccaggc

SEQ ID NO: 17595 - RNA, 22 nt, Artificial Sequence
  ELANE RNA Guide
cugggcaacggggugcagagcc

SEQ ID NO: 17596 - RNA, 22 nt, Artificial Sequence
  ELANE RNA Guide
gaaggccccagcccauggccag

SEQ ID NO: 17597 - RNA, 22 nt, Artificial Sequence
  ELANE RNA Guide
gagccuggccaugggcuggggc

SEQ ID NO: 17598 - RNA, 22 nt, Artificial Sequence
  ELANE RNA Guide
gcaacggggugcagagccuggc

SEQ ID NO: 17599 - RNA, 22 nt, Artificial Sequence
  ELANE RNA Guide
gcagagccuggccaugggcugg

SEQ ID NO: 17600 - RNA, 22 nt, Artificial Sequence
  ELANE RNA Guide
gccaggcucugcaccccguugc

SEQ ID NO: 17601 - RNA, 22 nt, Artificial Sequence
  ELANE RNA Guide
gcccauggccaggcucugcacc

SEQ ID NO: 17602 - RNA, 22 nt, Artificial Sequence
  ELANE RNA Guide
gccccagcccauggccaggcuc

SEQ ID NO: 17603 - RNA, 22 nt, Artificial Sequence
  ELANE RNA Guide
gccgccugggcaacggggugca

SEQ ID NO: 17604 - RNA, 22 nt, Artificial Sequence
  ELANE RNA Guide
gccugggcaacggggugcagag

SEQ ID NO: 17605 - RNA, 22 nt, Artificial Sequence
  ELANE RNA Guide
gcucugcaccccguugcccagg

SEQ ID NO: 17606 - RNA, 22 nt, Artificial Sequence
  ELANE RNA Guide
ggcaacggggugcagagccugg

SEQ ID NO: 17607 - RNA, 22 nt, Artificial Sequence
  ELANE RNA Guide
ggccaggcucugcaccccguug

SEQ ID NO: 17608 - RNA, 22 nt, Artificial Sequence
  ELANE RNA Guide
ggccccagcccauggccaggcu

SEQ ID NO: 17609 - RNA, 22 nt, Artificial Sequence
  ELANE RNA Guide
ggcucugcaccccguugcccag

SEQ ID NO: 17610 - RNA, 22 nt, Artificial Sequence
  ELANE RNA Guide
gggcaacggggugcagagccug

SEQ ID NO: 17611 - RNA, 22 nt, Artificial Sequence
  ELANE RNA Guide
ggggugcagagccuggccaugg

SEQ ID NO: 17612 - RNA, 22 nt, Artificial Sequence
  ELANE RNA Guide
gggugcagagccuggccauggg

SEQ ID NO: 17613 - RNA, 22 nt, Artificial Sequence
  ELANE RNA Guide
ggugcagagccuggccaugggc

SEQ ID NO: 17614 - RNA, 22 nt, Artificial Sequence
  ELANE RNA Guide
gugcagagccuggccaugggcu

SEQ ID NO: 17615 - RNA, 22 nt, Artificial Sequence
  ELANE RNA Guide
ugcagagccuggccaugggcug

SEQ ID NO: 17616 - RNA, 22 nt, Artificial Sequence
  ELANE RNA Guide
uggccaggcucugcaccccguu

SEQ ID NO: 17617 - RNA, 22 nt, Artificial Sequence
  ELANE RNA Guide
ugggcaacggggugcagagccu

SEQ ID NO: 17618 - RNA, 20 nt, Artificial Sequence
  ELANE RNA Guide
aacggggugcaguaccuggc

SEQ ID NO: 17619 - RNA, 20 nt, Artificial Sequence
  ELANE RNA Guide
acggggugcaguaccuggcc

SEQ ID NO: 17620 - RNA, 20 nt, Artificial Sequence
  ELANE RNA Guide
agcccauggccagguacugc

SEQ ID NO: 17621 - RNA, 20 nt, Artificial Sequence
  ELANE RNA Guide
agguacugcaccccguugcc

SEQ ID NO: 17622 - RNA, 20 nt, Artificial Sequence
  ELANE RNA Guide
aguaccuggccaugggcugg

SEQ ID NO: 17623 - RNA, 20 nt, Artificial Sequence
  ELANE RNA Guide
auggccagguacugcacccc

SEQ ID NO: 17624 - RNA, 20 nt, Artificial Sequence
  ELANE RNA Guide
caacggggugcaguaccugg

SEQ ID NO: 17625 - RNA, 20 nt, Artificial Sequence
  ELANE RNA Guide
cagcccauggccagguacug

SEQ ID NO: 17626 - RNA, 20 nt, Artificial Sequence
  ELANE RNA Guide
cagguacugcaccccguugc

SEQ ID NO: 17627 - RNA, 20 nt, Artificial Sequence
  ELANE RNA Guide
caguaccuggccaugggcug

SEQ ID NO: 17628 - RNA, 20 nt, Artificial Sequence
  ELANE RNA Guide
cauggccagguacugcaccc

SEQ ID NO: 17629 - RNA, 20 nt, Artificial Sequence
  ELANE RNA Guide
ccagcccauggccagguacu

SEQ ID NO: 17630 - RNA, 20 nt, Artificial Sequence
  ELANE RNA Guide
ccagguacugcaccccguug

SEQ ID NO: 17631 - RNA, 20 nt, Artificial Sequence
  ELANE RNA Guide
ccauggccagguacugcacc

SEQ ID NO: 17632 - RNA, 20 nt, Artificial Sequence
  ELANE RNA Guide
cccagcccauggccagguac

SEQ ID NO: 17633 - RNA, 20 nt, Artificial Sequence
  ELANE RNA Guide
cccauggccagguacugcac

SEQ ID NO: 17634 - RNA, 20 nt, Artificial Sequence
  ELANE RNA Guide
ccccagcccauggccaggua

SEQ ID NO: 17635 - RNA, 20 nt, Artificial Sequence
  ELANE RNA Guide
ccugggcaacggggugcagu

SEQ ID NO: 17636 - RNA, 20 nt, Artificial Sequence
  ELANE RNA Guide
cggggugcaguaccuggcca

SEQ ID NO: 17637 - RNA, 20 nt, Artificial Sequence
  ELANE RNA Guide
cugggcaacggggugcagua

SEQ ID NO: 17638 - RNA, 20 nt, Artificial Sequence
  ELANE RNA Guide
gaaggccccagcccauggcc

SEQ ID NO: 17639 - RNA, 20 nt, Artificial Sequence
  ELANE RNA Guide
gcaacggggugcaguaccug

SEQ ID NO: 17640 - RNA, 20 nt, Artificial Sequence
  ELANE RNA Guide
gcaguaccuggccaugggcu

SEQ ID NO: 17641 - RNA, 20 nt, Artificial Sequence
  ELANE RNA Guide
gccagguacugcaccccguu

SEQ ID NO: 17642 - RNA, 20 nt, Artificial Sequence
  ELANE RNA Guide
gcccauggccagguacugca

SEQ ID NO: 17643 - RNA, 20 nt, Artificial Sequence
  ELANE RNA Guide
gccccagcccauggccaggu

SEQ ID NO: 17644 - RNA, 20 nt, Artificial Sequence
  ELANE RNA Guide
ggcaacggggugcaguaccu

SEQ ID NO: 17645 - RNA, 20 nt, Artificial Sequence
  ELANE RNA Guide
ggccagguacugcaccccgu

SEQ ID NO: 17646 - RNA, 20 nt, Artificial Sequence
  ELANE RNA Guide
gggcaacggggugcaguacc

SEQ ID NO: 17647 - RNA, 20 nt, Artificial Sequence
  ELANE RNA Guide
ggggugcaguaccuggccau

SEQ ID NO: 17648 - RNA, 20 nt, Artificial Sequence
  ELANE RNA Guide
gggugcaguaccuggccaug

SEQ ID NO: 17649 - RNA, 20 nt, Artificial Sequence
  ELANE RNA Guide
gguacugcaccccguugccc

SEQ ID NO: 17650 - RNA, 20 nt, Artificial Sequence
  ELANE RNA Guide
ggugcaguaccuggccaugg

SEQ ID NO: 17651 - RNA, 20 nt, Artificial Sequence
  ELANE RNA Guide
guaccuggccaugggcuggg

SEQ ID NO: 17652 - RNA, 20 nt, Artificial Sequence
  ELANE RNA Guide
guacugcaccccguugccca

SEQ ID NO: 17653 - RNA, 20 nt, Artificial Sequence
  ELANE RNA Guide
gugcaguaccuggccauggg

SEQ ID NO: 17654 - RNA, 20 nt, Artificial Sequence
  ELANE RNA Guide
uaccuggccaugggcugggg

SEQ ID NO: 17655 - RNA, 20 nt, Artificial Sequence
  ELANE RNA Guide
ugcaguaccuggccaugggc

SEQ ID NO: 17656 - RNA, 20 nt, Artificial Sequence
  ELANE RNA Guide
uggccagguacugcaccccg

SEQ ID NO: 17657 - RNA, 20 nt, Artificial Sequence
  ELANE RNA Guide
ugggcaacggggugcaguac

SEQ ID NO: 17658 - RNA, 21 nt, Artificial Sequence
  ELANE RNA Guide
aacggggugcaguaccuggcc

SEQ ID NO: 17659 - RNA, 21 nt, Artificial Sequence
  ELANE RNA Guide
acggggugcaguaccuggcca

SEQ ID NO: 17660 - RNA, 21 nt, Artificial Sequence
  ELANE RNA Guide
agaaggccccagcccauggcc

SEQ ID NO: 17661 - RNA, 21 nt, Artificial Sequence
  ELANE RNA Guide
agcccauggccagguacugca

SEQ ID NO: 17662 - RNA, 21 nt, Artificial Sequence
  ELANE RNA Guide
agguacugcaccccguugccc

SEQ ID NO: 17663 - RNA, 21 nt, Artificial Sequence
  ELANE RNA Guide
aguaccuggccaugggcuggg

SEQ ID NO: 17664 - RNA, 21 nt, Artificial Sequence
  ELANE RNA Guide
auggccagguacugcaccccg

SEQ ID NO: 17665 - RNA, 21 nt, Artificial Sequence
  ELANE RNA Guide
caacggggugcaguaccuggc

SEQ ID NO: 17666 - RNA, 21 nt, Artificial Sequence
  ELANE RNA Guide
cagcccauggccagguacugc

SEQ ID NO: 17667 - RNA, 21 nt, Artificial Sequence
  ELANE RNA Guide
cagguacugcaccccguugcc

SEQ ID NO: 17668 - RNA, 21 nt, Artificial Sequence
  ELANE RNA Guide
caguaccuggccaugggcugg

SEQ ID NO: 17669 - RNA, 21 nt, Artificial Sequence
  ELANE RNA Guide
cauggccagguacugcacccc

SEQ ID NO: 17670 - RNA, 21 nt, Artificial Sequence
  ELANE RNA Guide
ccagcccauggccagguacug

SEQ ID NO: 17671 - RNA, 21 nt, Artificial Sequence
  ELANE RNA Guide
ccagguacugcaccccguugc

SEQ ID NO: 17672 - RNA, 21 nt, Artificial Sequence
  ELANE RNA Guide
ccauggccagguacugcaccc

SEQ ID NO: 17673 - RNA, 21 nt, Artificial Sequence
  ELANE RNA Guide
cccagcccauggccagguacu

SEQ ID NO: 17674 - RNA, 21 nt, Artificial Sequence
  ELANE RNA Guide
cccauggccagguacugcacc

SEQ ID NO: 17675 - RNA, 21 nt, Artificial Sequence
  ELANE RNA Guide
ccccagcccauggccagguac

SEQ ID NO: 17676 - RNA, 21 nt, Artificial Sequence
  ELANE RNA Guide
ccugggcaacggggugcagua

SEQ ID NO: 17677 - RNA, 21 nt, Artificial Sequence
  ELANE RNA Guide
cggggugcaguaccuggccau

SEQ ID NO: 17678 - RNA, 21 nt, Artificial Sequence
  ELANE RNA Guide
cugggcaacggggugcaguac

SEQ ID NO: 17679 - RNA, 21 nt, Artificial Sequence
  ELANE RNA Guide
gcaacggggugcaguaccugg

SEQ ID NO: 17680 - RNA, 21 nt, Artificial Sequence
  ELANE RNA Guide
gcaguaccuggccaugggcug

SEQ ID NO: 17681 - RNA, 21 nt, Artificial Sequence
  ELANE RNA Guide
gccagguacugcaccccguug

SEQ ID NO: 17682 - RNA, 21 nt, Artificial Sequence
  ELANE RNA Guide
gcccauggccagguacugcac

SEQ ID NO: 17683 - RNA, 21 nt, Artificial Sequence
  ELANE RNA Guide
gccccagcccauggccaggua

SEQ ID NO: 17684 - RNA, 21 nt, Artificial Sequence
  ELANE RNA Guide
gccugggcaacggggugcagu

SEQ ID NO: 17685 - RNA, 21 nt, Artificial Sequence
  ELANE RNA Guide
ggcaacggggugcaguaccug

SEQ ID NO: 17686 - RNA, 21 nt, Artificial Sequence
  ELANE RNA Guide
ggccagguacugcaccccguu

SEQ ID NO: 17687 - RNA, 21 nt, Artificial Sequence
  ELANE RNA Guide
ggccccagcccauggccaggu

SEQ ID NO: 17688 - RNA, 21 nt, Artificial Sequence
  ELANE RNA Guide
gggcaacggggugcaguaccu

SEQ ID NO: 17689 - RNA, 21 nt, Artificial Sequence
  ELANE RNA Guide
ggggugcaguaccuggccaug

SEQ ID NO: 17690 - RNA, 21 nt, Artificial Sequence
  ELANE RNA Guide
gggugcaguaccuggccaugg

SEQ ID NO: 17691 - RNA, 21 nt, Artificial Sequence
  ELANE RNA Guide
gguacugcaccccguugccca

SEQ ID NO: 17692 - RNA, 21 nt, Artificial Sequence
  ELANE RNA Guide
ggugcaguaccuggccauggg

SEQ ID NO: 17693 - RNA, 21 nt, Artificial Sequence
  ELANE RNA Guide
guaccuggccaugggcugggg

SEQ ID NO: 17694 - RNA, 21 nt, Artificial Sequence
  ELANE RNA Guide
guacugcaccccguugcccag

SEQ ID NO: 17695 - RNA, 21 nt, Artificial Sequence
  ELANE RNA Guide
gugcaguaccuggccaugggc

SEQ ID NO: 17696 - RNA, 21 nt, Artificial Sequence
  ELANE RNA Guide
uaccuggccaugggcuggggc

SEQ ID NO: 17697 - RNA, 21 nt, Artificial Sequence
  ELANE RNA Guide
ugcaguaccuggccaugggcu

SEQ ID NO: 17698 - RNA, 21 nt, Artificial Sequence
  ELANE RNA Guide
uggccagguacugcaccccgu

SEQ ID NO: 17699 - RNA, 21 nt, Artificial Sequence
  ELANE RNA Guide
ugggcaacggggugcaguacc

SEQ ID NO: 17700 - RNA, 22 nt, Artificial Sequence
  ELANE RNA Guide
aacggggugcaguaccuggcca

SEQ ID NO: 17701 - RNA, 22 nt, Artificial Sequence
  ELANE RNA Guide
acggggugcaguaccuggccau

SEQ ID NO: 17702 - RNA, 22 nt, Artificial Sequence
  ELANE RNA Guide
agcccauggccagguacugcac

SEQ ID NO: 17703 - RNA, 22 nt, Artificial Sequence
  ELANE RNA Guide
aggccccagcccauggccaggu

SEQ ID NO: 17704 - RNA, 22 nt, Artificial Sequence
  ELANE RNA Guide
agguacugcaccccguugccca

SEQ ID NO: 17705 - RNA, 22 nt, Artificial Sequence
  ELANE RNA Guide
aguaccuggccaugggcugggg

SEQ ID NO: 17706 - RNA, 22 nt, Artificial Sequence
  ELANE RNA Guide
auggccagguacugcaccccgu

SEQ ID NO: 17707 - RNA, 22 nt, Artificial Sequence
  ELANE RNA Guide
caacggggugcaguaccuggcc

SEQ ID NO: 17708 - RNA, 22 nt, Artificial Sequence
  ELANE RNA Guide
cagaaggccccagcccauggcc

SEQ ID NO: 17709 - RNA, 22 nt, Artificial Sequence
  ELANE RNA Guide
cagcccauggccagguacugca

SEQ ID NO: 17710 - RNA, 22 nt, Artificial Sequence
  ELANE RNA Guide
cagguacugcaccccguugccc

SEQ ID NO: 17711 - RNA, 22 nt, Artificial Sequence
  ELANE RNA Guide
caguaccuggccaugggcuggg

SEQ ID NO: 17712 - RNA, 22 nt, Artificial Sequence
  ELANE RNA Guide
cauggccagguacugcaccccg

SEQ ID NO: 17713 - RNA, 22 nt, Artificial Sequence
  ELANE RNA Guide
ccagcccauggccagguacugc

SEQ ID NO: 17714 - RNA, 22 nt, Artificial Sequence
  ELANE RNA Guide
ccagguacugcaccccguugcc

SEQ ID NO: 17715 - RNA, 22 nt, Artificial Sequence
  ELANE RNA Guide
ccauggccagguacugcacccc

SEQ ID NO: 17716 - RNA, 22 nt, Artificial Sequence
  ELANE RNA Guide
cccagcccauggccagguacug

SEQ ID NO: 17717 - RNA, 22 nt, Artificial Sequence
  ELANE RNA Guide
cccauggccagguacugcaccc

SEQ ID NO: 17718 - RNA, 22 nt, Artificial Sequence
  ELANE RNA Guide
ccccagcccauggccagguacu

SEQ ID NO: 17719 - RNA, 22 nt, Artificial Sequence
  ELANE RNA Guide
ccugggcaacggggugcaguac

SEQ ID NO: 17720 - RNA, 22 nt, Artificial Sequence
  ELANE RNA Guide
cgccugggcaacggggugcagu

SEQ ID NO: 17721 - RNA, 22 nt, Artificial Sequence
  ELANE RNA Guide
cggggugcaguaccuggccaug

SEQ ID NO: 17722 - RNA, 22 nt, Artificial Sequence
  ELANE RNA Guide
cugggcaacggggugcaguacc

SEQ ID NO: 17723 - RNA, 22 nt, Artificial Sequence
  ELANE RNA Guide
gcaacggggugcaguaccuggc

SEQ ID NO: 17724 - RNA, 22 nt, Artificial Sequence
  ELANE RNA Guide
gcaguaccuggccaugggcugg

SEQ ID NO: 17725 - RNA, 22 nt, Artificial Sequence
  ELANE RNA Guide
gccagguacugcaccccguugc

SEQ ID NO: 17726 - RNA, 22 nt, Artificial Sequence
  ELANE RNA Guide
gcccauggccagguacugcacc

SEQ ID NO: 17727 - RNA, 22 nt, Artificial Sequence
  ELANE RNA Guide
gccccagcccauggccagguac

SEQ ID NO: 17728 - RNA, 22 nt, Artificial Sequence
  ELANE RNA Guide
gccugggcaacggggugcagua

SEQ ID NO: 17729 - RNA, 22 nt, Artificial Sequence
  ELANE RNA Guide
ggcaacggggugcaguaccugg

SEQ ID NO: 17730 - RNA, 22 nt, Artificial Sequence
  ELANE RNA Guide
ggccagguacugcaccccguug

SEQ ID NO: 17731 - RNA, 22 nt, Artificial Sequence
  ELANE RNA Guide
ggccccagcccauggccaggua

SEQ ID NO: 17732 - RNA, 22 nt, Artificial Sequence
  ELANE RNA Guide
gggcaacggggugcaguaccug

SEQ ID NO: 17733 - RNA, 22 nt, Artificial Sequence
  ELANE RNA Guide
ggggugcaguaccuggccaugg

SEQ ID NO: 17734 - RNA, 22 nt, Artificial Sequence
  ELANE RNA Guide
gggugcaguaccuggccauggg

SEQ ID NO: 17735 - RNA, 22 nt, Artificial Sequence
  ELANE RNA Guide
gguacugcaccccguugcccag

SEQ ID NO: 17736 - RNA, 22 nt, Artificial Sequence
  ELANE RNA Guide
ggugcaguaccuggccaugggc

SEQ ID NO: 17737 - RNA, 22 nt, Artificial Sequence
  ELANE RNA Guide
guaccuggccaugggcuggggc

SEQ ID NO: 17738 - RNA, 22 nt, Artificial Sequence
  ELANE RNA Guide
guacugcaccccguugcccagg

SEQ ID NO: 17739 - RNA, 22 nt, Artificial Sequence
  ELANE RNA Guide
gugcaguaccuggccaugggcu

SEQ ID NO: 17740 - RNA, 22 nt, Artificial Sequence
  ELANE RNA Guide
uaccuggccaugggcuggggcc

SEQ ID NO: 17741 - RNA, 22 nt, Artificial Sequence
  ELANE RNA Guide
ugcaguaccuggccaugggcug

SEQ ID NO: 17742 - RNA, 22 nt, Artificial Sequence
  ELANE RNA Guide
uggccagguacugcaccccguu

SEQ ID NO: 17743 - RNA, 22 nt, Artificial Sequence
  ELANE RNA Guide
ugggcaacggggugcaguaccu

SEQ ID NO: 17744 - RNA, 20 nt, Artificial Sequence
  ELANE RNA Guide
aacggggugcagucccuggc

SEQ ID NO: 17745 - RNA, 20 nt, Artificial Sequence
  ELANE RNA Guide
acggggugcagucccuggcc

SEQ ID NO: 17746 - RNA, 20 nt, Artificial Sequence
  ELANE RNA Guide
agcccauggccagggacugc

SEQ ID NO: 17747 - RNA, 20 nt, Artificial Sequence
  ELANE RNA Guide
agggacugcaccccguugcc

SEQ ID NO: 17748 - RNA, 20 nt, Artificial Sequence
  ELANE RNA Guide
agucccuggccaugggcugg

SEQ ID NO: 17749 - RNA, 20 nt, Artificial Sequence
  ELANE RNA Guide
auggccagggacugcacccc

SEQ ID NO: 17750 - RNA, 20 nt, Artificial Sequence
  ELANE RNA Guide
caacggggugcagucccugg

SEQ ID NO: 17751 - RNA, 20 nt, Artificial Sequence
  ELANE RNA Guide
cagcccauggccagggacug

SEQ ID NO: 17752 - RNA, 20 nt, Artificial Sequence
  ELANE RNA Guide
cagggacugcaccccguugc

SEQ ID NO: 17753 - RNA, 20 nt, Artificial Sequence
  ELANE RNA Guide
cagucccuggccaugggcug

SEQ ID NO: 17754 - RNA, 20 nt, Artificial Sequence
  ELANE RNA Guide
cauggccagggacugcaccc

SEQ ID NO: 17755 - RNA, 20 nt, Artificial Sequence
  ELANE RNA Guide
ccagcccauggccagggacu

SEQ ID NO: 17756 - RNA, 20 nt, Artificial Sequence
  ELANE RNA Guide
ccagggacugcaccccguug

SEQ ID NO: 17757 - RNA, 20 nt, Artificial Sequence
  ELANE RNA Guide
ccauggccagggacugcacc

SEQ ID NO: 17758 - RNA, 20 nt, Artificial Sequence
  ELANE RNA Guide
cccagcccauggccagggac

SEQ ID NO: 17759 - RNA, 20 nt, Artificial Sequence
  ELANE RNA Guide
cccauggccagggacugcac

SEQ ID NO: 17760 - RNA, 20 nt, Artificial Sequence
  ELANE RNA Guide
ccccagcccauggccaggga

SEQ ID NO: 17761 - RNA, 20 nt, Artificial Sequence
  ELANE RNA Guide
cggggugcagucccuggcca

SEQ ID NO: 17762 - RNA, 20 nt, Artificial Sequence
  ELANE RNA Guide
cugggcaacggggugcaguc

SEQ ID NO: 17763 - RNA, 20 nt, Artificial Sequence
  ELANE RNA Guide
gcaacggggugcagucccug

SEQ ID NO: 17764 - RNA, 20 nt, Artificial Sequence
  ELANE RNA Guide
gcagucccuggccaugggcu

SEQ ID NO: 17765 - RNA, 20 nt, Artificial Sequence
  ELANE RNA Guide
gccagggacugcaccccguu

SEQ ID NO: 17766 - RNA, 20 nt, Artificial Sequence
  ELANE RNA Guide
gcccauggccagggacugca

SEQ ID NO: 17767 - RNA, 20 nt, Artificial Sequence
  ELANE RNA Guide
gccccagcccauggccaggg

SEQ ID NO: 17768 - RNA, 20 nt, Artificial Sequence
  ELANE RNA Guide
ggacugcaccccguugccca

SEQ ID NO: 17769 - RNA, 20 nt, Artificial Sequence
  ELANE RNA Guide
ggcaacggggugcagucccu

SEQ ID NO: 17770 - RNA, 20 nt, Artificial Sequence
  ELANE RNA Guide
ggccagggacugcaccccgu

SEQ ID NO: 17771 - RNA, 20 nt, Artificial Sequence
  ELANE RNA Guide
gggacugcaccccguugccc

SEQ ID NO: 17772 - RNA, 20 nt, Artificial Sequence
  ELANE RNA Guide
gggcaacggggugcaguccc

SEQ ID NO: 17773 - RNA, 20 nt, Artificial Sequence
  ELANE RNA Guide
ggggugcagucccuggccau

SEQ ID NO: 17774 - RNA, 20 nt, Artificial Sequence
  ELANE RNA Guide
gggugcagucccuggccaug

SEQ ID NO: 17775 - RNA, 20 nt, Artificial Sequence
  ELANE RNA Guide
ggugcagucccuggccaugg

SEQ ID NO: 17776 - RNA, 20 nt, Artificial Sequence
  ELANE RNA Guide
gucccuggccaugggcuggg

SEQ ID NO: 17777 - RNA, 20 nt, Artificial Sequence
  ELANE RNA Guide
gugcagucccuggccauggg

SEQ ID NO: 17778 - RNA, 20 nt, Artificial Sequence
  ELANE RNA Guide
ucccuggccaugggcugggg

SEQ ID NO: 17779 - RNA, 20 nt, Artificial Sequence
  ELANE RNA Guide
ugcagucccuggccaugggc

SEQ ID NO: 17780 - RNA, 20 nt, Artificial Sequence
  ELANE RNA Guide
uggccagggacugcaccccg

SEQ ID NO: 17781 - RNA, 20 nt, Artificial Sequence
  ELANE RNA Guide
ugggcaacggggugcagucc

SEQ ID NO: 17782 - RNA, 21 nt, Artificial Sequence
  ELANE RNA Guide
aacggggugcagucccuggcc

SEQ ID NO: 17783 - RNA, 21 nt, Artificial Sequence
  ELANE RNA Guide
acggggugcagucccuggcca

SEQ ID NO: 17784 - RNA, 21 nt, Artificial Sequence
  ELANE RNA Guide
agcccauggccagggacugca

SEQ ID NO: 17785 - RNA, 21 nt, Artificial Sequence
  ELANE RNA Guide
agggacugcaccccguugccc

SEQ ID NO: 17786 - RNA, 21 nt, Artificial Sequence
  ELANE RNA Guide
agucccuggccaugggcuggg

SEQ ID NO: 17787 - RNA, 21 nt, Artificial Sequence
  ELANE RNA Guide
auggccagggacugcaccccg

SEQ ID NO: 17788 - RNA, 21 nt, Artificial Sequence
  ELANE RNA Guide
caacggggugcagucccuggc

SEQ ID NO: 17789 - RNA, 21 nt, Artificial Sequence
  ELANE RNA Guide
cagcccauggccagggacugc

SEQ ID NO: 17790 - RNA, 21 nt, Artificial Sequence
  ELANE RNA Guide
cagggacugcaccccguugcc

SEQ ID NO: 17791 - RNA, 21 nt, Artificial Sequence
  ELANE RNA Guide
cagucccuggccaugggcugg

SEQ ID NO: 17792 - RNA, 21 nt, Artificial Sequence
  ELANE RNA Guide
cauggccagggacugcacccc

SEQ ID NO: 17793 - RNA, 21 nt, Artificial Sequence
  ELANE RNA Guide
ccagcccauggccagggacug

SEQ ID NO: 17794 - RNA, 21 nt, Artificial Sequence
  ELANE RNA Guide
ccagggacugcaccccguugc

SEQ ID NO: 17795 - RNA, 21 nt, Artificial Sequence
  ELANE RNA Guide
ccauggccagggacugcaccc

SEQ ID NO: 17796 - RNA, 21 nt, Artificial Sequence
  ELANE RNA Guide
cccagcccauggccagggacu

SEQ ID NO: 17797 - RNA, 21 nt, Artificial Sequence
  ELANE RNA Guide
cccauggccagggacugcacc

SEQ ID NO: 17798 - RNA, 21 nt, Artificial Sequence
  ELANE RNA Guide
ccccagcccauggccagggac

SEQ ID NO: 17799 - RNA, 21 nt, Artificial Sequence
  ELANE RNA Guide
ccugggcaacggggugcaguc

SEQ ID NO: 17800 - RNA, 21 nt, Artificial Sequence
  ELANE RNA Guide
cggggugcagucccuggccau

SEQ ID NO: 17801 - RNA, 21 nt, Artificial Sequence
  ELANE RNA Guide
cugggcaacggggugcagucc

SEQ ID NO: 17802 - RNA, 21 nt, Artificial Sequence
  ELANE RNA Guide
gcaacggggugcagucccugg

SEQ ID NO: 17803 - RNA, 21 nt, Artificial Sequence
  ELANE RNA Guide
gcagucccuggccaugggcug

SEQ ID NO: 17804 - RNA, 21 nt, Artificial Sequence
  ELANE RNA Guide
gccagggacugcaccccguug

SEQ ID NO: 17805 - RNA, 21 nt, Artificial Sequence
  ELANE RNA Guide
gcccauggccagggacugcac

SEQ ID NO: 17806 - RNA, 21 nt, Artificial Sequence
  ELANE RNA Guide
gccccagcccauggccaggga

SEQ ID NO: 17807 - RNA, 21 nt, Artificial Sequence
  ELANE RNA Guide
ggacugcaccccguugcccag

SEQ ID NO: 17808 - RNA, 21 nt, Artificial Sequence
  ELANE RNA Guide
ggcaacggggugcagucccug

SEQ ID NO: 17809 - RNA, 21 nt, Artificial Sequence
  ELANE RNA Guide
ggccagggacugcaccccguu

SEQ ID NO: 17810 - RNA, 21 nt, Artificial Sequence
  ELANE RNA Guide
gggacugcaccccguugccca

SEQ ID NO: 17811 - RNA, 21 nt, Artificial Sequence
  ELANE RNA Guide
gggcaacggggugcagucccu

SEQ ID NO: 17812 - RNA, 21 nt, Artificial Sequence
  ELANE RNA Guide
ggggugcagucccuggccaug

SEQ ID NO: 17813 - RNA, 21 nt, Artificial Sequence
  ELANE RNA Guide
gggugcagucccuggccaugg

SEQ ID NO: 17814 - RNA, 21 nt, Artificial Sequence
  ELANE RNA Guide
ggugcagucccuggccauggg

SEQ ID NO: 17815 - RNA, 21 nt, Artificial Sequence
  ELANE RNA Guide
gucccuggccaugggcugggg

SEQ ID NO: 17816 - RNA, 21 nt, Artificial Sequence
  ELANE RNA Guide
gugcagucccuggccaugggc

SEQ ID NO: 17817 - RNA, 21 nt, Artificial Sequence
  ELANE RNA Guide
ucccuggccaugggcuggggc

SEQ ID NO: 17818 - RNA, 21 nt, Artificial Sequence
  ELANE RNA Guide
ugcagucccuggccaugggcu

SEQ ID NO: 17819 - RNA, 21 nt, Artificial Sequence
  ELANE RNA Guide
uggccagggacugcaccccgu

SEQ ID NO: 17820 - RNA, 21 nt, Artificial Sequence
  ELANE RNA Guide
ugggcaacggggugcaguccc

SEQ ID NO: 17821 - RNA, 22 nt, Artificial Sequence
  ELANE RNA Guide
aacggggugcagucccuggcca

SEQ ID NO: 17822 - RNA, 22 nt, Artificial Sequence
  ELANE RNA Guide
acggggugcagucccuggccau

SEQ ID NO: 17823 - RNA, 22 nt, Artificial Sequence
  ELANE RNA Guide
agcccauggccagggacugcac

SEQ ID NO: 17824 - RNA, 22 nt, Artificial Sequence
  ELANE RNA Guide
aggccccagcccauggccaggg

SEQ ID NO: 17825 - RNA, 22 nt, Artificial Sequence
  ELANE RNA Guide
agggacugcaccccguugccca

SEQ ID NO: 17826 - RNA, 22 nt, Artificial Sequence
  ELANE RNA Guide
agucccuggccaugggcugggg

SEQ ID NO: 17827 - RNA, 22 nt, Artificial Sequence
  ELANE RNA Guide
auggccagggacugcaccccgu

SEQ ID NO: 17828 - RNA, 22 nt, Artificial Sequence
  ELANE RNA Guide
caacggggugcagucccuggcc

SEQ ID NO: 17829 - RNA, 22 nt, Artificial Sequence
  ELANE RNA Guide
cagcccauggccagggacugca

SEQ ID NO: 17830 - RNA, 22 nt, Artificial Sequence
  ELANE RNA Guide
cagggacugcaccccguugccc

SEQ ID NO: 17831 - RNA, 22 nt, Artificial Sequence
  ELANE RNA Guide
cagucccuggccaugggcuggg

SEQ ID NO: 17832 - RNA, 22 nt, Artificial Sequence
  ELANE RNA Guide
cauggccagggacugcaccccg

SEQ ID NO: 17833 - RNA, 22 nt, Artificial Sequence
  ELANE RNA Guide
ccagcccauggccagggacugc

SEQ ID NO: 17834 - RNA, 22 nt, Artificial Sequence
  ELANE RNA Guide
ccagggacugcaccccguugcc

SEQ ID NO: 17835 - RNA, 22 nt, Artificial Sequence
  ELANE RNA Guide
ccauggccagggacugcacccc

SEQ ID NO: 17836 - RNA, 22 nt, Artificial Sequence
  ELANE RNA Guide
cccagcccauggccagggacug

SEQ ID NO: 17837 - RNA, 22 nt, Artificial Sequence
  ELANE RNA Guide
cccauggccagggacugcaccc

SEQ ID NO: 17838 - RNA, 22 nt, Artificial Sequence
  ELANE RNA Guide
ccccagcccauggccagggacu

SEQ ID NO: 17839 - RNA, 22 nt, Artificial Sequence
  ELANE RNA Guide
ccugggcaacggggugcagucc

SEQ ID NO: 17840 - RNA, 22 nt, Artificial Sequence
  ELANE RNA Guide
cggggugcagucccuggccaug

SEQ ID NO: 17841 - RNA, 22 nt, Artificial Sequence
  ELANE RNA Guide
cugggcaacggggugcaguccc

SEQ ID NO: 17842 - RNA, 22 nt, Artificial Sequence
  ELANE RNA Guide
gcaacggggugcagucccuggc

SEQ ID NO: 17843 - RNA, 22 nt, Artificial Sequence
  ELANE RNA Guide
gcagucccuggccaugggcugg

SEQ ID NO: 17844 - RNA, 22 nt, Artificial Sequence
  ELANE RNA Guide
gccagggacugcaccccguugc

SEQ ID NO: 17845 - RNA, 22 nt, Artificial Sequence
  ELANE RNA Guide
gcccauggccagggacugcacc

SEQ ID NO: 17846 - RNA, 22 nt, Artificial Sequence
  ELANE RNA Guide
gccccagcccauggccagggac

SEQ ID NO: 17847 - RNA, 22 nt, Artificial Sequence
  ELANE RNA Guide
gccugggcaacggggugcaguc

SEQ ID NO: 17848 - RNA, 22 nt, Artificial Sequence
  ELANE RNA Guide
ggacugcaccccguugcccagg

SEQ ID NO: 17849 - RNA, 22 nt, Artificial Sequence
  ELANE RNA Guide
ggcaacggggugcagucccugg

SEQ ID NO: 17850 - RNA, 22 nt, Artificial Sequence
  ELANE RNA Guide
ggccagggacugcaccccguug

SEQ ID NO: 17851 - RNA, 22 nt, Artificial Sequence
  ELANE RNA Guide
ggccccagcccauggccaggga

SEQ ID NO: 17852 - RNA, 22 nt, Artificial Sequence
  ELANE RNA Guide
gggacugcaccccguugcccag

SEQ ID NO: 17853 - RNA, 22 nt, Artificial Sequence
  ELANE RNA Guide
gggcaacggggugcagucccug

SEQ ID NO: 17854 - RNA, 22 nt, Artificial Sequence
  ELANE RNA Guide
ggggugcagucccuggccaugg

SEQ ID NO: 17855 - RNA, 22 nt, Artificial Sequence
  ELANE RNA Guide
gggugcagucccuggccauggg

SEQ ID NO: 17856 - RNA, 22 nt, Artificial Sequence
  ELANE RNA Guide
ggugcagucccuggccaugggc

SEQ ID NO: 17857 - RNA, 22 nt, Artificial Sequence
  ELANE RNA Guide
gucccuggccaugggcuggggc

SEQ ID NO: 17858 - RNA, 22 nt, Artificial Sequence
  ELANE RNA Guide
gugcagucccuggccaugggcu

SEQ ID NO: 17859 - RNA, 22 nt, Artificial Sequence
  ELANE RNA Guide
ucccuggccaugggcuggggcc

SEQ ID NO: 17860 - RNA, 22 nt, Artificial Sequence
  ELANE RNA Guide
ugcagucccuggccaugggcug

SEQ ID NO: 17861 - RNA, 22 nt, Artificial Sequence
  ELANE RNA Guide
uggccagggacugcaccccguu

SEQ ID NO: 17862 - RNA, 22 nt, Artificial Sequence
  ELANE RNA Guide
ugggcaacggggugcagucccu

SEQ ID NO: 17863 - RNA, 20 nt, Artificial Sequence
  ELANE RNA Guide
aacggggugcaguuccuggc

SEQ ID NO: 17864 - RNA, 20 nt, Artificial Sequence
  ELANE RNA Guide
acggggugcaguuccuggcc

SEQ ID NO: 17865 - RNA, 20 nt, Artificial Sequence
  ELANE RNA Guide
agcccauggccaggaacugc

SEQ ID NO: 17866 - RNA, 20 nt, Artificial Sequence
  ELANE RNA Guide
aggaacugcaccccguugcc

SEQ ID NO: 17867 - RNA, 20 nt, Artificial Sequence
  ELANE RNA Guide
aguuccuggccaugggcugg

SEQ ID NO: 17868 - RNA, 20 nt, Artificial Sequence
  ELANE RNA Guide
auggccaggaacugcacccc

SEQ ID NO: 17869 - RNA, 20 nt, Artificial Sequence
  ELANE RNA Guide
caacggggugcaguuccugg

SEQ ID NO: 17870 - RNA, 20 nt, Artificial Sequence
  ELANE RNA Guide
cagcccauggccaggaacug

SEQ ID NO: 17871 - RNA, 20 nt, Artificial Sequence
  ELANE RNA Guide
caggaacugcaccccguugc

SEQ ID NO: 17872 - RNA, 20 nt, Artificial Sequence
  ELANE RNA Guide
caguuccuggccaugggcug

SEQ ID NO: 17873 - RNA, 20 nt, Artificial Sequence
  ELANE RNA Guide
cauggccaggaacugcaccc

SEQ ID NO: 17874 - RNA, 20 nt, Artificial Sequence
  ELANE RNA Guide
ccagcccauggccaggaacu

SEQ ID NO: 17875 - RNA, 20 nt, Artificial Sequence
  ELANE RNA Guide
ccaggaacugcaccccguug

SEQ ID NO: 17876 - RNA, 20 nt, Artificial Sequence
  ELANE RNA Guide
ccauggccaggaacugcacc

SEQ ID NO: 17877 - RNA, 20 nt, Artificial Sequence
  ELANE RNA Guide
cccagcccauggccaggaac

SEQ ID NO: 17878 - RNA, 20 nt, Artificial Sequence
  ELANE RNA Guide
cccauggccaggaacugcac

SEQ ID NO: 17879 - RNA, 20 nt, Artificial Sequence
  ELANE RNA Guide
ccccagcccauggccaggaa

SEQ ID NO: 17880 - RNA, 20 nt, Artificial Sequence
  ELANE RNA Guide
cggggugcaguuccuggcca

SEQ ID NO: 17881 - RNA, 20 nt, Artificial Sequence
  ELANE RNA Guide
cugggcaacggggugcaguu

SEQ ID NO: 17882 - RNA, 20 nt, Artificial Sequence
  ELANE RNA Guide
gaacugcaccccguugccca

SEQ ID NO: 17883 - RNA, 20 nt, Artificial Sequence
  ELANE RNA Guide
gcaacggggugcaguuccug

SEQ ID NO: 17884 - RNA, 20 nt, Artificial Sequence
  ELANE RNA Guide
gcaguuccuggccaugggcu

SEQ ID NO: 17885 - RNA, 20 nt, Artificial Sequence
  ELANE RNA Guide
gccaggaacugcaccccguu

SEQ ID NO: 17886 - RNA, 20 nt, Artificial Sequence
  ELANE RNA Guide
gcccauggccaggaacugca

SEQ ID NO: 17887 - RNA, 20 nt, Artificial Sequence
  ELANE RNA Guide
gccccagcccauggccagga

SEQ ID NO: 17888 - RNA, 20 nt, Artificial Sequence
  ELANE RNA Guide
ggaacugcaccccguugccc

SEQ ID NO: 17889 - RNA, 20 nt, Artificial Sequence
  ELANE RNA Guide
ggcaacggggugcaguuccu

SEQ ID NO: 17890 - RNA, 20 nt, Artificial Sequence
  ELANE RNA Guide
ggccaggaacugcaccccgu

SEQ ID NO: 17891 - RNA, 20 nt, Artificial Sequence
  ELANE RNA Guide
gggcaacggggugcaguucc

SEQ ID NO: 17892 - RNA, 20 nt, Artificial Sequence
  ELANE RNA Guide
ggggugcaguuccuggccau

SEQ ID NO: 17893 - RNA, 20 nt, Artificial Sequence
  ELANE RNA Guide
gggugcaguuccuggccaug

SEQ ID NO: 17894 - RNA, 20 nt, Artificial Sequence
  ELANE RNA Guide
ggugcaguuccuggccaugg

SEQ ID NO: 17895 - RNA, 20 nt, Artificial Sequence
  ELANE RNA Guide
gugcaguuccuggccauggg

SEQ ID NO: 17896 - RNA, 20 nt, Artificial Sequence
  ELANE RNA Guide
guuccuggccaugggcuggg

SEQ ID NO: 17897 - RNA, 20 nt, Artificial Sequence
  ELANE RNA Guide
ugcaguuccuggccaugggc

SEQ ID NO: 17898 - RNA, 20 nt, Artificial Sequence
  ELANE RNA Guide
uggccaggaacugcaccccg

SEQ ID NO: 17899 - RNA, 20 nt, Artificial Sequence
  ELANE RNA Guide
ugggcaacggggugcaguuc

SEQ ID NO: 17900 - RNA, 20 nt, Artificial Sequence
  ELANE RNA Guide
uuccuggccaugggcugggg

SEQ ID NO: 17901 - RNA, 21 nt, Artificial Sequence
  ELANE RNA Guide
aacggggugcaguuccuggcc

SEQ ID NO: 17902 - RNA, 21 nt, Artificial Sequence
  ELANE RNA Guide
acggggugcaguuccuggcca

SEQ ID NO: 17903 - RNA, 21 nt, Artificial Sequence
  ELANE RNA Guide
agcccauggccaggaacugca

SEQ ID NO: 17904 - RNA, 21 nt, Artificial Sequence
  ELANE RNA Guide
aggaacugcaccccguugccc

SEQ ID NO: 17905 - RNA, 21 nt, Artificial Sequence
  ELANE RNA Guide
aguuccuggccaugggcuggg

SEQ ID NO: 17906 - RNA, 21 nt, Artificial Sequence
  ELANE RNA Guide
auggccaggaacugcaccccg

SEQ ID NO: 17907 - RNA, 21 nt, Artificial Sequence
  ELANE RNA Guide
caacggggugcaguuccuggc

SEQ ID NO: 17908 - RNA, 21 nt, Artificial Sequence
  ELANE RNA Guide
cagcccauggccaggaacugc

SEQ ID NO: 17909 - RNA, 21 nt, Artificial Sequence
  ELANE RNA Guide
caggaacugcaccccguugcc

SEQ ID NO: 17910 - RNA, 21 nt, Artificial Sequence
  ELANE RNA Guide
caguuccuggccaugggcugg

SEQ ID NO: 17911 - RNA, 21 nt, Artificial Sequence
  ELANE RNA Guide
cauggccaggaacugcacccc

SEQ ID NO: 17912 - RNA, 21 nt, Artificial Sequence
  ELANE RNA Guide
ccagcccauggccaggaacug

SEQ ID NO: 17913 - RNA, 21 nt, Artificial Sequence
  ELANE RNA Guide
ccaggaacugcaccccguugc

SEQ ID NO: 17914 - RNA, 21 nt, Artificial Sequence
  ELANE RNA Guide
ccauggccaggaacugcaccc

SEQ ID NO: 17915 - RNA, 21 nt, Artificial Sequence
  ELANE RNA Guide
cccagcccauggccaggaacu

SEQ ID NO: 17916 - RNA, 21 nt, Artificial Sequence
  ELANE RNA Guide
cccauggccaggaacugcacc

SEQ ID NO: 17917 - RNA, 21 nt, Artificial Sequence
  ELANE RNA Guide
ccccagcccauggccaggaac

SEQ ID NO: 17918 - RNA, 21 nt, Artificial Sequence
  ELANE RNA Guide
ccugggcaacggggugcaguu

SEQ ID NO: 17919 - RNA, 21 nt, Artificial Sequence
  ELANE RNA Guide
cggggugcaguuccuggccau

SEQ ID NO: 17920 - RNA, 21 nt, Artificial Sequence
  ELANE RNA Guide
cugggcaacggggugcaguuc

SEQ ID NO: 17921 - RNA, 21 nt, Artificial Sequence
  ELANE RNA Guide
gaacugcaccccguugcccag

SEQ ID NO: 17922 - RNA, 21 nt, Artificial Sequence
  ELANE RNA Guide
gcaacggggugcaguuccugg

SEQ ID NO: 17923 - RNA, 21 nt, Artificial Sequence
  ELANE RNA Guide
gcaguuccuggccaugggcug

SEQ ID NO: 17924 - RNA, 21 nt, Artificial Sequence
  ELANE RNA Guide
gccaggaacugcaccccguug

SEQ ID NO: 17925 - RNA, 21 nt, Artificial Sequence
  ELANE RNA Guide
gcccauggccaggaacugcac

SEQ ID NO: 17926 - RNA, 21 nt, Artificial Sequence
  ELANE RNA Guide
gccccagcccauggccaggaa

SEQ ID NO: 17927 - RNA, 21 nt, Artificial Sequence
  ELANE RNA Guide
ggaacugcaccccguugccca

SEQ ID NO: 17928 - RNA, 21 nt, Artificial Sequence
  ELANE RNA Guide
ggcaacggggugcaguuccug

SEQ ID NO: 17929 - RNA, 21 nt, Artificial Sequence
  ELANE RNA Guide
ggccaggaacugcaccccguu

SEQ ID NO: 17930 - RNA, 21 nt, Artificial Sequence
  ELANE RNA Guide
ggccccagcccauggccagga

SEQ ID NO: 17931 - RNA, 21 nt, Artificial Sequence
  ELANE RNA Guide
gggcaacggggugcaguuccu

SEQ ID NO: 17932 - RNA, 21 nt, Artificial Sequence
  ELANE RNA Guide
ggggugcaguuccuggccaug

SEQ ID NO: 17933 - RNA, 21 nt, Artificial Sequence
  ELANE RNA Guide
gggugcaguuccuggccaugg

SEQ ID NO: 17934 - RNA, 21 nt, Artificial Sequence
  ELANE RNA Guide
ggugcaguuccuggccauggg

SEQ ID NO: 17935 - RNA, 21 nt, Artificial Sequence
  ELANE RNA Guide
gugcaguuccuggccaugggc

SEQ ID NO: 17936 - RNA, 21 nt, Artificial Sequence
  ELANE RNA Guide
guuccuggccaugggcugggg

SEQ ID NO: 17937 - RNA, 21 nt, Artificial Sequence
  ELANE RNA Guide
ugcaguuccuggccaugggcu

SEQ ID NO: 17938 - RNA, 21 nt, Artificial Sequence
  ELANE RNA Guide
uggccaggaacugcaccccgu

SEQ ID NO: 17939 - RNA, 21 nt, Artificial Sequence
  ELANE RNA Guide
ugggcaacggggugcaguucc

SEQ ID NO: 17940 - RNA, 21 nt, Artificial Sequence
  ELANE RNA Guide
uuccuggccaugggcuggggc

SEQ ID NO: 17941 - RNA, 22 nt, Artificial Sequence
  ELANE RNA Guide
aacggggugcaguuccuggcca

SEQ ID NO: 17942 - RNA, 22 nt, Artificial Sequence
  ELANE RNA Guide
acggggugcaguuccuggccau

SEQ ID NO: 17943 - RNA, 22 nt, Artificial Sequence
  ELANE RNA Guide
agcccauggccaggaacugcac

SEQ ID NO: 17944 - RNA, 22 nt, Artificial Sequence
  ELANE RNA Guide
aggaacugcaccccguugccca

SEQ ID NO: 17945 - RNA, 22 nt, Artificial Sequence
  ELANE RNA Guide
aggccccagcccauggccagga

SEQ ID NO: 17946 - RNA, 22 nt, Artificial Sequence
  ELANE RNA Guide
aguuccuggccaugggcugggg

SEQ ID NO: 17947 - RNA, 22 nt, Artificial Sequence
  ELANE RNA Guide
auggccaggaacugcaccccgu

SEQ ID NO: 17948 - RNA, 22 nt, Artificial Sequence
  ELANE RNA Guide
caacggggugcaguuccuggcc

SEQ ID NO: 17949 - RNA, 22 nt, Artificial Sequence
  ELANE RNA Guide
cagcccauggccaggaacugca

SEQ ID NO: 17950 - RNA, 22 nt, Artificial Sequence
  ELANE RNA Guide
caggaacugcaccccguugccc

SEQ ID NO: 17951 - RNA, 22 nt, Artificial Sequence
  ELANE RNA Guide
caguuccuggccaugggcuggg

SEQ ID NO: 17952 - RNA, 22 nt, Artificial Sequence
  ELANE RNA Guide
cauggccaggaacugcaccccg

SEQ ID NO: 17953 - RNA, 22 nt, Artificial Sequence
  ELANE RNA Guide
ccagcccauggccaggaacugc

SEQ ID NO: 17954 - RNA, 22 nt, Artificial Sequence
  ELANE RNA Guide
ccaggaacugcaccccguugcc

SEQ ID NO: 17955 - RNA, 22 nt, Artificial Sequence
  ELANE RNA Guide
ccauggccaggaacugcacccc

SEQ ID NO: 17956 - RNA, 22 nt, Artificial Sequence
  ELANE RNA Guide
cccagcccauggccaggaacug

SEQ ID NO: 17957 - RNA, 22 nt, Artificial Sequence
  ELANE RNA Guide
cccauggccaggaacugcaccc

SEQ ID NO: 17958 - RNA, 22 nt, Artificial Sequence
  ELANE RNA Guide
ccccagcccauggccaggaacu

SEQ ID NO: 17959 - RNA, 22 nt, Artificial Sequence
  ELANE RNA Guide
ccugggcaacggggugcaguuc

SEQ ID NO: 17960 - RNA, 22 nt, Artificial Sequence
  ELANE RNA Guide
cggggugcaguuccuggccaug

SEQ ID NO: 17961 - RNA, 22 nt, Artificial Sequence
  ELANE RNA Guide
cugggcaacggggugcaguucc

SEQ ID NO: 17962 - RNA, 22 nt, Artificial Sequence
  ELANE RNA Guide
gaacugcaccccguugcccagg

SEQ ID NO: 17963 - RNA, 22 nt, Artificial Sequence
  ELANE RNA Guide
gcaacggggugcaguuccuggc

SEQ ID NO: 17964 - RNA, 22 nt, Artificial Sequence
  ELANE RNA Guide
gcaguuccuggccaugggcugg

SEQ ID NO: 17965 - RNA, 22 nt, Artificial Sequence
  ELANE RNA Guide
gccaggaacugcaccccguugc

SEQ ID NO: 17966 - RNA, 22 nt, Artificial Sequence
  ELANE RNA Guide
gcccauggccaggaacugcacc

SEQ ID NO: 17967 - RNA, 22 nt, Artificial Sequence
  ELANE RNA Guide
gccccagcccauggccaggaac

SEQ ID NO: 17968 - RNA, 22 nt, Artificial Sequence
  ELANE RNA Guide
gccugggcaacggggugcaguu

SEQ ID NO: 17969 - RNA, 22 nt, Artificial Sequence
  ELANE RNA Guide
ggaacugcaccccguugcccag

SEQ ID NO: 17970 - RNA, 22 nt, Artificial Sequence
  ELANE RNA Guide
ggcaacggggugcaguuccugg

SEQ ID NO: 17971 - RNA, 22 nt, Artificial Sequence
  ELANE RNA Guide
ggccaggaacugcaccccguug

SEQ ID NO: 17972 - RNA, 22 nt, Artificial Sequence
  ELANE RNA Guide
ggccccagcccauggccaggaa

SEQ ID NO: 17973 - RNA, 22 nt, Artificial Sequence
  ELANE RNA Guide
gggcaacggggugcaguuccug

SEQ ID NO: 17974 - RNA, 22 nt, Artificial Sequence
  ELANE RNA Guide
ggggugcaguuccuggccaugg

SEQ ID NO: 17975 - RNA, 22 nt, Artificial Sequence
  ELANE RNA Guide
gggugcaguuccuggccauggg

SEQ ID NO: 17976 - RNA, 22 nt, Artificial Sequence
  ELANE RNA Guide
ggugcaguuccuggccaugggc

SEQ ID NO: 17977 - RNA, 22 nt, Artificial Sequence
  ELANE RNA Guide
gugcaguuccuggccaugggcu

SEQ ID NO: 17978 - RNA, 22 nt, Artificial Sequence
  ELANE RNA Guide
guuccuggccaugggcuggggc

SEQ ID NO: 17979 - RNA, 22 nt, Artificial Sequence
  ELANE RNA Guide
ugcaguuccuggccaugggcug

SEQ ID NO: 17980 - RNA, 22 nt, Artificial Sequence
  ELANE RNA Guide
uggccaggaacugcaccccguu

SEQ ID NO: 17981 - RNA, 22 nt, Artificial Sequence
  ELANE RNA Guide
ugggcaacggggugcaguuccu

SEQ ID NO: 17982 - RNA, 22 nt, Artificial Sequence
  ELANE RNA Guide
uuccuggccaugggcuggggcc

SEQ ID NO: 17983 - RNA, 20 nt, Artificial Sequence
  ELANE RNA Guide
aacggggugcaguggcuggc

SEQ ID NO: 17984 - RNA, 20 nt, Artificial Sequence
  ELANE RNA Guide
acggggugcaguggcuggcc

SEQ ID NO: 17985 - RNA, 20 nt, Artificial Sequence
  ELANE RNA Guide
agaaggccccagcccauggc

SEQ ID NO: 17986 - RNA, 20 nt, Artificial Sequence
  ELANE RNA Guide
agccacugcaccccguugcc

SEQ ID NO: 17987 - RNA, 20 nt, Artificial Sequence
  ELANE RNA Guide
agcccauggccagccacugc

SEQ ID NO: 17988 - RNA, 20 nt, Artificial Sequence
  ELANE RNA Guide
aguggcuggccaugggcugg

SEQ ID NO: 17989 - RNA, 20 nt, Artificial Sequence
  ELANE RNA Guide
auggccagccacugcacccc

SEQ ID NO: 17990 - RNA, 20 nt, Artificial Sequence
  ELANE RNA Guide
caacggggugcaguggcugg

SEQ ID NO: 17991 - RNA, 20 nt, Artificial Sequence
  ELANE RNA Guide
cagccacugcaccccguugc

SEQ ID NO: 17992 - RNA, 20 nt, Artificial Sequence
  ELANE RNA Guide
cagcccauggccagccacug

SEQ ID NO: 17993 - RNA, 20 nt, Artificial Sequence
  ELANE RNA Guide
caguggcuggccaugggcug

SEQ ID NO: 17994 - RNA, 20 nt, Artificial Sequence
  ELANE RNA Guide
cauggccagccacugcaccc

SEQ ID NO: 17995 - RNA, 20 nt, Artificial Sequence
  ELANE RNA Guide
ccagccacugcaccccguug

SEQ ID NO: 17996 - RNA, 20 nt, Artificial Sequence
  ELANE RNA Guide
ccagcccauggccagccacu

SEQ ID NO: 17997 - RNA, 20 nt, Artificial Sequence
  ELANE RNA Guide
ccauggccagccacugcacc

SEQ ID NO: 17998 - RNA, 20 nt, Artificial Sequence
  ELANE RNA Guide
cccagcccauggccagccac

SEQ ID NO: 17999 - RNA, 20 nt, Artificial Sequence
  ELANE RNA Guide
cccauggccagccacugcac

SEQ ID NO: 18000 - RNA, 20 nt, Artificial Sequence
  ELANE RNA Guide
ccccagcccauggccagcca

SEQ ID NO: 18001 - RNA, 20 nt, Artificial Sequence
  ELANE RNA Guide
cggggugcaguggcuggcca

SEQ ID NO: 18002 - RNA, 20 nt, Artificial Sequence
  ELANE RNA Guide
cugggcaacggggugcagug

SEQ ID NO: 18003 - RNA, 20 nt, Artificial Sequence
  ELANE RNA Guide
gcaacggggugcaguggcug

SEQ ID NO: 18004 - RNA, 20 nt, Artificial Sequence
  ELANE RNA Guide
gcaguggcuggccaugggcu

SEQ ID NO: 18005 - RNA, 20 nt, Artificial Sequence
  ELANE RNA Guide
gccacugcaccccguugccc

SEQ ID NO: 18006 - RNA, 20 nt, Artificial Sequence
  ELANE RNA Guide
gccagccacugcaccccguu

SEQ ID NO: 18007 - RNA, 20 nt, Artificial Sequence
  ELANE RNA Guide
gcccauggccagccacugca

SEQ ID NO: 18008 - RNA, 20 nt, Artificial Sequence
  ELANE RNA Guide
gccccagcccauggccagcc

SEQ ID NO: 18009 - RNA, 20 nt, Artificial Sequence
  ELANE RNA Guide
ggcaacggggugcaguggcu

SEQ ID NO: 18010 - RNA, 20 nt, Artificial Sequence
  ELANE RNA Guide
ggccagccacugcaccccgu

SEQ ID NO: 18011 - RNA, 20 nt, Artificial Sequence
  ELANE RNA Guide
ggccccagcccauggccagc

SEQ ID NO: 18012 - RNA, 20 nt, Artificial Sequence
  ELANE RNA Guide
ggcuggccaugggcuggggc

SEQ ID NO: 18013 - RNA, 20 nt, Artificial Sequence
  ELANE RNA Guide
gggcaacggggugcaguggc

SEQ ID NO: 18014 - RNA, 20 nt, Artificial Sequence
  ELANE RNA Guide
ggggugcaguggcuggccau

SEQ ID NO: 18015 - RNA, 20 nt, Artificial Sequence
  ELANE RNA Guide
gggugcaguggcuggccaug

SEQ ID NO: 18016 - RNA, 20 nt, Artificial Sequence
  ELANE RNA Guide
ggugcaguggcuggccaugg

SEQ ID NO: 18017 - RNA, 20 nt, Artificial Sequence
  ELANE RNA Guide
gugcaguggcuggccauggg

SEQ ID NO: 18018 - RNA, 20 nt, Artificial Sequence
  ELANE RNA Guide
guggcuggccaugggcuggg

SEQ ID NO: 18019 - RNA, 20 nt, Artificial Sequence
  ELANE RNA Guide
ugcaguggcuggccaugggc

SEQ ID NO: 18020 - RNA, 20 nt, Artificial Sequence
  ELANE RNA Guide
uggccagccacugcaccccg

SEQ ID NO: 18021 - RNA, 20 nt, Artificial Sequence
  ELANE RNA Guide
uggcuggccaugggcugggg

SEQ ID NO: 18022 - RNA, 20 nt, Artificial Sequence
  ELANE RNA Guide
ugggcaacggggugcagugg

SEQ ID NO: 18023 - RNA, 21 nt, Artificial Sequence
  ELANE RNA Guide
aacggggugcaguggcuggcc

SEQ ID NO: 18024 - RNA, 21 nt, Artificial Sequence
  ELANE RNA Guide
acggggugcaguggcuggcca

SEQ ID NO: 18025 - RNA, 21 nt, Artificial Sequence
  ELANE RNA Guide
agccacugcaccccguugccc

SEQ ID NO: 18026 - RNA, 21 nt, Artificial Sequence
  ELANE RNA Guide
agcccauggccagccacugca

SEQ ID NO: 18027 - RNA, 21 nt, Artificial Sequence
  ELANE RNA Guide
aggccccagcccauggccagc

SEQ ID NO: 18028 - RNA, 21 nt, Artificial Sequence
  ELANE RNA Guide
aguggcuggccaugggcuggg

SEQ ID NO: 18029 - RNA, 21 nt, Artificial Sequence
  ELANE RNA Guide
auggccagccacugcaccccg

SEQ ID NO: 18030 - RNA, 21 nt, Artificial Sequence
  ELANE RNA Guide
caacggggugcaguggcuggc

SEQ ID NO: 18031 - RNA, 21 nt, Artificial Sequence
  ELANE RNA Guide
cagaaggccccagcccauggc

SEQ ID NO: 18032 - RNA, 21 nt, Artificial Sequence
  ELANE RNA Guide
cagccacugcaccccguugcc

SEQ ID NO: 18033 - RNA, 21 nt, Artificial Sequence
  ELANE RNA Guide
cagcccauggccagccacugc

SEQ ID NO: 18034 - RNA, 21 nt, Artificial Sequence
  ELANE RNA Guide
caguggcuggccaugggcugg

SEQ ID NO: 18035 - RNA, 21 nt, Artificial Sequence
  ELANE RNA Guide
cauggccagccacugcacccc

SEQ ID NO: 18036 - RNA, 21 nt, Artificial Sequence
  ELANE RNA Guide
ccagccacugcaccccguugc

SEQ ID NO: 18037 - RNA, 21 nt, Artificial Sequence
  ELANE RNA Guide
ccagcccauggccagccacug

SEQ ID NO: 18038 - RNA, 21 nt, Artificial Sequence
  ELANE RNA Guide
ccauggccagccacugcaccc

SEQ ID NO: 18039 - RNA, 21 nt, Artificial Sequence
  ELANE RNA Guide
cccagcccauggccagccacu

SEQ ID NO: 18040 - RNA, 21 nt, Artificial Sequence
  ELANE RNA Guide
cccauggccagccacugcacc

SEQ ID NO: 18041 - RNA, 21 nt, Artificial Sequence
  ELANE RNA Guide
ccccagcccauggccagccac

SEQ ID NO: 18042 - RNA, 21 nt, Artificial Sequence
  ELANE RNA Guide
ccugggcaacggggugcagug

SEQ ID NO: 18043 - RNA, 21 nt, Artificial Sequence
  ELANE RNA Guide
cggggugcaguggcuggccau

SEQ ID NO: 18044 - RNA, 21 nt, Artificial Sequence
  ELANE RNA Guide
cugggcaacggggugcagugg

SEQ ID NO: 18045 - RNA, 21 nt, Artificial Sequence
  ELANE RNA Guide
gcaacggggugcaguggcugg

SEQ ID NO: 18046 - RNA, 21 nt, Artificial Sequence
  ELANE RNA Guide
gcaguggcuggccaugggcug

SEQ ID NO: 18047 - RNA, 21 nt, Artificial Sequence
  ELANE RNA Guide
gccacugcaccccguugccca

SEQ ID NO: 18048 - RNA, 21 nt, Artificial Sequence
  ELANE RNA Guide
gccagccacugcaccccguug

SEQ ID NO: 18049 - RNA, 21 nt, Artificial Sequence
  ELANE RNA Guide
gcccauggccagccacugcac

SEQ ID NO: 18050 - RNA, 21 nt, Artificial Sequence
  ELANE RNA Guide
gccccagcccauggccagcca

SEQ ID NO: 18051 - RNA, 21 nt, Artificial Sequence
  ELANE RNA Guide
ggcaacggggugcaguggcug

SEQ ID NO: 18052 - RNA, 21 nt, Artificial Sequence
  ELANE RNA Guide
ggccagccacugcaccccguu

SEQ ID NO: 18053 - RNA, 21 nt, Artificial Sequence
  ELANE RNA Guide
gggcaacggggugcaguggcu

SEQ ID NO: 18054 - RNA, 21 nt, Artificial Sequence
  ELANE RNA Guide
ggggugcaguggcuggccaug

SEQ ID NO: 18055 - RNA, 21 nt, Artificial Sequence
  ELANE RNA Guide
gggugcaguggcuggccaugg

SEQ ID NO: 18056 - RNA, 21 nt, Artificial Sequence
  ELANE RNA Guide
ggugcaguggcuggccauggg

SEQ ID NO: 18057 - RNA, 21 nt, Artificial Sequence
  ELANE RNA Guide
gugcaguggcuggccaugggc

SEQ ID NO: 18058 - RNA, 21 nt, Artificial Sequence
  ELANE RNA Guide
guggcuggccaugggcugggg

SEQ ID NO: 18059 - RNA, 21 nt, Artificial Sequence
  ELANE RNA Guide
ugcaguggcuggccaugggcu

SEQ ID NO: 18060 - RNA, 21 nt, Artificial Sequence
  ELANE RNA Guide
uggccagccacugcaccccgu

SEQ ID NO: 18061 - RNA, 21 nt, Artificial Sequence
  ELANE RNA Guide
uggcuggccaugggcuggggc

SEQ ID NO: 18062 - RNA, 21 nt, Artificial Sequence
  ELANE RNA Guide
ugggcaacggggugcaguggc

SEQ ID NO: 18063 - RNA, 22 nt, Artificial Sequence
  ELANE RNA Guide
aacggggugcaguggcuggcca

SEQ ID NO: 18064 - RNA, 22 nt, Artificial Sequence
  ELANE RNA Guide
aaggccccagcccauggccagc

SEQ ID NO: 18065 - RNA, 22 nt, Artificial Sequence
  ELANE RNA Guide
acggggugcaguggcuggccau

SEQ ID NO: 18066 - RNA, 22 nt, Artificial Sequence
  ELANE RNA Guide
agccacugcaccccguugccca

SEQ ID NO: 18067 - RNA, 22 nt, Artificial Sequence
  ELANE RNA Guide
agcccauggccagccacugcac

SEQ ID NO: 18068 - RNA, 22 nt, Artificial Sequence
  ELANE RNA Guide
aggccccagcccauggccagcc

SEQ ID NO: 18069 - RNA, 22 nt, Artificial Sequence
  ELANE RNA Guide
aguggcuggccaugggcugggg

SEQ ID NO: 18070 - RNA, 22 nt, Artificial Sequence
  ELANE RNA Guide
auggccagccacugcaccccgu

SEQ ID NO: 18071 - RNA, 22 nt, Artificial Sequence
  ELANE RNA Guide
caacggggugcaguggcuggcc

SEQ ID NO: 18072 - RNA, 22 nt, Artificial Sequence
  ELANE RNA Guide
cagccacugcaccccguugccc

SEQ ID NO: 18073 - RNA, 22 nt, Artificial Sequence
  ELANE RNA Guide
cagcccauggccagccacugca

SEQ ID NO: 18074 - RNA, 22 nt, Artificial Sequence
  ELANE RNA Guide
caguggcuggccaugggcuggg

SEQ ID NO: 18075 - RNA, 22 nt, Artificial Sequence
  ELANE RNA Guide
cauggccagccacugcaccccg

SEQ ID NO: 18076 - RNA, 22 nt, Artificial Sequence
  ELANE RNA Guide
ccagaaggccccagcccauggc

SEQ ID NO: 18077 - RNA, 22 nt, Artificial Sequence
  ELANE RNA Guide
ccagccacugcaccccguugcc

SEQ ID NO: 18078 - RNA, 22 nt, Artificial Sequence
  ELANE RNA Guide
ccagcccauggccagccacugc

SEQ ID NO: 18079 - RNA, 22 nt, Artificial Sequence
  ELANE RNA Guide
ccauggccagccacugcacccc

SEQ ID NO: 18080 - RNA, 22 nt, Artificial Sequence
  ELANE RNA Guide
cccagcccauggccagccacug

SEQ ID NO: 18081 - RNA, 22 nt, Artificial Sequence
  ELANE RNA Guide
cccauggccagccacugcaccc

SEQ ID NO: 18082 - RNA, 22 nt, Artificial Sequence
  ELANE RNA Guide
ccccagcccauggccagccacu

SEQ ID NO: 18083 - RNA, 22 nt, Artificial Sequence
  ELANE RNA Guide
ccugggcaacggggugcagugg

SEQ ID NO: 18084 - RNA, 22 nt, Artificial Sequence
  ELANE RNA Guide
cggggugcaguggcuggccaug

SEQ ID NO: 18085 - RNA, 22 nt, Artificial Sequence
  ELANE RNA Guide
cugggcaacggggugcaguggc

SEQ ID NO: 18086 - RNA, 22 nt, Artificial Sequence
  ELANE RNA Guide
gcaacggggugcaguggcuggc

SEQ ID NO: 18087 - RNA, 22 nt, Artificial Sequence
  ELANE RNA Guide
gcaguggcuggccaugggcugg

SEQ ID NO: 18088 - RNA, 22 nt, Artificial Sequence
  ELANE RNA Guide
gccacugcaccccguugcccag

SEQ ID NO: 18089 - RNA, 22 nt, Artificial Sequence
  ELANE RNA Guide
gccagccacugcaccccguugc

SEQ ID NO: 18090 - RNA, 22 nt, Artificial Sequence
  ELANE RNA Guide
gcccauggccagccacugcacc

SEQ ID NO: 18091 - RNA, 22 nt, Artificial Sequence
  ELANE RNA Guide
gccccagcccauggccagccac

SEQ ID NO: 18092 - RNA, 22 nt, Artificial Sequence
  ELANE RNA Guide
gccugggcaacggggugcagug

SEQ ID NO: 18093 - RNA, 22 nt, Artificial Sequence
  ELANE RNA Guide
ggcaacggggugcaguggcugg

SEQ ID NO: 18094 - RNA, 22 nt, Artificial Sequence
  ELANE RNA Guide
ggccagccacugcaccccguug

SEQ ID NO: 18095 - RNA, 22 nt, Artificial Sequence
  ELANE RNA Guide
ggccccagcccauggccagcca

SEQ ID NO: 18096 - RNA, 22 nt, Artificial Sequence
  ELANE RNA Guide
ggcuggccaugggcuggggccu

SEQ ID NO: 18097 - RNA, 22 nt, Artificial Sequence
  ELANE RNA Guide
gggcaacggggugcaguggcug

SEQ ID NO: 18098 - RNA, 22 nt, Artificial Sequence
  ELANE RNA Guide
ggggugcaguggcuggccaugg

SEQ ID NO: 18099 - RNA, 22 nt, Artificial Sequence
  ELANE RNA Guide
gggugcaguggcuggccauggg

SEQ ID NO: 18100 - RNA, 22 nt, Artificial Sequence
  ELANE RNA Guide
ggugcaguggcuggccaugggc

SEQ ID NO: 18101 - RNA, 22 nt, Artificial Sequence
  ELANE RNA Guide
gugcaguggcuggccaugggcu

SEQ ID NO: 18102 - RNA, 22 nt, Artificial Sequence
  ELANE RNA Guide
guggcuggccaugggcuggggc

SEQ ID NO: 18103 - RNA, 22 nt, Artificial Sequence
  ELANE RNA Guide
ugcaguggcuggccaugggcug

SEQ ID NO: 18104 - RNA, 22 nt, Artificial Sequence
  ELANE RNA Guide
uggccagccacugcaccccguu

SEQ ID NO: 18105 - RNA, 22 nt, Artificial Sequence
  ELANE RNA Guide
uggcuggccaugggcuggggcc

SEQ ID NO: 18106 - RNA, 22 nt, Artificial Sequence
  ELANE RNA Guide
ugggcaacggggugcaguggcu

SEQ ID NO: 18107 - RNA, 20 nt, Artificial Sequence
  ELANE RNA Guide
aacggggugcagugcccggc

SEQ ID NO: 18108 - RNA, 20 nt, Artificial Sequence
  ELANE RNA Guide
aaggccccagcccauggccg

SEQ ID NO: 18109 - RNA, 20 nt, Artificial Sequence
  ELANE RNA Guide
acggggugcagugcccggcc

SEQ ID NO: 18110 - RNA, 20 nt, Artificial Sequence
  ELANE RNA Guide
agcccauggccgggcacugc

SEQ ID NO: 18111 - RNA, 20 nt, Artificial Sequence
  ELANE RNA Guide
aggccccagcccauggccgg

SEQ ID NO: 18112 - RNA, 20 nt, Artificial Sequence
  ELANE RNA Guide
agugcccggccaugggcugg

SEQ ID NO: 18113 - RNA, 20 nt, Artificial Sequence
  ELANE RNA Guide
auggccgggcacugcacccc

SEQ ID NO: 18114 - RNA, 20 nt, Artificial Sequence
  ELANE RNA Guide
caacggggugcagugcccgg

SEQ ID NO: 18115 - RNA, 20 nt, Artificial Sequence
  ELANE RNA Guide
cagaaggccccagcccaugg

SEQ ID NO: 18116 - RNA, 20 nt, Artificial Sequence
  ELANE RNA Guide
cagcccauggccgggcacug

SEQ ID NO: 18117 - RNA, 20 nt, Artificial Sequence
  ELANE RNA Guide
cagugcccggccaugggcug

SEQ ID NO: 18118 - RNA, 20 nt, Artificial Sequence
  ELANE RNA Guide
cauggccgggcacugcaccc

SEQ ID NO: 18119 - RNA, 20 nt, Artificial Sequence
  ELANE RNA Guide
ccagaaggccccagcccaug

SEQ ID NO: 18120 - RNA, 20 nt, Artificial Sequence
  ELANE RNA Guide
ccagcccauggccgggcacu

SEQ ID NO: 18121 - RNA, 20 nt, Artificial Sequence
  ELANE RNA Guide
ccauggccgggcacugcacc

SEQ ID NO: 18122 - RNA, 20 nt, Artificial Sequence
  ELANE RNA Guide
cccagcccauggccgggcac

SEQ ID NO: 18123 - RNA, 20 nt, Artificial Sequence
  ELANE RNA Guide
cccauggccgggcacugcac

SEQ ID NO: 18124 - RNA, 20 nt, Artificial Sequence
  ELANE RNA Guide
ccccagcccauggccgggca

SEQ ID NO: 18125 - RNA, 20 nt, Artificial Sequence
  ELANE RNA Guide
ccggccaugggcuggggccu

SEQ ID NO: 18126 - RNA, 20 nt, Artificial Sequence
  ELANE RNA Guide
ccgggcacugcaccccguug

SEQ ID NO: 18127 - RNA, 20 nt, Artificial Sequence
  ELANE RNA Guide
cgggcacugcaccccguugc

SEQ ID NO: 18128 - RNA, 20 nt, Artificial Sequence
  ELANE RNA Guide
cggggugcagugcccggcca

SEQ ID NO: 18129 - RNA, 20 nt, Artificial Sequence
  ELANE RNA Guide
gcaacggggugcagugcccg

SEQ ID NO: 18130 - RNA, 20 nt, Artificial Sequence
  ELANE RNA Guide
gcagugcccggccaugggcu

SEQ ID NO: 18131 - RNA, 20 nt, Artificial Sequence
  ELANE RNA Guide
gcccauggccgggcacugca

SEQ ID NO: 18132 - RNA, 20 nt, Artificial Sequence
  ELANE RNA Guide
gccgggcacugcaccccguu

SEQ ID NO: 18133 - RNA, 20 nt, Artificial Sequence
  ELANE RNA Guide
ggcaacggggugcagugccc

SEQ ID NO: 18134 - RNA, 20 nt, Artificial Sequence
  ELANE RNA Guide
ggccgggcacugcaccccgu

SEQ ID NO: 18135 - RNA, 20 nt, Artificial Sequence
  ELANE RNA Guide
gggcaacggggugcagugcc

SEQ ID NO: 18136 - RNA, 20 nt, Artificial Sequence
  ELANE RNA Guide
ggggugcagugcccggccau

SEQ ID NO: 18137 - RNA, 20 nt, Artificial Sequence
  ELANE RNA Guide
gggugcagugcccggccaug

SEQ ID NO: 18138 - RNA, 20 nt, Artificial Sequence
  ELANE RNA Guide
ggugcagugcccggccaugg

SEQ ID NO: 18139 - RNA, 20 nt, Artificial Sequence
  ELANE RNA Guide
gugcagugcccggccauggg

SEQ ID NO: 18140 - RNA, 20 nt, Artificial Sequence
  ELANE RNA Guide
gugcccggccaugggcuggg

SEQ ID NO: 18141 - RNA, 20 nt, Artificial Sequence
  ELANE RNA Guide
ugcagugcccggccaugggc

SEQ ID NO: 18142 - RNA, 20 nt, Artificial Sequence
  ELANE RNA Guide
ugcccggccaugggcugggg

SEQ ID NO: 18143 - RNA, 20 nt, Artificial Sequence
  ELANE RNA Guide
uggccgggcacugcaccccg

SEQ ID NO: 18144 - RNA, 20 nt, Artificial Sequence
  ELANE RNA Guide
ugggcaacggggugcagugc

SEQ ID NO: 18145 - RNA, 21 nt, Artificial Sequence
  ELANE RNA Guide
aacggggugcagugcccggcc

SEQ ID NO: 18146 - RNA, 21 nt, Artificial Sequence
  ELANE RNA Guide
aaggccccagcccauggccgg

SEQ ID NO: 18147 - RNA, 21 nt, Artificial Sequence
  ELANE RNA Guide
acggggugcagugcccggcca

SEQ ID NO: 18148 - RNA, 21 nt, Artificial Sequence
  ELANE RNA Guide
agcccauggccgggcacugca

SEQ ID NO: 18149 - RNA, 21 nt, Artificial Sequence
  ELANE RNA Guide
agugcccggccaugggcuggg

SEQ ID NO: 18150 - RNA, 21 nt, Artificial Sequence
  ELANE RNA Guide
auggccgggcacugcaccccg

SEQ ID NO: 18151 - RNA, 21 nt, Artificial Sequence
  ELANE RNA Guide
caacggggugcagugcccggc

SEQ ID NO: 18152 - RNA, 21 nt, Artificial Sequence
  ELANE RNA Guide
cagcccauggccgggcacugc

SEQ ID NO: 18153 - RNA, 21 nt, Artificial Sequence
  ELANE RNA Guide
cagugcccggccaugggcugg

SEQ ID NO: 18154 - RNA, 21 nt, Artificial Sequence
  ELANE RNA Guide
cauggccgggcacugcacccc

SEQ ID NO: 18155 - RNA, 21 nt, Artificial Sequence
  ELANE RNA Guide
ccagaaggccccagcccaugg

SEQ ID NO: 18156 - RNA, 21 nt, Artificial Sequence
  ELANE RNA Guide
ccagcccauggccgggcacug

SEQ ID NO: 18157 - RNA, 21 nt, Artificial Sequence
  ELANE RNA Guide
ccauggccgggcacugcaccc

SEQ ID NO: 18158 - RNA, 21 nt, Artificial Sequence
  ELANE RNA Guide
cccagaaggccccagcccaug

SEQ ID NO: 18159 - RNA, 21 nt, Artificial Sequence
  ELANE RNA Guide
cccagcccauggccgggcacu

SEQ ID NO: 18160 - RNA, 21 nt, Artificial Sequence
  ELANE RNA Guide
cccauggccgggcacugcacc

SEQ ID NO: 18161 - RNA, 21 nt, Artificial Sequence
  ELANE RNA Guide
ccggccaugggcuggggccuu

SEQ ID NO: 18162 - RNA, 21 nt, Artificial Sequence
  ELANE RNA Guide
ccgggcacugcaccccguugc

SEQ ID NO: 18163 - RNA, 21 nt, Artificial Sequence
  ELANE RNA Guide
cgggcacugcaccccguugcc

SEQ ID NO: 18164 - RNA, 21 nt, Artificial Sequence
  ELANE RNA Guide
cggggugcagugcccggccau

SEQ ID NO: 18165 - RNA, 21 nt, Artificial Sequence
  ELANE RNA Guide
cugggcaacggggugcagugc

SEQ ID NO: 18166 - RNA, 21 nt, Artificial Sequence
  ELANE RNA Guide
gaaggccccagcccauggccg

SEQ ID NO: 18167 - RNA, 21 nt, Artificial Sequence
  ELANE RNA Guide
gcaacggggugcagugcccgg

SEQ ID NO: 18168 - RNA, 21 nt, Artificial Sequence
  ELANE RNA Guide
gcagugcccggccaugggcug

SEQ ID NO: 18169 - RNA, 21 nt, Artificial Sequence
  ELANE RNA Guide
gcccauggccgggcacugcac

SEQ ID NO: 18170 - RNA, 21 nt, Artificial Sequence
  ELANE RNA Guide
gccgggcacugcaccccguug

SEQ ID NO: 18171 - RNA, 21 nt, Artificial Sequence
  ELANE RNA Guide
ggcaacggggugcagugcccg

SEQ ID NO: 18172 - RNA, 21 nt, Artificial Sequence
  ELANE RNA Guide
ggccgggcacugcaccccguu

SEQ ID NO: 18173 - RNA, 21 nt, Artificial Sequence
  ELANE RNA Guide
gggcaacggggugcagugccc

SEQ ID NO: 18174 - RNA, 21 nt, Artificial Sequence
  ELANE RNA Guide
ggggugcagugcccggccaug

SEQ ID NO: 18175 - RNA, 21 nt, Artificial Sequence
  ELANE RNA Guide
gggugcagugcccggccaugg

SEQ ID NO: 18176 - RNA, 21 nt, Artificial Sequence
  ELANE RNA Guide
ggugcagugcccggccauggg

SEQ ID NO: 18177 - RNA, 21 nt, Artificial Sequence
  ELANE RNA Guide
gugcagugcccggccaugggc

SEQ ID NO: 18178 - RNA, 21 nt, Artificial Sequence
  ELANE RNA Guide
ugcagugcccggccaugggcu

SEQ ID NO: 18179 - RNA, 21 nt, Artificial Sequence
  ELANE RNA Guide
uggccgggcacugcaccccgu

SEQ ID NO: 18180 - RNA, 21 nt, Artificial Sequence
  ELANE RNA Guide
ugggcaacggggugcagugcc

SEQ ID NO: 18181 - RNA, 22 nt, Artificial Sequence
  ELANE RNA Guide
aacggggugcagugcccggcca

SEQ ID NO: 18182 - RNA, 22 nt, Artificial Sequence
  ELANE RNA Guide
aaggccccagcccauggccggg

SEQ ID NO: 18183 - RNA, 22 nt, Artificial Sequence
  ELANE RNA Guide
acggggugcagugcccggccau

SEQ ID NO: 18184 - RNA, 22 nt, Artificial Sequence
  ELANE RNA Guide
agaaggccccagcccauggccg

SEQ ID NO: 18185 - RNA, 22 nt, Artificial Sequence
  ELANE RNA Guide
agcccauggccgggcacugcac

SEQ ID NO: 18186 - RNA, 22 nt, Artificial Sequence
  ELANE RNA Guide
agugcccggccaugggcugggg

SEQ ID NO: 18187 - RNA, 22 nt, Artificial Sequence
  ELANE RNA Guide
auggccgggcacugcaccccgu

SEQ ID NO: 18188 - RNA, 22 nt, Artificial Sequence
  ELANE RNA Guide
caacggggugcagugcccggcc

SEQ ID NO: 18189 - RNA, 22 nt, Artificial Sequence
  ELANE RNA Guide
cagcccauggccgggcacugca

SEQ ID NO: 18190 - RNA, 22 nt, Artificial Sequence
  ELANE RNA Guide
cagugcccggccaugggcuggg

SEQ ID NO: 18191 - RNA, 22 nt, Artificial Sequence
  ELANE RNA Guide
cauggccgggcacugcaccccg

SEQ ID NO: 18192 - RNA, 22 nt, Artificial Sequence
  ELANE RNA Guide
ccagcccauggccgggcacugc

SEQ ID NO: 18193 - RNA, 22 nt, Artificial Sequence
  ELANE RNA Guide
ccauggccgggcacugcacccc

SEQ ID NO: 18194 - RNA, 22 nt, Artificial Sequence
  ELANE RNA Guide
cccagaaggccccagcccaugg

SEQ ID NO: 18195 - RNA, 22 nt, Artificial Sequence
  ELANE RNA Guide
cccagcccauggccgggcacug

SEQ ID NO: 18196 - RNA, 22 nt, Artificial Sequence
  ELANE RNA Guide
cccauggccgggcacugcaccc

SEQ ID NO: 18197 - RNA, 22 nt, Artificial Sequence
  ELANE RNA Guide
ccccagcccauggccgggcacu

SEQ ID NO: 18198 - RNA, 22 nt, Artificial Sequence
  ELANE RNA Guide
cccggccaugggcuggggccuu

SEQ ID NO: 18199 - RNA, 22 nt, Artificial Sequence
  ELANE RNA Guide
ccggccaugggcuggggccuuc

SEQ ID NO: 18200 - RNA, 22 nt, Artificial Sequence
  ELANE RNA Guide
ccgggcacugcaccccguugcc

SEQ ID NO: 18201 - RNA, 22 nt, Artificial Sequence
  ELANE RNA Guide
ccugggcaacggggugcagugc

SEQ ID NO: 18202 - RNA, 22 nt, Artificial Sequence
  ELANE RNA Guide
cgggcacugcaccccguugccc

SEQ ID NO: 18203 - RNA, 22 nt, Artificial Sequence
  ELANE RNA Guide
cggggugcagugcccggccaug

SEQ ID NO: 18204 - RNA, 22 nt, Artificial Sequence
  ELANE RNA Guide
cugggcaacggggugcagugcc

SEQ ID NO: 18205 - RNA, 22 nt, Artificial Sequence
  ELANE RNA Guide
gaaggccccagcccauggccgg

SEQ ID NO: 18206 - RNA, 22 nt, Artificial Sequence
  ELANE RNA Guide
gcaacggggugcagugcccggc

SEQ ID NO: 18207 - RNA, 22 nt, Artificial Sequence
  ELANE RNA Guide
gcagugcccggccaugggcugg

SEQ ID NO: 18208 - RNA, 22 nt, Artificial Sequence
  ELANE RNA Guide
gcccagaaggccccagcccaug

SEQ ID NO: 18209 - RNA, 22 nt, Artificial Sequence
  ELANE RNA Guide
gcccauggccgggcacugcacc

SEQ ID NO: 18210 - RNA, 22 nt, Artificial Sequence
  ELANE RNA Guide
gccgggcacugcaccccguugc

SEQ ID NO: 18211 - RNA, 22 nt, Artificial Sequence
  ELANE RNA Guide
ggcaacggggugcagugcccgg

SEQ ID NO: 18212 - RNA, 22 nt, Artificial Sequence
  ELANE RNA Guide
ggccgggcacugcaccccguug

SEQ ID NO: 18213 - RNA, 22 nt, Artificial Sequence
  ELANE RNA Guide
gggcaacggggugcagugcccg

SEQ ID NO: 18214 - RNA, 22 nt, Artificial Sequence
  ELANE RNA Guide
ggggugcagugcccggccaugg

SEQ ID NO: 18215 - RNA, 22 nt, Artificial Sequence
  ELANE RNA Guide
gggugcagugcccggccauggg

SEQ ID NO: 18216 - RNA, 22 nt, Artificial Sequence
  ELANE RNA Guide
ggugcagugcccggccaugggc

SEQ ID NO: 18217 - RNA, 22 nt, Artificial Sequence
  ELANE RNA Guide
gugcagugcccggccaugggcu

SEQ ID NO: 18218 - RNA, 22 nt, Artificial Sequence
  ELANE RNA Guide
ugcagugcccggccaugggcug

SEQ ID NO: 18219 - RNA, 22 nt, Artificial Sequence
  ELANE RNA Guide
uggccgggcacugcaccccguu

SEQ ID NO: 18220 - RNA, 22 nt, Artificial Sequence
  ELANE RNA Guide
ugggcaacggggugcagugccc

SEQ ID NO: 18221 - RNA, 20 nt, Artificial Sequence
  ELANE RNA Guide
aacggggugcagugccuagc

SEQ ID NO: 18222 - RNA, 20 nt, Artificial Sequence
  ELANE RNA Guide
aaggccccagcccauggcua

SEQ ID NO: 18223 - RNA, 20 nt, Artificial Sequence
  ELANE RNA Guide
acggggugcagugccuagcc

SEQ ID NO: 18224 - RNA, 20 nt, Artificial Sequence
  ELANE RNA Guide
agcccauggcuaggcacugc

SEQ ID NO: 18225 - RNA, 20 nt, Artificial Sequence
  ELANE RNA Guide
aggccccagcccauggcuag

SEQ ID NO: 18226 - RNA, 20 nt, Artificial Sequence
  ELANE RNA Guide
agugccuagccaugggcugg

SEQ ID NO: 18227 - RNA, 20 nt, Artificial Sequence
  ELANE RNA Guide
auggcuaggcacugcacccc

SEQ ID NO: 18228 - RNA, 20 nt, Artificial Sequence
  ELANE RNA Guide
caacggggugcagugccuag

SEQ ID NO: 18229 - RNA, 20 nt, Artificial Sequence
  ELANE RNA Guide
cagcccauggcuaggcacug

SEQ ID NO: 18230 - RNA, 20 nt, Artificial Sequence
  ELANE RNA Guide
cagugccuagccaugggcug

SEQ ID NO: 18231 - RNA, 20 nt, Artificial Sequence
  ELANE RNA Guide
cauggcuaggcacugcaccc

SEQ ID NO: 18232 - RNA, 20 nt, Artificial Sequence
  ELANE RNA Guide
ccagcccauggcuaggcacu

SEQ ID NO: 18233 - RNA, 20 nt, Artificial Sequence
  ELANE RNA Guide
ccauggcuaggcacugcacc

SEQ ID NO: 18234 - RNA, 20 nt, Artificial Sequence
  ELANE RNA Guide
cccagaaggccccagcccau

SEQ ID NO: 18235 - RNA, 20 nt, Artificial Sequence
  ELANE RNA Guide
cccagcccauggcuaggcac

SEQ ID NO: 18236 - RNA, 20 nt, Artificial Sequence
  ELANE RNA Guide
cccauggcuaggcacugcac

SEQ ID NO: 18237 - RNA, 20 nt, Artificial Sequence
  ELANE RNA Guide
ccccagcccauggcuaggca

SEQ ID NO: 18238 - RNA, 20 nt, Artificial Sequence
  ELANE RNA Guide
ccuagccaugggcuggggcc

SEQ ID NO: 18239 - RNA, 20 nt, Artificial Sequence
  ELANE RNA Guide
cggggugcagugccuagcca

SEQ ID NO: 18240 - RNA, 20 nt, Artificial Sequence
  ELANE RNA Guide
cuagccaugggcuggggccu

SEQ ID NO: 18241 - RNA, 20 nt, Artificial Sequence
  ELANE RNA Guide
cuaggcacugcaccccguug

SEQ ID NO: 18242 - RNA, 20 nt, Artificial Sequence
  ELANE RNA Guide
gaaggccccagcccauggcu

SEQ ID NO: 18243 - RNA, 20 nt, Artificial Sequence
  ELANE RNA Guide
gcaacggggugcagugccua

SEQ ID NO: 18244 - RNA, 20 nt, Artificial Sequence
  ELANE RNA Guide
gcagugccuagccaugggcu

SEQ ID NO: 18245 - RNA, 20 nt, Artificial Sequence
  ELANE RNA Guide
gcccauggcuaggcacugca

SEQ ID NO: 18246 - RNA, 20 nt, Artificial Sequence
  ELANE RNA Guide
gccccagcccauggcuaggc

SEQ ID NO: 18247 - RNA, 20 nt, Artificial Sequence
  ELANE RNA Guide
gccuagccaugggcuggggc

SEQ ID NO: 18248 - RNA, 20 nt, Artificial Sequence
  ELANE RNA Guide
gcuaggcacugcaccccguu

SEQ ID NO: 18249 - RNA, 20 nt, Artificial Sequence
  ELANE RNA Guide
ggcaacggggugcagugccu

SEQ ID NO: 18250 - RNA, 20 nt, Artificial Sequence
  ELANE RNA Guide
ggccccagcccauggcuagg

SEQ ID NO: 18251 - RNA, 20 nt, Artificial Sequence
  ELANE RNA Guide
ggcuaggcacugcaccccgu

SEQ ID NO: 18252 - RNA, 20 nt, Artificial Sequence
  ELANE RNA Guide
ggggugcagugccuagccau

SEQ ID NO: 18253 - RNA, 20 nt, Artificial Sequence
  ELANE RNA Guide
gggugcagugccuagccaug

SEQ ID NO: 18254 - RNA, 20 nt, Artificial Sequence
  ELANE RNA Guide
ggugcagugccuagccaugg

SEQ ID NO: 18255 - RNA, 20 nt, Artificial Sequence
  ELANE RNA Guide
gugcagugccuagccauggg

SEQ ID NO: 18256 - RNA, 20 nt, Artificial Sequence
  ELANE RNA Guide
gugccuagccaugggcuggg

SEQ ID NO: 18257 - RNA, 20 nt, Artificial Sequence
  ELANE RNA Guide
uagccaugggcuggggccuu

SEQ ID NO: 18258 - RNA, 20 nt, Artificial Sequence
  ELANE RNA Guide
ugcagugccuagccaugggc

SEQ ID NO: 18259 - RNA, 20 nt, Artificial Sequence
  ELANE RNA Guide
ugccuagccaugggcugggg

SEQ ID NO: 18260 - RNA, 20 nt, Artificial Sequence
  ELANE RNA Guide
uggcuaggcacugcaccccg

SEQ ID NO: 18261 - RNA, 21 nt, Artificial Sequence
  ELANE RNA Guide
aacggggugcagugccuagcc

SEQ ID NO: 18262 - RNA, 21 nt, Artificial Sequence
  ELANE RNA Guide
aaggccccagcccauggcuag

SEQ ID NO: 18263 - RNA, 21 nt, Artificial Sequence
  ELANE RNA Guide
acggggugcagugccuagcca

SEQ ID NO: 18264 - RNA, 21 nt, Artificial Sequence
  ELANE RNA Guide
agaaggccccagcccauggcu

SEQ ID NO: 18265 - RNA, 21 nt, Artificial Sequence
  ELANE RNA Guide
agcccauggcuaggcacugca

SEQ ID NO: 18266 - RNA, 21 nt, Artificial Sequence
  ELANE RNA Guide
aggccccagcccauggcuagg

SEQ ID NO: 18267 - RNA, 21 nt, Artificial Sequence
  ELANE RNA Guide
agugccuagccaugggcuggg

SEQ ID NO: 18268 - RNA, 21 nt, Artificial Sequence
  ELANE RNA Guide
auggcuaggcacugcaccccg

SEQ ID NO: 18269 - RNA, 21 nt, Artificial Sequence
  ELANE RNA Guide
caacggggugcagugccuagc

SEQ ID NO: 18270 - RNA, 21 nt, Artificial Sequence
  ELANE RNA Guide
cagcccauggcuaggcacugc

SEQ ID NO: 18271 - RNA, 21 nt, Artificial Sequence
  ELANE RNA Guide
cagugccuagccaugggcugg

SEQ ID NO: 18272 - RNA, 21 nt, Artificial Sequence
  ELANE RNA Guide
cauggcuaggcacugcacccc

SEQ ID NO: 18273 - RNA, 21 nt, Artificial Sequence
  ELANE RNA Guide
ccagcccauggcuaggcacug

SEQ ID NO: 18274 - RNA, 21 nt, Artificial Sequence
  ELANE RNA Guide
ccauggcuaggcacugcaccc

SEQ ID NO: 18275 - RNA, 21 nt, Artificial Sequence
  ELANE RNA Guide
cccagcccauggcuaggcacu

SEQ ID NO: 18276 - RNA, 21 nt, Artificial Sequence
  ELANE RNA Guide
cccauggcuaggcacugcacc

SEQ ID NO: 18277 - RNA, 21 nt, Artificial Sequence
  ELANE RNA Guide
ccccagcccauggcuaggcac

SEQ ID NO: 18278 - RNA, 21 nt, Artificial Sequence
  ELANE RNA Guide
ccuagccaugggcuggggccu

SEQ ID NO: 18279 - RNA, 21 nt, Artificial Sequence
  ELANE RNA Guide
cggggugcagugccuagccau

SEQ ID NO: 18280 - RNA, 21 nt, Artificial Sequence
  ELANE RNA Guide
cuagccaugggcuggggccuu

SEQ ID NO: 18281 - RNA, 21 nt, Artificial Sequence
  ELANE RNA Guide
cuaggcacugcaccccguugc

SEQ ID NO: 18282 - RNA, 21 nt, Artificial Sequence
  ELANE RNA Guide
gaaggccccagcccauggcua

SEQ ID NO: 18283 - RNA, 21 nt, Artificial Sequence
  ELANE RNA Guide
gcaacggggugcagugccuag

SEQ ID NO: 18284 - RNA, 21 nt, Artificial Sequence
  ELANE RNA Guide
gcagugccuagccaugggcug

SEQ ID NO: 18285 - RNA, 21 nt, Artificial Sequence
  ELANE RNA Guide
gcccagaaggccccagcccau

SEQ ID NO: 18286 - RNA, 21 nt, Artificial Sequence
  ELANE RNA Guide
gcccauggcuaggcacugcac

SEQ ID NO: 18287 - RNA, 21 nt, Artificial Sequence
  ELANE RNA Guide
gccccagcccauggcuaggca

SEQ ID NO: 18288 - RNA, 21 nt, Artificial Sequence
  ELANE RNA Guide
gccuagccaugggcuggggcc

SEQ ID NO: 18289 - RNA, 21 nt, Artificial Sequence
  ELANE RNA Guide
gcuaggcacugcaccccguug

SEQ ID NO: 18290 - RNA, 21 nt, Artificial Sequence
  ELANE RNA Guide
ggcaacggggugcagugccua

SEQ ID NO: 18291 - RNA, 21 nt, Artificial Sequence
  ELANE RNA Guide
ggccccagcccauggcuaggc

SEQ ID NO: 18292 - RNA, 21 nt, Artificial Sequence
  ELANE RNA Guide
ggcuaggcacugcaccccguu

SEQ ID NO: 18293 - RNA, 21 nt, Artificial Sequence
  ELANE RNA Guide
gggcaacggggugcagugccu

SEQ ID NO: 18294 - RNA, 21 nt, Artificial Sequence
  ELANE RNA Guide
ggggugcagugccuagccaug

SEQ ID NO: 18295 - RNA, 21 nt, Artificial Sequence
  ELANE RNA Guide
gggugcagugccuagccaugg

SEQ ID NO: 18296 - RNA, 21 nt, Artificial Sequence
  ELANE RNA Guide
ggugcagugccuagccauggg

SEQ ID NO: 18297 - RNA, 21 nt, Artificial Sequence
  ELANE RNA Guide
gugcagugccuagccaugggc

SEQ ID NO: 18298 - RNA, 21 nt, Artificial Sequence
  ELANE RNA Guide
gugccuagccaugggcugggg

SEQ ID NO: 18299 - RNA, 21 nt, Artificial Sequence
  ELANE RNA Guide
uagccaugggcuggggccuuc

SEQ ID NO: 18300 - RNA, 21 nt, Artificial Sequence
  ELANE RNA Guide
ugcagugccuagccaugggcu

SEQ ID NO: 18301 - RNA, 21 nt, Artificial Sequence
  ELANE RNA Guide
ugccuagccaugggcuggggc

SEQ ID NO: 18302 - RNA, 21 nt, Artificial Sequence
  ELANE RNA Guide
uggcuaggcacugcaccccgu

SEQ ID NO: 18303 - RNA, 22 nt, Artificial Sequence
  ELANE RNA Guide
aacggggugcagugccuagcca

SEQ ID NO: 18304 - RNA, 22 nt, Artificial Sequence
  ELANE RNA Guide
aaggccccagcccauggcuagg

SEQ ID NO: 18305 - RNA, 22 nt, Artificial Sequence
  ELANE RNA Guide
acggggugcagugccuagccau

SEQ ID NO: 18306 - RNA, 22 nt, Artificial Sequence
  ELANE RNA Guide
agaaggccccagcccauggcua

SEQ ID NO: 18307 - RNA, 22 nt, Artificial Sequence
  ELANE RNA Guide
agcccauggcuaggcacugcac

SEQ ID NO: 18308 - RNA, 22 nt, Artificial Sequence
  ELANE RNA Guide
aggccccagcccauggcuaggc

SEQ ID NO: 18309 - RNA, 22 nt, Artificial Sequence
  ELANE RNA Guide
agugccuagccaugggcugggg

SEQ ID NO: 18310 - RNA, 22 nt, Artificial Sequence
  ELANE RNA Guide
auggcuaggcacugcaccccgu

SEQ ID NO: 18311 - RNA, 22 nt, Artificial Sequence
  ELANE RNA Guide
caacggggugcagugccuagcc

SEQ ID NO: 18312 - RNA, 22 nt, Artificial Sequence
  ELANE RNA Guide
cagaaggccccagcccauggcu

SEQ ID NO: 18313 - RNA, 22 nt, Artificial Sequence
  ELANE RNA Guide
cagcccauggcuaggcacugca

SEQ ID NO: 18314 - RNA, 22 nt, Artificial Sequence
  ELANE RNA Guide
cagugccuagccaugggcuggg

SEQ ID NO: 18315 - RNA, 22 nt, Artificial Sequence
  ELANE RNA Guide
cauggcuaggcacugcaccccg

SEQ ID NO: 18316 - RNA, 22 nt, Artificial Sequence
  ELANE RNA Guide
ccagcccauggcuaggcacugc

SEQ ID NO: 18317 - RNA, 22 nt, Artificial Sequence
  ELANE RNA Guide
ccauggcuaggcacugcacccc

SEQ ID NO: 18318 - RNA, 22 nt, Artificial Sequence
  ELANE RNA Guide
cccagcccauggcuaggcacug

SEQ ID NO: 18319 - RNA, 22 nt, Artificial Sequence
  ELANE RNA Guide
cccauggcuaggcacugcaccc

SEQ ID NO: 18320 - RNA, 22 nt, Artificial Sequence
  ELANE RNA Guide
ccccagcccauggcuaggcacu

SEQ ID NO: 18321 - RNA, 22 nt, Artificial Sequence
  ELANE RNA Guide
ccuagccaugggcuggggccuu

SEQ ID NO: 18322 - RNA, 22 nt, Artificial Sequence
  ELANE RNA Guide
cggggugcagugccuagccaug

SEQ ID NO: 18323 - RNA, 22 nt, Artificial Sequence
  ELANE RNA Guide
cuagccaugggcuggggccuuc

SEQ ID NO: 18324 - RNA, 22 nt, Artificial Sequence
  ELANE RNA Guide
cuaggcacugcaccccguugcc

SEQ ID NO: 18325 - RNA, 22 nt, Artificial Sequence
  ELANE RNA Guide
gaaggccccagcccauggcuag

SEQ ID NO: 18326 - RNA, 22 nt, Artificial Sequence
  ELANE RNA Guide
gcaacggggugcagugccuagc

SEQ ID NO: 18327 - RNA, 22 nt, Artificial Sequence
  ELANE RNA Guide
gcagugccuagccaugggcugg

SEQ ID NO: 18328 - RNA, 22 nt, Artificial Sequence
  ELANE RNA Guide
gcccauggcuaggcacugcacc

SEQ ID NO: 18329 - RNA, 22 nt, Artificial Sequence
  ELANE RNA Guide
gccccagcccauggcuaggcac

SEQ ID NO: 18330 - RNA, 22 nt, Artificial Sequence
  ELANE RNA Guide
gccuagccaugggcuggggccu

SEQ ID NO: 18331 - RNA, 22 nt, Artificial Sequence
  ELANE RNA Guide
gcuaggcacugcaccccguugc

SEQ ID NO: 18332 - RNA, 22 nt, Artificial Sequence
  ELANE RNA Guide
ggcaacggggugcagugccuag

SEQ ID NO: 18333 - RNA, 22 nt, Artificial Sequence
  ELANE RNA Guide
ggccccagcccauggcuaggca

SEQ ID NO: 18334 - RNA, 22 nt, Artificial Sequence
  ELANE RNA Guide
ggcuaggcacugcaccccguug

SEQ ID NO: 18335 - RNA, 22 nt, Artificial Sequence
  ELANE RNA Guide
gggcaacggggugcagugccua

SEQ ID NO: 18336 - RNA, 22 nt, Artificial Sequence
  ELANE RNA Guide
ggggugcagugccuagccaugg

SEQ ID NO: 18337 - RNA, 22 nt, Artificial Sequence
  ELANE RNA Guide
gggugcagugccuagccauggg

SEQ ID NO: 18338 - RNA, 22 nt, Artificial Sequence
  ELANE RNA Guide
ggugcagugccuagccaugggc

SEQ ID NO: 18339 - RNA, 22 nt, Artificial Sequence
  ELANE RNA Guide
gugcagugccuagccaugggcu

SEQ ID NO: 18340 - RNA, 22 nt, Artificial Sequence
  ELANE RNA Guide
gugccuagccaugggcuggggc

SEQ ID NO: 18341 - RNA, 22 nt, Artificial Sequence
  ELANE RNA Guide
uagccaugggcuggggccuucu

SEQ ID NO: 18342 - RNA, 22 nt, Artificial Sequence
  ELANE RNA Guide
ugcagugccuagccaugggcug

SEQ ID NO: 18343 - RNA, 22 nt, Artificial Sequence
  ELANE RNA Guide
ugcccagaaggccccagcccau

SEQ ID NO: 18344 - RNA, 22 nt, Artificial Sequence
  ELANE RNA Guide
ugccuagccaugggcuggggcc

SEQ ID NO: 18345 - RNA, 22 nt, Artificial Sequence
  ELANE RNA Guide
uggcuaggcacugcaccccguu

SEQ ID NO: 18346 - RNA, 22 nt, Artificial Sequence
  ELANE RNA Guide
ugggcaacggggugcagugccu

SEQ ID NO: 18347 - RNA, 20 nt, Artificial Sequence
  ELANE RNA Guide
aacggggugcagugccugcc

SEQ ID NO: 18348 - RNA, 20 nt, Artificial Sequence
  ELANE RNA Guide
aaggccccagcccaugggca

SEQ ID NO: 18349 - RNA, 20 nt, Artificial Sequence
  ELANE RNA Guide
acggggugcagugccugccc

SEQ ID NO: 18350 - RNA, 20 nt, Artificial Sequence
  ELANE RNA Guide
agaaggccccagcccauggg

SEQ ID NO: 18351 - RNA, 20 nt, Artificial Sequence
  ELANE RNA Guide
agcccaugggcaggcacugc

SEQ ID NO: 18352 - RNA, 20 nt, Artificial Sequence
  ELANE RNA Guide
aggccccagcccaugggcag

SEQ ID NO: 18353 - RNA, 20 nt, Artificial Sequence
  ELANE RNA Guide
agugccugcccaugggcugg

SEQ ID NO: 18354 - RNA, 20 nt, Artificial Sequence
  ELANE RNA Guide
augggcaggcacugcacccc

SEQ ID NO: 18355 - RNA, 20 nt, Artificial Sequence
  ELANE RNA Guide
caacggggugcagugccugc

SEQ ID NO: 18356 - RNA, 20 nt, Artificial Sequence
  ELANE RNA Guide
cagcccaugggcaggcacug

SEQ ID NO: 18357 - RNA, 20 nt, Artificial Sequence
  ELANE RNA Guide
cagugccugcccaugggcug

SEQ ID NO: 18358 - RNA, 20 nt, Artificial Sequence
  ELANE RNA Guide
caugggcaggcacugcaccc

SEQ ID NO: 18359 - RNA, 20 nt, Artificial Sequence
  ELANE RNA Guide
ccagcccaugggcaggcacu

SEQ ID NO: 18360 - RNA, 20 nt, Artificial Sequence
  ELANE RNA Guide
ccaugggcaggcacugcacc

SEQ ID NO: 18361 - RNA, 20 nt, Artificial Sequence
  ELANE RNA Guide
cccagcccaugggcaggcac

SEQ ID NO: 18362 - RNA, 20 nt, Artificial Sequence
  ELANE RNA Guide
cccaugggcaggcacugcac

SEQ ID NO: 18363 - RNA, 20 nt, Artificial Sequence
  ELANE RNA Guide
ccccagcccaugggcaggca

SEQ ID NO: 18364 - RNA, 20 nt, Artificial Sequence
  ELANE RNA Guide
ccugcccaugggcuggggcc

SEQ ID NO: 18365 - RNA, 20 nt, Artificial Sequence
  ELANE RNA Guide
cggggugcagugccugccca

SEQ ID NO: 18366 - RNA, 20 nt, Artificial Sequence
  ELANE RNA Guide
cugcccaugggcuggggccu

SEQ ID NO: 18367 - RNA, 20 nt, Artificial Sequence
  ELANE RNA Guide
gaaggccccagcccaugggc

SEQ ID NO: 18368 - RNA, 20 nt, Artificial Sequence
  ELANE RNA Guide
gcaacggggugcagugccug

SEQ ID NO: 18369 - RNA, 20 nt, Artificial Sequence
  ELANE RNA Guide
gcagugccugcccaugggcu

SEQ ID NO: 18370 - RNA, 20 nt, Artificial Sequence
  ELANE RNA Guide
gcccagaaggccccagccca

SEQ ID NO: 18371 - RNA, 20 nt, Artificial Sequence
  ELANE RNA Guide
gcccaugggcaggcacugca

SEQ ID NO: 18372 - RNA, 20 nt, Artificial Sequence
  ELANE RNA Guide
gcccaugggcuggggccuuc

SEQ ID NO: 18373 - RNA, 20 nt, Artificial Sequence
  ELANE RNA Guide
gccccagcccaugggcaggc

SEQ ID NO: 18374 - RNA, 20 nt, Artificial Sequence
  ELANE RNA Guide
gccugcccaugggcuggggc

SEQ ID NO: 18375 - RNA, 20 nt, Artificial Sequence
  ELANE RNA Guide
ggcaggcacugcaccccguu

SEQ ID NO: 18376 - RNA, 20 nt, Artificial Sequence
  ELANE RNA Guide
ggccccagcccaugggcagg

SEQ ID NO: 18377 - RNA, 20 nt, Artificial Sequence
  ELANE RNA Guide
gggcaggcacugcaccccgu

SEQ ID NO: 18378 - RNA, 20 nt, Artificial Sequence
  ELANE RNA Guide
ggggugcagugccugcccau

SEQ ID NO: 18379 - RNA, 20 nt, Artificial Sequence
  ELANE RNA Guide
gggugcagugccugcccaug

SEQ ID NO: 18380 - RNA, 20 nt, Artificial Sequence
  ELANE RNA Guide
ggugcagugccugcccaugg

SEQ ID NO: 18381 - RNA, 20 nt, Artificial Sequence
  ELANE RNA Guide
gugcagugccugcccauggg

SEQ ID NO: 18382 - RNA, 20 nt, Artificial Sequence
  ELANE RNA Guide
gugccugcccaugggcuggg

SEQ ID NO: 18383 - RNA, 20 nt, Artificial Sequence
  ELANE RNA Guide
ugcagugccugcccaugggc

SEQ ID NO: 18384 - RNA, 20 nt, Artificial Sequence
  ELANE RNA Guide
ugcccaugggcuggggccuu

SEQ ID NO: 18385 - RNA, 20 nt, Artificial Sequence
  ELANE RNA Guide
ugccugcccaugggcugggg

SEQ ID NO: 18386 - RNA, 20 nt, Artificial Sequence
  ELANE RNA Guide
ugggcaggcacugcaccccg

SEQ ID NO: 18387 - RNA, 21 nt, Artificial Sequence
  ELANE RNA Guide
aacggggugcagugccugccc

SEQ ID NO: 18388 - RNA, 21 nt, Artificial Sequence
  ELANE RNA Guide
aaggccccagcccaugggcag

SEQ ID NO: 18389 - RNA, 21 nt, Artificial Sequence
  ELANE RNA Guide
acggggugcagugccugccca

SEQ ID NO: 18390 - RNA, 21 nt, Artificial Sequence
  ELANE RNA Guide
agaaggccccagcccaugggc

SEQ ID NO: 18391 - RNA, 21 nt, Artificial Sequence
  ELANE RNA Guide
agcccaugggcaggcacugca

SEQ ID NO: 18392 - RNA, 21 nt, Artificial Sequence
  ELANE RNA Guide
aggccccagcccaugggcagg

SEQ ID NO: 18393 - RNA, 21 nt, Artificial Sequence
  ELANE RNA Guide
agugccugcccaugggcuggg

SEQ ID NO: 18394 - RNA, 21 nt, Artificial Sequence
  ELANE RNA Guide
augggcaggcacugcaccccg

SEQ ID NO: 18395 - RNA, 21 nt, Artificial Sequence
  ELANE RNA Guide
caacggggugcagugccugcc

SEQ ID NO: 18396 - RNA, 21 nt, Artificial Sequence
  ELANE RNA Guide
cagaaggccccagcccauggg

SEQ ID NO: 18397 - RNA, 21 nt, Artificial Sequence
  ELANE RNA Guide
cagcccaugggcaggcacugc

SEQ ID NO: 18398 - RNA, 21 nt, Artificial Sequence
  ELANE RNA Guide
cagugccugcccaugggcugg

SEQ ID NO: 18399 - RNA, 21 nt, Artificial Sequence
  ELANE RNA Guide
caugggcaggcacugcacccc

SEQ ID NO: 18400 - RNA, 21 nt, Artificial Sequence
  ELANE RNA Guide
ccagcccaugggcaggcacug

SEQ ID NO: 18401 - RNA, 21 nt, Artificial Sequence
  ELANE RNA Guide
ccaugggcaggcacugcaccc

SEQ ID NO: 18402 - RNA, 21 nt, Artificial Sequence
  ELANE RNA Guide
cccagcccaugggcaggcacu

SEQ ID NO: 18403 - RNA, 21 nt, Artificial Sequence
  ELANE RNA Guide
cccaugggcaggcacugcacc

SEQ ID NO: 18404 - RNA, 21 nt, Artificial Sequence
  ELANE RNA Guide
ccccagcccaugggcaggcac

SEQ ID NO: 18405 - RNA, 21 nt, Artificial Sequence
  ELANE RNA Guide
ccugcccaugggcuggggccu

SEQ ID NO: 18406 - RNA, 21 nt, Artificial Sequence
  ELANE RNA Guide
cggggugcagugccugcccau

SEQ ID NO: 18407 - RNA, 21 nt, Artificial Sequence
  ELANE RNA Guide
cugcccaugggcuggggccuu

SEQ ID NO: 18408 - RNA, 21 nt, Artificial Sequence
  ELANE RNA Guide
gaaggccccagcccaugggca

SEQ ID NO: 18409 - RNA, 21 nt, Artificial Sequence
  ELANE RNA Guide
gcaacggggugcagugccugc

SEQ ID NO: 18410 - RNA, 21 nt, Artificial Sequence
  ELANE RNA Guide
gcagugccugcccaugggcug

SEQ ID NO: 18411 - RNA, 21 nt, Artificial Sequence
  ELANE RNA Guide
gcccaugggcaggcacugcac

SEQ ID NO: 18412 - RNA, 21 nt, Artificial Sequence
  ELANE RNA Guide
gcccaugggcuggggccuucu

SEQ ID NO: 18413 - RNA, 21 nt, Artificial Sequence
  ELANE RNA Guide
gccccagcccaugggcaggca

SEQ ID NO: 18414 - RNA, 21 nt, Artificial Sequence
  ELANE RNA Guide
ggcaacggggugcagugccug

SEQ ID NO: 18415 - RNA, 21 nt, Artificial Sequence
  ELANE RNA Guide
ggcaggcacugcaccccguug

SEQ ID NO: 18416 - RNA, 21 nt, Artificial Sequence
  ELANE RNA Guide
gggcaggcacugcaccccguu

SEQ ID NO: 18417 - RNA, 21 nt, Artificial Sequence
  ELANE RNA Guide
ggggugcagugccugcccaug

SEQ ID NO: 18418 - RNA, 21 nt, Artificial Sequence
  ELANE RNA Guide
gggugcagugccugcccaugg

SEQ ID NO: 18419 - RNA, 21 nt, Artificial Sequence
  ELANE RNA Guide
ggugcagugccugcccauggg

SEQ ID NO: 18420 - RNA, 21 nt, Artificial Sequence
  ELANE RNA Guide
gugcagugccugcccaugggc

SEQ ID NO: 18421 - RNA, 21 nt, Artificial Sequence
  ELANE RNA Guide
gugccugcccaugggcugggg

SEQ ID NO: 18422 - RNA, 21 nt, Artificial Sequence
  ELANE RNA Guide
ugcagugccugcccaugggcu

SEQ ID NO: 18423 - RNA, 21 nt, Artificial Sequence
  ELANE RNA Guide
ugcccagaaggccccagccca

SEQ ID NO: 18424 - RNA, 21 nt, Artificial Sequence
  ELANE RNA Guide
ugcccaugggcuggggccuuc

SEQ ID NO: 18425 - RNA, 21 nt, Artificial Sequence
  ELANE RNA Guide
ugccugcccaugggcuggggc

SEQ ID NO: 18426 - RNA, 21 nt, Artificial Sequence
  ELANE RNA Guide
ugggcaggcacugcaccccgu

SEQ ID NO: 18427 - RNA, 22 nt, Artificial Sequence
  ELANE RNA Guide
aacggggugcagugccugccca

SEQ ID NO: 18428 - RNA, 22 nt, Artificial Sequence
  ELANE RNA Guide
aaggccccagcccaugggcagg

SEQ ID NO: 18429 - RNA, 22 nt, Artificial Sequence
  ELANE RNA Guide
acggggugcagugccugcccau

SEQ ID NO: 18430 - RNA, 22 nt, Artificial Sequence
  ELANE RNA Guide
agaaggccccagcccaugggca

SEQ ID NO: 18431 - RNA, 22 nt, Artificial Sequence
  ELANE RNA Guide
agcccaugggcaggcacugcac

SEQ ID NO: 18432 - RNA, 22 nt, Artificial Sequence
  ELANE RNA Guide
aggccccagcccaugggcaggc

SEQ ID NO: 18433 - RNA, 22 nt, Artificial Sequence
  ELANE RNA Guide
agugccugcccaugggcugggg

SEQ ID NO: 18434 - RNA, 22 nt, Artificial Sequence
  ELANE RNA Guide
augggcaggcacugcaccccgu

SEQ ID NO: 18435 - RNA, 22 nt, Artificial Sequence
  ELANE RNA Guide
caacggggugcagugccugccc

SEQ ID NO: 18436 - RNA, 22 nt, Artificial Sequence
  ELANE RNA Guide
cagaaggccccagcccaugggc

SEQ ID NO: 18437 - RNA, 22 nt, Artificial Sequence
  ELANE RNA Guide
cagcccaugggcaggcacugca

SEQ ID NO: 18438 - RNA, 22 nt, Artificial Sequence
  ELANE RNA Guide
cagugccugcccaugggcuggg

SEQ ID NO: 18439 - RNA, 22 nt, Artificial Sequence
  ELANE RNA Guide
caugggcaggcacugcaccccg

SEQ ID NO: 18440 - RNA, 22 nt, Artificial Sequence
  ELANE RNA Guide
ccagaaggccccagcccauggg

SEQ ID NO: 18441 - RNA, 22 nt, Artificial Sequence
  ELANE RNA Guide
ccagcccaugggcaggcacugc

SEQ ID NO: 18442 - RNA, 22 nt, Artificial Sequence
  ELANE RNA Guide
ccaugggcaggcacugcacccc

SEQ ID NO: 18443 - RNA, 22 nt, Artificial Sequence
  ELANE RNA Guide
cccagcccaugggcaggcacug

SEQ ID NO: 18444 - RNA, 22 nt, Artificial Sequence
  ELANE RNA Guide
cccaugggcaggcacugcaccc

SEQ ID NO: 18445 - RNA, 22 nt, Artificial Sequence
  ELANE RNA Guide
ccccagcccaugggcaggcacu

SEQ ID NO: 18446 - RNA, 22 nt, Artificial Sequence
  ELANE RNA Guide
ccugcccaugggcuggggccuu

SEQ ID NO: 18447 - RNA, 22 nt, Artificial Sequence
  ELANE RNA Guide
cggggugcagugccugcccaug

SEQ ID NO: 18448 - RNA, 22 nt, Artificial Sequence
  ELANE RNA Guide
cugcccagaaggccccagccca

SEQ ID NO: 18449 - RNA, 22 nt, Artificial Sequence
  ELANE RNA Guide
cugcccaugggcuggggccuuc

SEQ ID NO: 18450 - RNA, 22 nt, Artificial Sequence
  ELANE RNA Guide
gaaggccccagcccaugggcag

SEQ ID NO: 18451 - RNA, 22 nt, Artificial Sequence
  ELANE RNA Guide
gcaacggggugcagugccugcc

SEQ ID NO: 18452 - RNA, 22 nt, Artificial Sequence
  ELANE RNA Guide
gcagugccugcccaugggcugg

SEQ ID NO: 18453 - RNA, 22 nt, Artificial Sequence
  ELANE RNA Guide
gcccaugggcaggcacugcacc

SEQ ID NO: 18454 - RNA, 22 nt, Artificial Sequence
  ELANE RNA Guide
gcccaugggcuggggccuucug

SEQ ID NO: 18455 - RNA, 22 nt, Artificial Sequence
  ELANE RNA Guide
gccccagcccaugggcaggcac

SEQ ID NO: 18456 - RNA, 22 nt, Artificial Sequence
  ELANE RNA Guide
gccugcccaugggcuggggccu

SEQ ID NO: 18457 - RNA, 22 nt, Artificial Sequence
  ELANE RNA Guide
ggcaacggggugcagugccugc

SEQ ID NO: 18458 - RNA, 22 nt, Artificial Sequence
  ELANE RNA Guide
ggcaggcacugcaccccguugc

SEQ ID NO: 18459 - RNA, 22 nt, Artificial Sequence
  ELANE RNA Guide
ggccccagcccaugggcaggca

SEQ ID NO: 18460 - RNA, 22 nt, Artificial Sequence
  ELANE RNA Guide
gggcaacggggugcagugccug

SEQ ID NO: 18461 - RNA, 22 nt, Artificial Sequence
  ELANE RNA Guide
gggcaggcacugcaccccguug

SEQ ID NO: 18462 - RNA, 22 nt, Artificial Sequence
  ELANE RNA Guide
ggggugcagugccugcccaugg

SEQ ID NO: 18463 - RNA, 22 nt, Artificial Sequence
  ELANE RNA Guide
gggugcagugccugcccauggg

SEQ ID NO: 18464 - RNA, 22 nt, Artificial Sequence
  ELANE RNA Guide
ggugcagugccugcccaugggc

SEQ ID NO: 18465 - RNA, 22 nt, Artificial Sequence
  ELANE RNA Guide
gugcagugccugcccaugggcu

SEQ ID NO: 18466 - RNA, 22 nt, Artificial Sequence
  ELANE RNA Guide
gugccugcccaugggcuggggc

SEQ ID NO: 18467 - RNA, 22 nt, Artificial Sequence
  ELANE RNA Guide
ugcagugccugcccaugggcug

SEQ ID NO: 18468 - RNA, 22 nt, Artificial Sequence
  ELANE RNA Guide
ugcccaugggcuggggccuucu

SEQ ID NO: 18469 - RNA, 22 nt, Artificial Sequence
  ELANE RNA Guide
ugccugcccaugggcuggggcc

SEQ ID NO: 18470 - RNA, 22 nt, Artificial Sequence
  ELANE RNA Guide
ugggcaggcacugcaccccguu

SEQ ID NO: 18471 - RNA, 20 nt, Artificial Sequence
  ELANE RNA Guide
aacggggugcagugccugga

SEQ ID NO: 18472 - RNA, 20 nt, Artificial Sequence
  ELANE RNA Guide
aaggccccagcccaugucca

SEQ ID NO: 18473 - RNA, 20 nt, Artificial Sequence
  ELANE RNA Guide
acggggugcagugccuggac

SEQ ID NO: 18474 - RNA, 20 nt, Artificial Sequence
  ELANE RNA Guide
agaaggccccagcccauguc

SEQ ID NO: 18475 - RNA, 20 nt, Artificial Sequence
  ELANE RNA Guide
agcccauguccaggcacugc

SEQ ID NO: 18476 - RNA, 20 nt, Artificial Sequence
  ELANE RNA Guide
aggccccagcccauguccag

SEQ ID NO: 18477 - RNA, 20 nt, Artificial Sequence
  ELANE RNA Guide
agugccuggacaugggcugg

SEQ ID NO: 18478 - RNA, 20 nt, Artificial Sequence
  ELANE RNA Guide
auguccaggcacugcacccc

SEQ ID NO: 18479 - RNA, 20 nt, Artificial Sequence
  ELANE RNA Guide
caacggggugcagugccugg

SEQ ID NO: 18480 - RNA, 20 nt, Artificial Sequence
  ELANE RNA Guide
cagaaggccccagcccaugu

SEQ ID NO: 18481 - RNA, 20 nt, Artificial Sequence
  ELANE RNA Guide
cagcccauguccaggcacug

SEQ ID NO: 18482 - RNA, 20 nt, Artificial Sequence
  ELANE RNA Guide
cagugccuggacaugggcug

SEQ ID NO: 18483 - RNA, 20 nt, Artificial Sequence
  ELANE RNA Guide
cauguccaggcacugcaccc

SEQ ID NO: 18484 - RNA, 20 nt, Artificial Sequence
  ELANE RNA Guide
ccagcccauguccaggcacu

SEQ ID NO: 18485 - RNA, 20 nt, Artificial Sequence
  ELANE RNA Guide
ccauguccaggcacugcacc

SEQ ID NO: 18486 - RNA, 20 nt, Artificial Sequence
  ELANE RNA Guide
cccagcccauguccaggcac

SEQ ID NO: 18487 - RNA, 20 nt, Artificial Sequence
  ELANE RNA Guide
cccauguccaggcacugcac

SEQ ID NO: 18488 - RNA, 20 nt, Artificial Sequence
  ELANE RNA Guide
ccccagcccauguccaggca

SEQ ID NO: 18489 - RNA, 20 nt, Artificial Sequence
  ELANE RNA Guide
ccuggacaugggcuggggcc

SEQ ID NO: 18490 - RNA, 20 nt, Artificial Sequence
  ELANE RNA Guide
cggggugcagugccuggaca

SEQ ID NO: 18491 - RNA, 20 nt, Artificial Sequence
  ELANE RNA Guide
cuggacaugggcuggggccu

SEQ ID NO: 18492 - RNA, 20 nt, Artificial Sequence
  ELANE RNA Guide
gaaggccccagcccaugucc

SEQ ID NO: 18493 - RNA, 20 nt, Artificial Sequence
  ELANE RNA Guide
gacaugggcuggggccuucu

SEQ ID NO: 18494 - RNA, 20 nt, Artificial Sequence
  ELANE RNA Guide
gcagugccuggacaugggcu

SEQ ID NO: 18495 - RNA, 20 nt, Artificial Sequence
  ELANE RNA Guide
gcccauguccaggcacugca

SEQ ID NO: 18496 - RNA, 20 nt, Artificial Sequence
  ELANE RNA Guide
gccccagcccauguccaggc

SEQ ID NO: 18497 - RNA, 20 nt, Artificial Sequence
  ELANE RNA Guide
gccuggacaugggcuggggc

SEQ ID NO: 18498 - RNA, 20 nt, Artificial Sequence
  ELANE RNA Guide
ggacaugggcuggggccuuc

SEQ ID NO: 18499 - RNA, 20 nt, Artificial Sequence
  ELANE RNA Guide
ggccccagcccauguccagg

SEQ ID NO: 18500 - RNA, 20 nt, Artificial Sequence
  ELANE RNA Guide
ggggugcagugccuggacau

SEQ ID NO: 18501 - RNA, 20 nt, Artificial Sequence
  ELANE RNA Guide
gggugcagugccuggacaug

SEQ ID NO: 18502 - RNA, 20 nt, Artificial Sequence
  ELANE RNA Guide
ggugcagugccuggacaugg

SEQ ID NO: 18503 - RNA, 20 nt, Artificial Sequence
  ELANE RNA Guide
guccaggcacugcaccccgu

SEQ ID NO: 18504 - RNA, 20 nt, Artificial Sequence
  ELANE RNA Guide
gugcagugccuggacauggg

SEQ ID NO: 18505 - RNA, 20 nt, Artificial Sequence
  ELANE RNA Guide
gugccuggacaugggcuggg

SEQ ID NO: 18506 - RNA, 20 nt, Artificial Sequence
  ELANE RNA Guide
ugcagugccuggacaugggc

SEQ ID NO: 18507 - RNA, 20 nt, Artificial Sequence
  ELANE RNA Guide
ugcccagaaggccccagccc

SEQ ID NO: 18508 - RNA, 20 nt, Artificial Sequence
  ELANE RNA Guide
ugccuggacaugggcugggg

SEQ ID NO: 18509 - RNA, 20 nt, Artificial Sequence
  ELANE RNA Guide
uggacaugggcuggggccuu

SEQ ID NO: 18510 - RNA, 20 nt, Artificial Sequence
  ELANE RNA Guide
uguccaggcacugcaccccg

SEQ ID NO: 18511 - RNA, 21 nt, Artificial Sequence
  ELANE RNA Guide
aacggggugcagugccuggac

SEQ ID NO: 18512 - RNA, 21 nt, Artificial Sequence
  ELANE RNA Guide
aaggccccagcccauguccag

SEQ ID NO: 18513 - RNA, 21 nt, Artificial Sequence
  ELANE RNA Guide
acggggugcagugccuggaca

SEQ ID NO: 18514 - RNA, 21 nt, Artificial Sequence
  ELANE RNA Guide
agaaggccccagcccaugucc

SEQ ID NO: 18515 - RNA, 21 nt, Artificial Sequence
  ELANE RNA Guide
agcccauguccaggcacugca

SEQ ID NO: 18516 - RNA, 21 nt, Artificial Sequence
  ELANE RNA Guide
aggccccagcccauguccagg

SEQ ID NO: 18517 - RNA, 21 nt, Artificial Sequence
  ELANE RNA Guide
agugccuggacaugggcuggg

SEQ ID NO: 18518 - RNA, 21 nt, Artificial Sequence
  ELANE RNA Guide
auguccaggcacugcaccccg

SEQ ID NO: 18519 - RNA, 21 nt, Artificial Sequence
  ELANE RNA Guide
caacggggugcagugccugga

SEQ ID NO: 18520 - RNA, 21 nt, Artificial Sequence
  ELANE RNA Guide
cagaaggccccagcccauguc

SEQ ID NO: 18521 - RNA, 21 nt, Artificial Sequence
  ELANE RNA Guide
cagcccauguccaggcacugc

SEQ ID NO: 18522 - RNA, 21 nt, Artificial Sequence
  ELANE RNA Guide
cagugccuggacaugggcugg

SEQ ID NO: 18523 - RNA, 21 nt, Artificial Sequence
  ELANE RNA Guide
cauguccaggcacugcacccc

SEQ ID NO: 18524 - RNA, 21 nt, Artificial Sequence
  ELANE RNA Guide
ccagaaggccccagcccaugu

SEQ ID NO: 18525 - RNA, 21 nt, Artificial Sequence
  ELANE RNA Guide
ccagcccauguccaggcacug

SEQ ID NO: 18526 - RNA, 21 nt, Artificial Sequence
  ELANE RNA Guide
ccauguccaggcacugcaccc

SEQ ID NO: 18527 - RNA, 21 nt, Artificial Sequence
  ELANE RNA Guide
cccagcccauguccaggcacu

SEQ ID NO: 18528 - RNA, 21 nt, Artificial Sequence
  ELANE RNA Guide
cccauguccaggcacugcacc

SEQ ID NO: 18529 - RNA, 21 nt, Artificial Sequence
  ELANE RNA Guide
ccccagcccauguccaggcac

SEQ ID NO: 18530 - RNA, 21 nt, Artificial Sequence
  ELANE RNA Guide
ccuggacaugggcuggggccu

SEQ ID NO: 18531 - RNA, 21 nt, Artificial Sequence
  ELANE RNA Guide
cggggugcagugccuggacau

SEQ ID NO: 18532 - RNA, 21 nt, Artificial Sequence
  ELANE RNA Guide
cugcccagaaggccccagccc

SEQ ID NO: 18533 - RNA, 21 nt, Artificial Sequence
  ELANE RNA Guide
cuggacaugggcuggggccuu

SEQ ID NO: 18534 - RNA, 21 nt, Artificial Sequence
  ELANE RNA Guide
gaaggccccagcccaugucca

SEQ ID NO: 18535 - RNA, 21 nt, Artificial Sequence
  ELANE RNA Guide
gacaugggcuggggccuucug

SEQ ID NO: 18536 - RNA, 21 nt, Artificial Sequence
  ELANE RNA Guide
gcaacggggugcagugccugg

SEQ ID NO: 18537 - RNA, 21 nt, Artificial Sequence
  ELANE RNA Guide
gcagugccuggacaugggcug

SEQ ID NO: 18538 - RNA, 21 nt, Artificial Sequence
  ELANE RNA Guide
gcccauguccaggcacugcac

SEQ ID NO: 18539 - RNA, 21 nt, Artificial Sequence
  ELANE RNA Guide
gccccagcccauguccaggca

SEQ ID NO: 18540 - RNA, 21 nt, Artificial Sequence
  ELANE RNA Guide
gccuggacaugggcuggggcc

SEQ ID NO: 18541 - RNA, 21 nt, Artificial Sequence
  ELANE RNA Guide
ggacaugggcuggggccuucu

SEQ ID NO: 18542 - RNA, 21 nt, Artificial Sequence
  ELANE RNA Guide
ggccccagcccauguccaggc

SEQ ID NO: 18543 - RNA, 21 nt, Artificial Sequence
  ELANE RNA Guide
ggggugcagugccuggacaug

SEQ ID NO: 18544 - RNA, 21 nt, Artificial Sequence
  ELANE RNA Guide
gggugcagugccuggacaugg

SEQ ID NO: 18545 - RNA, 21 nt, Artificial Sequence
  ELANE RNA Guide
ggugcagugccuggacauggg

SEQ ID NO: 18546 - RNA, 21 nt, Artificial Sequence
  ELANE RNA Guide
guccaggcacugcaccccguu

SEQ ID NO: 18547 - RNA, 21 nt, Artificial Sequence
  ELANE RNA Guide
gugcagugccuggacaugggc

SEQ ID NO: 18548 - RNA, 21 nt, Artificial Sequence
  ELANE RNA Guide
gugccuggacaugggcugggg

SEQ ID NO: 18549 - RNA, 21 nt, Artificial Sequence
  ELANE RNA Guide
ugcagugccuggacaugggcu

SEQ ID NO: 18550 - RNA, 21 nt, Artificial Sequence
  ELANE RNA Guide
ugccuggacaugggcuggggc

SEQ ID NO: 18551 - RNA, 21 nt, Artificial Sequence
  ELANE RNA Guide
uggacaugggcuggggccuuc

SEQ ID NO: 18552 - RNA, 21 nt, Artificial Sequence
  ELANE RNA Guide
uguccaggcacugcaccccgu

SEQ ID NO: 18553 - RNA, 22 nt, Artificial Sequence
  ELANE RNA Guide
aacggggugcagugccuggaca

SEQ ID NO: 18554 - RNA, 22 nt, Artificial Sequence
  ELANE RNA Guide
aaggccccagcccauguccagg

SEQ ID NO: 18555 - RNA, 22 nt, Artificial Sequence
  ELANE RNA Guide
acggggugcagugccuggacau

SEQ ID NO: 18556 - RNA, 22 nt, Artificial Sequence
  ELANE RNA Guide
agaaggccccagcccaugucca

SEQ ID NO: 18557 - RNA, 22 nt, Artificial Sequence
  ELANE RNA Guide
agcccauguccaggcacugcac

SEQ ID NO: 18558 - RNA, 22 nt, Artificial Sequence
  ELANE RNA Guide
aggccccagcccauguccaggc

SEQ ID NO: 18559 - RNA, 22 nt, Artificial Sequence
  ELANE RNA Guide
agugccuggacaugggcugggg

SEQ ID NO: 18560 - RNA, 22 nt, Artificial Sequence
  ELANE RNA Guide
auguccaggcacugcaccccgu

SEQ ID NO: 18561 - RNA, 22 nt, Artificial Sequence
  ELANE RNA Guide
caacggggugcagugccuggac

SEQ ID NO: 18562 - RNA, 22 nt, Artificial Sequence
  ELANE RNA Guide
cagaaggccccagcccaugucc

SEQ ID NO: 18563 - RNA, 22 nt, Artificial Sequence
  ELANE RNA Guide
cagcccauguccaggcacugca

SEQ ID NO: 18564 - RNA, 22 nt, Artificial Sequence
  ELANE RNA Guide
cagugccuggacaugggcuggg

SEQ ID NO: 18565 - RNA, 22 nt, Artificial Sequence
  ELANE RNA Guide
cauguccaggcacugcaccccg

SEQ ID NO: 18566 - RNA, 22 nt, Artificial Sequence
  ELANE RNA Guide
ccagaaggccccagcccauguc

SEQ ID NO: 18567 - RNA, 22 nt, Artificial Sequence
  ELANE RNA Guide
ccagcccauguccaggcacugc

SEQ ID NO: 18568 - RNA, 22 nt, Artificial Sequence
  ELANE RNA Guide
ccauguccaggcacugcacccc

SEQ ID NO: 18569 - RNA, 22 nt, Artificial Sequence
  ELANE RNA Guide
cccagaaggccccagcccaugu

SEQ ID NO: 18570 - RNA, 22 nt, Artificial Sequence
  ELANE RNA Guide
cccagcccauguccaggcacug

SEQ ID NO: 18571 - RNA, 22 nt, Artificial Sequence
  ELANE RNA Guide
cccauguccaggcacugcaccc

SEQ ID NO: 18572 - RNA, 22 nt, Artificial Sequence
  ELANE RNA Guide
ccccagcccauguccaggcacu

SEQ ID NO: 18573 - RNA, 22 nt, Artificial Sequence
  ELANE RNA Guide
ccugcccagaaggccccagccc

SEQ ID NO: 18574 - RNA, 22 nt, Artificial Sequence
  ELANE RNA Guide
ccuggacaugggcuggggccuu

SEQ ID NO: 18575 - RNA, 22 nt, Artificial Sequence
  ELANE RNA Guide
cggggugcagugccuggacaug

SEQ ID NO: 18576 - RNA, 22 nt, Artificial Sequence
  ELANE RNA Guide
cuggacaugggcuggggccuuc

SEQ ID NO: 18577 - RNA, 22 nt, Artificial Sequence
  ELANE RNA Guide
gaaggccccagcccauguccag

SEQ ID NO: 18578 - RNA, 22 nt, Artificial Sequence
  ELANE RNA Guide
gacaugggcuggggccuucugg

SEQ ID NO: 18579 - RNA, 22 nt, Artificial Sequence
  ELANE RNA Guide
gcaacggggugcagugccugga

SEQ ID NO: 18580 - RNA, 22 nt, Artificial Sequence
  ELANE RNA Guide
gcagugccuggacaugggcugg

SEQ ID NO: 18581 - RNA, 22 nt, Artificial Sequence
  ELANE RNA Guide
gcccauguccaggcacugcacc

SEQ ID NO: 18582 - RNA, 22 nt, Artificial Sequence
  ELANE RNA Guide
gccccagcccauguccaggcac

SEQ ID NO: 18583 - RNA, 22 nt, Artificial Sequence
  ELANE RNA Guide
gccuggacaugggcuggggccu

SEQ ID NO: 18584 - RNA, 22 nt, Artificial Sequence
  ELANE RNA Guide
ggacaugggcuggggccuucug

SEQ ID NO: 18585 - RNA, 22 nt, Artificial Sequence
  ELANE RNA Guide
ggcaacggggugcagugccugg

SEQ ID NO: 18586 - RNA, 22 nt, Artificial Sequence
  ELANE RNA Guide
ggccccagcccauguccaggca

SEQ ID NO: 18587 - RNA, 22 nt, Artificial Sequence
  ELANE RNA Guide
ggggugcagugccuggacaugg

SEQ ID NO: 18588 - RNA, 22 nt, Artificial Sequence
  ELANE RNA Guide
gggugcagugccuggacauggg

SEQ ID NO: 18589 - RNA, 22 nt, Artificial Sequence
  ELANE RNA Guide
ggugcagugccuggacaugggc

SEQ ID NO: 18590 - RNA, 22 nt, Artificial Sequence
  ELANE RNA Guide
guccaggcacugcaccccguug

SEQ ID NO: 18591 - RNA, 22 nt, Artificial Sequence
  ELANE RNA Guide
gugcagugccuggacaugggcu

SEQ ID NO: 18592 - RNA, 22 nt, Artificial Sequence
  ELANE RNA Guide
gugccuggacaugggcuggggc

SEQ ID NO: 18593 - RNA, 22 nt, Artificial Sequence
  ELANE RNA Guide
ugcagugccuggacaugggcug

SEQ ID NO: 18594 - RNA, 22 nt, Artificial Sequence
  ELANE RNA Guide
ugccuggacaugggcuggggcc

SEQ ID NO: 18595 - RNA, 22 nt, Artificial Sequence
  ELANE RNA Guide
uggacaugggcuggggccuucu

SEQ ID NO: 18596 - RNA, 22 nt, Artificial Sequence
  ELANE RNA Guide
uguccaggcacugcaccccguu

SEQ ID NO: 18597 - RNA, 20 nt, Artificial Sequence
  ELANE RNA Guide
aaggccccggcccauggcca

SEQ ID NO: 18598 - RNA, 20 nt, Artificial Sequence
  ELANE RNA Guide
acgguuccugcccagaaggc

SEQ ID NO: 18599 - RNA, 20 nt, Artificial Sequence
  ELANE RNA Guide
agaaggccccggcccauggc

SEQ ID NO: 18600 - RNA, 20 nt, Artificial Sequence
  ELANE RNA Guide
aggccccggcccauggccag

SEQ ID NO: 18601 - RNA, 20 nt, Artificial Sequence
  ELANE RNA Guide
agugccuggccaugggccgg

SEQ ID NO: 18602 - RNA, 20 nt, Artificial Sequence
  ELANE RNA Guide
augggccggggccuucuggg

SEQ ID NO: 18603 - RNA, 20 nt, Artificial Sequence
  ELANE RNA Guide
cagaaggccccggcccaugg

SEQ ID NO: 18604 - RNA, 20 nt, Artificial Sequence
  ELANE RNA Guide
cagugccuggccaugggccg

SEQ ID NO: 18605 - RNA, 20 nt, Artificial Sequence
  ELANE RNA Guide
caugggccggggccuucugg

SEQ ID NO: 18606 - RNA, 20 nt, Artificial Sequence
  ELANE RNA Guide
ccagaaggccccggcccaug

SEQ ID NO: 18607 - RNA, 20 nt, Artificial Sequence
  ELANE RNA Guide
ccaugggccggggccuucug

SEQ ID NO: 18608 - RNA, 20 nt, Artificial Sequence
  ELANE RNA Guide
cccagaaggccccggcccau

SEQ ID NO: 18609 - RNA, 20 nt, Artificial Sequence
  ELANE RNA Guide
ccccggcccauggccaggca

SEQ ID NO: 18610 - RNA, 20 nt, Artificial Sequence
  ELANE RNA Guide
cccggcccauggccaggcac

SEQ ID NO: 18611 - RNA, 20 nt, Artificial Sequence
  ELANE RNA Guide
ccggcccauggccaggcacu

SEQ ID NO: 18612 - RNA, 20 nt, Artificial Sequence
  ELANE RNA Guide
ccggggccuucugggcagga

SEQ ID NO: 18613 - RNA, 20 nt, Artificial Sequence
  ELANE RNA Guide
ccugcccagaaggccccggc

SEQ ID NO: 18614 - RNA, 20 nt, Artificial Sequence
  ELANE RNA Guide
cggcccauggccaggcacug

SEQ ID NO: 18615 - RNA, 20 nt, Artificial Sequence
  ELANE RNA Guide
cgguuccugcccagaaggcc

SEQ ID NO: 18616 - RNA, 20 nt, Artificial Sequence
  ELANE RNA Guide
cugcccagaaggccccggcc

SEQ ID NO: 18617 - RNA, 20 nt, Artificial Sequence
  ELANE RNA Guide
cuggccaugggccggggccu

SEQ ID NO: 18618 - RNA, 20 nt, Artificial Sequence
  ELANE RNA Guide
gaaggccccggcccauggcc

SEQ ID NO: 18619 - RNA, 20 nt, Artificial Sequence
  ELANE RNA Guide
gcagugccuggccaugggcc

SEQ ID NO: 18620 - RNA, 20 nt, Artificial Sequence
  ELANE RNA Guide
gccaugggccggggccuucu

SEQ ID NO: 18621 - RNA, 20 nt, Artificial Sequence
  ELANE RNA Guide
gcccagaaggccccggccca

SEQ ID NO: 18622 - RNA, 20 nt, Artificial Sequence
  ELANE RNA Guide
gccggggccuucugggcagg

SEQ ID NO: 18623 - RNA, 20 nt, Artificial Sequence
  ELANE RNA Guide
ggccaugggccggggccuuc

SEQ ID NO: 18624 - RNA, 20 nt, Artificial Sequence
  ELANE RNA Guide
ggccggggccuucugggcag

SEQ ID NO: 18625 - RNA, 20 nt, Artificial Sequence
  ELANE RNA Guide
gggccggggccuucugggca

SEQ ID NO: 18626 - RNA, 20 nt, Artificial Sequence
  ELANE RNA Guide
gggugcagugccuggccaug

SEQ ID NO: 18627 - RNA, 20 nt, Artificial Sequence
  ELANE RNA Guide
ggugcagugccuggccaugg

SEQ ID NO: 18628 - RNA, 20 nt, Artificial Sequence
  ELANE RNA Guide
gguuccugcccagaaggccc

SEQ ID NO: 18629 - RNA, 20 nt, Artificial Sequence
  ELANE RNA Guide
gugcagugccuggccauggg

SEQ ID NO: 18630 - RNA, 20 nt, Artificial Sequence
  ELANE RNA Guide
gugccuggccaugggccggg

SEQ ID NO: 18631 - RNA, 20 nt, Artificial Sequence
  ELANE RNA Guide
guuccugcccagaaggcccc

SEQ ID NO: 18632 - RNA, 20 nt, Artificial Sequence
  ELANE RNA Guide
uccugcccagaaggccccgg

SEQ ID NO: 18633 - RNA, 20 nt, Artificial Sequence
  ELANE RNA Guide
ugcagugccuggccaugggc

SEQ ID NO: 18634 - RNA, 20 nt, Artificial Sequence
  ELANE RNA Guide
ugcccagaaggccccggccc

SEQ ID NO: 18635 - RNA, 20 nt, Artificial Sequence
  ELANE RNA Guide
ugccuggccaugggccgggg

SEQ ID NO: 18636 - RNA, 20 nt, Artificial Sequence
  ELANE RNA Guide
uggccaugggccggggccuu

SEQ ID NO: 18637 - RNA, 20 nt, Artificial Sequence
  ELANE RNA Guide
ugggccggggccuucugggc

SEQ ID NO: 18638 - RNA, 20 nt, Artificial Sequence
  ELANE RNA Guide
uuccugcccagaaggccccg

SEQ ID NO: 18639 - RNA, 21 nt, Artificial Sequence
  ELANE RNA Guide
aaggccccggcccauggccag

SEQ ID NO: 18640 - RNA, 21 nt, Artificial Sequence
  ELANE RNA Guide
acgguuccugcccagaaggcc

SEQ ID NO: 18641 - RNA, 21 nt, Artificial Sequence
  ELANE RNA Guide
agaaggccccggcccauggcc

SEQ ID NO: 18642 - RNA, 21 nt, Artificial Sequence
  ELANE RNA Guide
agugccuggccaugggccggg

SEQ ID NO: 18643 - RNA, 21 nt, Artificial Sequence
  ELANE RNA Guide
augggccggggccuucugggc

SEQ ID NO: 18644 - RNA, 21 nt, Artificial Sequence
  ELANE RNA Guide
cacgguuccugcccagaaggc

SEQ ID NO: 18645 - RNA, 21 nt, Artificial Sequence
  ELANE RNA Guide
cagaaggccccggcccauggc

SEQ ID NO: 18646 - RNA, 21 nt, Artificial Sequence
  ELANE RNA Guide
cagugccuggccaugggccgg

SEQ ID NO: 18647 - RNA, 21 nt, Artificial Sequence
  ELANE RNA Guide
caugggccggggccuucuggg

SEQ ID NO: 18648 - RNA, 21 nt, Artificial Sequence
  ELANE RNA Guide
ccagaaggccccggcccaugg

SEQ ID NO: 18649 - RNA, 21 nt, Artificial Sequence
  ELANE RNA Guide
ccaugggccggggccuucugg

SEQ ID NO: 18650 - RNA, 21 nt, Artificial Sequence
  ELANE RNA Guide
cccagaaggccccggcccaug

SEQ ID NO: 18651 - RNA, 21 nt, Artificial Sequence
  ELANE RNA Guide
cccggcccauggccaggcacu

SEQ ID NO: 18652 - RNA, 21 nt, Artificial Sequence
  ELANE RNA Guide
ccggcccauggccaggcacug

SEQ ID NO: 18653 - RNA, 21 nt, Artificial Sequence
  ELANE RNA Guide
ccggggccuucugggcaggaa

SEQ ID NO: 18654 - RNA, 21 nt, Artificial Sequence
  ELANE RNA Guide
cggcccauggccaggcacugc

SEQ ID NO: 18655 - RNA, 21 nt, Artificial Sequence
  ELANE RNA Guide
cgguuccugcccagaaggccc

SEQ ID NO: 18656 - RNA, 21 nt, Artificial Sequence
  ELANE RNA Guide
cuggccaugggccggggccuu

SEQ ID NO: 18657 - RNA, 21 nt, Artificial Sequence
  ELANE RNA Guide
gaaggccccggcccauggcca

SEQ ID NO: 18658 - RNA, 21 nt, Artificial Sequence
  ELANE RNA Guide
gcagugccuggccaugggccg

SEQ ID NO: 18659 - RNA, 21 nt, Artificial Sequence
  ELANE RNA Guide
gccaugggccggggccuucug

SEQ ID NO: 18660 - RNA, 21 nt, Artificial Sequence
  ELANE RNA Guide
gcccagaaggccccggcccau

SEQ ID NO: 18661 - RNA, 21 nt, Artificial Sequence
  ELANE RNA Guide
gccggggccuucugggcagga

SEQ ID NO: 18662 - RNA, 21 nt, Artificial Sequence
  ELANE RNA Guide
ggccaugggccggggccuucu

SEQ ID NO: 18663 - RNA, 21 nt, Artificial Sequence
  ELANE RNA Guide
ggggugcagugccuggccaug

SEQ ID NO: 18664 - RNA, 21 nt, Artificial Sequence
  ELANE RNA Guide
gggugcagugccuggccaugg

SEQ ID NO: 18665 - RNA, 21 nt, Artificial Sequence
  ELANE RNA Guide
ggugcagugccuggccauggg

SEQ ID NO: 18666 - RNA, 21 nt, Artificial Sequence
  ELANE RNA Guide
gguuccugcccagaaggcccc

SEQ ID NO: 18667 - RNA, 21 nt, Artificial Sequence
  ELANE RNA Guide
gugcagugccuggccaugggc

SEQ ID NO: 18668 - RNA, 21 nt, Artificial Sequence
  ELANE RNA Guide
guuccugcccagaaggccccg

SEQ ID NO: 18669 - RNA, 21 nt, Artificial Sequence
  ELANE RNA Guide
uccugcccagaaggccccggc

SEQ ID NO: 18670 - RNA, 21 nt, Artificial Sequence
  ELANE RNA Guide
ugcagugccuggccaugggcc

SEQ ID NO: 18671 - RNA, 21 nt, Artificial Sequence
  ELANE RNA Guide
ugcccagaaggccccggccca

SEQ ID NO: 18672 - RNA, 21 nt, Artificial Sequence
  ELANE RNA Guide
uggccaugggccggggccuuc

SEQ ID NO: 18673 - RNA, 21 nt, Artificial Sequence
  ELANE RNA Guide
ugggccggggccuucugggca

SEQ ID NO: 18674 - RNA, 21 nt, Artificial Sequence
  ELANE RNA Guide
uuccugcccagaaggccccgg

SEQ ID NO: 18675 - RNA, 22 nt, Artificial Sequence
  ELANE RNA Guide
aaggccccggcccauggccagg

SEQ ID NO: 18676 - RNA, 22 nt, Artificial Sequence
  ELANE RNA Guide
acgguuccugcccagaaggccc

SEQ ID NO: 18677 - RNA, 22 nt, Artificial Sequence
  ELANE RNA Guide
agaaggccccggcccauggcca

SEQ ID NO: 18678 - RNA, 22 nt, Artificial Sequence
  ELANE RNA Guide
agugccuggccaugggccgggg

SEQ ID NO: 18679 - RNA, 22 nt, Artificial Sequence
  ELANE RNA Guide
augggccggggccuucugggca

SEQ ID NO: 18680 - RNA, 22 nt, Artificial Sequence
  ELANE RNA Guide
cacgguuccugcccagaaggcc

SEQ ID NO: 18681 - RNA, 22 nt, Artificial Sequence
  ELANE RNA Guide
cagaaggccccggcccauggcc

SEQ ID NO: 18682 - RNA, 22 nt, Artificial Sequence
  ELANE RNA Guide
cagugccuggccaugggccggg

SEQ ID NO: 18683 - RNA, 22 nt, Artificial Sequence
  ELANE RNA Guide
caugggccggggccuucugggc

SEQ ID NO: 18684 - RNA, 22 nt, Artificial Sequence
  ELANE RNA Guide
ccacgguuccugcccagaaggc

SEQ ID NO: 18685 - RNA, 22 nt, Artificial Sequence
  ELANE RNA Guide
ccagaaggccccggcccauggc

SEQ ID NO: 18686 - RNA, 22 nt, Artificial Sequence
  ELANE RNA Guide
ccaugggccggggccuucuggg

SEQ ID NO: 18687 - RNA, 22 nt, Artificial Sequence
  ELANE RNA Guide
cccagaaggccccggcccaugg

SEQ ID NO: 18688 - RNA, 22 nt, Artificial Sequence
  ELANE RNA Guide
ccccggcccauggccaggcacu

SEQ ID NO: 18689 - RNA, 22 nt, Artificial Sequence
  ELANE RNA Guide
cccggcccauggccaggcacug

SEQ ID NO: 18690 - RNA, 22 nt, Artificial Sequence
  ELANE RNA Guide
ccggcccauggccaggcacugc

SEQ ID NO: 18691 - RNA, 22 nt, Artificial Sequence
  ELANE RNA Guide
ccggggccuucugggcaggaac

SEQ ID NO: 18692 - RNA, 22 nt, Artificial Sequence
  ELANE RNA Guide
ccuggccaugggccggggccuu

SEQ ID NO: 18693 - RNA, 22 nt, Artificial Sequence
  ELANE RNA Guide
cggcccauggccaggcacugca

SEQ ID NO: 18694 - RNA, 22 nt, Artificial Sequence
  ELANE RNA Guide
cggggugcagugccuggccaug

SEQ ID NO: 18695 - RNA, 22 nt, Artificial Sequence
  ELANE RNA Guide
cgguuccugcccagaaggcccc

SEQ ID NO: 18696 - RNA, 22 nt, Artificial Sequence
  ELANE RNA Guide
cugcccagaaggccccggccca

SEQ ID NO: 18697 - RNA, 22 nt, Artificial Sequence
  ELANE RNA Guide
cuggccaugggccggggccuuc

SEQ ID NO: 18698 - RNA, 22 nt, Artificial Sequence
  ELANE RNA Guide
gaaggccccggcccauggccag

SEQ ID NO: 18699 - RNA, 22 nt, Artificial Sequence
  ELANE RNA Guide
gcagugccuggccaugggccgg

SEQ ID NO: 18700 - RNA, 22 nt, Artificial Sequence
  ELANE RNA Guide
gccaugggccggggccuucugg

SEQ ID NO: 18701 - RNA, 22 nt, Artificial Sequence
  ELANE RNA Guide
gcccagaaggccccggcccaug

SEQ ID NO: 18702 - RNA, 22 nt, Artificial Sequence
  ELANE RNA Guide
gccggggccuucugggcaggaa

SEQ ID NO: 18703 - RNA, 22 nt, Artificial Sequence
  ELANE RNA Guide
ggccaugggccggggccuucug

SEQ ID NO: 18704 - RNA, 22 nt, Artificial Sequence
  ELANE RNA Guide
ggccggggccuucugggcagga

SEQ ID NO: 18705 - RNA, 22 nt, Artificial Sequence
  ELANE RNA Guide
ggggugcagugccuggccaugg

SEQ ID NO: 18706 - RNA, 22 nt, Artificial Sequence
  ELANE RNA Guide
gggugcagugccuggccauggg

SEQ ID NO: 18707 - RNA, 22 nt, Artificial Sequence
  ELANE RNA Guide
ggugcagugccuggccaugggc

SEQ ID NO: 18708 - RNA, 22 nt, Artificial Sequence
  ELANE RNA Guide
gguuccugcccagaaggccccg

SEQ ID NO: 18709 - RNA, 22 nt, Artificial Sequence
  ELANE RNA Guide
gugcagugccuggccaugggcc

SEQ ID NO: 18710 - RNA, 22 nt, Artificial Sequence
  ELANE RNA Guide
guuccugcccagaaggccccgg

SEQ ID NO: 18711 - RNA, 22 nt, Artificial Sequence
  ELANE RNA Guide
uccugcccagaaggccccggcc

SEQ ID NO: 18712 - RNA, 22 nt, Artificial Sequence
  ELANE RNA Guide
ugcagugccuggccaugggccg

SEQ ID NO: 18713 - RNA, 22 nt, Artificial Sequence
  ELANE RNA Guide
ugcccagaaggccccggcccau

SEQ ID NO: 18714 - RNA, 22 nt, Artificial Sequence
  ELANE RNA Guide
uggccaugggccggggccuucu

SEQ ID NO: 18715 - RNA, 22 nt, Artificial Sequence
  ELANE RNA Guide
ugggccggggccuucugggcag

SEQ ID NO: 18716 - RNA, 22 nt, Artificial Sequence
  ELANE RNA Guide
uuccugcccagaaggccccggc

SEQ ID NO: 18717 - RNA, 20 nt, Artificial Sequence
  ELANE RNA Guide
aaggccgcagcccauggcca

SEQ ID NO: 18718 - RNA, 20 nt, Artificial Sequence
  ELANE RNA Guide
agaaggccgcagcccauggc

SEQ ID NO: 18719 - RNA, 20 nt, Artificial Sequence
  ELANE RNA Guide
aggccgcagcccauggccag

SEQ ID NO: 18720 - RNA, 20 nt, Artificial Sequence
  ELANE RNA Guide
agugccuggccaugggcugc

SEQ ID NO: 18721 - RNA, 20 nt, Artificial Sequence
  ELANE RNA Guide
augggcugcggccuucuggg

SEQ ID NO: 18722 - RNA, 20 nt, Artificial Sequence
  ELANE RNA Guide
cacgguuccugcccagaagg

SEQ ID NO: 18723 - RNA, 20 nt, Artificial Sequence
  ELANE RNA Guide
cagaaggccgcagcccaugg

SEQ ID NO: 18724 - RNA, 20 nt, Artificial Sequence
  ELANE RNA Guide
cagugccuggccaugggcug

SEQ ID NO: 18725 - RNA, 20 nt, Artificial Sequence
  ELANE RNA Guide
caugggcugcggccuucugg

SEQ ID NO: 18726 - RNA, 20 nt, Artificial Sequence
  ELANE RNA Guide
ccacgguuccugcccagaag

SEQ ID NO: 18727 - RNA, 20 nt, Artificial Sequence
  ELANE RNA Guide
ccagaaggccgcagcccaug

SEQ ID NO: 18728 - RNA, 20 nt, Artificial Sequence
  ELANE RNA Guide
ccaugggcugcggccuucug

SEQ ID NO: 18729 - RNA, 20 nt, Artificial Sequence
  ELANE RNA Guide
cccagaaggccgcagcccau

SEQ ID NO: 18730 - RNA, 20 nt, Artificial Sequence
  ELANE RNA Guide
ccgcagcccauggccaggca

SEQ ID NO: 18731 - RNA, 20 nt, Artificial Sequence
  ELANE RNA Guide
ccugcccagaaggccgcagc

SEQ ID NO: 18732 - RNA, 20 nt, Artificial Sequence
  ELANE RNA Guide
ccuggccaugggcugcggcc

SEQ ID NO: 18733 - RNA, 20 nt, Artificial Sequence
  ELANE RNA Guide
cgcagcccauggccaggcac

SEQ ID NO: 18734 - RNA, 20 nt, Artificial Sequence
  ELANE RNA Guide
cugcccagaaggccgcagcc

SEQ ID NO: 18735 - RNA, 20 nt, Artificial Sequence
  ELANE RNA Guide
cugcggccuucugggcagga

SEQ ID NO: 18736 - RNA, 20 nt, Artificial Sequence
  ELANE RNA Guide
cuggccaugggcugcggccu

SEQ ID NO: 18737 - RNA, 20 nt, Artificial Sequence
  ELANE RNA Guide
gaaggccgcagcccauggcc

SEQ ID NO: 18738 - RNA, 20 nt, Artificial Sequence
  ELANE RNA Guide
gcagugccuggccaugggcu

SEQ ID NO: 18739 - RNA, 20 nt, Artificial Sequence
  ELANE RNA Guide
gccaugggcugcggccuucu

SEQ ID NO: 18740 - RNA, 20 nt, Artificial Sequence
  ELANE RNA Guide
gcccagaaggccgcagccca

SEQ ID NO: 18741 - RNA, 20 nt, Artificial Sequence
  ELANE RNA Guide
gccgcagcccauggccaggc

SEQ ID NO: 18742 - RNA, 20 nt, Artificial Sequence
  ELANE RNA Guide
gccuggccaugggcugcggc

SEQ ID NO: 18743 - RNA, 20 nt, Artificial Sequence
  ELANE RNA Guide
gcggccuucugggcaggaac

SEQ ID NO: 18744 - RNA, 20 nt, Artificial Sequence
  ELANE RNA Guide
gcugcggccuucugggcagg

SEQ ID NO: 18745 - RNA, 20 nt, Artificial Sequence
  ELANE RNA Guide
ggccaugggcugcggccuuc

SEQ ID NO: 18746 - RNA, 20 nt, Artificial Sequence
  ELANE RNA Guide
ggccgcagcccauggccagg

SEQ ID NO: 18747 - RNA, 20 nt, Artificial Sequence
  ELANE RNA Guide
ggcugcggccuucugggcag

SEQ ID NO: 18748 - RNA, 20 nt, Artificial Sequence
  ELANE RNA Guide
gggcugcggccuucugggca

SEQ ID NO: 18749 - RNA, 20 nt, Artificial Sequence
  ELANE RNA Guide
gguuccugcccagaaggccg

SEQ ID NO: 18750 - RNA, 20 nt, Artificial Sequence
  ELANE RNA Guide
gugccuggccaugggcugcg

SEQ ID NO: 18751 - RNA, 20 nt, Artificial Sequence
  ELANE RNA Guide
guuccugcccagaaggccgc

SEQ ID NO: 18752 - RNA, 20 nt, Artificial Sequence
  ELANE RNA Guide
uccugcccagaaggccgcag

SEQ ID NO: 18753 - RNA, 20 nt, Artificial Sequence
  ELANE RNA Guide
ugcccagaaggccgcagccc

SEQ ID NO: 18754 - RNA, 20 nt, Artificial Sequence
  ELANE RNA Guide
ugccuggccaugggcugcgg

SEQ ID NO: 18755 - RNA, 20 nt, Artificial Sequence
  ELANE RNA Guide
ugcggccuucugggcaggaa

SEQ ID NO: 18756 - RNA, 20 nt, Artificial Sequence
  ELANE RNA Guide
uggccaugggcugcggccuu

SEQ ID NO: 18757 - RNA, 20 nt, Artificial Sequence
  ELANE RNA Guide
ugggcugcggccuucugggc

SEQ ID NO: 18758 - RNA, 20 nt, Artificial Sequence
  ELANE RNA Guide
uuccugcccagaaggccgca

SEQ ID NO: 18759 - RNA, 21 nt, Artificial Sequence
  ELANE RNA Guide
aaggccgcagcccauggccag

SEQ ID NO: 18760 - RNA, 21 nt, Artificial Sequence
  ELANE RNA Guide
agaaggccgcagcccauggcc

SEQ ID NO: 18761 - RNA, 21 nt, Artificial Sequence
  ELANE RNA Guide
aggccgcagcccauggccagg

SEQ ID NO: 18762 - RNA, 21 nt, Artificial Sequence
  ELANE RNA Guide
agugccuggccaugggcugcg

SEQ ID NO: 18763 - RNA, 21 nt, Artificial Sequence
  ELANE RNA Guide
augggcugcggccuucugggc

SEQ ID NO: 18764 - RNA, 21 nt, Artificial Sequence
  ELANE RNA Guide
cagaaggccgcagcccauggc

SEQ ID NO: 18765 - RNA, 21 nt, Artificial Sequence
  ELANE RNA Guide
cagugccuggccaugggcugc

SEQ ID NO: 18766 - RNA, 21 nt, Artificial Sequence
  ELANE RNA Guide
caugggcugcggccuucuggg

SEQ ID NO: 18767 - RNA, 21 nt, Artificial Sequence
  ELANE RNA Guide
ccacgguuccugcccagaagg

SEQ ID NO: 18768 - RNA, 21 nt, Artificial Sequence
  ELANE RNA Guide
ccagaaggccgcagcccaugg

SEQ ID NO: 18769 - RNA, 21 nt, Artificial Sequence
  ELANE RNA Guide
ccaugggcugcggccuucugg

SEQ ID NO: 18770 - RNA, 21 nt, Artificial Sequence
  ELANE RNA Guide
cccacgguuccugcccagaag

SEQ ID NO: 18771 - RNA, 21 nt, Artificial Sequence
  ELANE RNA Guide
cccagaaggccgcagcccaug

SEQ ID NO: 18772 - RNA, 21 nt, Artificial Sequence
  ELANE RNA Guide
ccgcagcccauggccaggcac

SEQ ID NO: 18773 - RNA, 21 nt, Artificial Sequence
  ELANE RNA Guide
ccugcccagaaggccgcagcc

SEQ ID NO: 18774 - RNA, 21 nt, Artificial Sequence
  ELANE RNA Guide
ccuggccaugggcugcggccu

SEQ ID NO: 18775 - RNA, 21 nt, Artificial Sequence
  ELANE RNA Guide
cgcagcccauggccaggcacu

SEQ ID NO: 18776 - RNA, 21 nt, Artificial Sequence
  ELANE RNA Guide
cgguuccugcccagaaggccg

SEQ ID NO: 18777 - RNA, 21 nt, Artificial Sequence
  ELANE RNA Guide
cugcccagaaggccgcagccc

SEQ ID NO: 18778 - RNA, 21 nt, Artificial Sequence
  ELANE RNA Guide
cugcggccuucugggcaggaa

SEQ ID NO: 18779 - RNA, 21 nt, Artificial Sequence
  ELANE RNA Guide
cuggccaugggcugcggccuu

SEQ ID NO: 18780 - RNA, 21 nt, Artificial Sequence
  ELANE RNA Guide
gaaggccgcagcccauggcca

SEQ ID NO: 18781 - RNA, 21 nt, Artificial Sequence
  ELANE RNA Guide
gcagugccuggccaugggcug

SEQ ID NO: 18782 - RNA, 21 nt, Artificial Sequence
  ELANE RNA Guide
gccaugggcugcggccuucug

SEQ ID NO: 18783 - RNA, 21 nt, Artificial Sequence
  ELANE RNA Guide
gcccagaaggccgcagcccau

SEQ ID NO: 18784 - RNA, 21 nt, Artificial Sequence
  ELANE RNA Guide
gccgcagcccauggccaggca

SEQ ID NO: 18785 - RNA, 21 nt, Artificial Sequence
  ELANE RNA Guide
gcggccuucugggcaggaacc

SEQ ID NO: 18786 - RNA, 21 nt, Artificial Sequence
  ELANE RNA Guide
gcugcggccuucugggcagga

SEQ ID NO: 18787 - RNA, 21 nt, Artificial Sequence
  ELANE RNA Guide
ggccaugggcugcggccuucu

SEQ ID NO: 18788 - RNA, 21 nt, Artificial Sequence
  ELANE RNA Guide
ggcugcggccuucugggcagg

SEQ ID NO: 18789 - RNA, 21 nt, Artificial Sequence
  ELANE RNA Guide
gggcugcggccuucugggcag

SEQ ID NO: 18790 - RNA, 21 nt, Artificial Sequence
  ELANE RNA Guide
gguuccugcccagaaggccgc

SEQ ID NO: 18791 - RNA, 21 nt, Artificial Sequence
  ELANE RNA Guide
gugccuggccaugggcugcgg

SEQ ID NO: 18792 - RNA, 21 nt, Artificial Sequence
  ELANE RNA Guide
guuccugcccagaaggccgca

SEQ ID NO: 18793 - RNA, 21 nt, Artificial Sequence
  ELANE RNA Guide
uccugcccagaaggccgcagc

SEQ ID NO: 18794 - RNA, 21 nt, Artificial Sequence
  ELANE RNA Guide
ugcagugccuggccaugggcu

SEQ ID NO: 18795 - RNA, 21 nt, Artificial Sequence
  ELANE RNA Guide
ugcccagaaggccgcagccca

SEQ ID NO: 18796 - RNA, 21 nt, Artificial Sequence
  ELANE RNA Guide
ugccuggccaugggcugcggc

SEQ ID NO: 18797 - RNA, 21 nt, Artificial Sequence
  ELANE RNA Guide
ugcggccuucugggcaggaac

SEQ ID NO: 18798 - RNA, 21 nt, Artificial Sequence
  ELANE RNA Guide
uggccaugggcugcggccuuc

SEQ ID NO: 18799 - RNA, 21 nt, Artificial Sequence
  ELANE RNA Guide
ugggcugcggccuucugggca

SEQ ID NO: 18800 - RNA, 21 nt, Artificial Sequence
  ELANE RNA Guide
uuccugcccagaaggccgcag

SEQ ID NO: 18801 - RNA, 22 nt, Artificial Sequence
  ELANE RNA Guide
aaggccgcagcccauggccagg

SEQ ID NO: 18802 - RNA, 22 nt, Artificial Sequence
  ELANE RNA Guide
acgguuccugcccagaaggccg

SEQ ID NO: 18803 - RNA, 22 nt, Artificial Sequence
  ELANE RNA Guide
agaaggccgcagcccauggcca

SEQ ID NO: 18804 - RNA, 22 nt, Artificial Sequence
  ELANE RNA Guide
aggccgcagcccauggccaggc

SEQ ID NO: 18805 - RNA, 22 nt, Artificial Sequence
  ELANE RNA Guide
agugccuggccaugggcugcgg

SEQ ID NO: 18806 - RNA, 22 nt, Artificial Sequence
  ELANE RNA Guide
augggcugcggccuucugggca

SEQ ID NO: 18807 - RNA, 22 nt, Artificial Sequence
  ELANE RNA Guide
cagaaggccgcagcccauggcc

SEQ ID NO: 18808 - RNA, 22 nt, Artificial Sequence
  ELANE RNA Guide
cagugccuggccaugggcugcg

SEQ ID NO: 18809 - RNA, 22 nt, Artificial Sequence
  ELANE RNA Guide
caugggcugcggccuucugggc

SEQ ID NO: 18810 - RNA, 22 nt, Artificial Sequence
  ELANE RNA Guide
ccagaaggccgcagcccauggc

SEQ ID NO: 18811 - RNA, 22 nt, Artificial Sequence
  ELANE RNA Guide
ccaugggcugcggccuucuggg

SEQ ID NO: 18812 - RNA, 22 nt, Artificial Sequence
  ELANE RNA Guide
cccacgguuccugcccagaagg

SEQ ID NO: 18813 - RNA, 22 nt, Artificial Sequence
  ELANE RNA Guide
cccagaaggccgcagcccaugg

SEQ ID NO: 18814 - RNA, 22 nt, Artificial Sequence
  ELANE RNA Guide
ccgcagcccauggccaggcacu

SEQ ID NO: 18815 - RNA, 22 nt, Artificial Sequence
  ELANE RNA Guide
ccugcccagaaggccgcagccc

SEQ ID NO: 18816 - RNA, 22 nt, Artificial Sequence
  ELANE RNA Guide
ccuggccaugggcugcggccuu

SEQ ID NO: 18817 - RNA, 22 nt, Artificial Sequence
  ELANE RNA Guide
cgcagcccauggccaggcacug

SEQ ID NO: 18818 - RNA, 22 nt, Artificial Sequence
  ELANE RNA Guide
cgguuccugcccagaaggccgc

SEQ ID NO: 18819 - RNA, 22 nt, Artificial Sequence
  ELANE RNA Guide
cugcccagaaggccgcagccca

SEQ ID NO: 18820 - RNA, 22 nt, Artificial Sequence
  ELANE RNA Guide
cugcggccuucugggcaggaac

SEQ ID NO: 18821 - RNA, 22 nt, Artificial Sequence
  ELANE RNA Guide
cuggccaugggcugcggccuuc

SEQ ID NO: 18822 - RNA, 22 nt, Artificial Sequence
  ELANE RNA Guide
gaaggccgcagcccauggccag

SEQ ID NO: 18823 - RNA, 22 nt, Artificial Sequence
  ELANE RNA Guide
gcagugccuggccaugggcugc

SEQ ID NO: 18824 - RNA, 22 nt, Artificial Sequence
  ELANE RNA Guide
gccaugggcugcggccuucugg

SEQ ID NO: 18825 - RNA, 22 nt, Artificial Sequence
  ELANE RNA Guide
gcccagaaggccgcagcccaug

SEQ ID NO: 18826 - RNA, 22 nt, Artificial Sequence
  ELANE RNA Guide
gccgcagcccauggccaggcac

SEQ ID NO: 18827 - RNA, 22 nt, Artificial Sequence
  ELANE RNA Guide
gccuggccaugggcugcggccu

SEQ ID NO: 18828 - RNA, 22 nt, Artificial Sequence
  ELANE RNA Guide
gcggccuucugggcaggaaccg

SEQ ID NO: 18829 - RNA, 22 nt, Artificial Sequence
  ELANE RNA Guide
gcugcggccuucugggcaggaa

SEQ ID NO: 18830 - RNA, 22 nt, Artificial Sequence
  ELANE RNA Guide
ggccaugggcugcggccuucug

SEQ ID NO: 18831 - RNA, 22 nt, Artificial Sequence
  ELANE RNA Guide
ggccgcagcccauggccaggca

SEQ ID NO: 18832 - RNA, 22 nt, Artificial Sequence
  ELANE RNA Guide
ggcugcggccuucugggcagga

SEQ ID NO: 18833 - RNA, 22 nt, Artificial Sequence
  ELANE RNA Guide
gggcugcggccuucugggcagg

SEQ ID NO: 18834 - RNA, 22 nt, Artificial Sequence
  ELANE RNA Guide
gguuccugcccagaaggccgca

SEQ ID NO: 18835 - RNA, 22 nt, Artificial Sequence
  ELANE RNA Guide
gugcagugccuggccaugggcu

SEQ ID NO: 18836 - RNA, 22 nt, Artificial Sequence
  ELANE RNA Guide
gugccuggccaugggcugcggc

SEQ ID NO: 18837 - RNA, 22 nt, Artificial Sequence
  ELANE RNA Guide
guuccugcccagaaggccgcag

SEQ ID NO: 18838 - RNA, 22 nt, Artificial Sequence
  ELANE RNA Guide
ucccacgguuccugcccagaag

SEQ ID NO: 18839 - RNA, 22 nt, Artificial Sequence
  ELANE RNA Guide
uccugcccagaaggccgcagcc

SEQ ID NO: 18840 - RNA, 22 nt, Artificial Sequence
  ELANE RNA Guide
ugcagugccuggccaugggcug

SEQ ID NO: 18841 - RNA, 22 nt, Artificial Sequence
  ELANE RNA Guide
ugcccagaaggccgcagcccau

SEQ ID NO: 18842 - RNA, 22 nt, Artificial Sequence
  ELANE RNA Guide
ugccuggccaugggcugcggcc

SEQ ID NO: 18843 - RNA, 22 nt, Artificial Sequence
  ELANE RNA Guide
ugcggccuucugggcaggaacc

SEQ ID NO: 18844 - RNA, 22 nt, Artificial Sequence
  ELANE RNA Guide
uggccaugggcugcggccuucu

SEQ ID NO: 18845 - RNA, 22 nt, Artificial Sequence
  ELANE RNA Guide
ugggcugcggccuucugggcag

SEQ ID NO: 18846 - RNA, 22 nt, Artificial Sequence
  ELANE RNA Guide
uuccugcccagaaggccgcagc

SEQ ID NO: 18847 - RNA, 20 nt, Artificial Sequence
  ELANE RNA Guide
aacgccccagcccauggcca

SEQ ID NO: 18848 - RNA, 20 nt, Artificial Sequence
  ELANE RNA Guide
acgccccagcccauggccag

SEQ ID NO: 18849 - RNA, 20 nt, Artificial Sequence
  ELANE RNA Guide
acgguuccugcccagaacgc

SEQ ID NO: 18850 - RNA, 20 nt, Artificial Sequence
  ELANE RNA Guide
agaacgccccagcccauggc

SEQ ID NO: 18851 - RNA, 20 nt, Artificial Sequence
  ELANE RNA Guide
agugccuggccaugggcugg

SEQ ID NO: 18852 - RNA, 20 nt, Artificial Sequence
  ELANE RNA Guide
aucccacgguuccugcccag

SEQ ID NO: 18853 - RNA, 20 nt, Artificial Sequence
  ELANE RNA Guide
augggcuggggcguucuggg

SEQ ID NO: 18854 - RNA, 20 nt, Artificial Sequence
  ELANE RNA Guide
cacgguuccugcccagaacg

SEQ ID NO: 18855 - RNA, 20 nt, Artificial Sequence
  ELANE RNA Guide
cagaacgccccagcccaugg

SEQ ID NO: 18856 - RNA, 20 nt, Artificial Sequence
  ELANE RNA Guide
caugggcuggggcguucugg

SEQ ID NO: 18857 - RNA, 20 nt, Artificial Sequence
  ELANE RNA Guide
ccacgguuccugcccagaac

SEQ ID NO: 18858 - RNA, 20 nt, Artificial Sequence
  ELANE RNA Guide
ccagaacgccccagcccaug

SEQ ID NO: 18859 - RNA, 20 nt, Artificial Sequence
  ELANE RNA Guide
ccaugggcuggggcguucug

SEQ ID NO: 18860 - RNA, 20 nt, Artificial Sequence
  ELANE RNA Guide
cccacgguuccugcccagaa

SEQ ID NO: 18861 - RNA, 20 nt, Artificial Sequence
  ELANE RNA Guide
cccagaacgccccagcccau

SEQ ID NO: 18862 - RNA, 20 nt, Artificial Sequence
  ELANE RNA Guide
ccugcccagaacgccccagc

SEQ ID NO: 18863 - RNA, 20 nt, Artificial Sequence
  ELANE RNA Guide
ccuggccaugggcuggggcg

SEQ ID NO: 18864 - RNA, 20 nt, Artificial Sequence
  ELANE RNA Guide
cgguuccugcccagaacgcc

SEQ ID NO: 18865 - RNA, 20 nt, Artificial Sequence
  ELANE RNA Guide
cguucugggcaggaaccgug

SEQ ID NO: 18866 - RNA, 20 nt, Artificial Sequence
  ELANE RNA Guide
cugcccagaacgccccagcc

SEQ ID NO: 18867 - RNA, 20 nt, Artificial Sequence
  ELANE RNA Guide
cuggccaugggcuggggcgu

SEQ ID NO: 18868 - RNA, 20 nt, Artificial Sequence
  ELANE RNA Guide
cuggggcguucugggcagga

SEQ ID NO: 18869 - RNA, 20 nt, Artificial Sequence
  ELANE RNA Guide
gaacgccccagcccauggcc

SEQ ID NO: 18870 - RNA, 20 nt, Artificial Sequence
  ELANE RNA Guide
gaucccacgguuccugccca

SEQ ID NO: 18871 - RNA, 20 nt, Artificial Sequence
  ELANE RNA Guide
gccaugggcuggggcguucu

SEQ ID NO: 18872 - RNA, 20 nt, Artificial Sequence
  ELANE RNA Guide
gcccagaacgccccagccca

SEQ ID NO: 18873 - RNA, 20 nt, Artificial Sequence
  ELANE RNA Guide
gccuggccaugggcuggggc

SEQ ID NO: 18874 - RNA, 20 nt, Artificial Sequence
  ELANE RNA Guide
gcguucugggcaggaaccgu

SEQ ID NO: 18875 - RNA, 20 nt, Artificial Sequence
  ELANE RNA Guide
gcuggggcguucugggcagg

SEQ ID NO: 18876 - RNA, 20 nt, Artificial Sequence
  ELANE RNA Guide
ggccaugggcuggggcguuc

SEQ ID NO: 18877 - RNA, 20 nt, Artificial Sequence
  ELANE RNA Guide
ggcguucugggcaggaaccg

SEQ ID NO: 18878 - RNA, 20 nt, Artificial Sequence
  ELANE RNA Guide
ggcuggggcguucugggcag

SEQ ID NO: 18879 - RNA, 20 nt, Artificial Sequence
  ELANE RNA Guide
gggcguucugggcaggaacc

SEQ ID NO: 18880 - RNA, 20 nt, Artificial Sequence
  ELANE RNA Guide
gggcuggggcguucugggca

SEQ ID NO: 18881 - RNA, 20 nt, Artificial Sequence
  ELANE RNA Guide
ggggcguucugggcaggaac

SEQ ID NO: 18882 - RNA, 20 nt, Artificial Sequence
  ELANE RNA Guide
gguuccugcccagaacgccc

SEQ ID NO: 18883 - RNA, 20 nt, Artificial Sequence
  ELANE RNA Guide
gugccuggccaugggcuggg

SEQ ID NO: 18884 - RNA, 20 nt, Artificial Sequence
  ELANE RNA Guide
guuccugcccagaacgcccc

SEQ ID NO: 18885 - RNA, 20 nt, Artificial Sequence
  ELANE RNA Guide
ucccacgguuccugcccaga

SEQ ID NO: 18886 - RNA, 20 nt, Artificial Sequence
  ELANE RNA Guide
uccugcccagaacgccccag

SEQ ID NO: 18887 - RNA, 20 nt, Artificial Sequence
  ELANE RNA Guide
ugcccagaacgccccagccc

SEQ ID NO: 18888 - RNA, 20 nt, Artificial Sequence
  ELANE RNA Guide
ugccuggccaugggcugggg

SEQ ID NO: 18889 - RNA, 20 nt, Artificial Sequence
  ELANE RNA Guide
uggccaugggcuggggcguu

SEQ ID NO: 18890 - RNA, 20 nt, Artificial Sequence
  ELANE RNA Guide
ugggcuggggcguucugggc

SEQ ID NO: 18891 - RNA, 20 nt, Artificial Sequence
  ELANE RNA Guide
uggggcguucugggcaggaa

SEQ ID NO: 18892 - RNA, 20 nt, Artificial Sequence
  ELANE RNA Guide
uuccugcccagaacgcccca

SEQ ID NO: 18893 - RNA, 21 nt, Artificial Sequence
  ELANE RNA Guide
aacgccccagcccauggccag

SEQ ID NO: 18894 - RNA, 21 nt, Artificial Sequence
  ELANE RNA Guide
acgccccagcccauggccagg

SEQ ID NO: 18895 - RNA, 21 nt, Artificial Sequence
  ELANE RNA Guide
acgguuccugcccagaacgcc

SEQ ID NO: 18896 - RNA, 21 nt, Artificial Sequence
  ELANE RNA Guide
agaacgccccagcccauggcc

SEQ ID NO: 18897 - RNA, 21 nt, Artificial Sequence
  ELANE RNA Guide
agugccuggccaugggcuggg

SEQ ID NO: 18898 - RNA, 21 nt, Artificial Sequence
  ELANE RNA Guide
aucccacgguuccugcccaga

SEQ ID NO: 18899 - RNA, 21 nt, Artificial Sequence
  ELANE RNA Guide
augggcuggggcguucugggc

SEQ ID NO: 18900 - RNA, 21 nt, Artificial Sequence
  ELANE RNA Guide
cacgguuccugcccagaacgc

SEQ ID NO: 18901 - RNA, 21 nt, Artificial Sequence
  ELANE RNA Guide
cagaacgccccagcccauggc

SEQ ID NO: 18902 - RNA, 21 nt, Artificial Sequence
  ELANE RNA Guide
cagugccuggccaugggcugg

SEQ ID NO: 18903 - RNA, 21 nt, Artificial Sequence
  ELANE RNA Guide
caugggcuggggcguucuggg

SEQ ID NO: 18904 - RNA, 21 nt, Artificial Sequence
  ELANE RNA Guide
ccacgguuccugcccagaacg

SEQ ID NO: 18905 - RNA, 21 nt, Artificial Sequence
  ELANE RNA Guide
ccagaacgccccagcccaugg

SEQ ID NO: 18906 - RNA, 21 nt, Artificial Sequence
  ELANE RNA Guide
ccaugggcuggggcguucugg

SEQ ID NO: 18907 - RNA, 21 nt, Artificial Sequence
  ELANE RNA Guide
cccacgguuccugcccagaac

SEQ ID NO: 18908 - RNA, 21 nt, Artificial Sequence
  ELANE RNA Guide
cccagaacgccccagcccaug

SEQ ID NO: 18909 - RNA, 21 nt, Artificial Sequence
  ELANE RNA Guide
ccugcccagaacgccccagcc

SEQ ID NO: 18910 - RNA, 21 nt, Artificial Sequence
  ELANE RNA Guide
ccuggccaugggcuggggcgu

SEQ ID NO: 18911 - RNA, 21 nt, Artificial Sequence
  ELANE RNA Guide
cgaucccacgguuccugccca

SEQ ID NO: 18912 - RNA, 21 nt, Artificial Sequence
  ELANE RNA Guide
cgguuccugcccagaacgccc

SEQ ID NO: 18913 - RNA, 21 nt, Artificial Sequence
  ELANE RNA Guide
cguucugggcaggaaccgugg

SEQ ID NO: 18914 - RNA, 21 nt, Artificial Sequence
  ELANE RNA Guide
cugcccagaacgccccagccc

SEQ ID NO: 18915 - RNA, 21 nt, Artificial Sequence
  ELANE RNA Guide
cuggccaugggcuggggcguu

SEQ ID NO: 18916 - RNA, 21 nt, Artificial Sequence
  ELANE RNA Guide
cuggggcguucugggcaggaa

SEQ ID NO: 18917 - RNA, 21 nt, Artificial Sequence
  ELANE RNA Guide
gaacgccccagcccauggcca

SEQ ID NO: 18918 - RNA, 21 nt, Artificial Sequence
  ELANE RNA Guide
gaucccacgguuccugcccag

SEQ ID NO: 18919 - RNA, 21 nt, Artificial Sequence
  ELANE RNA Guide
gccaugggcuggggcguucug

SEQ ID NO: 18920 - RNA, 21 nt, Artificial Sequence
  ELANE RNA Guide
gcccagaacgccccagcccau

SEQ ID NO: 18921 - RNA, 21 nt, Artificial Sequence
  ELANE RNA Guide
gcguucugggcaggaaccgug

SEQ ID NO: 18922 - RNA, 21 nt, Artificial Sequence
  ELANE RNA Guide
gcuggggcguucugggcagga

SEQ ID NO: 18923 - RNA, 21 nt, Artificial Sequence
  ELANE RNA Guide
ggccaugggcuggggcguucu

SEQ ID NO: 18924 - RNA, 21 nt, Artificial Sequence
  ELANE RNA Guide
ggcguucugggcaggaaccgu

SEQ ID NO: 18925 - RNA, 21 nt, Artificial Sequence
  ELANE RNA Guide
ggcuggggcguucugggcagg

SEQ ID NO: 18926 - RNA, 21 nt, Artificial Sequence
  ELANE RNA Guide
gggcguucugggcaggaaccg

SEQ ID NO: 18927 - RNA, 21 nt, Artificial Sequence
  ELANE RNA Guide
gggcuggggcguucugggcag

SEQ ID NO: 18928 - RNA, 21 nt, Artificial Sequence
  ELANE RNA Guide
ggggcguucugggcaggaacc

SEQ ID NO: 18929 - RNA, 21 nt, Artificial Sequence
  ELANE RNA Guide
gguuccugcccagaacgcccc

SEQ ID NO: 18930 - RNA, 21 nt, Artificial Sequence
  ELANE RNA Guide
gugccuggccaugggcugggg

SEQ ID NO: 18931 - RNA, 21 nt, Artificial Sequence
  ELANE RNA Guide
guuccugcccagaacgcccca

SEQ ID NO: 18932 - RNA, 21 nt, Artificial Sequence
  ELANE RNA Guide
ucccacgguuccugcccagaa

SEQ ID NO: 18933 - RNA, 21 nt, Artificial Sequence
  ELANE RNA Guide
uccugcccagaacgccccagc

SEQ ID NO: 18934 - RNA, 21 nt, Artificial Sequence
  ELANE RNA Guide
ugcccagaacgccccagccca

SEQ ID NO: 18935 - RNA, 21 nt, Artificial Sequence
  ELANE RNA Guide
ugccuggccaugggcuggggc

SEQ ID NO: 18936 - RNA, 21 nt, Artificial Sequence
  ELANE RNA Guide
uggccaugggcuggggcguuc

SEQ ID NO: 18937 - RNA, 21 nt, Artificial Sequence
  ELANE RNA Guide
ugggcuggggcguucugggca

SEQ ID NO: 18938 - RNA, 21 nt, Artificial Sequence
  ELANE RNA Guide
uggggcguucugggcaggaac

SEQ ID NO: 18939 - RNA, 21 nt, Artificial Sequence
  ELANE RNA Guide
uuccugcccagaacgccccag

SEQ ID NO: 18940 - RNA, 22 nt, Artificial Sequence
  ELANE RNA Guide
aacgccccagcccauggccagg

SEQ ID NO: 18941 - RNA, 22 nt, Artificial Sequence
  ELANE RNA Guide
acgccccagcccauggccaggc

SEQ ID NO: 18942 - RNA, 22 nt, Artificial Sequence
  ELANE RNA Guide
acgguuccugcccagaacgccc

SEQ ID NO: 18943 - RNA, 22 nt, Artificial Sequence
  ELANE RNA Guide
agaacgccccagcccauggcca

SEQ ID NO: 18944 - RNA, 22 nt, Artificial Sequence
  ELANE RNA Guide
agugccuggccaugggcugggg

SEQ ID NO: 18945 - RNA, 22 nt, Artificial Sequence
  ELANE RNA Guide
aucccacgguuccugcccagaa

SEQ ID NO: 18946 - RNA, 22 nt, Artificial Sequence
  ELANE RNA Guide
augggcuggggcguucugggca

SEQ ID NO: 18947 - RNA, 22 nt, Artificial Sequence
  ELANE RNA Guide
cacgguuccugcccagaacgcc

SEQ ID NO: 18948 - RNA, 22 nt, Artificial Sequence
  ELANE RNA Guide
cagaacgccccagcccauggcc

SEQ ID NO: 18949 - RNA, 22 nt, Artificial Sequence
  ELANE RNA Guide
cagugccuggccaugggcuggg

SEQ ID NO: 18950 - RNA, 22 nt, Artificial Sequence
  ELANE RNA Guide
caugggcuggggcguucugggc

SEQ ID NO: 18951 - RNA, 22 nt, Artificial Sequence
  ELANE RNA Guide
ccacgguuccugcccagaacgc

SEQ ID NO: 18952 - RNA, 22 nt, Artificial Sequence
  ELANE RNA Guide
ccagaacgccccagcccauggc

SEQ ID NO: 18953 - RNA, 22 nt, Artificial Sequence
  ELANE RNA Guide
ccaugggcuggggcguucuggg

SEQ ID NO: 18954 - RNA, 22 nt, Artificial Sequence
  ELANE RNA Guide
cccacgguuccugcccagaacg

SEQ ID NO: 18955 - RNA, 22 nt, Artificial Sequence
  ELANE RNA Guide
cccagaacgccccagcccaugg

SEQ ID NO: 18956 - RNA, 22 nt, Artificial Sequence
  ELANE RNA Guide
ccugcccagaacgccccagccc

SEQ ID NO: 18957 - RNA, 22 nt, Artificial Sequence
  ELANE RNA Guide
ccuggccaugggcuggggcguu

SEQ ID NO: 18958 - RNA, 22 nt, Artificial Sequence
  ELANE RNA Guide
cgaucccacgguuccugcccag

SEQ ID NO: 18959 - RNA, 22 nt, Artificial Sequence
  ELANE RNA Guide
cgguuccugcccagaacgcccc

SEQ ID NO: 18960 - RNA, 22 nt, Artificial Sequence
  ELANE RNA Guide
cguucugggcaggaaccguggg

SEQ ID NO: 18961 - RNA, 22 nt, Artificial Sequence
  ELANE RNA Guide
cugcccagaacgccccagccca

SEQ ID NO: 18962 - RNA, 22 nt, Artificial Sequence
  ELANE RNA Guide
cuggccaugggcuggggcguuc

SEQ ID NO: 18963 - RNA, 22 nt, Artificial Sequence
  ELANE RNA Guide
cuggggcguucugggcaggaac

SEQ ID NO: 18964 - RNA, 22 nt, Artificial Sequence
  ELANE RNA Guide
gaacgccccagcccauggccag

SEQ ID NO: 18965 - RNA, 22 nt, Artificial Sequence
  ELANE RNA Guide
gaucccacgguuccugcccaga

SEQ ID NO: 18966 - RNA, 22 nt, Artificial Sequence
  ELANE RNA Guide
gcagugccuggccaugggcugg

SEQ ID NO: 18967 - RNA, 22 nt, Artificial Sequence
  ELANE RNA Guide
gccaugggcuggggcguucugg

SEQ ID NO: 18968 - RNA, 22 nt, Artificial Sequence
  ELANE RNA Guide
gcccagaacgccccagcccaug

SEQ ID NO: 18969 - RNA, 22 nt, Artificial Sequence
  ELANE RNA Guide
gccuggccaugggcuggggcgu

SEQ ID NO: 18970 - RNA, 22 nt, Artificial Sequence
  ELANE RNA Guide
gcgaucccacgguuccugccca

SEQ ID NO: 18971 - RNA, 22 nt, Artificial Sequence
  ELANE RNA Guide
gcguucugggcaggaaccgugg

SEQ ID NO: 18972 - RNA, 22 nt, Artificial Sequence
  ELANE RNA Guide
gcuggggcguucugggcaggaa

SEQ ID NO: 18973 - RNA, 22 nt, Artificial Sequence
  ELANE RNA Guide
ggccaugggcuggggcguucug

SEQ ID NO: 18974 - RNA, 22 nt, Artificial Sequence
  ELANE RNA Guide
ggcguucugggcaggaaccgug

SEQ ID NO: 18975 - RNA, 22 nt, Artificial Sequence
  ELANE RNA Guide
ggcuggggcguucugggcagga

SEQ ID NO: 18976 - RNA, 22 nt, Artificial Sequence
  ELANE RNA Guide
gggcguucugggcaggaaccgu

SEQ ID NO: 18977 - RNA, 22 nt, Artificial Sequence
  ELANE RNA Guide
gggcuggggcguucugggcagg

SEQ ID NO: 18978 - RNA, 22 nt, Artificial Sequence
  ELANE RNA Guide
ggggcguucugggcaggaaccg

SEQ ID NO: 18979 - RNA, 22 nt, Artificial Sequence
  ELANE RNA Guide
gguuccugcccagaacgcccca

SEQ ID NO: 18980 - RNA, 22 nt, Artificial Sequence
  ELANE RNA Guide
gugccuggccaugggcuggggc

SEQ ID NO: 18981 - RNA, 22 nt, Artificial Sequence
  ELANE RNA Guide
guuccugcccagaacgccccag

SEQ ID NO: 18982 - RNA, 22 nt, Artificial Sequence
  ELANE RNA Guide
ucccacgguuccugcccagaac

SEQ ID NO: 18983 - RNA, 22 nt, Artificial Sequence
  ELANE RNA Guide
uccugcccagaacgccccagcc

SEQ ID NO: 18984 - RNA, 22 nt, Artificial Sequence
  ELANE RNA Guide
ugcccagaacgccccagcccau

SEQ ID NO: 18985 - RNA, 22 nt, Artificial Sequence
  ELANE RNA Guide
ugccuggccaugggcuggggcg

SEQ ID NO: 18986 - RNA, 22 nt, Artificial Sequence
  ELANE RNA Guide
uggccaugggcuggggcguucu

SEQ ID NO: 18987 - RNA, 22 nt, Artificial Sequence
  ELANE RNA Guide
ugggcuggggcguucugggcag

SEQ ID NO: 18988 - RNA, 22 nt, Artificial Sequence
  ELANE RNA Guide
uggggcguucugggcaggaacc

SEQ ID NO: 18989 - RNA, 22 nt, Artificial Sequence
  ELANE RNA Guide
uuccugcccagaacgccccagc

SEQ ID NO: 18990 - RNA, 20 nt, Artificial Sequence
  ELANE RNA Guide
aaccguaggaucgccagcgu

SEQ ID NO: 18991 - RNA, 20 nt, Artificial Sequence
  ELANE RNA Guide
accguaggaucgccagcguc

SEQ ID NO: 18992 - RNA, 20 nt, Artificial Sequence
  ELANE RNA Guide
acgcuggcgauccuacgguu

SEQ ID NO: 18993 - RNA, 20 nt, Artificial Sequence
  ELANE RNA Guide
aggaaccguaggaucgccag

SEQ ID NO: 18994 - RNA, 20 nt, Artificial Sequence
  ELANE RNA Guide
aggacgcuggcgauccuacg

SEQ ID NO: 18995 - RNA, 20 nt, Artificial Sequence
  ELANE RNA Guide
auccuacgguuccugcccag

SEQ ID NO: 18996 - RNA, 20 nt, Artificial Sequence
  ELANE RNA Guide
caggaaccguaggaucgcca

SEQ ID NO: 18997 - RNA, 20 nt, Artificial Sequence
  ELANE RNA Guide
caggacgcuggcgauccuac

SEQ ID NO: 18998 - RNA, 20 nt, Artificial Sequence
  ELANE RNA Guide
ccguaggaucgccagcgucc

SEQ ID NO: 18999 - RNA, 20 nt, Artificial Sequence
  ELANE RNA Guide
ccuacgguuccugcccagaa

SEQ ID NO: 19000 - RNA, 20 nt, Artificial Sequence
  ELANE RNA Guide
ccugcaggacgcuggcgauc

SEQ ID NO: 19001 - RNA, 20 nt, Artificial Sequence
  ELANE RNA Guide
ccuucugggcaggaaccgua

SEQ ID NO: 19002 - RNA, 20 nt, Artificial Sequence
  ELANE RNA Guide
cgauccuacgguuccugccc

SEQ ID NO: 19003 - RNA, 20 nt, Artificial Sequence
  ELANE RNA Guide
cgcuggcgauccuacgguuc

SEQ ID NO: 19004 - RNA, 20 nt, Artificial Sequence
  ELANE RNA Guide
cguaggaucgccagcguccu

SEQ ID NO: 19005 - RNA, 20 nt, Artificial Sequence
  ELANE RNA Guide
cuacgguuccugcccagaag

SEQ ID NO: 19006 - RNA, 20 nt, Artificial Sequence
  ELANE RNA Guide
cuccugcaggacgcuggcga

SEQ ID NO: 19007 - RNA, 20 nt, Artificial Sequence
  ELANE RNA Guide
cugcaggacgcuggcgaucc

SEQ ID NO: 19008 - RNA, 20 nt, Artificial Sequence
  ELANE RNA Guide
cuggcgauccuacgguuccu

SEQ ID NO: 19009 - RNA, 20 nt, Artificial Sequence
  ELANE RNA Guide
cugggcaggaaccguaggau

SEQ ID NO: 19010 - RNA, 20 nt, Artificial Sequence
  ELANE RNA Guide
cuucugggcaggaaccguag

SEQ ID NO: 19011 - RNA, 20 nt, Artificial Sequence
  ELANE RNA Guide
gaaccguaggaucgccagcg

SEQ ID NO: 19012 - RNA, 20 nt, Artificial Sequence
  ELANE RNA Guide
gacgcuggcgauccuacggu

SEQ ID NO: 19013 - RNA, 20 nt, Artificial Sequence
  ELANE RNA Guide
gauccuacgguuccugccca

SEQ ID NO: 19014 - RNA, 20 nt, Artificial Sequence
  ELANE RNA Guide
gcaggaaccguaggaucgcc

SEQ ID NO: 19015 - RNA, 20 nt, Artificial Sequence
  ELANE RNA Guide
gcaggacgcuggcgauccua

SEQ ID NO: 19016 - RNA, 20 nt, Artificial Sequence
  ELANE RNA Guide
gccuucugggcaggaaccgu

SEQ ID NO: 19017 - RNA, 20 nt, Artificial Sequence
  ELANE RNA Guide
gcgauccuacgguuccugcc

SEQ ID NO: 19018 - RNA, 20 nt, Artificial Sequence
  ELANE RNA Guide
gcuggcgauccuacgguucc

SEQ ID NO: 19019 - RNA, 20 nt, Artificial Sequence
  ELANE RNA Guide
ggaaccguaggaucgccagc

SEQ ID NO: 19020 - RNA, 20 nt, Artificial Sequence
  ELANE RNA Guide
ggacgcuggcgauccuacgg

SEQ ID NO: 19021 - RNA, 20 nt, Artificial Sequence
  ELANE RNA Guide
ggcaggaaccguaggaucgc

SEQ ID NO: 19022 - RNA, 20 nt, Artificial Sequence
  ELANE RNA Guide
ggccuucugggcaggaaccg

SEQ ID NO: 19023 - RNA, 20 nt, Artificial Sequence
  ELANE RNA Guide
ggcgauccuacgguuccugc

SEQ ID NO: 19024 - RNA, 20 nt, Artificial Sequence
  ELANE RNA Guide
gggcaggaaccguaggaucg

SEQ ID NO: 19025 - RNA, 20 nt, Artificial Sequence
  ELANE RNA Guide
gggccuucugggcaggaacc

SEQ ID NO: 19026 - RNA, 20 nt, Artificial Sequence
  ELANE RNA Guide
ggggccuucugggcaggaac

SEQ ID NO: 19027 - RNA, 20 nt, Artificial Sequence
  ELANE RNA Guide
guaggaucgccagcguccug

SEQ ID NO: 19028 - RNA, 20 nt, Artificial Sequence
  ELANE RNA Guide
uaggaucgccagcguccugc

SEQ ID NO: 19029 - RNA, 20 nt, Artificial Sequence
  ELANE RNA Guide
uccuacgguuccugcccaga

SEQ ID NO: 19030 - RNA, 20 nt, Artificial Sequence
  ELANE RNA Guide
uccugcaggacgcuggcgau

SEQ ID NO: 19031 - RNA, 20 nt, Artificial Sequence
  ELANE RNA Guide
ucugggcaggaaccguagga

SEQ ID NO: 19032 - RNA, 20 nt, Artificial Sequence
  ELANE RNA Guide
ugcaggacgcuggcgauccu

SEQ ID NO: 19033 - RNA, 20 nt, Artificial Sequence
  ELANE RNA Guide
uggcgauccuacgguuccug

SEQ ID NO: 19034 - RNA, 20 nt, Artificial Sequence
  ELANE RNA Guide
ugggcaggaaccguaggauc

SEQ ID NO: 19035 - RNA, 20 nt, Artificial Sequence
  ELANE RNA Guide
uucugggcaggaaccguagg

SEQ ID NO: 19036 - RNA, 21 nt, Artificial Sequence
  ELANE RNA Guide
aaccguaggaucgccagcguc

SEQ ID NO: 19037 - RNA, 21 nt, Artificial Sequence
  ELANE RNA Guide
accguaggaucgccagcgucc

SEQ ID NO: 19038 - RNA, 21 nt, Artificial Sequence
  ELANE RNA Guide
acgcuggcgauccuacgguuc

SEQ ID NO: 19039 - RNA, 21 nt, Artificial Sequence
  ELANE RNA Guide
aggaaccguaggaucgccagc

SEQ ID NO: 19040 - RNA, 21 nt, Artificial Sequence
  ELANE RNA Guide
aggacgcuggcgauccuacgg

SEQ ID NO: 19041 - RNA, 21 nt, Artificial Sequence
  ELANE RNA Guide
auccuacgguuccugcccaga

SEQ ID NO: 19042 - RNA, 21 nt, Artificial Sequence
  ELANE RNA Guide
caggaaccguaggaucgccag

SEQ ID NO: 19043 - RNA, 21 nt, Artificial Sequence
  ELANE RNA Guide
caggacgcuggcgauccuacg

SEQ ID NO: 19044 - RNA, 21 nt, Artificial Sequence
  ELANE RNA Guide
ccguaggaucgccagcguccu

SEQ ID NO: 19045 - RNA, 21 nt, Artificial Sequence
  ELANE RNA Guide
ccuacgguuccugcccagaag

SEQ ID NO: 19046 - RNA, 21 nt, Artificial Sequence
  ELANE RNA Guide
ccugcaggacgcuggcgaucc

SEQ ID NO: 19047 - RNA, 21 nt, Artificial Sequence
  ELANE RNA Guide
ccuucugggcaggaaccguag

SEQ ID NO: 19048 - RNA, 21 nt, Artificial Sequence
  ELANE RNA Guide
cgauccuacgguuccugccca

SEQ ID NO: 19049 - RNA, 21 nt, Artificial Sequence
  ELANE RNA Guide
cgcuggcgauccuacgguucc

SEQ ID NO: 19050 - RNA, 21 nt, Artificial Sequence
  ELANE RNA Guide
cguaggaucgccagcguccug

SEQ ID NO: 19051 - RNA, 21 nt, Artificial Sequence
  ELANE RNA Guide
cuacgguuccugcccagaagg

SEQ ID NO: 19052 - RNA, 21 nt, Artificial Sequence
  ELANE RNA Guide
cuccugcaggacgcuggcgau

SEQ ID NO: 19053 - RNA, 21 nt, Artificial Sequence
  ELANE RNA Guide
cugcaggacgcuggcgauccu

SEQ ID NO: 19054 - RNA, 21 nt, Artificial Sequence
  ELANE RNA Guide
cuggcgauccuacgguuccug

SEQ ID NO: 19055 - RNA, 21 nt, Artificial Sequence
  ELANE RNA Guide
cugggcaggaaccguaggauc

SEQ ID NO: 19056 - RNA, 21 nt, Artificial Sequence
  ELANE RNA Guide
cuucugggcaggaaccguagg

SEQ ID NO: 19057 - RNA, 21 nt, Artificial Sequence
  ELANE RNA Guide
gaaccguaggaucgccagcgu

SEQ ID NO: 19058 - RNA, 21 nt, Artificial Sequence
  ELANE RNA Guide
gacgcuggcgauccuacgguu

SEQ ID NO: 19059 - RNA, 21 nt, Artificial Sequence
  ELANE RNA Guide
gauccuacgguuccugcccag

SEQ ID NO: 19060 - RNA, 21 nt, Artificial Sequence
  ELANE RNA Guide
gcaggaaccguaggaucgcca

SEQ ID NO: 19061 - RNA, 21 nt, Artificial Sequence
  ELANE RNA Guide
gcaggacgcuggcgauccuac

SEQ ID NO: 19062 - RNA, 21 nt, Artificial Sequence
  ELANE RNA Guide
gccuucugggcaggaaccgua

SEQ ID NO: 19063 - RNA, 21 nt, Artificial Sequence
  ELANE RNA Guide
gcgauccuacgguuccugccc

SEQ ID NO: 19064 - RNA, 21 nt, Artificial Sequence
  ELANE RNA Guide
gcuccugcaggacgcuggcga

SEQ ID NO: 19065 - RNA, 21 nt, Artificial Sequence
  ELANE RNA Guide
gcuggcgauccuacgguuccu

SEQ ID NO: 19066 - RNA, 21 nt, Artificial Sequence
  ELANE RNA Guide
ggaaccguaggaucgccagcg

SEQ ID NO: 19067 - RNA, 21 nt, Artificial Sequence
  ELANE RNA Guide
ggacgcuggcgauccuacggu

SEQ ID NO: 19068 - RNA, 21 nt, Artificial Sequence
  ELANE RNA Guide
ggcaggaaccguaggaucgcc

SEQ ID NO: 19069 - RNA, 21 nt, Artificial Sequence
  ELANE RNA Guide
ggccuucugggcaggaaccgu

SEQ ID NO: 19070 - RNA, 21 nt, Artificial Sequence
  ELANE RNA Guide
ggcgauccuacgguuccugcc

SEQ ID NO: 19071 - RNA, 21 nt, Artificial Sequence
  ELANE RNA Guide
gggcaggaaccguaggaucgc

SEQ ID NO: 19072 - RNA, 21 nt, Artificial Sequence
  ELANE RNA Guide
gggccuucugggcaggaaccg

SEQ ID NO: 19073 - RNA, 21 nt, Artificial Sequence
  ELANE RNA Guide
ggggccuucugggcaggaacc

SEQ ID NO: 19074 - RNA, 21 nt, Artificial Sequence
  ELANE RNA Guide
guaggaucgccagcguccugc

SEQ ID NO: 19075 - RNA, 21 nt, Artificial Sequence
  ELANE RNA Guide
uaggaucgccagcguccugca

SEQ ID NO: 19076 - RNA, 21 nt, Artificial Sequence
  ELANE RNA Guide
uccuacgguuccugcccagaa

SEQ ID NO: 19077 - RNA, 21 nt, Artificial Sequence
  ELANE RNA Guide
uccugcaggacgcuggcgauc

SEQ ID NO: 19078 - RNA, 21 nt, Artificial Sequence
  ELANE RNA Guide
ucugggcaggaaccguaggau

SEQ ID NO: 19079 - RNA, 21 nt, Artificial Sequence
  ELANE RNA Guide
ugcaggacgcuggcgauccua

SEQ ID NO: 19080 - RNA, 21 nt, Artificial Sequence
  ELANE RNA Guide
uggcgauccuacgguuccugc

SEQ ID NO: 19081 - RNA, 21 nt, Artificial Sequence
  ELANE RNA Guide
ugggcaggaaccguaggaucg

SEQ ID NO: 19082 - RNA, 21 nt, Artificial Sequence
  ELANE RNA Guide
uggggccuucugggcaggaac

SEQ ID NO: 19083 - RNA, 21 nt, Artificial Sequence
  ELANE RNA Guide
uucugggcaggaaccguagga

SEQ ID NO: 19084 - RNA, 22 nt, Artificial Sequence
  ELANE RNA Guide
aaccguaggaucgccagcgucc

SEQ ID NO: 19085 - RNA, 22 nt, Artificial Sequence
  ELANE RNA Guide
accguaggaucgccagcguccu

SEQ ID NO: 19086 - RNA, 22 nt, Artificial Sequence
  ELANE RNA Guide
acgcuggcgauccuacgguucc

SEQ ID NO: 19087 - RNA, 22 nt, Artificial Sequence
  ELANE RNA Guide
agcuccugcaggacgcuggcga

SEQ ID NO: 19088 - RNA, 22 nt, Artificial Sequence
  ELANE RNA Guide
aggaaccguaggaucgccagcg

SEQ ID NO: 19089 - RNA, 22 nt, Artificial Sequence
  ELANE RNA Guide
aggacgcuggcgauccuacggu

SEQ ID NO: 19090 - RNA, 22 nt, Artificial Sequence
  ELANE RNA Guide
auccuacgguuccugcccagaa

SEQ ID NO: 19091 - RNA, 22 nt, Artificial Sequence
  ELANE RNA Guide
caggaaccguaggaucgccagc

SEQ ID NO: 19092 - RNA, 22 nt, Artificial Sequence
  ELANE RNA Guide
caggacgcuggcgauccuacgg

SEQ ID NO: 19093 - RNA, 22 nt, Artificial Sequence
  ELANE RNA Guide
ccguaggaucgccagcguccug

SEQ ID NO: 19094 - RNA, 22 nt, Artificial Sequence
  ELANE RNA Guide
ccuacgguuccugcccagaagg

SEQ ID NO: 19095 - RNA, 22 nt, Artificial Sequence
  ELANE RNA Guide
ccugcaggacgcuggcgauccu

SEQ ID NO: 19096 - RNA, 22 nt, Artificial Sequence
  ELANE RNA Guide
ccuucugggcaggaaccguagg

SEQ ID NO: 19097 - RNA, 22 nt, Artificial Sequence
  ELANE RNA Guide
cgauccuacgguuccugcccag

SEQ ID NO: 19098 - RNA, 22 nt, Artificial Sequence
  ELANE RNA Guide
cgcuggcgauccuacgguuccu

SEQ ID NO: 19099 - RNA, 22 nt, Artificial Sequence
  ELANE RNA Guide
cguaggaucgccagcguccugc

SEQ ID NO: 19100 - RNA, 22 nt, Artificial Sequence
  ELANE RNA Guide
cuacgguuccugcccagaaggc

SEQ ID NO: 19101 - RNA, 22 nt, Artificial Sequence
  ELANE RNA Guide
cuccugcaggacgcuggcgauc

SEQ ID NO: 19102 - RNA, 22 nt, Artificial Sequence
  ELANE RNA Guide
cugcaggacgcuggcgauccua

SEQ ID NO: 19103 - RNA, 22 nt, Artificial Sequence
  ELANE RNA Guide
cuggcgauccuacgguuccugc

SEQ ID NO: 19104 - RNA, 22 nt, Artificial Sequence
  ELANE RNA Guide
cugggcaggaaccguaggaucg

SEQ ID NO: 19105 - RNA, 22 nt, Artificial Sequence
  ELANE RNA Guide
cuggggccuucugggcaggaac

SEQ ID NO: 19106 - RNA, 22 nt, Artificial Sequence
  ELANE RNA Guide
cuucugggcaggaaccguagga

SEQ ID NO: 19107 - RNA, 22 nt, Artificial Sequence
  ELANE RNA Guide
gaaccguaggaucgccagcguc

SEQ ID NO: 19108 - RNA, 22 nt, Artificial Sequence
  ELANE RNA Guide
gacgcuggcgauccuacgguuc

SEQ ID NO: 19109 - RNA, 22 nt, Artificial Sequence
  ELANE RNA Guide
gauccuacgguuccugcccaga

SEQ ID NO: 19110 - RNA, 22 nt, Artificial Sequence
  ELANE RNA Guide
gcaggaaccguaggaucgccag

SEQ ID NO: 19111 - RNA, 22 nt, Artificial Sequence
  ELANE RNA Guide
gcaggacgcuggcgauccuacg

SEQ ID NO: 19112 - RNA, 22 nt, Artificial Sequence
  ELANE RNA Guide
gccuucugggcaggaaccguag

SEQ ID NO: 19113 - RNA, 22 nt, Artificial Sequence
  ELANE RNA Guide
gcgauccuacgguuccugccca

SEQ ID NO: 19114 - RNA, 22 nt, Artificial Sequence
  ELANE RNA Guide
gcuccugcaggacgcuggcgau

SEQ ID NO: 19115 - RNA, 22 nt, Artificial Sequence
  ELANE RNA Guide
gcuggcgauccuacgguuccug

SEQ ID NO: 19116 - RNA, 22 nt, Artificial Sequence
  ELANE RNA Guide
ggaaccguaggaucgccagcgu

SEQ ID NO: 19117 - RNA, 22 nt, Artificial Sequence
  ELANE RNA Guide
ggacgcuggcgauccuacgguu

SEQ ID NO: 19118 - RNA, 22 nt, Artificial Sequence
  ELANE RNA Guide
ggcaggaaccguaggaucgcca

SEQ ID NO: 19119 - RNA, 22 nt, Artificial Sequence
  ELANE RNA Guide
ggccuucugggcaggaaccgua

SEQ ID NO: 19120 - RNA, 22 nt, Artificial Sequence
  ELANE RNA Guide
ggcgauccuacgguuccugccc

SEQ ID NO: 19121 - RNA, 22 nt, Artificial Sequence
  ELANE RNA Guide
gggcaggaaccguaggaucgcc

SEQ ID NO: 19122 - RNA, 22 nt, Artificial Sequence
  ELANE RNA Guide
gggccuucugggcaggaaccgu

SEQ ID NO: 19123 - RNA, 22 nt, Artificial Sequence
  ELANE RNA Guide
ggggccuucugggcaggaaccg

SEQ ID NO: 19124 - RNA, 22 nt, Artificial Sequence
  ELANE RNA Guide
guaggaucgccagcguccugca

SEQ ID NO: 19125 - RNA, 22 nt, Artificial Sequence
  ELANE RNA Guide
uaggaucgccagcguccugcag

SEQ ID NO: 19126 - RNA, 22 nt, Artificial Sequence
  ELANE RNA Guide
uccuacgguuccugcccagaag

SEQ ID NO: 19127 - RNA, 22 nt, Artificial Sequence
  ELANE RNA Guide
uccugcaggacgcuggcgaucc

SEQ ID NO: 19128 - RNA, 22 nt, Artificial Sequence
  ELANE RNA Guide
ucugggcaggaaccguaggauc

SEQ ID NO: 19129 - RNA, 22 nt, Artificial Sequence
  ELANE RNA Guide
ugcaggacgcuggcgauccuac

SEQ ID NO: 19130 - RNA, 22 nt, Artificial Sequence
  ELANE RNA Guide
uggcgauccuacgguuccugcc

SEQ ID NO: 19131 - RNA, 22 nt, Artificial Sequence
  ELANE RNA Guide
ugggcaggaaccguaggaucgc

SEQ ID NO: 19132 - RNA, 22 nt, Artificial Sequence
  ELANE RNA Guide
uggggccuucugggcaggaacc

SEQ ID NO: 19133 - RNA, 22 nt, Artificial Sequence
  ELANE RNA Guide
uucugggcaggaaccguaggau

SEQ ID NO: 19134 - RNA, 20 nt, Artificial Sequence
  ELANE RNA Guide
aaccgucggaucgccagcgu

SEQ ID NO: 19135 - RNA, 20 nt, Artificial Sequence
  ELANE RNA Guide
accgucggaucgccagcguc

SEQ ID NO: 19136 - RNA, 20 nt, Artificial Sequence
  ELANE RNA Guide
acgcuggcgauccgacgguu

SEQ ID NO: 19137 - RNA, 20 nt, Artificial Sequence
  ELANE RNA Guide
aggaaccgucggaucgccag

SEQ ID NO: 19138 - RNA, 20 nt, Artificial Sequence
  ELANE RNA Guide
aggacgcuggcgauccgacg

SEQ ID NO: 19139 - RNA, 20 nt, Artificial Sequence
  ELANE RNA Guide
auccgacgguuccugcccag

SEQ ID NO: 19140 - RNA, 20 nt, Artificial Sequence
  ELANE RNA Guide
caggaaccgucggaucgcca

SEQ ID NO: 19141 - RNA, 20 nt, Artificial Sequence
  ELANE RNA Guide
caggacgcuggcgauccgac

SEQ ID NO: 19142 - RNA, 20 nt, Artificial Sequence
  ELANE RNA Guide
ccgacgguuccugcccagaa

SEQ ID NO: 19143 - RNA, 20 nt, Artificial Sequence
  ELANE RNA Guide
ccgucggaucgccagcgucc

SEQ ID NO: 19144 - RNA, 20 nt, Artificial Sequence
  ELANE RNA Guide
ccuucugggcaggaaccguc

SEQ ID NO: 19145 - RNA, 20 nt, Artificial Sequence
  ELANE RNA Guide
cgacgguuccugcccagaag

SEQ ID NO: 19146 - RNA, 20 nt, Artificial Sequence
  ELANE RNA Guide
cgauccgacgguuccugccc

SEQ ID NO: 19147 - RNA, 20 nt, Artificial Sequence
  ELANE RNA Guide
cgcuggcgauccgacgguuc

SEQ ID NO: 19148 - RNA, 20 nt, Artificial Sequence
  ELANE RNA Guide
cgucggaucgccagcguccu

SEQ ID NO: 19149 - RNA, 20 nt, Artificial Sequence
  ELANE RNA Guide
cuggcgauccgacgguuccu

SEQ ID NO: 19150 - RNA, 20 nt, Artificial Sequence
  ELANE RNA Guide
cugggcaggaaccgucggau

SEQ ID NO: 19151 - RNA, 20 nt, Artificial Sequence
  ELANE RNA Guide
cuucugggcaggaaccgucg

SEQ ID NO: 19152 - RNA, 20 nt, Artificial Sequence
  ELANE RNA Guide
gaaccgucggaucgccagcg

SEQ ID NO: 19153 - RNA, 20 nt, Artificial Sequence
  ELANE RNA Guide
gacgcuggcgauccgacggu

SEQ ID NO: 19154 - RNA, 20 nt, Artificial Sequence
  ELANE RNA Guide
gauccgacgguuccugccca

SEQ ID NO: 19155 - RNA, 20 nt, Artificial Sequence
  ELANE RNA Guide
gcaggaaccgucggaucgcc

SEQ ID NO: 19156 - RNA, 20 nt, Artificial Sequence
  ELANE RNA Guide
gcaggacgcuggcgauccga

SEQ ID NO: 19157 - RNA, 20 nt, Artificial Sequence
  ELANE RNA Guide
gcgauccgacgguuccugcc

SEQ ID NO: 19158 - RNA, 20 nt, Artificial Sequence
  ELANE RNA Guide
gcuggcgauccgacgguucc

SEQ ID NO: 19159 - RNA, 20 nt, Artificial Sequence
  ELANE RNA Guide
ggaaccgucggaucgccagc

SEQ ID NO: 19160 - RNA, 20 nt, Artificial Sequence
  ELANE RNA Guide
ggacgcuggcgauccgacgg

SEQ ID NO: 19161 - RNA, 20 nt, Artificial Sequence
  ELANE RNA Guide
ggcaggaaccgucggaucgc

SEQ ID NO: 19162 - RNA, 20 nt, Artificial Sequence
  ELANE RNA Guide
ggcgauccgacgguuccugc

SEQ ID NO: 19163 - RNA, 20 nt, Artificial Sequence
  ELANE RNA Guide
gggcaggaaccgucggaucg

SEQ ID NO: 19164 - RNA, 20 nt, Artificial Sequence
  ELANE RNA Guide
gucggaucgccagcguccug

SEQ ID NO: 19165 - RNA, 20 nt, Artificial Sequence
  ELANE RNA Guide
uccgacgguuccugcccaga

SEQ ID NO: 19166 - RNA, 20 nt, Artificial Sequence
  ELANE RNA Guide
ucggaucgccagcguccugc

SEQ ID NO: 19167 - RNA, 20 nt, Artificial Sequence
  ELANE RNA Guide
ucugggcaggaaccgucgga

SEQ ID NO: 19168 - RNA, 20 nt, Artificial Sequence
  ELANE RNA Guide
ugcaggacgcuggcgauccg

SEQ ID NO: 19169 - RNA, 20 nt, Artificial Sequence
  ELANE RNA Guide
uggcgauccgacgguuccug

SEQ ID NO: 19170 - RNA, 20 nt, Artificial Sequence
  ELANE RNA Guide
ugggcaggaaccgucggauc

SEQ ID NO: 19171 - RNA, 20 nt, Artificial Sequence
  ELANE RNA Guide
uucugggcaggaaccgucgg

SEQ ID NO: 19172 - RNA, 21 nt, Artificial Sequence
  ELANE RNA Guide
aaccgucggaucgccagcguc

SEQ ID NO: 19173 - RNA, 21 nt, Artificial Sequence
  ELANE RNA Guide
accgucggaucgccagcgucc

SEQ ID NO: 19174 - RNA, 21 nt, Artificial Sequence
  ELANE RNA Guide
acgcuggcgauccgacgguuc

SEQ ID NO: 19175 - RNA, 21 nt, Artificial Sequence
  ELANE RNA Guide
aggaaccgucggaucgccagc

SEQ ID NO: 19176 - RNA, 21 nt, Artificial Sequence
  ELANE RNA Guide
aggacgcuggcgauccgacgg

SEQ ID NO: 19177 - RNA, 21 nt, Artificial Sequence
  ELANE RNA Guide
auccgacgguuccugcccaga

SEQ ID NO: 19178 - RNA, 21 nt, Artificial Sequence
  ELANE RNA Guide
caggaaccgucggaucgccag

SEQ ID NO: 19179 - RNA, 21 nt, Artificial Sequence
  ELANE RNA Guide
caggacgcuggcgauccgacg

SEQ ID NO: 19180 - RNA, 21 nt, Artificial Sequence
  ELANE RNA Guide
ccgacgguuccugcccagaag

SEQ ID NO: 19181 - RNA, 21 nt, Artificial Sequence
  ELANE RNA Guide
ccgucggaucgccagcguccu

SEQ ID NO: 19182 - RNA, 21 nt, Artificial Sequence
  ELANE RNA Guide
ccuucugggcaggaaccgucg

SEQ ID NO: 19183 - RNA, 21 nt, Artificial Sequence
  ELANE RNA Guide
cgacgguuccugcccagaagg

SEQ ID NO: 19184 - RNA, 21 nt, Artificial Sequence
  ELANE RNA Guide
cgauccgacgguuccugccca

SEQ ID NO: 19185 - RNA, 21 nt, Artificial Sequence
  ELANE RNA Guide
cgcuggcgauccgacgguucc

SEQ ID NO: 19186 - RNA, 21 nt, Artificial Sequence
  ELANE RNA Guide
cgucggaucgccagcguccug

SEQ ID NO: 19187 - RNA, 21 nt, Artificial Sequence
  ELANE RNA Guide
cugcaggacgcuggcgauccg

SEQ ID NO: 19188 - RNA, 21 nt, Artificial Sequence
  ELANE RNA Guide
cuggcgauccgacgguuccug

SEQ ID NO: 19189 - RNA, 21 nt, Artificial Sequence
  ELANE RNA Guide
cugggcaggaaccgucggauc

SEQ ID NO: 19190 - RNA, 21 nt, Artificial Sequence
  ELANE RNA Guide
cuucugggcaggaaccgucgg

SEQ ID NO: 19191 - RNA, 21 nt, Artificial Sequence
  ELANE RNA Guide
gaaccgucggaucgccagcgu

SEQ ID NO: 19192 - RNA, 21 nt, Artificial Sequence
  ELANE RNA Guide
gacgcuggcgauccgacgguu

SEQ ID NO: 19193 - RNA, 21 nt, Artificial Sequence
  ELANE RNA Guide
gauccgacgguuccugcccag

SEQ ID NO: 19194 - RNA, 21 nt, Artificial Sequence
  ELANE RNA Guide
gcaggaaccgucggaucgcca

SEQ ID NO: 19195 - RNA, 21 nt, Artificial Sequence
  ELANE RNA Guide
gcaggacgcuggcgauccgac

SEQ ID NO: 19196 - RNA, 21 nt, Artificial Sequence
  ELANE RNA Guide
gccuucugggcaggaaccguc

SEQ ID NO: 19197 - RNA, 21 nt, Artificial Sequence
  ELANE RNA Guide
gcgauccgacgguuccugccc

SEQ ID NO: 19198 - RNA, 21 nt, Artificial Sequence
  ELANE RNA Guide
gcuggcgauccgacgguuccu

SEQ ID NO: 19199 - RNA, 21 nt, Artificial Sequence
  ELANE RNA Guide
ggaaccgucggaucgccagcg

SEQ ID NO: 19200 - RNA, 21 nt, Artificial Sequence
  ELANE RNA Guide
ggacgcuggcgauccgacggu

SEQ ID NO: 19201 - RNA, 21 nt, Artificial Sequence
  ELANE RNA Guide
ggcaggaaccgucggaucgcc

SEQ ID NO: 19202 - RNA, 21 nt, Artificial Sequence
  ELANE RNA Guide
ggcgauccgacgguuccugcc

SEQ ID NO: 19203 - RNA, 21 nt, Artificial Sequence
  ELANE RNA Guide
gggcaggaaccgucggaucgc

SEQ ID NO: 19204 - RNA, 21 nt, Artificial Sequence
  ELANE RNA Guide
gucggaucgccagcguccugc

SEQ ID NO: 19205 - RNA, 21 nt, Artificial Sequence
  ELANE RNA Guide
uccgacgguuccugcccagaa

SEQ ID NO: 19206 - RNA, 21 nt, Artificial Sequence
  ELANE RNA Guide
ucggaucgccagcguccugca

SEQ ID NO: 19207 - RNA, 21 nt, Artificial Sequence
  ELANE RNA Guide
ucugggcaggaaccgucggau

SEQ ID NO: 19208 - RNA, 21 nt, Artificial Sequence
  ELANE RNA Guide
ugcaggacgcuggcgauccga

SEQ ID NO: 19209 - RNA, 21 nt, Artificial Sequence
  ELANE RNA Guide
uggcgauccgacgguuccugc

SEQ ID NO: 19210 - RNA, 21 nt, Artificial Sequence
  ELANE RNA Guide
ugggcaggaaccgucggaucg

SEQ ID NO: 19211 - RNA, 21 nt, Artificial Sequence
  ELANE RNA Guide
uucugggcaggaaccgucgga

SEQ ID NO: 19212 - RNA, 22 nt, Artificial Sequence
  ELANE RNA Guide
aaccgucggaucgccagcgucc

SEQ ID NO: 19213 - RNA, 22 nt, Artificial Sequence
  ELANE RNA Guide
accgucggaucgccagcguccu

SEQ ID NO: 19214 - RNA, 22 nt, Artificial Sequence
  ELANE RNA Guide
acgcuggcgauccgacgguucc

SEQ ID NO: 19215 - RNA, 22 nt, Artificial Sequence
  ELANE RNA Guide
aggaaccgucggaucgccagcg

SEQ ID NO: 19216 - RNA, 22 nt, Artificial Sequence
  ELANE RNA Guide
aggacgcuggcgauccgacggu

SEQ ID NO: 19217 - RNA, 22 nt, Artificial Sequence
  ELANE RNA Guide
auccgacgguuccugcccagaa

SEQ ID NO: 19218 - RNA, 22 nt, Artificial Sequence
  ELANE RNA Guide
caggaaccgucggaucgccagc

SEQ ID NO: 19219 - RNA, 22 nt, Artificial Sequence
  ELANE RNA Guide
caggacgcuggcgauccgacgg

SEQ ID NO: 19220 - RNA, 22 nt, Artificial Sequence
  ELANE RNA Guide
ccgacgguuccugcccagaagg

SEQ ID NO: 19221 - RNA, 22 nt, Artificial Sequence
  ELANE RNA Guide
ccgucggaucgccagcguccug

SEQ ID NO: 19222 - RNA, 22 nt, Artificial Sequence
  ELANE RNA Guide
ccugcaggacgcuggcgauccg

SEQ ID NO: 19223 - RNA, 22 nt, Artificial Sequence
  ELANE RNA Guide
ccuucugggcaggaaccgucgg

SEQ ID NO: 19224 - RNA, 22 nt, Artificial Sequence
  ELANE RNA Guide
cgacgguuccugcccagaaggc

SEQ ID NO: 19225 - RNA, 22 nt, Artificial Sequence
  ELANE RNA Guide
cgauccgacgguuccugcccag

SEQ ID NO: 19226 - RNA, 22 nt, Artificial Sequence
  ELANE RNA Guide
cgcuggcgauccgacgguuccu

SEQ ID NO: 19227 - RNA, 22 nt, Artificial Sequence
  ELANE RNA Guide
cgucggaucgccagcguccugc

SEQ ID NO: 19228 - RNA, 22 nt, Artificial Sequence
  ELANE RNA Guide
cugcaggacgcuggcgauccga

SEQ ID NO: 19229 - RNA, 22 nt, Artificial Sequence
  ELANE RNA Guide
cuggcgauccgacgguuccugc

SEQ ID NO: 19230 - RNA, 22 nt, Artificial Sequence
  ELANE RNA Guide
cugggcaggaaccgucggaucg

SEQ ID NO: 19231 - RNA, 22 nt, Artificial Sequence
  ELANE RNA Guide
cuucugggcaggaaccgucgga

SEQ ID NO: 19232 - RNA, 22 nt, Artificial Sequence
  ELANE RNA Guide
gaaccgucggaucgccagcguc

SEQ ID NO: 19233 - RNA, 22 nt, Artificial Sequence
  ELANE RNA Guide
gacgcuggcgauccgacgguuc

SEQ ID NO: 19234 - RNA, 22 nt, Artificial Sequence
  ELANE RNA Guide
gauccgacgguuccugcccaga

SEQ ID NO: 19235 - RNA, 22 nt, Artificial Sequence
  ELANE RNA Guide
gcaggaaccgucggaucgccag

SEQ ID NO: 19236 - RNA, 22 nt, Artificial Sequence
  ELANE RNA Guide
gcaggacgcuggcgauccgacg

SEQ ID NO: 19237 - RNA, 22 nt, Artificial Sequence
  ELANE RNA Guide
gccuucugggcaggaaccgucg

SEQ ID NO: 19238 - RNA, 22 nt, Artificial Sequence
  ELANE RNA Guide
gcgauccgacgguuccugccca

SEQ ID NO: 19239 - RNA, 22 nt, Artificial Sequence
  ELANE RNA Guide
gcuggcgauccgacgguuccug

SEQ ID NO: 19240 - RNA, 22 nt, Artificial Sequence
  ELANE RNA Guide
ggaaccgucggaucgccagcgu

SEQ ID NO: 19241 - RNA, 22 nt, Artificial Sequence
  ELANE RNA Guide
ggacgcuggcgauccgacgguu

SEQ ID NO: 19242 - RNA, 22 nt, Artificial Sequence
  ELANE RNA Guide
ggcaggaaccgucggaucgcca

SEQ ID NO: 19243 - RNA, 22 nt, Artificial Sequence
  ELANE RNA Guide
ggccuucugggcaggaaccguc

SEQ ID NO: 19244 - RNA, 22 nt, Artificial Sequence
  ELANE RNA Guide
ggcgauccgacgguuccugccc

SEQ ID NO: 19245 - RNA, 22 nt, Artificial Sequence
  ELANE RNA Guide
gggcaggaaccgucggaucgcc

SEQ ID NO: 19246 - RNA, 22 nt, Artificial Sequence
  ELANE RNA Guide
gucggaucgccagcguccugca

SEQ ID NO: 19247 - RNA, 22 nt, Artificial Sequence
  ELANE RNA Guide
uccgacgguuccugcccagaag

SEQ ID NO: 19248 - RNA, 22 nt, Artificial Sequence
  ELANE RNA Guide
ucggaucgccagcguccugcag

SEQ ID NO: 19249 - RNA, 22 nt, Artificial Sequence
  ELANE RNA Guide
ucugggcaggaaccgucggauc

SEQ ID NO: 19250 - RNA, 22 nt, Artificial Sequence
  ELANE RNA Guide
ugcaggacgcuggcgauccgac

SEQ ID NO: 19251 - RNA, 22 nt, Artificial Sequence
  ELANE RNA Guide
uggcgauccgacgguuccugcc

SEQ ID NO: 19252 - RNA, 22 nt, Artificial Sequence
  ELANE RNA Guide
ugggcaggaaccgucggaucgc

SEQ ID NO: 19253 - RNA, 22 nt, Artificial Sequence
  ELANE RNA Guide
uucugggcaggaaccgucggau

SEQ ID NO: 19254 - RNA, 20 nt, Artificial Sequence
  ELANE RNA Guide
aaccguggggucgccagcgu

SEQ ID NO: 19255 - RNA, 20 nt, Artificial Sequence
  ELANE RNA Guide
accccacgguuccugcccag

SEQ ID NO: 19256 - RNA, 20 nt, Artificial Sequence
  ELANE RNA Guide
accguggggucgccagcguc

SEQ ID NO: 19257 - RNA, 20 nt, Artificial Sequence
  ELANE RNA Guide
acgcuggcgaccccacgguu

SEQ ID NO: 19258 - RNA, 20 nt, Artificial Sequence
  ELANE RNA Guide
agcuccugcaggacgcuggc

SEQ ID NO: 19259 - RNA, 20 nt, Artificial Sequence
  ELANE RNA Guide
aggaaccguggggucgccag

SEQ ID NO: 19260 - RNA, 20 nt, Artificial Sequence
  ELANE RNA Guide
aggacgcuggcgaccccacg

SEQ ID NO: 19261 - RNA, 20 nt, Artificial Sequence
  ELANE RNA Guide
caggaaccguggggucgcca

SEQ ID NO: 19262 - RNA, 20 nt, Artificial Sequence
  ELANE RNA Guide
caggacgcuggcgaccccac

SEQ ID NO: 19263 - RNA, 20 nt, Artificial Sequence
  ELANE RNA Guide
ccguggggucgccagcgucc

SEQ ID NO: 19264 - RNA, 20 nt, Artificial Sequence
  ELANE RNA Guide
ccugcaggacgcuggcgacc

SEQ ID NO: 19265 - RNA, 20 nt, Artificial Sequence
  ELANE RNA Guide
ccuucugggcaggaaccgug

SEQ ID NO: 19266 - RNA, 20 nt, Artificial Sequence
  ELANE RNA Guide
cgaccccacgguuccugccc

SEQ ID NO: 19267 - RNA, 20 nt, Artificial Sequence
  ELANE RNA Guide
cgcuggcgaccccacgguuc

SEQ ID NO: 19268 - RNA, 20 nt, Artificial Sequence
  ELANE RNA Guide
cguggggucgccagcguccu

SEQ ID NO: 19269 - RNA, 20 nt, Artificial Sequence
  ELANE RNA Guide
cugcaggacgcuggcgaccc

SEQ ID NO: 19270 - RNA, 20 nt, Artificial Sequence
  ELANE RNA Guide
cuggcgaccccacgguuccu

SEQ ID NO: 19271 - RNA, 20 nt, Artificial Sequence
  ELANE RNA Guide
cugggcaggaaccguggggu

SEQ ID NO: 19272 - RNA, 20 nt, Artificial Sequence
  ELANE RNA Guide
cuucugggcaggaaccgugg

SEQ ID NO: 19273 - RNA, 20 nt, Artificial Sequence
  ELANE RNA Guide
gaaccguggggucgccagcg

SEQ ID NO: 19274 - RNA, 20 nt, Artificial Sequence
  ELANE RNA Guide
gaccccacgguuccugccca

SEQ ID NO: 19275 - RNA, 20 nt, Artificial Sequence
  ELANE RNA Guide
gacgcuggcgaccccacggu

SEQ ID NO: 19276 - RNA, 20 nt, Artificial Sequence
  ELANE RNA Guide
gagcuccugcaggacgcugg

SEQ ID NO: 19277 - RNA, 20 nt, Artificial Sequence
  ELANE RNA Guide
gcaggaaccguggggucgcc

SEQ ID NO: 19278 - RNA, 20 nt, Artificial Sequence
  ELANE RNA Guide
gcaggacgcuggcgacccca

SEQ ID NO: 19279 - RNA, 20 nt, Artificial Sequence
  ELANE RNA Guide
gcgaccccacgguuccugcc

SEQ ID NO: 19280 - RNA, 20 nt, Artificial Sequence
  ELANE RNA Guide
gcuccugcaggacgcuggcg

SEQ ID NO: 19281 - RNA, 20 nt, Artificial Sequence
  ELANE RNA Guide
gcuggcgaccccacgguucc

SEQ ID NO: 19282 - RNA, 20 nt, Artificial Sequence
  ELANE RNA Guide
ggaaccguggggucgccagc

SEQ ID NO: 19283 - RNA, 20 nt, Artificial Sequence
  ELANE RNA Guide
ggacgcuggcgaccccacgg

SEQ ID NO: 19284 - RNA, 20 nt, Artificial Sequence
  ELANE RNA Guide
ggcaggaaccguggggucgc

SEQ ID NO: 19285 - RNA, 20 nt, Artificial Sequence
  ELANE RNA Guide
ggcgaccccacgguuccugc

SEQ ID NO: 19286 - RNA, 20 nt, Artificial Sequence
  ELANE RNA Guide
gggcaggaaccguggggucg

SEQ ID NO: 19287 - RNA, 20 nt, Artificial Sequence
  ELANE RNA Guide
ggggucgccagcguccugca

SEQ ID NO: 19288 - RNA, 20 nt, Artificial Sequence
  ELANE RNA Guide
gggucgccagcguccugcag

SEQ ID NO: 19289 - RNA, 20 nt, Artificial Sequence
  ELANE RNA Guide
ggucgccagcguccugcagg

SEQ ID NO: 19290 - RNA, 20 nt, Artificial Sequence
  ELANE RNA Guide
guggggucgccagcguccug

SEQ ID NO: 19291 - RNA, 20 nt, Artificial Sequence
  ELANE RNA Guide
uccugcaggacgcuggcgac

SEQ ID NO: 19292 - RNA, 20 nt, Artificial Sequence
  ELANE RNA Guide
ucugggcaggaaccgugggg

SEQ ID NO: 19293 - RNA, 20 nt, Artificial Sequence
  ELANE RNA Guide
ugcaggacgcuggcgacccc

SEQ ID NO: 19294 - RNA, 20 nt, Artificial Sequence
  ELANE RNA Guide
uggcgaccccacgguuccug

SEQ ID NO: 19295 - RNA, 20 nt, Artificial Sequence
  ELANE RNA Guide
ugggcaggaaccgugggguc

SEQ ID NO: 19296 - RNA, 20 nt, Artificial Sequence
  ELANE RNA Guide
uggggucgccagcguccugc

SEQ ID NO: 19297 - RNA, 20 nt, Artificial Sequence
  ELANE RNA Guide
uucugggcaggaaccguggg

SEQ ID NO: 19298 - RNA, 21 nt, Artificial Sequence
  ELANE RNA Guide
aaccguggggucgccagcguc

SEQ ID NO: 19299 - RNA, 21 nt, Artificial Sequence
  ELANE RNA Guide
accccacgguuccugcccaga

SEQ ID NO: 19300 - RNA, 21 nt, Artificial Sequence
  ELANE RNA Guide
accguggggucgccagcgucc

SEQ ID NO: 19301 - RNA, 21 nt, Artificial Sequence
  ELANE RNA Guide
acgcuggcgaccccacgguuc

SEQ ID NO: 19302 - RNA, 21 nt, Artificial Sequence
  ELANE RNA Guide
agcuccugcaggacgcuggcg

SEQ ID NO: 19303 - RNA, 21 nt, Artificial Sequence
  ELANE RNA Guide
aggaaccguggggucgccagc

SEQ ID NO: 19304 - RNA, 21 nt, Artificial Sequence
  ELANE RNA Guide
aggacgcuggcgaccccacgg

SEQ ID NO: 19305 - RNA, 21 nt, Artificial Sequence
  ELANE RNA Guide
caggaaccguggggucgccag

SEQ ID NO: 19306 - RNA, 21 nt, Artificial Sequence
  ELANE RNA Guide
caggacgcuggcgaccccacg

SEQ ID NO: 19307 - RNA, 21 nt, Artificial Sequence
  ELANE RNA Guide
ccguggggucgccagcguccu

SEQ ID NO: 19308 - RNA, 21 nt, Artificial Sequence
  ELANE RNA Guide
ccugcaggacgcuggcgaccc

SEQ ID NO: 19309 - RNA, 21 nt, Artificial Sequence
  ELANE RNA Guide
ccuucugggcaggaaccgugg

SEQ ID NO: 19310 - RNA, 21 nt, Artificial Sequence
  ELANE RNA Guide
cgaccccacgguuccugccca

SEQ ID NO: 19311 - RNA, 21 nt, Artificial Sequence
  ELANE RNA Guide
cgcuggcgaccccacgguucc

SEQ ID NO: 19312 - RNA, 21 nt, Artificial Sequence
  ELANE RNA Guide
cguggggucgccagcguccug

SEQ ID NO: 19313 - RNA, 21 nt, Artificial Sequence
  ELANE RNA Guide
cuccugcaggacgcuggcgac

SEQ ID NO: 19314 - RNA, 21 nt, Artificial Sequence
  ELANE RNA Guide
cugcaggacgcuggcgacccc

SEQ ID NO: 19315 - RNA, 21 nt, Artificial Sequence
  ELANE RNA Guide
cuggcgaccccacgguuccug

SEQ ID NO: 19316 - RNA, 21 nt, Artificial Sequence
  ELANE RNA Guide
cugggcaggaaccgugggguc

SEQ ID NO: 19317 - RNA, 21 nt, Artificial Sequence
  ELANE RNA Guide
cuucugggcaggaaccguggg

SEQ ID NO: 19318 - RNA, 21 nt, Artificial Sequence
  ELANE RNA Guide
gaaccguggggucgccagcgu

SEQ ID NO: 19319 - RNA, 21 nt, Artificial Sequence
  ELANE RNA Guide
gaccccacgguuccugcccag

SEQ ID NO: 19320 - RNA, 21 nt, Artificial Sequence
  ELANE RNA Guide
gacgcuggcgaccccacgguu

SEQ ID NO: 19321 - RNA, 21 nt, Artificial Sequence
  ELANE RNA Guide
gagcuccugcaggacgcuggc

SEQ ID NO: 19322 - RNA, 21 nt, Artificial Sequence
  ELANE RNA Guide
gcaggaaccguggggucgcca

SEQ ID NO: 19323 - RNA, 21 nt, Artificial Sequence
  ELANE RNA Guide
gcaggacgcuggcgaccccac

SEQ ID NO: 19324 - RNA, 21 nt, Artificial Sequence
  ELANE RNA Guide
gccuucugggcaggaaccgug

SEQ ID NO: 19325 - RNA, 21 nt, Artificial Sequence
  ELANE RNA Guide
gcgaccccacgguuccugccc

SEQ ID NO: 19326 - RNA, 21 nt, Artificial Sequence
  ELANE RNA Guide
gcuggcgaccccacgguuccu

SEQ ID NO: 19327 - RNA, 21 nt, Artificial Sequence
  ELANE RNA Guide
ggaaccguggggucgccagcg

SEQ ID NO: 19328 - RNA, 21 nt, Artificial Sequence
  ELANE RNA Guide
ggacgcuggcgaccccacggu

SEQ ID NO: 19329 - RNA, 21 nt, Artificial Sequence
  ELANE RNA Guide
ggcaggaaccguggggucgcc

SEQ ID NO: 19330 - RNA, 21 nt, Artificial Sequence
  ELANE RNA Guide
ggcgaccccacgguuccugcc

SEQ ID NO: 19331 - RNA, 21 nt, Artificial Sequence
  ELANE RNA Guide
gggcaggaaccguggggucgc

SEQ ID NO: 19332 - RNA, 21 nt, Artificial Sequence
  ELANE RNA Guide
ggggucgccagcguccugcag

SEQ ID NO: 19333 - RNA, 21 nt, Artificial Sequence
  ELANE RNA Guide
gggucgccagcguccugcagg

SEQ ID NO: 19334 - RNA, 21 nt, Artificial Sequence
  ELANE RNA Guide
ggucgccagcguccugcagga

SEQ ID NO: 19335 - RNA, 21 nt, Artificial Sequence
  ELANE RNA Guide
guggggucgccagcguccugc

SEQ ID NO: 19336 - RNA, 21 nt, Artificial Sequence
  ELANE RNA Guide
uccugcaggacgcuggcgacc

SEQ ID NO: 19337 - RNA, 21 nt, Artificial Sequence
  ELANE RNA Guide
ucugggcaggaaccguggggu

SEQ ID NO: 19338 - RNA, 21 nt, Artificial Sequence
  ELANE RNA Guide
ugagcuccugcaggacgcugg

SEQ ID NO: 19339 - RNA, 21 nt, Artificial Sequence
  ELANE RNA Guide
ugcaggacgcuggcgacccca

SEQ ID NO: 19340 - RNA, 21 nt, Artificial Sequence
  ELANE RNA Guide
uggcgaccccacgguuccugc

SEQ ID NO: 19341 - RNA, 21 nt, Artificial Sequence
  ELANE RNA Guide
ugggcaggaaccguggggucg

SEQ ID NO: 19342 - RNA, 21 nt, Artificial Sequence
  ELANE RNA Guide
uggggucgccagcguccugca

SEQ ID NO: 19343 - RNA, 21 nt, Artificial Sequence
  ELANE RNA Guide
uucugggcaggaaccgugggg

SEQ ID NO: 19344 - RNA, 22 nt, Artificial Sequence
  ELANE RNA Guide
aaccguggggucgccagcgucc

SEQ ID NO: 19345 - RNA, 22 nt, Artificial Sequence
  ELANE RNA Guide
accccacgguuccugcccagaa

SEQ ID NO: 19346 - RNA, 22 nt, Artificial Sequence
  ELANE RNA Guide
accguggggucgccagcguccu

SEQ ID NO: 19347 - RNA, 22 nt, Artificial Sequence
  ELANE RNA Guide
acgcuggcgaccccacgguucc

SEQ ID NO: 19348 - RNA, 22 nt, Artificial Sequence
  ELANE RNA Guide
aggaaccguggggucgccagcg

SEQ ID NO: 19349 - RNA, 22 nt, Artificial Sequence
  ELANE RNA Guide
aggacgcuggcgaccccacggu

SEQ ID NO: 19350 - RNA, 22 nt, Artificial Sequence
  ELANE RNA Guide
caggaaccguggggucgccagc

SEQ ID NO: 19351 - RNA, 22 nt, Artificial Sequence
  ELANE RNA Guide
caggacgcuggcgaccccacgg

SEQ ID NO: 19352 - RNA, 22 nt, Artificial Sequence
  ELANE RNA Guide
ccguggggucgccagcguccug

SEQ ID NO: 19353 - RNA, 22 nt, Artificial Sequence
  ELANE RNA Guide
ccugcaggacgcuggcgacccc

SEQ ID NO: 19354 - RNA, 22 nt, Artificial Sequence
  ELANE RNA Guide
ccuucugggcaggaaccguggg

SEQ ID NO: 19355 - RNA, 22 nt, Artificial Sequence
  ELANE RNA Guide
cgaccccacgguuccugcccag

SEQ ID NO: 19356 - RNA, 22 nt, Artificial Sequence
  ELANE RNA Guide
cgcuggcgaccccacgguuccu

SEQ ID NO: 19357 - RNA, 22 nt, Artificial Sequence
  ELANE RNA Guide
cguggggucgccagcguccugc

SEQ ID NO: 19358 - RNA, 22 nt, Artificial Sequence
  ELANE RNA Guide
cuccugcaggacgcuggcgacc

SEQ ID NO: 19359 - RNA, 22 nt, Artificial Sequence
  ELANE RNA Guide
cugcaggacgcuggcgacccca

SEQ ID NO: 19360 - RNA, 22 nt, Artificial Sequence
  ELANE RNA Guide
cuggcgaccccacgguuccugc

SEQ ID NO: 19361 - RNA, 22 nt, Artificial Sequence
  ELANE RNA Guide
cugggcaggaaccguggggucg

SEQ ID NO: 19362 - RNA, 22 nt, Artificial Sequence
  ELANE RNA Guide
cuucugggcaggaaccgugggg

SEQ ID NO: 19363 - RNA, 22 nt, Artificial Sequence
  ELANE RNA Guide
gaaccguggggucgccagcguc

SEQ ID NO: 19364 - RNA, 22 nt, Artificial Sequence
  ELANE RNA Guide
gaccccacgguuccugcccaga

SEQ ID NO: 19365 - RNA, 22 nt, Artificial Sequence
  ELANE RNA Guide
gacgcuggcgaccccacgguuc

SEQ ID NO: 19366 - RNA, 22 nt, Artificial Sequence
  ELANE RNA Guide
gagcuccugcaggacgcuggcg

SEQ ID NO: 19367 - RNA, 22 nt, Artificial Sequence
  ELANE RNA Guide
gcaggaaccguggggucgccag

SEQ ID NO: 19368 - RNA, 22 nt, Artificial Sequence
  ELANE RNA Guide
gcaggacgcuggcgaccccacg

SEQ ID NO: 19369 - RNA, 22 nt, Artificial Sequence
  ELANE RNA Guide
gccuucugggcaggaaccgugg

SEQ ID NO: 19370 - RNA, 22 nt, Artificial Sequence
  ELANE RNA Guide
gcgaccccacgguuccugccca

SEQ ID NO: 19371 - RNA, 22 nt, Artificial Sequence
  ELANE RNA Guide
gcuccugcaggacgcuggcgac

SEQ ID NO: 19372 - RNA, 22 nt, Artificial Sequence
  ELANE RNA Guide
gcuggcgaccccacgguuccug

SEQ ID NO: 19373 - RNA, 22 nt, Artificial Sequence
  ELANE RNA Guide
ggaaccguggggucgccagcgu

SEQ ID NO: 19374 - RNA, 22 nt, Artificial Sequence
  ELANE RNA Guide
ggacgcuggcgaccccacgguu

SEQ ID NO: 19375 - RNA, 22 nt, Artificial Sequence
  ELANE RNA Guide
ggcaggaaccguggggucgcca

SEQ ID NO: 19376 - RNA, 22 nt, Artificial Sequence
  ELANE RNA Guide
ggccuucugggcaggaaccgug

SEQ ID NO: 19377 - RNA, 22 nt, Artificial Sequence
  ELANE RNA Guide
ggcgaccccacgguuccugccc

SEQ ID NO: 19378 - RNA, 22 nt, Artificial Sequence
  ELANE RNA Guide
gggcaggaaccguggggucgcc

SEQ ID NO: 19379 - RNA, 22 nt, Artificial Sequence
  ELANE RNA Guide
ggggucgccagcguccugcagg

SEQ ID NO: 19380 - RNA, 22 nt, Artificial Sequence
  ELANE RNA Guide
gggucgccagcguccugcagga

SEQ ID NO: 19381 - RNA, 22 nt, Artificial Sequence
  ELANE RNA Guide
ggucgccagcguccugcaggag

SEQ ID NO: 19382 - RNA, 22 nt, Artificial Sequence
  ELANE RNA Guide
guggggucgccagcguccugca

SEQ ID NO: 19383 - RNA, 22 nt, Artificial Sequence
  ELANE RNA Guide
uccugcaggacgcuggcgaccc

SEQ ID NO: 19384 - RNA, 22 nt, Artificial Sequence
  ELANE RNA Guide
ucugggcaggaaccgugggguc

SEQ ID NO: 19385 - RNA, 22 nt, Artificial Sequence
  ELANE RNA Guide
ugagcuccugcaggacgcuggc

SEQ ID NO: 19386 - RNA, 22 nt, Artificial Sequence
  ELANE RNA Guide
ugcaggacgcuggcgaccccac

SEQ ID NO: 19387 - RNA, 22 nt, Artificial Sequence
  ELANE RNA Guide
uggcgaccccacgguuccugcc

SEQ ID NO: 19388 - RNA, 22 nt, Artificial Sequence
  ELANE RNA Guide
ugggcaggaaccguggggucgc

SEQ ID NO: 19389 - RNA, 22 nt, Artificial Sequence
  ELANE RNA Guide
uggggucgccagcguccugcag

SEQ ID NO: 19390 - RNA, 22 nt, Artificial Sequence
  ELANE RNA Guide
uucugggcaggaaccguggggu

SEQ ID NO: 19391 - RNA, 22 nt, Artificial Sequence
  ELANE RNA Guide
uugagcuccugcaggacgcugg

SEQ ID NO: 19392 - RNA, 20 nt, Artificial Sequence
  ELANE RNA Guide
aaccgugggaucaccagcgu

SEQ ID NO: 19393 - RNA, 20 nt, Artificial Sequence
  ELANE RNA Guide
accgugggaucaccagcguc

SEQ ID NO: 19394 - RNA, 20 nt, Artificial Sequence
  ELANE RNA Guide
acgcuggugaucccacgguu

SEQ ID NO: 19395 - RNA, 20 nt, Artificial Sequence
  ELANE RNA Guide
agcuccugcaggacgcuggu

SEQ ID NO: 19396 - RNA, 20 nt, Artificial Sequence
  ELANE RNA Guide
aggaaccgugggaucaccag

SEQ ID NO: 19397 - RNA, 20 nt, Artificial Sequence
  ELANE RNA Guide
aggacgcuggugaucccacg

SEQ ID NO: 19398 - RNA, 20 nt, Artificial Sequence
  ELANE RNA Guide
aucaccagcguccugcagga

SEQ ID NO: 19399 - RNA, 20 nt, Artificial Sequence
  ELANE RNA Guide
caccagcguccugcaggagc

SEQ ID NO: 19400 - RNA, 20 nt, Artificial Sequence
  ELANE RNA Guide
caggaaccgugggaucacca

SEQ ID NO: 19401 - RNA, 20 nt, Artificial Sequence
  ELANE RNA Guide
caggacgcuggugaucccac

SEQ ID NO: 19402 - RNA, 20 nt, Artificial Sequence
  ELANE RNA Guide
ccgugggaucaccagcgucc

SEQ ID NO: 19403 - RNA, 20 nt, Artificial Sequence
  ELANE RNA Guide
ccugcaggacgcuggugauc

SEQ ID NO: 19404 - RNA, 20 nt, Artificial Sequence
  ELANE RNA Guide
cgcuggugaucccacgguuc

SEQ ID NO: 19405 - RNA, 20 nt, Artificial Sequence
  ELANE RNA Guide
cgugggaucaccagcguccu

SEQ ID NO: 19406 - RNA, 20 nt, Artificial Sequence
  ELANE RNA Guide
cuccugcaggacgcugguga

SEQ ID NO: 19407 - RNA, 20 nt, Artificial Sequence
  ELANE RNA Guide
cugcaggacgcuggugaucc

SEQ ID NO: 19408 - RNA, 20 nt, Artificial Sequence
  ELANE RNA Guide
cugggcaggaaccgugggau

SEQ ID NO: 19409 - RNA, 20 nt, Artificial Sequence
  ELANE RNA Guide
cuggugaucccacgguuccu

SEQ ID NO: 19410 - RNA, 20 nt, Artificial Sequence
  ELANE RNA Guide
gaaccgugggaucaccagcg

SEQ ID NO: 19411 - RNA, 20 nt, Artificial Sequence
  ELANE RNA Guide
gacgcuggugaucccacggu

SEQ ID NO: 19412 - RNA, 20 nt, Artificial Sequence
  ELANE RNA Guide
gaucaccagcguccugcagg

SEQ ID NO: 19413 - RNA, 20 nt, Artificial Sequence
  ELANE RNA Guide
gcaggaaccgugggaucacc

SEQ ID NO: 19414 - RNA, 20 nt, Artificial Sequence
  ELANE RNA Guide
gcaggacgcuggugauccca

SEQ ID NO: 19415 - RNA, 20 nt, Artificial Sequence
  ELANE RNA Guide
gcuccugcaggacgcuggug

SEQ ID NO: 19416 - RNA, 20 nt, Artificial Sequence
  ELANE RNA Guide
gcuggugaucccacgguucc

SEQ ID NO: 19417 - RNA, 20 nt, Artificial Sequence
  ELANE RNA Guide
ggaaccgugggaucaccagc

SEQ ID NO: 19418 - RNA, 20 nt, Artificial Sequence
  ELANE RNA Guide
ggacgcuggugaucccacgg

SEQ ID NO: 19419 - RNA, 20 nt, Artificial Sequence
  ELANE RNA Guide
ggaucaccagcguccugcag

SEQ ID NO: 19420 - RNA, 20 nt, Artificial Sequence
  ELANE RNA Guide
ggcaggaaccgugggaucac

SEQ ID NO: 19421 - RNA, 20 nt, Artificial Sequence
  ELANE RNA Guide
gggaucaccagcguccugca

SEQ ID NO: 19422 - RNA, 20 nt, Artificial Sequence
  ELANE RNA Guide
gggcaggaaccgugggauca

SEQ ID NO: 19423 - RNA, 20 nt, Artificial Sequence
  ELANE RNA Guide
ggugaucccacgguuccugc

SEQ ID NO: 19424 - RNA, 20 nt, Artificial Sequence
  ELANE RNA Guide
gugaucccacgguuccugcc

SEQ ID NO: 19425 - RNA, 20 nt, Artificial Sequence
  ELANE RNA Guide
gugggaucaccagcguccug

SEQ ID NO: 19426 - RNA, 20 nt, Artificial Sequence
  ELANE RNA Guide
guugagcuccugcaggacgc

SEQ ID NO: 19427 - RNA, 20 nt, Artificial Sequence
  ELANE RNA Guide
ucaccagcguccugcaggag

SEQ ID NO: 19428 - RNA, 20 nt, Artificial Sequence
  ELANE RNA Guide
uccugcaggacgcuggugau

SEQ ID NO: 19429 - RNA, 20 nt, Artificial Sequence
  ELANE RNA Guide
ucugggcaggaaccguggga

SEQ ID NO: 19430 - RNA, 20 nt, Artificial Sequence
  ELANE RNA Guide
ugagcuccugcaggacgcug

SEQ ID NO: 19431 - RNA, 20 nt, Artificial Sequence
  ELANE RNA Guide
ugcaggacgcuggugauccc

SEQ ID NO: 19432 - RNA, 20 nt, Artificial Sequence
  ELANE RNA Guide
ugggaucaccagcguccugc

SEQ ID NO: 19433 - RNA, 20 nt, Artificial Sequence
  ELANE RNA Guide
ugggcaggaaccgugggauc

SEQ ID NO: 19434 - RNA, 20 nt, Artificial Sequence
  ELANE RNA Guide
uggugaucccacgguuccug

SEQ ID NO: 19435 - RNA, 20 nt, Artificial Sequence
  ELANE RNA Guide
uugagcuccugcaggacgcu

SEQ ID NO: 19436 - RNA, 21 nt, Artificial Sequence
  ELANE RNA Guide
aaccgugggaucaccagcguc

SEQ ID NO: 19437 - RNA, 21 nt, Artificial Sequence
  ELANE RNA Guide
accgugggaucaccagcgucc

SEQ ID NO: 19438 - RNA, 21 nt, Artificial Sequence
  ELANE RNA Guide
acgcuggugaucccacgguuc

SEQ ID NO: 19439 - RNA, 21 nt, Artificial Sequence
  ELANE RNA Guide
agcuccugcaggacgcuggug

SEQ ID NO: 19440 - RNA, 21 nt, Artificial Sequence
  ELANE RNA Guide
aggaaccgugggaucaccagc

SEQ ID NO: 19441 - RNA, 21 nt, Artificial Sequence
  ELANE RNA Guide
aggacgcuggugaucccacgg

SEQ ID NO: 19442 - RNA, 21 nt, Artificial Sequence
  ELANE RNA Guide
aucaccagcguccugcaggag

SEQ ID NO: 19443 - RNA, 21 nt, Artificial Sequence
  ELANE RNA Guide
caccagcguccugcaggagcu

SEQ ID NO: 19444 - RNA, 21 nt, Artificial Sequence
  ELANE RNA Guide
caggaaccgugggaucaccag

SEQ ID NO: 19445 - RNA, 21 nt, Artificial Sequence
  ELANE RNA Guide
caggacgcuggugaucccacg

SEQ ID NO: 19446 - RNA, 21 nt, Artificial Sequence
  ELANE RNA Guide
ccgugggaucaccagcguccu

SEQ ID NO: 19447 - RNA, 21 nt, Artificial Sequence
  ELANE RNA Guide
ccugcaggacgcuggugaucc

SEQ ID NO: 19448 - RNA, 21 nt, Artificial Sequence
  ELANE RNA Guide
cgcuggugaucccacgguucc

SEQ ID NO: 19449 - RNA, 21 nt, Artificial Sequence
  ELANE RNA Guide
cgugggaucaccagcguccug

SEQ ID NO: 19450 - RNA, 21 nt, Artificial Sequence
  ELANE RNA Guide
cguugagcuccugcaggacgc

SEQ ID NO: 19451 - RNA, 21 nt, Artificial Sequence
  ELANE RNA Guide
cuccugcaggacgcuggugau

SEQ ID NO: 19452 - RNA, 21 nt, Artificial Sequence
  ELANE RNA Guide
cugcaggacgcuggugauccc

SEQ ID NO: 19453 - RNA, 21 nt, Artificial Sequence
  ELANE RNA Guide
cugggcaggaaccgugggauc

SEQ ID NO: 19454 - RNA, 21 nt, Artificial Sequence
  ELANE RNA Guide
cuggugaucccacgguuccug

SEQ ID NO: 19455 - RNA, 21 nt, Artificial Sequence
  ELANE RNA Guide
gaaccgugggaucaccagcgu

SEQ ID NO: 19456 - RNA, 21 nt, Artificial Sequence
  ELANE RNA Guide
gacgcuggugaucccacgguu

SEQ ID NO: 19457 - RNA, 21 nt, Artificial Sequence
  ELANE RNA Guide
gagcuccugcaggacgcuggu

SEQ ID NO: 19458 - RNA, 21 nt, Artificial Sequence
  ELANE RNA Guide
gaucaccagcguccugcagga

SEQ ID NO: 19459 - RNA, 21 nt, Artificial Sequence
  ELANE RNA Guide
gcaggaaccgugggaucacca

SEQ ID NO: 19460 - RNA, 21 nt, Artificial Sequence
  ELANE RNA Guide
gcaggacgcuggugaucccac

SEQ ID NO: 19461 - RNA, 21 nt, Artificial Sequence
  ELANE RNA Guide
gcuccugcaggacgcugguga

SEQ ID NO: 19462 - RNA, 21 nt, Artificial Sequence
  ELANE RNA Guide
gcuggugaucccacgguuccu

SEQ ID NO: 19463 - RNA, 21 nt, Artificial Sequence
  ELANE RNA Guide
ggaaccgugggaucaccagcg

SEQ ID NO: 19464 - RNA, 21 nt, Artificial Sequence
  ELANE RNA Guide
ggacgcuggugaucccacggu

SEQ ID NO: 19465 - RNA, 21 nt, Artificial Sequence
  ELANE RNA Guide
ggaucaccagcguccugcagg

SEQ ID NO: 19466 - RNA, 21 nt, Artificial Sequence
  ELANE RNA Guide
ggcaggaaccgugggaucacc

SEQ ID NO: 19467 - RNA, 21 nt, Artificial Sequence
  ELANE RNA Guide
gggaucaccagcguccugcag

SEQ ID NO: 19468 - RNA, 21 nt, Artificial Sequence
  ELANE RNA Guide
gggcaggaaccgugggaucac

SEQ ID NO: 19469 - RNA, 21 nt, Artificial Sequence
  ELANE RNA Guide
ggugaucccacgguuccugcc

SEQ ID NO: 19470 - RNA, 21 nt, Artificial Sequence
  ELANE RNA Guide
gugaucccacgguuccugccc

SEQ ID NO: 19471 - RNA, 21 nt, Artificial Sequence
  ELANE RNA Guide
gugggaucaccagcguccugc

SEQ ID NO: 19472 - RNA, 21 nt, Artificial Sequence
  ELANE RNA Guide
guugagcuccugcaggacgcu

SEQ ID NO: 19473 - RNA, 21 nt, Artificial Sequence
  ELANE RNA Guide
ucaccagcguccugcaggagc

SEQ ID NO: 19474 - RNA, 21 nt, Artificial Sequence
  ELANE RNA Guide
uccugcaggacgcuggugauc

SEQ ID NO: 19475 - RNA, 21 nt, Artificial Sequence
  ELANE RNA Guide
ucugggcaggaaccgugggau

SEQ ID NO: 19476 - RNA, 21 nt, Artificial Sequence
  ELANE RNA Guide
ugcaggacgcuggugauccca

SEQ ID NO: 19477 - RNA, 21 nt, Artificial Sequence
  ELANE RNA Guide
ugggaucaccagcguccugca

SEQ ID NO: 19478 - RNA, 21 nt, Artificial Sequence
  ELANE RNA Guide
ugggcaggaaccgugggauca

SEQ ID NO: 19479 - RNA, 21 nt, Artificial Sequence
  ELANE RNA Guide
uggugaucccacgguuccugc

SEQ ID NO: 19480 - RNA, 21 nt, Artificial Sequence
  ELANE RNA Guide
uucugggcaggaaccguggga

SEQ ID NO: 19481 - RNA, 21 nt, Artificial Sequence
  ELANE RNA Guide
uugagcuccugcaggacgcug

SEQ ID NO: 19482 - RNA, 22 nt, Artificial Sequence
  ELANE RNA Guide
aaccgugggaucaccagcgucc

SEQ ID NO: 19483 - RNA, 22 nt, Artificial Sequence
  ELANE RNA Guide
accgugggaucaccagcguccu

SEQ ID NO: 19484 - RNA, 22 nt, Artificial Sequence
  ELANE RNA Guide
acgcuggugaucccacgguucc

SEQ ID NO: 19485 - RNA, 22 nt, Artificial Sequence
  ELANE RNA Guide
acguugagcuccugcaggacgc

SEQ ID NO: 19486 - RNA, 22 nt, Artificial Sequence
  ELANE RNA Guide
agcuccugcaggacgcugguga

SEQ ID NO: 19487 - RNA, 22 nt, Artificial Sequence
  ELANE RNA Guide
aggaaccgugggaucaccagcg

SEQ ID NO: 19488 - RNA, 22 nt, Artificial Sequence
  ELANE RNA Guide
aggacgcuggugaucccacggu

SEQ ID NO: 19489 - RNA, 22 nt, Artificial Sequence
  ELANE RNA Guide
aucaccagcguccugcaggagc

SEQ ID NO: 19490 - RNA, 22 nt, Artificial Sequence
  ELANE RNA Guide
caccagcguccugcaggagcuc

SEQ ID NO: 19491 - RNA, 22 nt, Artificial Sequence
  ELANE RNA Guide
caggaaccgugggaucaccagc

SEQ ID NO: 19492 - RNA, 22 nt, Artificial Sequence
  ELANE RNA Guide
caggacgcuggugaucccacgg

SEQ ID NO: 19493 - RNA, 22 nt, Artificial Sequence
  ELANE RNA Guide
ccgugggaucaccagcguccug

SEQ ID NO: 19494 - RNA, 22 nt, Artificial Sequence
  ELANE RNA Guide
ccugcaggacgcuggugauccc

SEQ ID NO: 19495 - RNA, 22 nt, Artificial Sequence
  ELANE RNA Guide
cgcuggugaucccacgguuccu

SEQ ID NO: 19496 - RNA, 22 nt, Artificial Sequence
  ELANE RNA Guide
cgugggaucaccagcguccugc

SEQ ID NO: 19497 - RNA, 22 nt, Artificial Sequence
  ELANE RNA Guide
cguugagcuccugcaggacgcu

SEQ ID NO: 19498 - RNA, 22 nt, Artificial Sequence
  ELANE RNA Guide
cuccugcaggacgcuggugauc

SEQ ID NO: 19499 - RNA, 22 nt, Artificial Sequence
  ELANE RNA Guide
cugcaggacgcuggugauccca

SEQ ID NO: 19500 - RNA, 22 nt, Artificial Sequence
  ELANE RNA Guide
cugggcaggaaccgugggauca

SEQ ID NO: 19501 - RNA, 22 nt, Artificial Sequence
  ELANE RNA Guide
cuggugaucccacgguuccugc

SEQ ID NO: 19502 - RNA, 22 nt, Artificial Sequence
  ELANE RNA Guide
cuucugggcaggaaccguggga

SEQ ID NO: 19503 - RNA, 22 nt, Artificial Sequence
  ELANE RNA Guide
gaaccgugggaucaccagcguc

SEQ ID NO: 19504 - RNA, 22 nt, Artificial Sequence
  ELANE RNA Guide
gacgcuggugaucccacgguuc

SEQ ID NO: 19505 - RNA, 22 nt, Artificial Sequence
  ELANE RNA Guide
gagcuccugcaggacgcuggug

SEQ ID NO: 19506 - RNA, 22 nt, Artificial Sequence
  ELANE RNA Guide
gaucaccagcguccugcaggag

SEQ ID NO: 19507 - RNA, 22 nt, Artificial Sequence
  ELANE RNA Guide
gcaggaaccgugggaucaccag

SEQ ID NO: 19508 - RNA, 22 nt, Artificial Sequence
  ELANE RNA Guide
gcaggacgcuggugaucccacg

SEQ ID NO: 19509 - RNA, 22 nt, Artificial Sequence
  ELANE RNA Guide
gcuccugcaggacgcuggugau

SEQ ID NO: 19510 - RNA, 22 nt, Artificial Sequence
  ELANE RNA Guide
gcuggugaucccacgguuccug

SEQ ID NO: 19511 - RNA, 22 nt, Artificial Sequence
  ELANE RNA Guide
ggaaccgugggaucaccagcgu

SEQ ID NO: 19512 - RNA, 22 nt, Artificial Sequence
  ELANE RNA Guide
ggacgcuggugaucccacgguu

SEQ ID NO: 19513 - RNA, 22 nt, Artificial Sequence
  ELANE RNA Guide
ggaucaccagcguccugcagga

SEQ ID NO: 19514 - RNA, 22 nt, Artificial Sequence
  ELANE RNA Guide
ggcaggaaccgugggaucacca

SEQ ID NO: 19515 - RNA, 22 nt, Artificial Sequence
  ELANE RNA Guide
gggaucaccagcguccugcagg

SEQ ID NO: 19516 - RNA, 22 nt, Artificial Sequence
  ELANE RNA Guide
gggcaggaaccgugggaucacc

SEQ ID NO: 19517 - RNA, 22 nt, Artificial Sequence
  ELANE RNA Guide
ggugaucccacgguuccugccc

SEQ ID NO: 19518 - RNA, 22 nt, Artificial Sequence
  ELANE RNA Guide
gugaucccacgguuccugccca

SEQ ID NO: 19519 - RNA, 22 nt, Artificial Sequence
  ELANE RNA Guide
gugggaucaccagcguccugca

SEQ ID NO: 19520 - RNA, 22 nt, Artificial Sequence
  ELANE RNA Guide
guugagcuccugcaggacgcug

SEQ ID NO: 19521 - RNA, 22 nt, Artificial Sequence
  ELANE RNA Guide
ucaccagcguccugcaggagcu

SEQ ID NO: 19522 - RNA, 22 nt, Artificial Sequence
  ELANE RNA Guide
uccugcaggacgcuggugaucc

SEQ ID NO: 19523 - RNA, 22 nt, Artificial Sequence
  ELANE RNA Guide
ucugggcaggaaccgugggauc

SEQ ID NO: 19524 - RNA, 22 nt, Artificial Sequence
  ELANE RNA Guide
ugagcuccugcaggacgcuggu

SEQ ID NO: 19525 - RNA, 22 nt, Artificial Sequence
  ELANE RNA Guide
ugcaggacgcuggugaucccac

SEQ ID NO: 19526 - RNA, 22 nt, Artificial Sequence
  ELANE RNA Guide
ugggaucaccagcguccugcag

SEQ ID NO: 19527 - RNA, 22 nt, Artificial Sequence
  ELANE RNA Guide
ugggcaggaaccgugggaucac

SEQ ID NO: 19528 - RNA, 22 nt, Artificial Sequence
  ELANE RNA Guide
uggugaucccacgguuccugcc

SEQ ID NO: 19529 - RNA, 22 nt, Artificial Sequence
  ELANE RNA Guide
uucugggcaggaaccgugggau

SEQ ID NO: 19530 - RNA, 20 nt, Artificial Sequence
  ELANE RNA Guide
aaccgugggaucgccagcau

SEQ ID NO: 19531 - RNA, 20 nt, Artificial Sequence
  ELANE RNA Guide
accgugggaucgccagcauc

SEQ ID NO: 19532 - RNA, 20 nt, Artificial Sequence
  ELANE RNA Guide
acguugagcuccugcaggau

SEQ ID NO: 19533 - RNA, 20 nt, Artificial Sequence
  ELANE RNA Guide
agcauccugcaggagcucaa

SEQ ID NO: 19534 - RNA, 20 nt, Artificial Sequence
  ELANE RNA Guide
agcuccugcaggaugcuggc

SEQ ID NO: 19535 - RNA, 20 nt, Artificial Sequence
  ELANE RNA Guide
aggaaccgugggaucgccag

SEQ ID NO: 19536 - RNA, 20 nt, Artificial Sequence
  ELANE RNA Guide
aggaugcuggcgaucccacg

SEQ ID NO: 19537 - RNA, 20 nt, Artificial Sequence
  ELANE RNA Guide
aucgccagcauccugcagga

SEQ ID NO: 19538 - RNA, 20 nt, Artificial Sequence
  ELANE RNA Guide
augcuggcgaucccacgguu

SEQ ID NO: 19539 - RNA, 20 nt, Artificial Sequence
  ELANE RNA Guide
cacguugagcuccugcagga

SEQ ID NO: 19540 - RNA, 20 nt, Artificial Sequence
  ELANE RNA Guide
cagcauccugcaggagcuca

SEQ ID NO: 19541 - RNA, 20 nt, Artificial Sequence
  ELANE RNA Guide
caggaaccgugggaucgcca

SEQ ID NO: 19542 - RNA, 20 nt, Artificial Sequence
  ELANE RNA Guide
caggaugcuggcgaucccac

SEQ ID NO: 19543 - RNA, 20 nt, Artificial Sequence
  ELANE RNA Guide
cauccugcaggagcucaacg

SEQ ID NO: 19544 - RNA, 20 nt, Artificial Sequence
  ELANE RNA Guide
ccagcauccugcaggagcuc

SEQ ID NO: 19545 - RNA, 20 nt, Artificial Sequence
  ELANE RNA Guide
ccgugggaucgccagcaucc

SEQ ID NO: 19546 - RNA, 20 nt, Artificial Sequence
  ELANE RNA Guide
ccugcaggaugcuggcgauc

SEQ ID NO: 19547 - RNA, 20 nt, Artificial Sequence
  ELANE RNA Guide
cgccagcauccugcaggagc

SEQ ID NO: 19548 - RNA, 20 nt, Artificial Sequence
  ELANE RNA Guide
cgucacguugagcuccugca

SEQ ID NO: 19549 - RNA, 20 nt, Artificial Sequence
  ELANE RNA Guide
cgugggaucgccagcauccu

SEQ ID NO: 19550 - RNA, 20 nt, Artificial Sequence
  ELANE RNA Guide
cguugagcuccugcaggaug

SEQ ID NO: 19551 - RNA, 20 nt, Artificial Sequence
  ELANE RNA Guide
cuccugcaggaugcuggcga

SEQ ID NO: 19552 - RNA, 20 nt, Artificial Sequence
  ELANE RNA Guide
cugcaggaugcuggcgaucc

SEQ ID NO: 19553 - RNA, 20 nt, Artificial Sequence
  ELANE RNA Guide
gaaccgugggaucgccagca

SEQ ID NO: 19554 - RNA, 20 nt, Artificial Sequence
  ELANE RNA Guide
gagcuccugcaggaugcugg

SEQ ID NO: 19555 - RNA, 20 nt, Artificial Sequence
  ELANE RNA Guide
gaucgccagcauccugcagg

SEQ ID NO: 19556 - RNA, 20 nt, Artificial Sequence
  ELANE RNA Guide
gaugcuggcgaucccacggu

SEQ ID NO: 19557 - RNA, 20 nt, Artificial Sequence
  ELANE RNA Guide
gcaggaaccgugggaucgcc

SEQ ID NO: 19558 - RNA, 20 nt, Artificial Sequence
  ELANE RNA Guide
gcaggaugcuggcgauccca

SEQ ID NO: 19559 - RNA, 20 nt, Artificial Sequence
  ELANE RNA Guide
gcauccugcaggagcucaac

SEQ ID NO: 19560 - RNA, 20 nt, Artificial Sequence
  ELANE RNA Guide
gccagcauccugcaggagcu

SEQ ID NO: 19561 - RNA, 20 nt, Artificial Sequence
  ELANE RNA Guide
gcuccugcaggaugcuggcg

SEQ ID NO: 19562 - RNA, 20 nt, Artificial Sequence
  ELANE RNA Guide
ggaaccgugggaucgccagc

SEQ ID NO: 19563 - RNA, 20 nt, Artificial Sequence
  ELANE RNA Guide
ggaucgccagcauccugcag

SEQ ID NO: 19564 - RNA, 20 nt, Artificial Sequence
  ELANE RNA Guide
ggaugcuggcgaucccacgg

SEQ ID NO: 19565 - RNA, 20 nt, Artificial Sequence
  ELANE RNA Guide
gggaucgccagcauccugca

SEQ ID NO: 19566 - RNA, 20 nt, Artificial Sequence
  ELANE RNA Guide
gucacguugagcuccugcag

SEQ ID NO: 19567 - RNA, 20 nt, Artificial Sequence
  ELANE RNA Guide
gugggaucgccagcauccug

SEQ ID NO: 19568 - RNA, 20 nt, Artificial Sequence
  ELANE RNA Guide
guugagcuccugcaggaugc

SEQ ID NO: 19569 - RNA, 20 nt, Artificial Sequence
  ELANE RNA Guide
ucacguugagcuccugcagg

SEQ ID NO: 19570 - RNA, 20 nt, Artificial Sequence
  ELANE RNA Guide
uccugcaggaugcuggcgau

SEQ ID NO: 19571 - RNA, 20 nt, Artificial Sequence
  ELANE RNA Guide
ucgccagcauccugcaggag

SEQ ID NO: 19572 - RNA, 20 nt, Artificial Sequence
  ELANE RNA Guide
ugagcuccugcaggaugcug

SEQ ID NO: 19573 - RNA, 20 nt, Artificial Sequence
  ELANE RNA Guide
ugcaggaugcuggcgauccc

SEQ ID NO: 19574 - RNA, 20 nt, Artificial Sequence
  ELANE RNA Guide
ugggaucgccagcauccugc

SEQ ID NO: 19575 - RNA, 20 nt, Artificial Sequence
  ELANE RNA Guide
uugagcuccugcaggaugcu

SEQ ID NO: 19576 - RNA, 21 nt, Artificial Sequence
  ELANE RNA Guide
aaccgugggaucgccagcauc

SEQ ID NO: 19577 - RNA, 21 nt, Artificial Sequence
  ELANE RNA Guide
accgugggaucgccagcaucc

SEQ ID NO: 19578 - RNA, 21 nt, Artificial Sequence
  ELANE RNA Guide
acguugagcuccugcaggaug

SEQ ID NO: 19579 - RNA, 21 nt, Artificial Sequence
  ELANE RNA Guide
agcauccugcaggagcucaac

SEQ ID NO: 19580 - RNA, 21 nt, Artificial Sequence
  ELANE RNA Guide
agcuccugcaggaugcuggcg

SEQ ID NO: 19581 - RNA, 21 nt, Artificial Sequence
  ELANE RNA Guide
aggaaccgugggaucgccagc

SEQ ID NO: 19582 - RNA, 21 nt, Artificial Sequence
  ELANE RNA Guide
aggaugcuggcgaucccacgg

SEQ ID NO: 19583 - RNA, 21 nt, Artificial Sequence
  ELANE RNA Guide
aucgccagcauccugcaggag

SEQ ID NO: 19584 - RNA, 21 nt, Artificial Sequence
  ELANE RNA Guide
augcuggcgaucccacgguuc

SEQ ID NO: 19585 - RNA, 21 nt, Artificial Sequence
  ELANE RNA Guide
cacguugagcuccugcaggau

SEQ ID NO: 19586 - RNA, 21 nt, Artificial Sequence
  ELANE RNA Guide
cagcauccugcaggagcucaa

SEQ ID NO: 19587 - RNA, 21 nt, Artificial Sequence
  ELANE RNA Guide
caggaaccgugggaucgccag

SEQ ID NO: 19588 - RNA, 21 nt, Artificial Sequence
  ELANE RNA Guide
caggaugcuggcgaucccacg

SEQ ID NO: 19589 - RNA, 21 nt, Artificial Sequence
  ELANE RNA Guide
cauccugcaggagcucaacgu

SEQ ID NO: 19590 - RNA, 21 nt, Artificial Sequence
  ELANE RNA Guide
ccagcauccugcaggagcuca

SEQ ID NO: 19591 - RNA, 21 nt, Artificial Sequence
  ELANE RNA Guide
ccgucacguugagcuccugca

SEQ ID NO: 19592 - RNA, 21 nt, Artificial Sequence
  ELANE RNA Guide
ccgugggaucgccagcauccu

SEQ ID NO: 19593 - RNA, 21 nt, Artificial Sequence
  ELANE RNA Guide
ccugcaggaugcuggcgaucc

SEQ ID NO: 19594 - RNA, 21 nt, Artificial Sequence
  ELANE RNA Guide
cgccagcauccugcaggagcu

SEQ ID NO: 19595 - RNA, 21 nt, Artificial Sequence
  ELANE RNA Guide
cgucacguugagcuccugcag

SEQ ID NO: 19596 - RNA, 21 nt, Artificial Sequence
  ELANE RNA Guide
cgugggaucgccagcauccug

SEQ ID NO: 19597 - RNA, 21 nt, Artificial Sequence
  ELANE RNA Guide
cguugagcuccugcaggaugc

SEQ ID NO: 19598 - RNA, 21 nt, Artificial Sequence
  ELANE RNA Guide
cuccugcaggaugcuggcgau

SEQ ID NO: 19599 - RNA, 21 nt, Artificial Sequence
  ELANE RNA Guide
cugcaggaugcuggcgauccc

SEQ ID NO: 19600 - RNA, 21 nt, Artificial Sequence
  ELANE RNA Guide
gaaccgugggaucgccagcau

SEQ ID NO: 19601 - RNA, 21 nt, Artificial Sequence
  ELANE RNA Guide
gagcuccugcaggaugcuggc

SEQ ID NO: 19602 - RNA, 21 nt, Artificial Sequence
  ELANE RNA Guide
gaucgccagcauccugcagga

SEQ ID NO: 19603 - RNA, 21 nt, Artificial Sequence
  ELANE RNA Guide
gaugcuggcgaucccacgguu

SEQ ID NO: 19604 - RNA, 21 nt, Artificial Sequence
  ELANE RNA Guide
gcaggaaccgugggaucgcca

SEQ ID NO: 19605 - RNA, 21 nt, Artificial Sequence
  ELANE RNA Guide
gcaggaugcuggcgaucccac

SEQ ID NO: 19606 - RNA, 21 nt, Artificial Sequence
  ELANE RNA Guide
gcauccugcaggagcucaacg

SEQ ID NO: 19607 - RNA, 21 nt, Artificial Sequence
  ELANE RNA Guide
gccagcauccugcaggagcuc

SEQ ID NO: 19608 - RNA, 21 nt, Artificial Sequence
  ELANE RNA Guide
gcuccugcaggaugcuggcga

SEQ ID NO: 19609 - RNA, 21 nt, Artificial Sequence
  ELANE RNA Guide
ggaaccgugggaucgccagca

SEQ ID NO: 19610 - RNA, 21 nt, Artificial Sequence
  ELANE RNA Guide
ggaucgccagcauccugcagg

SEQ ID NO: 19611 - RNA, 21 nt, Artificial Sequence
  ELANE RNA Guide
ggaugcuggcgaucccacggu

SEQ ID NO: 19612 - RNA, 21 nt, Artificial Sequence
  ELANE RNA Guide
ggcaggaaccgugggaucgcc

SEQ ID NO: 19613 - RNA, 21 nt, Artificial Sequence
  ELANE RNA Guide
gggaucgccagcauccugcag

SEQ ID NO: 19614 - RNA, 21 nt, Artificial Sequence
  ELANE RNA Guide
gucacguugagcuccugcagg

SEQ ID NO: 19615 - RNA, 21 nt, Artificial Sequence
  ELANE RNA Guide
gugggaucgccagcauccugc

SEQ ID NO: 19616 - RNA, 21 nt, Artificial Sequence
  ELANE RNA Guide
guugagcuccugcaggaugcu

SEQ ID NO: 19617 - RNA, 21 nt, Artificial Sequence
  ELANE RNA Guide
ucacguugagcuccugcagga

SEQ ID NO: 19618 - RNA, 21 nt, Artificial Sequence
  ELANE RNA Guide
uccugcaggaugcuggcgauc

SEQ ID NO: 19619 - RNA, 21 nt, Artificial Sequence
  ELANE RNA Guide
ucgccagcauccugcaggagc

SEQ ID NO: 19620 - RNA, 21 nt, Artificial Sequence
  ELANE RNA Guide
ugagcuccugcaggaugcugg

SEQ ID NO: 19621 - RNA, 21 nt, Artificial Sequence
  ELANE RNA Guide
ugcaggaugcuggcgauccca

SEQ ID NO: 19622 - RNA, 21 nt, Artificial Sequence
  ELANE RNA Guide
ugggaucgccagcauccugca

SEQ ID NO: 19623 - RNA, 21 nt, Artificial Sequence
  ELANE RNA Guide
uugagcuccugcaggaugcug

SEQ ID NO: 19624 - RNA, 22 nt, Artificial Sequence
  ELANE RNA Guide
aaccgugggaucgccagcaucc

SEQ ID NO: 19625 - RNA, 22 nt, Artificial Sequence
  ELANE RNA Guide
accgucacguugagcuccugca

SEQ ID NO: 19626 - RNA, 22 nt, Artificial Sequence
  ELANE RNA Guide
accgugggaucgccagcauccu

SEQ ID NO: 19627 - RNA, 22 nt, Artificial Sequence
  ELANE RNA Guide
acguugagcuccugcaggaugc

SEQ ID NO: 19628 - RNA, 22 nt, Artificial Sequence
  ELANE RNA Guide
agcauccugcaggagcucaacg

SEQ ID NO: 19629 - RNA, 22 nt, Artificial Sequence
  ELANE RNA Guide
agcuccugcaggaugcuggcga

SEQ ID NO: 19630 - RNA, 22 nt, Artificial Sequence
  ELANE RNA Guide
aggaaccgugggaucgccagca

SEQ ID NO: 19631 - RNA, 22 nt, Artificial Sequence
  ELANE RNA Guide
aggaugcuggcgaucccacggu

SEQ ID NO: 19632 - RNA, 22 nt, Artificial Sequence
  ELANE RNA Guide
aucgccagcauccugcaggagc

SEQ ID NO: 19633 - RNA, 22 nt, Artificial Sequence
  ELANE RNA Guide
augcuggcgaucccacgguucc

SEQ ID NO: 19634 - RNA, 22 nt, Artificial Sequence
  ELANE RNA Guide
cacguugagcuccugcaggaug

SEQ ID NO: 19635 - RNA, 22 nt, Artificial Sequence
  ELANE RNA Guide
cagcauccugcaggagcucaac

SEQ ID NO: 19636 - RNA, 22 nt, Artificial Sequence
  ELANE RNA Guide
caggaaccgugggaucgccagc

SEQ ID NO: 19637 - RNA, 22 nt, Artificial Sequence
  ELANE RNA Guide
caggaugcuggcgaucccacgg

SEQ ID NO: 19638 - RNA, 22 nt, Artificial Sequence
  ELANE RNA Guide
cauccugcaggagcucaacgug

SEQ ID NO: 19639 - RNA, 22 nt, Artificial Sequence
  ELANE RNA Guide
ccagcauccugcaggagcucaa

SEQ ID NO: 19640 - RNA, 22 nt, Artificial Sequence
  ELANE RNA Guide
ccgucacguugagcuccugcag

SEQ ID NO: 19641 - RNA, 22 nt, Artificial Sequence
  ELANE RNA Guide
ccgugggaucgccagcauccug

SEQ ID NO: 19642 - RNA, 22 nt, Artificial Sequence
  ELANE RNA Guide
ccugcaggaugcuggcgauccc

SEQ ID NO: 19643 - RNA, 22 nt, Artificial Sequence
  ELANE RNA Guide
cgccagcauccugcaggagcuc

SEQ ID NO: 19644 - RNA, 22 nt, Artificial Sequence
  ELANE RNA Guide
cgucacguugagcuccugcagg

SEQ ID NO: 19645 - RNA, 22 nt, Artificial Sequence
  ELANE RNA Guide
cgugggaucgccagcauccugc

SEQ ID NO: 19646 - RNA, 22 nt, Artificial Sequence
  ELANE RNA Guide
cguugagcuccugcaggaugcu

SEQ ID NO: 19647 - RNA, 22 nt, Artificial Sequence
  ELANE RNA Guide
cuccugcaggaugcuggcgauc

SEQ ID NO: 19648 - RNA, 22 nt, Artificial Sequence
  ELANE RNA Guide
cugcaggaugcuggcgauccca

SEQ ID NO: 19649 - RNA, 22 nt, Artificial Sequence
  ELANE RNA Guide
gaaccgugggaucgccagcauc

SEQ ID NO: 19650 - RNA, 22 nt, Artificial Sequence
  ELANE RNA Guide
gagcuccugcaggaugcuggcg

SEQ ID NO: 19651 - RNA, 22 nt, Artificial Sequence
  ELANE RNA Guide
gaucgccagcauccugcaggag

SEQ ID NO: 19652 - RNA, 22 nt, Artificial Sequence
  ELANE RNA Guide
gaugcuggcgaucccacgguuc

SEQ ID NO: 19653 - RNA, 22 nt, Artificial Sequence
  ELANE RNA Guide
gcaggaaccgugggaucgccag

SEQ ID NO: 19654 - RNA, 22 nt, Artificial Sequence
  ELANE RNA Guide
gcaggaugcuggcgaucccacg

SEQ ID NO: 19655 - RNA, 22 nt, Artificial Sequence
  ELANE RNA Guide
gcauccugcaggagcucaacgu

SEQ ID NO: 19656 - RNA, 22 nt, Artificial Sequence
  ELANE RNA Guide
gccagcauccugcaggagcuca

SEQ ID NO: 19657 - RNA, 22 nt, Artificial Sequence
  ELANE RNA Guide
gcuccugcaggaugcuggcgau

SEQ ID NO: 19658 - RNA, 22 nt, Artificial Sequence
  ELANE RNA Guide
ggaaccgugggaucgccagcau

SEQ ID NO: 19659 - RNA, 22 nt, Artificial Sequence
  ELANE RNA Guide
ggaucgccagcauccugcagga

SEQ ID NO: 19660 - RNA, 22 nt, Artificial Sequence
  ELANE RNA Guide
ggaugcuggcgaucccacgguu

SEQ ID NO: 19661 - RNA, 22 nt, Artificial Sequence
  ELANE RNA Guide
ggcaggaaccgugggaucgcca

SEQ ID NO: 19662 - RNA, 22 nt, Artificial Sequence
  ELANE RNA Guide
gggaucgccagcauccugcagg

SEQ ID NO: 19663 - RNA, 22 nt, Artificial Sequence
  ELANE RNA Guide
gggcaggaaccgugggaucgcc

SEQ ID NO: 19664 - RNA, 22 nt, Artificial Sequence
  ELANE RNA Guide
gucacguugagcuccugcagga

SEQ ID NO: 19665 - RNA, 22 nt, Artificial Sequence
  ELANE RNA Guide
gugggaucgccagcauccugca

SEQ ID NO: 19666 - RNA, 22 nt, Artificial Sequence
  ELANE RNA Guide
guugagcuccugcaggaugcug

SEQ ID NO: 19667 - RNA, 22 nt, Artificial Sequence
  ELANE RNA Guide
ucacguugagcuccugcaggau

SEQ ID NO: 19668 - RNA, 22 nt, Artificial Sequence
  ELANE RNA Guide
uccugcaggaugcuggcgaucc

SEQ ID NO: 19669 - RNA, 22 nt, Artificial Sequence
  ELANE RNA Guide
ucgccagcauccugcaggagcu

SEQ ID NO: 19670 - RNA, 22 nt, Artificial Sequence
  ELANE RNA Guide
ugagcuccugcaggaugcuggc

SEQ ID NO: 19671 - RNA, 22 nt, Artificial Sequence
  ELANE RNA Guide
ugcaggaugcuggcgaucccac

SEQ ID NO: 19672 - RNA, 22 nt, Artificial Sequence
  ELANE RNA Guide
ugggaucgccagcauccugcag

SEQ ID NO: 19673 - RNA, 22 nt, Artificial Sequence
  ELANE RNA Guide
uugagcuccugcaggaugcugg

SEQ ID NO: 19674 - RNA, 20 nt, Artificial Sequence
  ELANE RNA Guide
accaccgucacguugagcuc

SEQ ID NO: 19675 - RNA, 20 nt, Artificial Sequence
  ELANE RNA Guide
accgucacguugagcuccgg

SEQ ID NO: 19676 - RNA, 20 nt, Artificial Sequence
  ELANE RNA Guide
acguugagcuccggcaggac

SEQ ID NO: 19677 - RNA, 20 nt, Artificial Sequence
  ELANE RNA Guide
agcguccugccggagcucaa

SEQ ID NO: 19678 - RNA, 20 nt, Artificial Sequence
  ELANE RNA Guide
agcuccggcaggacgcuggc

SEQ ID NO: 19679 - RNA, 20 nt, Artificial Sequence
  ELANE RNA Guide
aucgccagcguccugccgga

SEQ ID NO: 19680 - RNA, 20 nt, Artificial Sequence
  ELANE RNA Guide
caccaccgucacguugagcu

SEQ ID NO: 19681 - RNA, 20 nt, Artificial Sequence
  ELANE RNA Guide
caccgucacguugagcuccg

SEQ ID NO: 19682 - RNA, 20 nt, Artificial Sequence
  ELANE RNA Guide
cacguugagcuccggcagga

SEQ ID NO: 19683 - RNA, 20 nt, Artificial Sequence
  ELANE RNA Guide
cagcguccugccggagcuca

SEQ ID NO: 19684 - RNA, 20 nt, Artificial Sequence
  ELANE RNA Guide
ccaccgucacguugagcucc

SEQ ID NO: 19685 - RNA, 20 nt, Artificial Sequence
  ELANE RNA Guide
ccagcguccugccggagcuc

SEQ ID NO: 19686 - RNA, 20 nt, Artificial Sequence
  ELANE RNA Guide
ccggagcucaacgugacggu

SEQ ID NO: 19687 - RNA, 20 nt, Artificial Sequence
  ELANE RNA Guide
ccggcaggacgcuggcgauc

SEQ ID NO: 19688 - RNA, 20 nt, Artificial Sequence
  ELANE RNA Guide
ccgucacguugagcuccggc

SEQ ID NO: 19689 - RNA, 20 nt, Artificial Sequence
  ELANE RNA Guide
ccgugggaucgccagcgucc

SEQ ID NO: 19690 - RNA, 20 nt, Artificial Sequence
  ELANE RNA Guide
ccugccggagcucaacguga

SEQ ID NO: 19691 - RNA, 20 nt, Artificial Sequence
  ELANE RNA Guide
cgccagcguccugccggagc

SEQ ID NO: 19692 - RNA, 20 nt, Artificial Sequence
  ELANE RNA Guide
cggcaggacgcuggcgaucc

SEQ ID NO: 19693 - RNA, 20 nt, Artificial Sequence
  ELANE RNA Guide
cgucacguugagcuccggca

SEQ ID NO: 19694 - RNA, 20 nt, Artificial Sequence
  ELANE RNA Guide
cguccugccggagcucaacg

SEQ ID NO: 19695 - RNA, 20 nt, Artificial Sequence
  ELANE RNA Guide
cgugggaucgccagcguccu

SEQ ID NO: 19696 - RNA, 20 nt, Artificial Sequence
  ELANE RNA Guide
cguugagcuccggcaggacg

SEQ ID NO: 19697 - RNA, 20 nt, Artificial Sequence
  ELANE RNA Guide
cuccggcaggacgcuggcga

SEQ ID NO: 19698 - RNA, 20 nt, Artificial Sequence
  ELANE RNA Guide
cugccggagcucaacgugac

SEQ ID NO: 19699 - RNA, 20 nt, Artificial Sequence
  ELANE RNA Guide
gagcuccggcaggacgcugg

SEQ ID NO: 19700 - RNA, 20 nt, Artificial Sequence
  ELANE RNA Guide
gaucgccagcguccugccgg

SEQ ID NO: 19701 - RNA, 20 nt, Artificial Sequence
  ELANE RNA Guide
gccagcguccugccggagcu

SEQ ID NO: 19702 - RNA, 20 nt, Artificial Sequence
  ELANE RNA Guide
gccggagcucaacgugacgg

SEQ ID NO: 19703 - RNA, 20 nt, Artificial Sequence
  ELANE RNA Guide
gcguccugccggagcucaac

SEQ ID NO: 19704 - RNA, 20 nt, Artificial Sequence
  ELANE RNA Guide
gcuccggcaggacgcuggcg

SEQ ID NO: 19705 - RNA, 20 nt, Artificial Sequence
  ELANE RNA Guide
ggaucgccagcguccugccg

SEQ ID NO: 19706 - RNA, 20 nt, Artificial Sequence
  ELANE RNA Guide
gggaucgccagcguccugcc

SEQ ID NO: 19707 - RNA, 20 nt, Artificial Sequence
  ELANE RNA Guide
gucacguugagcuccggcag

SEQ ID NO: 19708 - RNA, 20 nt, Artificial Sequence
  ELANE RNA Guide
guccugccggagcucaacgu

SEQ ID NO: 19709 - RNA, 20 nt, Artificial Sequence
  ELANE RNA Guide
gugggaucgccagcguccug

SEQ ID NO: 19710 - RNA, 20 nt, Artificial Sequence
  ELANE RNA Guide
guugagcuccggcaggacgc

SEQ ID NO: 19711 - RNA, 20 nt, Artificial Sequence
  ELANE RNA Guide
ucaccaccgucacguugagc

SEQ ID NO: 19712 - RNA, 20 nt, Artificial Sequence
  ELANE RNA Guide
ucacguugagcuccggcagg

SEQ ID NO: 19713 - RNA, 20 nt, Artificial Sequence
  ELANE RNA Guide
uccggcaggacgcuggcgau

SEQ ID NO: 19714 - RNA, 20 nt, Artificial Sequence
  ELANE RNA Guide
uccugccggagcucaacgug

SEQ ID NO: 19715 - RNA, 20 nt, Artificial Sequence
  ELANE RNA Guide
ucgccagcguccugccggag

SEQ ID NO: 19716 - RNA, 20 nt, Artificial Sequence
  ELANE RNA Guide
ugagcuccggcaggacgcug

SEQ ID NO: 19717 - RNA, 20 nt, Artificial Sequence
  ELANE RNA Guide
ugccggagcucaacgugacg

SEQ ID NO: 19718 - RNA, 20 nt, Artificial Sequence
  ELANE RNA Guide
ugggaucgccagcguccugc

SEQ ID NO: 19719 - RNA, 20 nt, Artificial Sequence
  ELANE RNA Guide
uugagcuccggcaggacgcu

SEQ ID NO: 19720 - RNA, 21 nt, Artificial Sequence
  ELANE RNA Guide
accaccgucacguugagcucc

SEQ ID NO: 19721 - RNA, 21 nt, Artificial Sequence
  ELANE RNA Guide
accgucacguugagcuccggc

SEQ ID NO: 19722 - RNA, 21 nt, Artificial Sequence
  ELANE RNA Guide
accgugggaucgccagcgucc

SEQ ID NO: 19723 - RNA, 21 nt, Artificial Sequence
  ELANE RNA Guide
acguugagcuccggcaggacg

SEQ ID NO: 19724 - RNA, 21 nt, Artificial Sequence
  ELANE RNA Guide
agcguccugccggagcucaac

SEQ ID NO: 19725 - RNA, 21 nt, Artificial Sequence
  ELANE RNA Guide
agcuccggcaggacgcuggcg

SEQ ID NO: 19726 - RNA, 21 nt, Artificial Sequence
  ELANE RNA Guide
aucgccagcguccugccggag

SEQ ID NO: 19727 - RNA, 21 nt, Artificial Sequence
  ELANE RNA Guide
caccaccgucacguugagcuc

SEQ ID NO: 19728 - RNA, 21 nt, Artificial Sequence
  ELANE RNA Guide
caccgucacguugagcuccgg

SEQ ID NO: 19729 - RNA, 21 nt, Artificial Sequence
  ELANE RNA Guide
cacguugagcuccggcaggac

SEQ ID NO: 19730 - RNA, 21 nt, Artificial Sequence
  ELANE RNA Guide
cagcguccugccggagcucaa

SEQ ID NO: 19731 - RNA, 21 nt, Artificial Sequence
  ELANE RNA Guide
ccaccgucacguugagcuccg

SEQ ID NO: 19732 - RNA, 21 nt, Artificial Sequence
  ELANE RNA Guide
ccagcguccugccggagcuca

SEQ ID NO: 19733 - RNA, 21 nt, Artificial Sequence
  ELANE RNA Guide
ccggagcucaacgugacggug

SEQ ID NO: 19734 - RNA, 21 nt, Artificial Sequence
  ELANE RNA Guide
ccggcaggacgcuggcgaucc

SEQ ID NO: 19735 - RNA, 21 nt, Artificial Sequence
  ELANE RNA Guide
ccgucacguugagcuccggca

SEQ ID NO: 19736 - RNA, 21 nt, Artificial Sequence
  ELANE RNA Guide
ccgugggaucgccagcguccu

SEQ ID NO: 19737 - RNA, 21 nt, Artificial Sequence
  ELANE RNA Guide
ccugccggagcucaacgugac

SEQ ID NO: 19738 - RNA, 21 nt, Artificial Sequence
  ELANE RNA Guide
cgccagcguccugccggagcu

SEQ ID NO: 19739 - RNA, 21 nt, Artificial Sequence
  ELANE RNA Guide
cggcaggacgcuggcgauccc

SEQ ID NO: 19740 - RNA, 21 nt, Artificial Sequence
  ELANE RNA Guide
cgucacguugagcuccggcag

SEQ ID NO: 19741 - RNA, 21 nt, Artificial Sequence
  ELANE RNA Guide
cguccugccggagcucaacgu

SEQ ID NO: 19742 - RNA, 21 nt, Artificial Sequence
  ELANE RNA Guide
cgugggaucgccagcguccug

SEQ ID NO: 19743 - RNA, 21 nt, Artificial Sequence
  ELANE RNA Guide
cguugagcuccggcaggacgc

SEQ ID NO: 19744 - RNA, 21 nt, Artificial Sequence
  ELANE RNA Guide
cuccggcaggacgcuggcgau

SEQ ID NO: 19745 - RNA, 21 nt, Artificial Sequence
  ELANE RNA Guide
cugccggagcucaacgugacg

SEQ ID NO: 19746 - RNA, 21 nt, Artificial Sequence
  ELANE RNA Guide
gagcuccggcaggacgcuggc

SEQ ID NO: 19747 - RNA, 21 nt, Artificial Sequence
  ELANE RNA Guide
gaucgccagcguccugccgga

SEQ ID NO: 19748 - RNA, 21 nt, Artificial Sequence
  ELANE RNA Guide
gccagcguccugccggagcuc

SEQ ID NO: 19749 - RNA, 21 nt, Artificial Sequence
  ELANE RNA Guide
gccggagcucaacgugacggu

SEQ ID NO: 19750 - RNA, 21 nt, Artificial Sequence
  ELANE RNA Guide
gcguccugccggagcucaacg

SEQ ID NO: 19751 - RNA, 21 nt, Artificial Sequence
  ELANE RNA Guide
gcuccggcaggacgcuggcga

SEQ ID NO: 19752 - RNA, 21 nt, Artificial Sequence
  ELANE RNA Guide
ggaucgccagcguccugccgg

SEQ ID NO: 19753 - RNA, 21 nt, Artificial Sequence
  ELANE RNA Guide
gggaucgccagcguccugccg

SEQ ID NO: 19754 - RNA, 21 nt, Artificial Sequence
  ELANE RNA Guide
gucaccaccgucacguugagc

SEQ ID NO: 19755 - RNA, 21 nt, Artificial Sequence
  ELANE RNA Guide
gucacguugagcuccggcagg

SEQ ID NO: 19756 - RNA, 21 nt, Artificial Sequence
  ELANE RNA Guide
guccugccggagcucaacgug

SEQ ID NO: 19757 - RNA, 21 nt, Artificial Sequence
  ELANE RNA Guide
gugggaucgccagcguccugc

SEQ ID NO: 19758 - RNA, 21 nt, Artificial Sequence
  ELANE RNA Guide
guugagcuccggcaggacgcu

SEQ ID NO: 19759 - RNA, 21 nt, Artificial Sequence
  ELANE RNA Guide
ucaccaccgucacguugagcu

SEQ ID NO: 19760 - RNA, 21 nt, Artificial Sequence
  ELANE RNA Guide
ucacguugagcuccggcagga

SEQ ID NO: 19761 - RNA, 21 nt, Artificial Sequence
  ELANE RNA Guide
uccggcaggacgcuggcgauc

SEQ ID NO: 19762 - RNA, 21 nt, Artificial Sequence
  ELANE RNA Guide
uccugccggagcucaacguga

SEQ ID NO: 19763 - RNA, 21 nt, Artificial Sequence
  ELANE RNA Guide
ucgccagcguccugccggagc

SEQ ID NO: 19764 - RNA, 21 nt, Artificial Sequence
  ELANE RNA Guide
ugagcuccggcaggacgcugg

SEQ ID NO: 19765 - RNA, 21 nt, Artificial Sequence
  ELANE RNA Guide
ugccggagcucaacgugacgg

SEQ ID NO: 19766 - RNA, 21 nt, Artificial Sequence
  ELANE RNA Guide
ugggaucgccagcguccugcc

SEQ ID NO: 19767 - RNA, 21 nt, Artificial Sequence
  ELANE RNA Guide
uugagcuccggcaggacgcug

SEQ ID NO: 19768 - RNA, 22 nt, Artificial Sequence
  ELANE RNA Guide
aaccgugggaucgccagcgucc

SEQ ID NO: 19769 - RNA, 22 nt, Artificial Sequence
  ELANE RNA Guide
accaccgucacguugagcuccg

SEQ ID NO: 19770 - RNA, 22 nt, Artificial Sequence
  ELANE RNA Guide
accgucacguugagcuccggca

SEQ ID NO: 19771 - RNA, 22 nt, Artificial Sequence
  ELANE RNA Guide
accgugggaucgccagcguccu

SEQ ID NO: 19772 - RNA, 22 nt, Artificial Sequence
  ELANE RNA Guide
acguugagcuccggcaggacgc

SEQ ID NO: 19773 - RNA, 22 nt, Artificial Sequence
  ELANE RNA Guide
agcguccugccggagcucaacg

SEQ ID NO: 19774 - RNA, 22 nt, Artificial Sequence
  ELANE RNA Guide
agcuccggcaggacgcuggcga

SEQ ID NO: 19775 - RNA, 22 nt, Artificial Sequence
  ELANE RNA Guide
aucgccagcguccugccggagc

SEQ ID NO: 19776 - RNA, 22 nt, Artificial Sequence
  ELANE RNA Guide
caccaccgucacguugagcucc

SEQ ID NO: 19777 - RNA, 22 nt, Artificial Sequence
  ELANE RNA Guide
caccgucacguugagcuccggc

SEQ ID NO: 19778 - RNA, 22 nt, Artificial Sequence
  ELANE RNA Guide
cacguugagcuccggcaggacg

SEQ ID NO: 19779 - RNA, 22 nt, Artificial Sequence
  ELANE RNA Guide
cagcguccugccggagcucaac

SEQ ID NO: 19780 - RNA, 22 nt, Artificial Sequence
  ELANE RNA Guide
ccaccgucacguugagcuccgg

SEQ ID NO: 19781 - RNA, 22 nt, Artificial Sequence
  ELANE RNA Guide
ccagcguccugccggagcucaa

SEQ ID NO: 19782 - RNA, 22 nt, Artificial Sequence
  ELANE RNA Guide
ccggagcucaacgugacggugg

SEQ ID NO: 19783 - RNA, 22 nt, Artificial Sequence
  ELANE RNA Guide
ccggcaggacgcuggcgauccc

SEQ ID NO: 19784 - RNA, 22 nt, Artificial Sequence
  ELANE RNA Guide
ccgucacguugagcuccggcag

SEQ ID NO: 19785 - RNA, 22 nt, Artificial Sequence
  ELANE RNA Guide
ccgugggaucgccagcguccug

SEQ ID NO: 19786 - RNA, 22 nt, Artificial Sequence
  ELANE RNA Guide
ccugccggagcucaacgugacg

SEQ ID NO: 19787 - RNA, 22 nt, Artificial Sequence
  ELANE RNA Guide
cgccagcguccugccggagcuc

SEQ ID NO: 19788 - RNA, 22 nt, Artificial Sequence
  ELANE RNA Guide
cggcaggacgcuggcgauccca

SEQ ID NO: 19789 - RNA, 22 nt, Artificial Sequence
  ELANE RNA Guide
cgucaccaccgucacguugagc

SEQ ID NO: 19790 - RNA, 22 nt, Artificial Sequence
  ELANE RNA Guide
cgucacguugagcuccggcagg

SEQ ID NO: 19791 - RNA, 22 nt, Artificial Sequence
  ELANE RNA Guide
cguccugccggagcucaacgug

SEQ ID NO: 19792 - RNA, 22 nt, Artificial Sequence
  ELANE RNA Guide
cgugggaucgccagcguccugc

SEQ ID NO: 19793 - RNA, 22 nt, Artificial Sequence
  ELANE RNA Guide
cguugagcuccggcaggacgcu

SEQ ID NO: 19794 - RNA, 22 nt, Artificial Sequence
  ELANE RNA Guide
cuccggcaggacgcuggcgauc

SEQ ID NO: 19795 - RNA, 22 nt, Artificial Sequence
  ELANE RNA Guide
cugccggagcucaacgugacgg

SEQ ID NO: 19796 - RNA, 22 nt, Artificial Sequence
  ELANE RNA Guide
gagcuccggcaggacgcuggcg

SEQ ID NO: 19797 - RNA, 22 nt, Artificial Sequence
  ELANE RNA Guide
gaucgccagcguccugccggag

SEQ ID NO: 19798 - RNA, 22 nt, Artificial Sequence
  ELANE RNA Guide
gccagcguccugccggagcuca

SEQ ID NO: 19799 - RNA, 22 nt, Artificial Sequence
  ELANE RNA Guide
gccggagcucaacgugacggug

SEQ ID NO: 19800 - RNA, 22 nt, Artificial Sequence
  ELANE RNA Guide
gcguccugccggagcucaacgu

SEQ ID NO: 19801 - RNA, 22 nt, Artificial Sequence
  ELANE RNA Guide
gcuccggcaggacgcuggcgau

SEQ ID NO: 19802 - RNA, 22 nt, Artificial Sequence
  ELANE RNA Guide
ggaucgccagcguccugccgga

SEQ ID NO: 19803 - RNA, 22 nt, Artificial Sequence
  ELANE RNA Guide
gggaucgccagcguccugccgg

SEQ ID NO: 19804 - RNA, 22 nt, Artificial Sequence
  ELANE RNA Guide
gucaccaccgucacguugagcu

SEQ ID NO: 19805 - RNA, 22 nt, Artificial Sequence
  ELANE RNA Guide
gucacguugagcuccggcagga

SEQ ID NO: 19806 - RNA, 22 nt, Artificial Sequence
  ELANE RNA Guide
guccugccggagcucaacguga

SEQ ID NO: 19807 - RNA, 22 nt, Artificial Sequence
  ELANE RNA Guide
gugggaucgccagcguccugcc

SEQ ID NO: 19808 - RNA, 22 nt, Artificial Sequence
  ELANE RNA Guide
guugagcuccggcaggacgcug

SEQ ID NO: 19809 - RNA, 22 nt, Artificial Sequence
  ELANE RNA Guide
ucaccaccgucacguugagcuc

SEQ ID NO: 19810 - RNA, 22 nt, Artificial Sequence
  ELANE RNA Guide
ucacguugagcuccggcaggac

SEQ ID NO: 19811 - RNA, 22 nt, Artificial Sequence
  ELANE RNA Guide
uccggcaggacgcuggcgaucc

SEQ ID NO: 19812 - RNA, 22 nt, Artificial Sequence
  ELANE RNA Guide
uccugccggagcucaacgugac

SEQ ID NO: 19813 - RNA, 22 nt, Artificial Sequence
  ELANE RNA Guide
ucgccagcguccugccggagcu

SEQ ID NO: 19814 - RNA, 22 nt, Artificial Sequence
  ELANE RNA Guide
ugagcuccggcaggacgcuggc

SEQ ID NO: 19815 - RNA, 22 nt, Artificial Sequence
  ELANE RNA Guide
ugccggagcucaacgugacggu

SEQ ID NO: 19816 - RNA, 22 nt, Artificial Sequence
  ELANE RNA Guide
ugggaucgccagcguccugccg

SEQ ID NO: 19817 - RNA, 22 nt, Artificial Sequence
  ELANE RNA Guide
uugagcuccggcaggacgcugg

SEQ ID NO: 19818 - RNA, 20 nt, Artificial Sequence
  ELANE RNA Guide
accaccgucacguugggcuc

SEQ ID NO: 19819 - RNA, 20 nt, Artificial Sequence
  ELANE RNA Guide
accgucacguugggcuccug

SEQ ID NO: 19820 - RNA, 20 nt, Artificial Sequence
  ELANE RNA Guide
acgucaccaccgucacguug

SEQ ID NO: 19821 - RNA, 20 nt, Artificial Sequence
  ELANE RNA Guide
acguugggcuccugcaggac

SEQ ID NO: 19822 - RNA, 20 nt, Artificial Sequence
  ELANE RNA Guide
agcccaacgugacgguggug

SEQ ID NO: 19823 - RNA, 20 nt, Artificial Sequence
  ELANE RNA Guide
agcguccugcaggagcccaa

SEQ ID NO: 19824 - RNA, 20 nt, Artificial Sequence
  ELANE RNA Guide
aggagcccaacgugacggug

SEQ ID NO: 19825 - RNA, 20 nt, Artificial Sequence
  ELANE RNA Guide
aucgccagcguccugcagga

SEQ ID NO: 19826 - RNA, 20 nt, Artificial Sequence
  ELANE RNA Guide
caccaccgucacguugggcu

SEQ ID NO: 19827 - RNA, 20 nt, Artificial Sequence
  ELANE RNA Guide
caccgucacguugggcuccu

SEQ ID NO: 19828 - RNA, 20 nt, Artificial Sequence
  ELANE RNA Guide
cacguugggcuccugcagga

SEQ ID NO: 19829 - RNA, 20 nt, Artificial Sequence
  ELANE RNA Guide
cagcguccugcaggagccca

SEQ ID NO: 19830 - RNA, 20 nt, Artificial Sequence
  ELANE RNA Guide
caggagcccaacgugacggu

SEQ ID NO: 19831 - RNA, 20 nt, Artificial Sequence
  ELANE RNA Guide
ccaccgucacguugggcucc

SEQ ID NO: 19832 - RNA, 20 nt, Artificial Sequence
  ELANE RNA Guide
ccagcguccugcaggagccc

SEQ ID NO: 19833 - RNA, 20 nt, Artificial Sequence
  ELANE RNA Guide
cccaacgugacgguggugac

SEQ ID NO: 19834 - RNA, 20 nt, Artificial Sequence
  ELANE RNA Guide
ccgucacguugggcuccugc

SEQ ID NO: 19835 - RNA, 20 nt, Artificial Sequence
  ELANE RNA Guide
ccugcaggagcccaacguga

SEQ ID NO: 19836 - RNA, 20 nt, Artificial Sequence
  ELANE RNA Guide
cgccagcguccugcaggagc

SEQ ID NO: 19837 - RNA, 20 nt, Artificial Sequence
  ELANE RNA Guide
cgucaccaccgucacguugg

SEQ ID NO: 19838 - RNA, 20 nt, Artificial Sequence
  ELANE RNA Guide
cgucacguugggcuccugca

SEQ ID NO: 19839 - RNA, 20 nt, Artificial Sequence
  ELANE RNA Guide
cguccugcaggagcccaacg

SEQ ID NO: 19840 - RNA, 20 nt, Artificial Sequence
  ELANE RNA Guide
cguugggcuccugcaggacg

SEQ ID NO: 19841 - RNA, 20 nt, Artificial Sequence
  ELANE RNA Guide
cugcaggagcccaacgugac

SEQ ID NO: 19842 - RNA, 20 nt, Artificial Sequence
  ELANE RNA Guide
gacgucaccaccgucacguu

SEQ ID NO: 19843 - RNA, 20 nt, Artificial Sequence
  ELANE RNA Guide
gagcccaacgugacgguggu

SEQ ID NO: 19844 - RNA, 20 nt, Artificial Sequence
  ELANE RNA Guide
gaucgccagcguccugcagg

SEQ ID NO: 19845 - RNA, 20 nt, Artificial Sequence
  ELANE RNA Guide
gcaggagcccaacgugacgg

SEQ ID NO: 19846 - RNA, 20 nt, Artificial Sequence
  ELANE RNA Guide
gccagcguccugcaggagcc

SEQ ID NO: 19847 - RNA, 20 nt, Artificial Sequence
  ELANE RNA Guide
gcccaacgugacggugguga

SEQ ID NO: 19848 - RNA, 20 nt, Artificial Sequence
  ELANE RNA Guide
gcguccugcaggagcccaac

SEQ ID NO: 19849 - RNA, 20 nt, Artificial Sequence
  ELANE RNA Guide
ggacgucaccaccgucacgu

SEQ ID NO: 19850 - RNA, 20 nt, Artificial Sequence
  ELANE RNA Guide
ggagcccaacgugacggugg

SEQ ID NO: 19851 - RNA, 20 nt, Artificial Sequence
  ELANE RNA Guide
gggacgucaccaccgucacg

SEQ ID NO: 19852 - RNA, 20 nt, Artificial Sequence
  ELANE RNA Guide
gggcuccugcaggacgcugg

SEQ ID NO: 19853 - RNA, 20 nt, Artificial Sequence
  ELANE RNA Guide
gucaccaccgucacguuggg

SEQ ID NO: 19854 - RNA, 20 nt, Artificial Sequence
  ELANE RNA Guide
gucacguugggcuccugcag

SEQ ID NO: 19855 - RNA, 20 nt, Artificial Sequence
  ELANE RNA Guide
guccugcaggagcccaacgu

SEQ ID NO: 19856 - RNA, 20 nt, Artificial Sequence
  ELANE RNA Guide
guugggcuccugcaggacgc

SEQ ID NO: 19857 - RNA, 20 nt, Artificial Sequence
  ELANE RNA Guide
ucaccaccgucacguugggc

SEQ ID NO: 19858 - RNA, 20 nt, Artificial Sequence
  ELANE RNA Guide
ucacguugggcuccugcagg

SEQ ID NO: 19859 - RNA, 20 nt, Artificial Sequence
  ELANE RNA Guide
uccugcaggagcccaacgug

SEQ ID NO: 19860 - RNA, 20 nt, Artificial Sequence
  ELANE RNA Guide
ucgccagcguccugcaggag

SEQ ID NO: 19861 - RNA, 20 nt, Artificial Sequence
  ELANE RNA Guide
ugcaggagcccaacgugacg

SEQ ID NO: 19862 - RNA, 20 nt, Artificial Sequence
  ELANE RNA Guide
ugggcuccugcaggacgcug

SEQ ID NO: 19863 - RNA, 20 nt, Artificial Sequence
  ELANE RNA Guide
uugggcuccugcaggacgcu

SEQ ID NO: 19864 - RNA, 21 nt, Artificial Sequence
  ELANE RNA Guide
accaccgucacguugggcucc

SEQ ID NO: 19865 - RNA, 21 nt, Artificial Sequence
  ELANE RNA Guide
accgucacguugggcuccugc

SEQ ID NO: 19866 - RNA, 21 nt, Artificial Sequence
  ELANE RNA Guide
acgucaccaccgucacguugg

SEQ ID NO: 19867 - RNA, 21 nt, Artificial Sequence
  ELANE RNA Guide
acguugggcuccugcaggacg

SEQ ID NO: 19868 - RNA, 21 nt, Artificial Sequence
  ELANE RNA Guide
agcccaacgugacggugguga

SEQ ID NO: 19869 - RNA, 21 nt, Artificial Sequence
  ELANE RNA Guide
agcguccugcaggagcccaac

SEQ ID NO: 19870 - RNA, 21 nt, Artificial Sequence
  ELANE RNA Guide
aggagcccaacgugacggugg

SEQ ID NO: 19871 - RNA, 21 nt, Artificial Sequence
  ELANE RNA Guide
agggacgucaccaccgucacg

SEQ ID NO: 19872 - RNA, 21 nt, Artificial Sequence
  ELANE RNA Guide
aucgccagcguccugcaggag

SEQ ID NO: 19873 - RNA, 21 nt, Artificial Sequence
  ELANE RNA Guide
caccaccgucacguugggcuc

SEQ ID NO: 19874 - RNA, 21 nt, Artificial Sequence
  ELANE RNA Guide
caccgucacguugggcuccug

SEQ ID NO: 19875 - RNA, 21 nt, Artificial Sequence
  ELANE RNA Guide
cacguugggcuccugcaggac

SEQ ID NO: 19876 - RNA, 21 nt, Artificial Sequence
  ELANE RNA Guide
cagcguccugcaggagcccaa

SEQ ID NO: 19877 - RNA, 21 nt, Artificial Sequence
  ELANE RNA Guide
caggagcccaacgugacggug

SEQ ID NO: 19878 - RNA, 21 nt, Artificial Sequence
  ELANE RNA Guide
ccaccgucacguugggcuccu

SEQ ID NO: 19879 - RNA, 21 nt, Artificial Sequence
  ELANE RNA Guide
ccagcguccugcaggagccca

SEQ ID NO: 19880 - RNA, 21 nt, Artificial Sequence
  ELANE RNA Guide
cccaacgugacgguggugacg

SEQ ID NO: 19881 - RNA, 21 nt, Artificial Sequence
  ELANE RNA Guide
ccgucacguugggcuccugca

SEQ ID NO: 19882 - RNA, 21 nt, Artificial Sequence
  ELANE RNA Guide
ccugcaggagcccaacgugac

SEQ ID NO: 19883 - RNA, 21 nt, Artificial Sequence
  ELANE RNA Guide
cgccagcguccugcaggagcc

SEQ ID NO: 19884 - RNA, 21 nt, Artificial Sequence
  ELANE RNA Guide
cgucaccaccgucacguuggg

SEQ ID NO: 19885 - RNA, 21 nt, Artificial Sequence
  ELANE RNA Guide
cgucacguugggcuccugcag

SEQ ID NO: 19886 - RNA, 21 nt, Artificial Sequence
  ELANE RNA Guide
cguccugcaggagcccaacgu

SEQ ID NO: 19887 - RNA, 21 nt, Artificial Sequence
  ELANE RNA Guide
cguugggcuccugcaggacgc

SEQ ID NO: 19888 - RNA, 21 nt, Artificial Sequence
  ELANE RNA Guide
cugcaggagcccaacgugacg

SEQ ID NO: 19889 - RNA, 21 nt, Artificial Sequence
  ELANE RNA Guide
gacgucaccaccgucacguug

SEQ ID NO: 19890 - RNA, 21 nt, Artificial Sequence
  ELANE RNA Guide
gagcccaacgugacgguggug

SEQ ID NO: 19891 - RNA, 21 nt, Artificial Sequence
  ELANE RNA Guide
gaucgccagcguccugcagga

SEQ ID NO: 19892 - RNA, 21 nt, Artificial Sequence
  ELANE RNA Guide
gcaggagcccaacgugacggu

SEQ ID NO: 19893 - RNA, 21 nt, Artificial Sequence
  ELANE RNA Guide
gccagcguccugcaggagccc

SEQ ID NO: 19894 - RNA, 21 nt, Artificial Sequence
  ELANE RNA Guide
gcccaacgugacgguggugac

SEQ ID NO: 19895 - RNA, 21 nt, Artificial Sequence
  ELANE RNA Guide
gcguccugcaggagcccaacg

SEQ ID NO: 19896 - RNA, 21 nt, Artificial Sequence
  ELANE RNA Guide
ggacgucaccaccgucacguu

SEQ ID NO: 19897 - RNA, 21 nt, Artificial Sequence
  ELANE RNA Guide
ggagcccaacgugacgguggu

SEQ ID NO: 19898 - RNA, 21 nt, Artificial Sequence
  ELANE RNA Guide
ggaucgccagcguccugcagg

SEQ ID NO: 19899 - RNA, 21 nt, Artificial Sequence
  ELANE RNA Guide
gggacgucaccaccgucacgu

SEQ ID NO: 19900 - RNA, 21 nt, Artificial Sequence
  ELANE RNA Guide
gggcuccugcaggacgcuggc

SEQ ID NO: 19901 - RNA, 21 nt, Artificial Sequence
  ELANE RNA Guide
gucaccaccgucacguugggc

SEQ ID NO: 19902 - RNA, 21 nt, Artificial Sequence
  ELANE RNA Guide
gucacguugggcuccugcagg

SEQ ID NO: 19903 - RNA, 21 nt, Artificial Sequence
  ELANE RNA Guide
guccugcaggagcccaacgug

SEQ ID NO: 19904 - RNA, 21 nt, Artificial Sequence
  ELANE RNA Guide
guugggcuccugcaggacgcu

SEQ ID NO: 19905 - RNA, 21 nt, Artificial Sequence
  ELANE RNA Guide
ucaccaccgucacguugggcu

SEQ ID NO: 19906 - RNA, 21 nt, Artificial Sequence
  ELANE RNA Guide
ucacguugggcuccugcagga

SEQ ID NO: 19907 - RNA, 21 nt, Artificial Sequence
  ELANE RNA Guide
uccugcaggagcccaacguga

SEQ ID NO: 19908 - RNA, 21 nt, Artificial Sequence
  ELANE RNA Guide
ucgccagcguccugcaggagc

SEQ ID NO: 19909 - RNA, 21 nt, Artificial Sequence
  ELANE RNA Guide
ugcaggagcccaacgugacgg

SEQ ID NO: 19910 - RNA, 21 nt, Artificial Sequence
  ELANE RNA Guide
ugggcuccugcaggacgcugg

SEQ ID NO: 19911 - RNA, 21 nt, Artificial Sequence
  ELANE RNA Guide
uugggcuccugcaggacgcug

SEQ ID NO: 19912 - RNA, 22 nt, Artificial Sequence
  ELANE RNA Guide
accaccgucacguugggcuccu

SEQ ID NO: 19913 - RNA, 22 nt, Artificial Sequence
  ELANE RNA Guide
accgucacguugggcuccugca

SEQ ID NO: 19914 - RNA, 22 nt, Artificial Sequence
  ELANE RNA Guide
acgucaccaccgucacguuggg

SEQ ID NO: 19915 - RNA, 22 nt, Artificial Sequence
  ELANE RNA Guide
acguugggcuccugcaggacgc

SEQ ID NO: 19916 - RNA, 22 nt, Artificial Sequence
  ELANE RNA Guide
agcccaacgugacgguggugac

SEQ ID NO: 19917 - RNA, 22 nt, Artificial Sequence
  ELANE RNA Guide
agcguccugcaggagcccaacg

SEQ ID NO: 19918 - RNA, 22 nt, Artificial Sequence
  ELANE RNA Guide
aggagcccaacgugacgguggu

SEQ ID NO: 19919 - RNA, 22 nt, Artificial Sequence
  ELANE RNA Guide
agggacgucaccaccgucacgu

SEQ ID NO: 19920 - RNA, 22 nt, Artificial Sequence
  ELANE RNA Guide
aucgccagcguccugcaggagc

SEQ ID NO: 19921 - RNA, 22 nt, Artificial Sequence
  ELANE RNA Guide
caccaccgucacguugggcucc

SEQ ID NO: 19922 - RNA, 22 nt, Artificial Sequence
  ELANE RNA Guide
caccgucacguugggcuccugc

SEQ ID NO: 19923 - RNA, 22 nt, Artificial Sequence
  ELANE RNA Guide
cacguugggcuccugcaggacg

SEQ ID NO: 19924 - RNA, 22 nt, Artificial Sequence
  ELANE RNA Guide
cagcguccugcaggagcccaac

SEQ ID NO: 19925 - RNA, 22 nt, Artificial Sequence
  ELANE RNA Guide
caggagcccaacgugacggugg

SEQ ID NO: 19926 - RNA, 22 nt, Artificial Sequence
  ELANE RNA Guide
ccaccgucacguugggcuccug

SEQ ID NO: 19927 - RNA, 22 nt, Artificial Sequence
  ELANE RNA Guide
ccagcguccugcaggagcccaa

SEQ ID NO: 19928 - RNA, 22 nt, Artificial Sequence
  ELANE RNA Guide
cccaacgugacgguggugacgu

SEQ ID NO: 19929 - RNA, 22 nt, Artificial Sequence
  ELANE RNA Guide
ccgucacguugggcuccugcag

SEQ ID NO: 19930 - RNA, 22 nt, Artificial Sequence
  ELANE RNA Guide
ccugcaggagcccaacgugacg

SEQ ID NO: 19931 - RNA, 22 nt, Artificial Sequence
  ELANE RNA Guide
cgccagcguccugcaggagccc

SEQ ID NO: 19932 - RNA, 22 nt, Artificial Sequence
  ELANE RNA Guide
cgucaccaccgucacguugggc

SEQ ID NO: 19933 - RNA, 22 nt, Artificial Sequence
  ELANE RNA Guide
cgucacguugggcuccugcagg

SEQ ID NO: 19934 - RNA, 22 nt, Artificial Sequence
  ELANE RNA Guide
cguccugcaggagcccaacgug

SEQ ID NO: 19935 - RNA, 22 nt, Artificial Sequence
  ELANE RNA Guide
cguugggcuccugcaggacgcu

SEQ ID NO: 19936 - RNA, 22 nt, Artificial Sequence
  ELANE RNA Guide
cugcaggagcccaacgugacgg

SEQ ID NO: 19937 - RNA, 22 nt, Artificial Sequence
  ELANE RNA Guide
gacgucaccaccgucacguugg

SEQ ID NO: 19938 - RNA, 22 nt, Artificial Sequence
  ELANE RNA Guide
gagcccaacgugacggugguga

SEQ ID NO: 19939 - RNA, 22 nt, Artificial Sequence
  ELANE RNA Guide
gagggacgucaccaccgucacg

SEQ ID NO: 19940 - RNA, 22 nt, Artificial Sequence
  ELANE RNA Guide
gaucgccagcguccugcaggag

SEQ ID NO: 19941 - RNA, 22 nt, Artificial Sequence
  ELANE RNA Guide
gcaggagcccaacgugacggug

SEQ ID NO: 19942 - RNA, 22 nt, Artificial Sequence
  ELANE RNA Guide
gccagcguccugcaggagccca

SEQ ID NO: 19943 - RNA, 22 nt, Artificial Sequence
  ELANE RNA Guide
gcccaacgugacgguggugacg

SEQ ID NO: 19944 - RNA, 22 nt, Artificial Sequence
  ELANE RNA Guide
gcguccugcaggagcccaacgu

SEQ ID NO: 19945 - RNA, 22 nt, Artificial Sequence
  ELANE RNA Guide
ggacgucaccaccgucacguug

SEQ ID NO: 19946 - RNA, 22 nt, Artificial Sequence
  ELANE RNA Guide
ggagcccaacgugacgguggug

SEQ ID NO: 19947 - RNA, 22 nt, Artificial Sequence
  ELANE RNA Guide
ggaucgccagcguccugcagga

SEQ ID NO: 19948 - RNA, 22 nt, Artificial Sequence
  ELANE RNA Guide
gggacgucaccaccgucacguu

SEQ ID NO: 19949 - RNA, 22 nt, Artificial Sequence
  ELANE RNA Guide
gggaucgccagcguccugcagg

SEQ ID NO: 19950 - RNA, 22 nt, Artificial Sequence
  ELANE RNA Guide
gggcuccugcaggacgcuggcg

SEQ ID NO: 19951 - RNA, 22 nt, Artificial Sequence
  ELANE RNA Guide
gucaccaccgucacguugggcu

SEQ ID NO: 19952 - RNA, 22 nt, Artificial Sequence
  ELANE RNA Guide
gucacguugggcuccugcagga

SEQ ID NO: 19953 - RNA, 22 nt, Artificial Sequence
  ELANE RNA Guide
guccugcaggagcccaacguga

SEQ ID NO: 19954 - RNA, 22 nt, Artificial Sequence
  ELANE RNA Guide
guugggcuccugcaggacgcug

SEQ ID NO: 19955 - RNA, 22 nt, Artificial Sequence
  ELANE RNA Guide
ucaccaccgucacguugggcuc

SEQ ID NO: 19956 - RNA, 22 nt, Artificial Sequence
  ELANE RNA Guide
ucacguugggcuccugcaggac

SEQ ID NO: 19957 - RNA, 22 nt, Artificial Sequence
  ELANE RNA Guide
uccugcaggagcccaacgugac

SEQ ID NO: 19958 - RNA, 22 nt, Artificial Sequence
  ELANE RNA Guide
ucgccagcguccugcaggagcc

SEQ ID NO: 19959 - RNA, 22 nt, Artificial Sequence
  ELANE RNA Guide
ugcaggagcccaacgugacggu

SEQ ID NO: 19960 - RNA, 22 nt, Artificial Sequence
  ELANE RNA Guide
ugggcuccugcaggacgcuggc

SEQ ID NO: 19961 - RNA, 22 nt, Artificial Sequence
  ELANE RNA Guide
uugggcuccugcaggacgcugg

SEQ ID NO: 19962 - RNA, 20 nt, Artificial Sequence
  ELANE RNA Guide
aaccgucgcagcaacgucug

SEQ ID NO: 19963 - RNA, 20 nt, Artificial Sequence
  ELANE RNA Guide
acgguugagcuccugcagga

SEQ ID NO: 19964 - RNA, 20 nt, Artificial Sequence
  ELANE RNA Guide
acguugcugcgacgguugag

SEQ ID NO: 19965 - RNA, 20 nt, Artificial Sequence
  ELANE RNA Guide
agacguugcugcgacgguug

SEQ ID NO: 19966 - RNA, 20 nt, Artificial Sequence
  ELANE RNA Guide
agcguccugcaggagcucaa

SEQ ID NO: 19967 - RNA, 20 nt, Artificial Sequence
  ELANE RNA Guide
agcucaaccgucgcagcaac

SEQ ID NO: 19968 - RNA, 20 nt, Artificial Sequence
  ELANE RNA Guide
aggagcucaaccgucgcagc

SEQ ID NO: 19969 - RNA, 20 nt, Artificial Sequence
  ELANE RNA Guide
agugcagacguugcugcgac

SEQ ID NO: 19970 - RNA, 20 nt, Artificial Sequence
  ELANE RNA Guide
caaccgucgcagcaacgucu

SEQ ID NO: 19971 - RNA, 20 nt, Artificial Sequence
  ELANE RNA Guide
cagacguugcugcgacgguu

SEQ ID NO: 19972 - RNA, 20 nt, Artificial Sequence
  ELANE RNA Guide
cagcguccugcaggagcuca

SEQ ID NO: 19973 - RNA, 20 nt, Artificial Sequence
  ELANE RNA Guide
caggagcucaaccgucgcag

SEQ ID NO: 19974 - RNA, 20 nt, Artificial Sequence
  ELANE RNA Guide
ccagcguccugcaggagcuc

SEQ ID NO: 19975 - RNA, 20 nt, Artificial Sequence
  ELANE RNA Guide
ccugcaggagcucaaccguc

SEQ ID NO: 19976 - RNA, 20 nt, Artificial Sequence
  ELANE RNA Guide
cgacgguugagcuccugcag

SEQ ID NO: 19977 - RNA, 20 nt, Artificial Sequence
  ELANE RNA Guide
cgguugagcuccugcaggac

SEQ ID NO: 19978 - RNA, 20 nt, Artificial Sequence
  ELANE RNA Guide
cguccugcaggagcucaacc

SEQ ID NO: 19979 - RNA, 20 nt, Artificial Sequence
  ELANE RNA Guide
cguugcugcgacgguugagc

SEQ ID NO: 19980 - RNA, 20 nt, Artificial Sequence
  ELANE RNA Guide
cucaaccgucgcagcaacgu

SEQ ID NO: 19981 - RNA, 20 nt, Artificial Sequence
  ELANE RNA Guide
cugcaggagcucaaccgucg

SEQ ID NO: 19982 - RNA, 20 nt, Artificial Sequence
  ELANE RNA Guide
cugcgacgguugagcuccug

SEQ ID NO: 19983 - RNA, 20 nt, Artificial Sequence
  ELANE RNA Guide
gacgguugagcuccugcagg

SEQ ID NO: 19984 - RNA, 20 nt, Artificial Sequence
  ELANE RNA Guide
gacguugcugcgacgguuga

SEQ ID NO: 19985 - RNA, 20 nt, Artificial Sequence
  ELANE RNA Guide
gagcucaaccgucgcagcaa

SEQ ID NO: 19986 - RNA, 20 nt, Artificial Sequence
  ELANE RNA Guide
gagugcagacguugcugcga

SEQ ID NO: 19987 - RNA, 20 nt, Artificial Sequence
  ELANE RNA Guide
gcagacguugcugcgacggu

SEQ ID NO: 19988 - RNA, 20 nt, Artificial Sequence
  ELANE RNA Guide
gcaggagcucaaccgucgca

SEQ ID NO: 19989 - RNA, 20 nt, Artificial Sequence
  ELANE RNA Guide
gcgacgguugagcuccugca

SEQ ID NO: 19990 - RNA, 20 nt, Artificial Sequence
  ELANE RNA Guide
gcguccugcaggagcucaac

SEQ ID NO: 19991 - RNA, 20 nt, Artificial Sequence
  ELANE RNA Guide
gcucaaccgucgcagcaacg

SEQ ID NO: 19992 - RNA, 20 nt, Artificial Sequence
  ELANE RNA Guide
gcugcgacgguugagcuccu

SEQ ID NO: 19993 - RNA, 20 nt, Artificial Sequence
  ELANE RNA Guide
ggagcucaaccgucgcagca

SEQ ID NO: 19994 - RNA, 20 nt, Artificial Sequence
  ELANE RNA Guide
gguugagcuccugcaggacg

SEQ ID NO: 19995 - RNA, 20 nt, Artificial Sequence
  ELANE RNA Guide
guccugcaggagcucaaccg

SEQ ID NO: 19996 - RNA, 20 nt, Artificial Sequence
  ELANE RNA Guide
gugcagacguugcugcgacg

SEQ ID NO: 19997 - RNA, 20 nt, Artificial Sequence
  ELANE RNA Guide
guugcugcgacgguugagcu

SEQ ID NO: 19998 - RNA, 20 nt, Artificial Sequence
  ELANE RNA Guide
ucaaccgucgcagcaacguc

SEQ ID NO: 19999 - RNA, 20 nt, Artificial Sequence
  ELANE RNA Guide
uccugcaggagcucaaccgu

SEQ ID NO: 20000 - RNA, 20 nt, Artificial Sequence
  ELANE RNA Guide
ugcagacguugcugcgacgg

SEQ ID NO: 20001 - RNA, 20 nt, Artificial Sequence
  ELANE RNA Guide
ugcaggagcucaaccgucgc

SEQ ID NO: 20002 - RNA, 20 nt, Artificial Sequence
  ELANE RNA Guide
ugcgacgguugagcuccugc

SEQ ID NO: 20003 - RNA, 20 nt, Artificial Sequence
  ELANE RNA Guide
ugcugcgacgguugagcucc

SEQ ID NO: 20004 - RNA, 20 nt, Artificial Sequence
  ELANE RNA Guide
uugcugcgacgguugagcuc

SEQ ID NO: 20005 - RNA, 21 nt, Artificial Sequence
  ELANE RNA Guide
aaccgucgcagcaacgucugc

SEQ ID NO: 20006 - RNA, 21 nt, Artificial Sequence
  ELANE RNA Guide
acgguugagcuccugcaggac

SEQ ID NO: 20007 - RNA, 21 nt, Artificial Sequence
  ELANE RNA Guide
acguugcugcgacgguugagc

SEQ ID NO: 20008 - RNA, 21 nt, Artificial Sequence
  ELANE RNA Guide
agacguugcugcgacgguuga

SEQ ID NO: 20009 - RNA, 21 nt, Artificial Sequence
  ELANE RNA Guide
agagugcagacguugcugcga

SEQ ID NO: 20010 - RNA, 21 nt, Artificial Sequence
  ELANE RNA Guide
agcguccugcaggagcucaac

SEQ ID NO: 20011 - RNA, 21 nt, Artificial Sequence
  ELANE RNA Guide
agcucaaccgucgcagcaacg

SEQ ID NO: 20012 - RNA, 21 nt, Artificial Sequence
  ELANE RNA Guide
aggagcucaaccgucgcagca

SEQ ID NO: 20013 - RNA, 21 nt, Artificial Sequence
  ELANE RNA Guide
agugcagacguugcugcgacg

SEQ ID NO: 20014 - RNA, 21 nt, Artificial Sequence
  ELANE RNA Guide
caaccgucgcagcaacgucug

SEQ ID NO: 20015 - RNA, 21 nt, Artificial Sequence
  ELANE RNA Guide
cagacguugcugcgacgguug

SEQ ID NO: 20016 - RNA, 21 nt, Artificial Sequence
  ELANE RNA Guide
cagcguccugcaggagcucaa

SEQ ID NO: 20017 - RNA, 21 nt, Artificial Sequence
  ELANE RNA Guide
caggagcucaaccgucgcagc

SEQ ID NO: 20018 - RNA, 21 nt, Artificial Sequence
  ELANE RNA Guide
ccagcguccugcaggagcuca

SEQ ID NO: 20019 - RNA, 21 nt, Artificial Sequence
  ELANE RNA Guide
ccugcaggagcucaaccgucg

SEQ ID NO: 20020 - RNA, 21 nt, Artificial Sequence
  ELANE RNA Guide
cgacgguugagcuccugcagg

SEQ ID NO: 20021 - RNA, 21 nt, Artificial Sequence
  ELANE RNA Guide
cgguugagcuccugcaggacg

SEQ ID NO: 20022 - RNA, 21 nt, Artificial Sequence
  ELANE RNA Guide
cguccugcaggagcucaaccg

SEQ ID NO: 20023 - RNA, 21 nt, Artificial Sequence
  ELANE RNA Guide
cguugcugcgacgguugagcu

SEQ ID NO: 20024 - RNA, 21 nt, Artificial Sequence
  ELANE RNA Guide
cucaaccgucgcagcaacguc

SEQ ID NO: 20025 - RNA, 21 nt, Artificial Sequence
  ELANE RNA Guide
cugcaggagcucaaccgucgc

SEQ ID NO: 20026 - RNA, 21 nt, Artificial Sequence
  ELANE RNA Guide
cugcgacgguugagcuccugc

SEQ ID NO: 20027 - RNA, 21 nt, Artificial Sequence
  ELANE RNA Guide
gacgguugagcuccugcagga

SEQ ID NO: 20028 - RNA, 21 nt, Artificial Sequence
  ELANE RNA Guide
gacguugcugcgacgguugag

SEQ ID NO: 20029 - RNA, 21 nt, Artificial Sequence
  ELANE RNA Guide
gagcucaaccgucgcagcaac

SEQ ID NO: 20030 - RNA, 21 nt, Artificial Sequence
  ELANE RNA Guide
gagugcagacguugcugcgac

SEQ ID NO: 20031 - RNA, 21 nt, Artificial Sequence
  ELANE RNA Guide
gcagacguugcugcgacgguu

SEQ ID NO: 20032 - RNA, 21 nt, Artificial Sequence
  ELANE RNA Guide
gcaggagcucaaccgucgcag

SEQ ID NO: 20033 - RNA, 21 nt, Artificial Sequence
  ELANE RNA Guide
gccagcguccugcaggagcuc

SEQ ID NO: 20034 - RNA, 21 nt, Artificial Sequence
  ELANE RNA Guide
gcgacgguugagcuccugcag

SEQ ID NO: 20035 - RNA, 21 nt, Artificial Sequence
  ELANE RNA Guide
gcguccugcaggagcucaacc

SEQ ID NO: 20036 - RNA, 21 nt, Artificial Sequence
  ELANE RNA Guide
gcucaaccgucgcagcaacgu

SEQ ID NO: 20037 - RNA, 21 nt, Artificial Sequence
  ELANE RNA Guide
gcugcgacgguugagcuccug

SEQ ID NO: 20038 - RNA, 21 nt, Artificial Sequence
  ELANE RNA Guide
ggagcucaaccgucgcagcaa

SEQ ID NO: 20039 - RNA, 21 nt, Artificial Sequence
  ELANE RNA Guide
gguugagcuccugcaggacgc

SEQ ID NO: 20040 - RNA, 21 nt, Artificial Sequence
  ELANE RNA Guide
guccugcaggagcucaaccgu

SEQ ID NO: 20041 - RNA, 21 nt, Artificial Sequence
  ELANE RNA Guide
gugcagacguugcugcgacgg

SEQ ID NO: 20042 - RNA, 21 nt, Artificial Sequence
  ELANE RNA Guide
guugcugcgacgguugagcuc

SEQ ID NO: 20043 - RNA, 21 nt, Artificial Sequence
  ELANE RNA Guide
ucaaccgucgcagcaacgucu

SEQ ID NO: 20044 - RNA, 21 nt, Artificial Sequence
  ELANE RNA Guide
uccugcaggagcucaaccguc

SEQ ID NO: 20045 - RNA, 21 nt, Artificial Sequence
  ELANE RNA Guide
ugcagacguugcugcgacggu

SEQ ID NO: 20046 - RNA, 21 nt, Artificial Sequence
  ELANE RNA Guide
ugcaggagcucaaccgucgca

SEQ ID NO: 20047 - RNA, 21 nt, Artificial Sequence
  ELANE RNA Guide
ugcgacgguugagcuccugca

SEQ ID NO: 20048 - RNA, 21 nt, Artificial Sequence
  ELANE RNA Guide
ugcugcgacgguugagcuccu

SEQ ID NO: 20049 - RNA, 21 nt, Artificial Sequence
  ELANE RNA Guide
uugcugcgacgguugagcucc

SEQ ID NO: 20050 - RNA, 22 nt, Artificial Sequence
  ELANE RNA Guide
aaccgucgcagcaacgucugca

SEQ ID NO: 20051 - RNA, 22 nt, Artificial Sequence
  ELANE RNA Guide
acgguugagcuccugcaggacg

SEQ ID NO: 20052 - RNA, 22 nt, Artificial Sequence
  ELANE RNA Guide
acguugcugcgacgguugagcu

SEQ ID NO: 20053 - RNA, 22 nt, Artificial Sequence
  ELANE RNA Guide
agacguugcugcgacgguugag

SEQ ID NO: 20054 - RNA, 22 nt, Artificial Sequence
  ELANE RNA Guide
agagugcagacguugcugcgac

SEQ ID NO: 20055 - RNA, 22 nt, Artificial Sequence
  ELANE RNA Guide
agcguccugcaggagcucaacc

SEQ ID NO: 20056 - RNA, 22 nt, Artificial Sequence
  ELANE RNA Guide
agcucaaccgucgcagcaacgu

SEQ ID NO: 20057 - RNA, 22 nt, Artificial Sequence
  ELANE RNA Guide
aggagcucaaccgucgcagcaa

SEQ ID NO: 20058 - RNA, 22 nt, Artificial Sequence
  ELANE RNA Guide
agugcagacguugcugcgacgg

SEQ ID NO: 20059 - RNA, 22 nt, Artificial Sequence
  ELANE RNA Guide
caaccgucgcagcaacgucugc

SEQ ID NO: 20060 - RNA, 22 nt, Artificial Sequence
  ELANE RNA Guide
cagacguugcugcgacgguuga

SEQ ID NO: 20061 - RNA, 22 nt, Artificial Sequence
  ELANE RNA Guide
cagcguccugcaggagcucaac

SEQ ID NO: 20062 - RNA, 22 nt, Artificial Sequence
  ELANE RNA Guide
caggagcucaaccgucgcagca

SEQ ID NO: 20063 - RNA, 22 nt, Artificial Sequence
  ELANE RNA Guide
ccagcguccugcaggagcucaa

SEQ ID NO: 20064 - RNA, 22 nt, Artificial Sequence
  ELANE RNA Guide
ccugcaggagcucaaccgucgc

SEQ ID NO: 20065 - RNA, 22 nt, Artificial Sequence
  ELANE RNA Guide
cgacgguugagcuccugcagga

SEQ ID NO: 20066 - RNA, 22 nt, Artificial Sequence
  ELANE RNA Guide
cgccagcguccugcaggagcuc

SEQ ID NO: 20067 - RNA, 22 nt, Artificial Sequence
  ELANE RNA Guide
cgguugagcuccugcaggacgc

SEQ ID NO: 20068 - RNA, 22 nt, Artificial Sequence
  ELANE RNA Guide
cguccugcaggagcucaaccgu

SEQ ID NO: 20069 - RNA, 22 nt, Artificial Sequence
  ELANE RNA Guide
cguugcugcgacgguugagcuc

SEQ ID NO: 20070 - RNA, 22 nt, Artificial Sequence
  ELANE RNA Guide
cucaaccgucgcagcaacgucu

SEQ ID NO: 20071 - RNA, 22 nt, Artificial Sequence
  ELANE RNA Guide
cugcaggagcucaaccgucgca

SEQ ID NO: 20072 - RNA, 22 nt, Artificial Sequence
  ELANE RNA Guide
cugcgacgguugagcuccugca

SEQ ID NO: 20073 - RNA, 22 nt, Artificial Sequence
  ELANE RNA Guide
gacgguugagcuccugcaggac

SEQ ID NO: 20074 - RNA, 22 nt, Artificial Sequence
  ELANE RNA Guide
gacguugcugcgacgguugagc

SEQ ID NO: 20075 - RNA, 22 nt, Artificial Sequence
  ELANE RNA Guide
gagagugcagacguugcugcga

SEQ ID NO: 20076 - RNA, 22 nt, Artificial Sequence
  ELANE RNA Guide
gagcucaaccgucgcagcaacg

SEQ ID NO: 20077 - RNA, 22 nt, Artificial Sequence
  ELANE RNA Guide
gagugcagacguugcugcgacg

SEQ ID NO: 20078 - RNA, 22 nt, Artificial Sequence
  ELANE RNA Guide
gcagacguugcugcgacgguug

SEQ ID NO: 20079 - RNA, 22 nt, Artificial Sequence
  ELANE RNA Guide
gcaggagcucaaccgucgcagc

SEQ ID NO: 20080 - RNA, 22 nt, Artificial Sequence
  ELANE RNA Guide
gccagcguccugcaggagcuca

SEQ ID NO: 20081 - RNA, 22 nt, Artificial Sequence
  ELANE RNA Guide
gcgacgguugagcuccugcagg

SEQ ID NO: 20082 - RNA, 22 nt, Artificial Sequence
  ELANE RNA Guide
gcguccugcaggagcucaaccg

SEQ ID NO: 20083 - RNA, 22 nt, Artificial Sequence
  ELANE RNA Guide
gcucaaccgucgcagcaacguc

SEQ ID NO: 20084 - RNA, 22 nt, Artificial Sequence
  ELANE RNA Guide
gcugcgacgguugagcuccugc

SEQ ID NO: 20085 - RNA, 22 nt, Artificial Sequence
  ELANE RNA Guide
ggagcucaaccgucgcagcaac

SEQ ID NO: 20086 - RNA, 22 nt, Artificial Sequence
  ELANE RNA Guide
gguugagcuccugcaggacgcu

SEQ ID NO: 20087 - RNA, 22 nt, Artificial Sequence
  ELANE RNA Guide
guccugcaggagcucaaccguc

SEQ ID NO: 20088 - RNA, 22 nt, Artificial Sequence
  ELANE RNA Guide
gugcagacguugcugcgacggu

SEQ ID NO: 20089 - RNA, 22 nt, Artificial Sequence
  ELANE RNA Guide
guugcugcgacgguugagcucc

SEQ ID NO: 20090 - RNA, 22 nt, Artificial Sequence
  ELANE RNA Guide
ucaaccgucgcagcaacgucug

SEQ ID NO: 20091 - RNA, 22 nt, Artificial Sequence
  ELANE RNA Guide
uccugcaggagcucaaccgucg

SEQ ID NO: 20092 - RNA, 22 nt, Artificial Sequence
  ELANE RNA Guide
ugcagacguugcugcgacgguu

SEQ ID NO: 20093 - RNA, 22 nt, Artificial Sequence
  ELANE RNA Guide
ugcaggagcucaaccgucgcag

SEQ ID NO: 20094 - RNA, 22 nt, Artificial Sequence
  ELANE RNA Guide
ugcgacgguugagcuccugcag

SEQ ID NO: 20095 - RNA, 22 nt, Artificial Sequence
  ELANE RNA Guide
ugcugcgacgguugagcuccug

SEQ ID NO: 20096 - RNA, 22 nt, Artificial Sequence
  ELANE RNA Guide
uugcugcgacgguugagcuccu

SEQ ID NO: 20097 - RNA, 20 nt, Artificial Sequence
  ELANE RNA Guide
acggcagagagggacgucac

SEQ ID NO: 20098 - RNA, 20 nt, Artificial Sequence
  ELANE RNA Guide
acgguggugacgucccucuc

SEQ ID NO: 20099 - RNA, 20 nt, Artificial Sequence
  ELANE RNA Guide
acgucccucucugccgucgc

SEQ ID NO: 20100 - RNA, 20 nt, Artificial Sequence
  ELANE RNA Guide
acguugcugcgacggcagag

SEQ ID NO: 20101 - RNA, 20 nt, Artificial Sequence
  ELANE RNA Guide
agacguugcugcgacggcag

SEQ ID NO: 20102 - RNA, 20 nt, Artificial Sequence
  ELANE RNA Guide
agagagggacgucaccaccg

SEQ ID NO: 20103 - RNA, 20 nt, Artificial Sequence
  ELANE RNA Guide
cagacguugcugcgacggca

SEQ ID NO: 20104 - RNA, 20 nt, Artificial Sequence
  ELANE RNA Guide
cagagagggacgucaccacc

SEQ ID NO: 20105 - RNA, 20 nt, Artificial Sequence
  ELANE RNA Guide
cccucucugccgucgcagca

SEQ ID NO: 20106 - RNA, 20 nt, Artificial Sequence
  ELANE RNA Guide
ccucucugccgucgcagcaa

SEQ ID NO: 20107 - RNA, 20 nt, Artificial Sequence
  ELANE RNA Guide
cgacggcagagagggacguc

SEQ ID NO: 20108 - RNA, 20 nt, Artificial Sequence
  ELANE RNA Guide
cggcagagagggacgucacc

SEQ ID NO: 20109 - RNA, 20 nt, Artificial Sequence
  ELANE RNA Guide
cgguggugacgucccucucu

SEQ ID NO: 20110 - RNA, 20 nt, Artificial Sequence
  ELANE RNA Guide
cgucccucucugccgucgca

SEQ ID NO: 20111 - RNA, 20 nt, Artificial Sequence
  ELANE RNA Guide
cgugacgguggugacguccc

SEQ ID NO: 20112 - RNA, 20 nt, Artificial Sequence
  ELANE RNA Guide
cguugcugcgacggcagaga

SEQ ID NO: 20113 - RNA, 20 nt, Artificial Sequence
  ELANE RNA Guide
cucucugccgucgcagcaac

SEQ ID NO: 20114 - RNA, 20 nt, Artificial Sequence
  ELANE RNA Guide
cugcgacggcagagagggac

SEQ ID NO: 20115 - RNA, 20 nt, Artificial Sequence
  ELANE RNA Guide
gacggcagagagggacguca

SEQ ID NO: 20116 - RNA, 20 nt, Artificial Sequence
  ELANE RNA Guide
gacgguggugacgucccucu

SEQ ID NO: 20117 - RNA, 20 nt, Artificial Sequence
  ELANE RNA Guide
gacgucccucucugccgucg

SEQ ID NO: 20118 - RNA, 20 nt, Artificial Sequence
  ELANE RNA Guide
gacguugcugcgacggcaga

SEQ ID NO: 20119 - RNA, 20 nt, Artificial Sequence
  ELANE RNA Guide
gagagggacgucaccaccgu

SEQ ID NO: 20120 - RNA, 20 nt, Artificial Sequence
  ELANE RNA Guide
gcagagagggacgucaccac

SEQ ID NO: 20121 - RNA, 20 nt, Artificial Sequence
  ELANE RNA Guide
gcgacggcagagagggacgu

SEQ ID NO: 20122 - RNA, 20 nt, Artificial Sequence
  ELANE RNA Guide
gcugcgacggcagagaggga

SEQ ID NO: 20123 - RNA, 20 nt, Artificial Sequence
  ELANE RNA Guide
ggcagagagggacgucacca

SEQ ID NO: 20124 - RNA, 20 nt, Artificial Sequence
  ELANE RNA Guide
ggugacgucccucucugccg

SEQ ID NO: 20125 - RNA, 20 nt, Artificial Sequence
  ELANE RNA Guide
gguggugacgucccucucug

SEQ ID NO: 20126 - RNA, 20 nt, Artificial Sequence
  ELANE RNA Guide
gucccucucugccgucgcag

SEQ ID NO: 20127 - RNA, 20 nt, Artificial Sequence
  ELANE RNA Guide
gugacgguggugacgucccu

SEQ ID NO: 20128 - RNA, 20 nt, Artificial Sequence
  ELANE RNA Guide
gugacgucccucucugccgu

SEQ ID NO: 20129 - RNA, 20 nt, Artificial Sequence
  ELANE RNA Guide
guggugacgucccucucugc

SEQ ID NO: 20130 - RNA, 20 nt, Artificial Sequence
  ELANE RNA Guide
guugcugcgacggcagagag

SEQ ID NO: 20131 - RNA, 20 nt, Artificial Sequence
  ELANE RNA Guide
ucccucucugccgucgcagc

SEQ ID NO: 20132 - RNA, 20 nt, Artificial Sequence
  ELANE RNA Guide
ugacgguggugacgucccuc

SEQ ID NO: 20133 - RNA, 20 nt, Artificial Sequence
  ELANE RNA Guide
ugacgucccucucugccguc

SEQ ID NO: 20134 - RNA, 20 nt, Artificial Sequence
  ELANE RNA Guide
ugcgacggcagagagggacg

SEQ ID NO: 20135 - RNA, 20 nt, Artificial Sequence
  ELANE RNA Guide
ugcugcgacggcagagaggg

SEQ ID NO: 20136 - RNA, 20 nt, Artificial Sequence
  ELANE RNA Guide
uggugacgucccucucugcc

SEQ ID NO: 20137 - RNA, 20 nt, Artificial Sequence
  ELANE RNA Guide
uugcugcgacggcagagagg

SEQ ID NO: 20138 - RNA, 21 nt, Artificial Sequence
  ELANE RNA Guide
acggcagagagggacgucacc

SEQ ID NO: 20139 - RNA, 21 nt, Artificial Sequence
  ELANE RNA Guide
acgguggugacgucccucucu

SEQ ID NO: 20140 - RNA, 21 nt, Artificial Sequence
  ELANE RNA Guide
acgucccucucugccgucgca

SEQ ID NO: 20141 - RNA, 21 nt, Artificial Sequence
  ELANE RNA Guide
acgugacgguggugacguccc

SEQ ID NO: 20142 - RNA, 21 nt, Artificial Sequence
  ELANE RNA Guide
acguugcugcgacggcagaga

SEQ ID NO: 20143 - RNA, 21 nt, Artificial Sequence
  ELANE RNA Guide
agacguugcugcgacggcaga

SEQ ID NO: 20144 - RNA, 21 nt, Artificial Sequence
  ELANE RNA Guide
agagagggacgucaccaccgu

SEQ ID NO: 20145 - RNA, 21 nt, Artificial Sequence
  ELANE RNA Guide
cagacguugcugcgacggcag

SEQ ID NO: 20146 - RNA, 21 nt, Artificial Sequence
  ELANE RNA Guide
cagagagggacgucaccaccg

SEQ ID NO: 20147 - RNA, 21 nt, Artificial Sequence
  ELANE RNA Guide
cccucucugccgucgcagcaa

SEQ ID NO: 20148 - RNA, 21 nt, Artificial Sequence
  ELANE RNA Guide
ccucucugccgucgcagcaac

SEQ ID NO: 20149 - RNA, 21 nt, Artificial Sequence
  ELANE RNA Guide
cgacggcagagagggacguca

SEQ ID NO: 20150 - RNA, 21 nt, Artificial Sequence
  ELANE RNA Guide
cggcagagagggacgucacca

SEQ ID NO: 20151 - RNA, 21 nt, Artificial Sequence
  ELANE RNA Guide
cgguggugacgucccucucug

SEQ ID NO: 20152 - RNA, 21 nt, Artificial Sequence
  ELANE RNA Guide
cgucccucucugccgucgcag

SEQ ID NO: 20153 - RNA, 21 nt, Artificial Sequence
  ELANE RNA Guide
cgugacgguggugacgucccu

SEQ ID NO: 20154 - RNA, 21 nt, Artificial Sequence
  ELANE RNA Guide
cguugcugcgacggcagagag

SEQ ID NO: 20155 - RNA, 21 nt, Artificial Sequence
  ELANE RNA Guide
cucucugccgucgcagcaacg

SEQ ID NO: 20156 - RNA, 21 nt, Artificial Sequence
  ELANE RNA Guide
cugcgacggcagagagggacg

SEQ ID NO: 20157 - RNA, 21 nt, Artificial Sequence
  ELANE RNA Guide
gacggcagagagggacgucac

SEQ ID NO: 20158 - RNA, 21 nt, Artificial Sequence
  ELANE RNA Guide
gacgguggugacgucccucuc

SEQ ID NO: 20159 - RNA, 21 nt, Artificial Sequence
  ELANE RNA Guide
gacgucccucucugccgucgc

SEQ ID NO: 20160 - RNA, 21 nt, Artificial Sequence
  ELANE RNA Guide
gacguugcugcgacggcagag

SEQ ID NO: 20161 - RNA, 21 nt, Artificial Sequence
  ELANE RNA Guide
gagagggacgucaccaccguc

SEQ ID NO: 20162 - RNA, 21 nt, Artificial Sequence
  ELANE RNA Guide
gcagacguugcugcgacggca

SEQ ID NO: 20163 - RNA, 21 nt, Artificial Sequence
  ELANE RNA Guide
gcagagagggacgucaccacc

SEQ ID NO: 20164 - RNA, 21 nt, Artificial Sequence
  ELANE RNA Guide
gcgacggcagagagggacguc

SEQ ID NO: 20165 - RNA, 21 nt, Artificial Sequence
  ELANE RNA Guide
gcugcgacggcagagagggac

SEQ ID NO: 20166 - RNA, 21 nt, Artificial Sequence
  ELANE RNA Guide
ggcagagagggacgucaccac

SEQ ID NO: 20167 - RNA, 21 nt, Artificial Sequence
  ELANE RNA Guide
ggugacgucccucucugccgu

SEQ ID NO: 20168 - RNA, 21 nt, Artificial Sequence
  ELANE RNA Guide
gguggugacgucccucucugc

SEQ ID NO: 20169 - RNA, 21 nt, Artificial Sequence
  ELANE RNA Guide
gucccucucugccgucgcagc

SEQ ID NO: 20170 - RNA, 21 nt, Artificial Sequence
  ELANE RNA Guide
gugacgguggugacgucccuc

SEQ ID NO: 20171 - RNA, 21 nt, Artificial Sequence
  ELANE RNA Guide
gugacgucccucucugccguc

SEQ ID NO: 20172 - RNA, 21 nt, Artificial Sequence
  ELANE RNA Guide
guggugacgucccucucugcc

SEQ ID NO: 20173 - RNA, 21 nt, Artificial Sequence
  ELANE RNA Guide
guugcugcgacggcagagagg

SEQ ID NO: 20174 - RNA, 21 nt, Artificial Sequence
  ELANE RNA Guide
ucccucucugccgucgcagca

SEQ ID NO: 20175 - RNA, 21 nt, Artificial Sequence
  ELANE RNA Guide
ugacgguggugacgucccucu

SEQ ID NO: 20176 - RNA, 21 nt, Artificial Sequence
  ELANE RNA Guide
ugacgucccucucugccgucg

SEQ ID NO: 20177 - RNA, 21 nt, Artificial Sequence
  ELANE RNA Guide
ugcgacggcagagagggacgu

SEQ ID NO: 20178 - RNA, 21 nt, Artificial Sequence
  ELANE RNA Guide
ugcugcgacggcagagaggga

SEQ ID NO: 20179 - RNA, 21 nt, Artificial Sequence
  ELANE RNA Guide
uggugacgucccucucugccg

SEQ ID NO: 20180 - RNA, 21 nt, Artificial Sequence
  ELANE RNA Guide
uugcugcgacggcagagaggg

SEQ ID NO: 20181 - RNA, 22 nt, Artificial Sequence
  ELANE RNA Guide
aacgugacgguggugacguccc

SEQ ID NO: 20182 - RNA, 22 nt, Artificial Sequence
  ELANE RNA Guide
acggcagagagggacgucacca

SEQ ID NO: 20183 - RNA, 22 nt, Artificial Sequence
  ELANE RNA Guide
acgguggugacgucccucucug

SEQ ID NO: 20184 - RNA, 22 nt, Artificial Sequence
  ELANE RNA Guide
acgucccucucugccgucgcag

SEQ ID NO: 20185 - RNA, 22 nt, Artificial Sequence
  ELANE RNA Guide
acgugacgguggugacgucccu

SEQ ID NO: 20186 - RNA, 22 nt, Artificial Sequence
  ELANE RNA Guide
acguugcugcgacggcagagag

SEQ ID NO: 20187 - RNA, 22 nt, Artificial Sequence
  ELANE RNA Guide
agacguugcugcgacggcagag

SEQ ID NO: 20188 - RNA, 22 nt, Artificial Sequence
  ELANE RNA Guide
agagagggacgucaccaccguc

SEQ ID NO: 20189 - RNA, 22 nt, Artificial Sequence
  ELANE RNA Guide
cagacguugcugcgacggcaga

SEQ ID NO: 20190 - RNA, 22 nt, Artificial Sequence
  ELANE RNA Guide
cagagagggacgucaccaccgu

SEQ ID NO: 20191 - RNA, 22 nt, Artificial Sequence
  ELANE RNA Guide
cccucucugccgucgcagcaac

SEQ ID NO: 20192 - RNA, 22 nt, Artificial Sequence
  ELANE RNA Guide
ccucucugccgucgcagcaacg

SEQ ID NO: 20193 - RNA, 22 nt, Artificial Sequence
  ELANE RNA Guide
cgacggcagagagggacgucac

SEQ ID NO: 20194 - RNA, 22 nt, Artificial Sequence
  ELANE RNA Guide
cggcagagagggacgucaccac

SEQ ID NO: 20195 - RNA, 22 nt, Artificial Sequence
  ELANE RNA Guide
cgguggugacgucccucucugc

SEQ ID NO: 20196 - RNA, 22 nt, Artificial Sequence
  ELANE RNA Guide
cgucccucucugccgucgcagc

SEQ ID NO: 20197 - RNA, 22 nt, Artificial Sequence
  ELANE RNA Guide
cgugacgguggugacgucccuc

SEQ ID NO: 20198 - RNA, 22 nt, Artificial Sequence
  ELANE RNA Guide
cguugcugcgacggcagagagg

SEQ ID NO: 20199 - RNA, 22 nt, Artificial Sequence
  ELANE RNA Guide
cucucugccgucgcagcaacgu

SEQ ID NO: 20200 - RNA, 22 nt, Artificial Sequence
  ELANE RNA Guide
cugcgacggcagagagggacgu

SEQ ID NO: 20201 - RNA, 22 nt, Artificial Sequence
  ELANE RNA Guide
gacggcagagagggacgucacc

SEQ ID NO: 20202 - RNA, 22 nt, Artificial Sequence
  ELANE RNA Guide
gacgguggugacgucccucucu

SEQ ID NO: 20203 - RNA, 22 nt, Artificial Sequence
  ELANE RNA Guide
gacgucccucucugccgucgca

SEQ ID NO: 20204 - RNA, 22 nt, Artificial Sequence
  ELANE RNA Guide
gacguugcugcgacggcagaga

SEQ ID NO: 20205 - RNA, 22 nt, Artificial Sequence
  ELANE RNA Guide
gagagggacgucaccaccguca

SEQ ID NO: 20206 - RNA, 22 nt, Artificial Sequence
  ELANE RNA Guide
gcagacguugcugcgacggcag

SEQ ID NO: 20207 - RNA, 22 nt, Artificial Sequence
  ELANE RNA Guide
gcagagagggacgucaccaccg

SEQ ID NO: 20208 - RNA, 22 nt, Artificial Sequence
  ELANE RNA Guide
gcgacggcagagagggacguca

SEQ ID NO: 20209 - RNA, 22 nt, Artificial Sequence
  ELANE RNA Guide
gcugcgacggcagagagggacg

SEQ ID NO: 20210 - RNA, 22 nt, Artificial Sequence
  ELANE RNA Guide
ggcagagagggacgucaccacc

SEQ ID NO: 20211 - RNA, 22 nt, Artificial Sequence
  ELANE RNA Guide
ggugacgucccucucugccguc

SEQ ID NO: 20212 - RNA, 22 nt, Artificial Sequence
  ELANE RNA Guide
gguggugacgucccucucugcc

SEQ ID NO: 20213 - RNA, 22 nt, Artificial Sequence
  ELANE RNA Guide
gucccucucugccgucgcagca

SEQ ID NO: 20214 - RNA, 22 nt, Artificial Sequence
  ELANE RNA Guide
gugacgguggugacgucccucu

SEQ ID NO: 20215 - RNA, 22 nt, Artificial Sequence
  ELANE RNA Guide
gugacgucccucucugccgucg

SEQ ID NO: 20216 - RNA, 22 nt, Artificial Sequence
  ELANE RNA Guide
guggugacgucccucucugccg

SEQ ID NO: 20217 - RNA, 22 nt, Artificial Sequence
  ELANE RNA Guide
guugcugcgacggcagagaggg

SEQ ID NO: 20218 - RNA, 22 nt, Artificial Sequence
  ELANE RNA Guide
ucccucucugccgucgcagcaa

SEQ ID NO: 20219 - RNA, 22 nt, Artificial Sequence
  ELANE RNA Guide
ugacgguggugacgucccucuc

SEQ ID NO: 20220 - RNA, 22 nt, Artificial Sequence
  ELANE RNA Guide
ugacgucccucucugccgucgc

SEQ ID NO: 20221 - RNA, 22 nt, Artificial Sequence
  ELANE RNA Guide
ugcagacguugcugcgacggca

SEQ ID NO: 20222 - RNA, 22 nt, Artificial Sequence
  ELANE RNA Guide
ugcgacggcagagagggacguc

SEQ ID NO: 20223 - RNA, 22 nt, Artificial Sequence
  ELANE RNA Guide
ugcugcgacggcagagagggac

SEQ ID NO: 20224 - RNA, 22 nt, Artificial Sequence
  ELANE RNA Guide
uggugacgucccucucugccgu

SEQ ID NO: 20225 - RNA, 22 nt, Artificial Sequence
  ELANE RNA Guide
uugcugcgacggcagagaggga

SEQ ID NO: 20226 - RNA, 20 nt, Artificial Sequence
  ELANE RNA Guide
acgcagagggacgucaccac

SEQ ID NO: 20227 - RNA, 20 nt, Artificial Sequence
  ELANE RNA Guide
acgguggugacgucccucug

SEQ ID NO: 20228 - RNA, 20 nt, Artificial Sequence
  ELANE RNA Guide
acgucccucugcgucgcagc

SEQ ID NO: 20229 - RNA, 20 nt, Artificial Sequence
  ELANE RNA Guide
acguugcugcgacgcagagg

SEQ ID NO: 20230 - RNA, 20 nt, Artificial Sequence
  ELANE RNA Guide
agacguugcugcgacgcaga

SEQ ID NO: 20231 - RNA, 20 nt, Artificial Sequence
  ELANE RNA Guide
agagugcagacguugcugcg

SEQ ID NO: 20232 - RNA, 20 nt, Artificial Sequence
  ELANE RNA Guide
cagacguugcugcgacgcag

SEQ ID NO: 20233 - RNA, 20 nt, Artificial Sequence
  ELANE RNA Guide
cccucugcgucgcagcaacg

SEQ ID NO: 20234 - RNA, 20 nt, Artificial Sequence
  ELANE RNA Guide
ccucugcgucgcagcaacgu

SEQ ID NO: 20235 - RNA, 20 nt, Artificial Sequence
  ELANE RNA Guide
cgacgcagagggacgucacc

SEQ ID NO: 20236 - RNA, 20 nt, Artificial Sequence
  ELANE RNA Guide
cgcagagggacgucaccacc

SEQ ID NO: 20237 - RNA, 20 nt, Artificial Sequence
  ELANE RNA Guide
cgguggugacgucccucugc

SEQ ID NO: 20238 - RNA, 20 nt, Artificial Sequence
  ELANE RNA Guide
cgucccucugcgucgcagca

SEQ ID NO: 20239 - RNA, 20 nt, Artificial Sequence
  ELANE RNA Guide
cguugcugcgacgcagaggg

SEQ ID NO: 20240 - RNA, 20 nt, Artificial Sequence
  ELANE RNA Guide
cucugcgucgcagcaacguc

SEQ ID NO: 20241 - RNA, 20 nt, Artificial Sequence
  ELANE RNA Guide
cugcgacgcagagggacguc

SEQ ID NO: 20242 - RNA, 20 nt, Artificial Sequence
  ELANE RNA Guide
cugcgucgcagcaacgucug

SEQ ID NO: 20243 - RNA, 20 nt, Artificial Sequence
  ELANE RNA Guide
gacgcagagggacgucacca

SEQ ID NO: 20244 - RNA, 20 nt, Artificial Sequence
  ELANE RNA Guide
gacgucccucugcgucgcag

SEQ ID NO: 20245 - RNA, 20 nt, Artificial Sequence
  ELANE RNA Guide
gacguugcugcgacgcagag

SEQ ID NO: 20246 - RNA, 20 nt, Artificial Sequence
  ELANE RNA Guide
gcagacguugcugcgacgca

SEQ ID NO: 20247 - RNA, 20 nt, Artificial Sequence
  ELANE RNA Guide
gcgacgcagagggacgucac

SEQ ID NO: 20248 - RNA, 20 nt, Artificial Sequence
  ELANE RNA Guide
gcugcgacgcagagggacgu

SEQ ID NO: 20249 - RNA, 20 nt, Artificial Sequence
  ELANE RNA Guide
ggugacgucccucugcgucg

SEQ ID NO: 20250 - RNA, 20 nt, Artificial Sequence
  ELANE RNA Guide
gguggugacgucccucugcg

SEQ ID NO: 20251 - RNA, 20 nt, Artificial Sequence
  ELANE RNA Guide
gucccucugcgucgcagcaa

SEQ ID NO: 20252 - RNA, 20 nt, Artificial Sequence
  ELANE RNA Guide
gugacgucccucugcgucgc

SEQ ID NO: 20253 - RNA, 20 nt, Artificial Sequence
  ELANE RNA Guide
guggugacgucccucugcgu

SEQ ID NO: 20254 - RNA, 20 nt, Artificial Sequence
  ELANE RNA Guide
guugcugcgacgcagaggga

SEQ ID NO: 20255 - RNA, 20 nt, Artificial Sequence
  ELANE RNA Guide
ucccucugcgucgcagcaac

SEQ ID NO: 20256 - RNA, 20 nt, Artificial Sequence
  ELANE RNA Guide
ucugcgucgcagcaacgucu

SEQ ID NO: 20257 - RNA, 20 nt, Artificial Sequence
  ELANE RNA Guide
ugacgucccucugcgucgca

SEQ ID NO: 20258 - RNA, 20 nt, Artificial Sequence
  ELANE RNA Guide
ugcagacguugcugcgacgc

SEQ ID NO: 20259 - RNA, 20 nt, Artificial Sequence
  ELANE RNA Guide
ugcgacgcagagggacguca

SEQ ID NO: 20260 - RNA, 20 nt, Artificial Sequence
  ELANE RNA Guide
ugcgucgcagcaacgucugc

SEQ ID NO: 20261 - RNA, 20 nt, Artificial Sequence
  ELANE RNA Guide
ugcugcgacgcagagggacg

SEQ ID NO: 20262 - RNA, 20 nt, Artificial Sequence
  ELANE RNA Guide
uggugacgucccucugcguc

SEQ ID NO: 20263 - RNA, 20 nt, Artificial Sequence
  ELANE RNA Guide
uugcugcgacgcagagggac

SEQ ID NO: 20264 - RNA, 21 nt, Artificial Sequence
  ELANE RNA Guide
acgcagagggacgucaccacc

SEQ ID NO: 20265 - RNA, 21 nt, Artificial Sequence
  ELANE RNA Guide
acgguggugacgucccucugc

SEQ ID NO: 20266 - RNA, 21 nt, Artificial Sequence
  ELANE RNA Guide
acgucccucugcgucgcagca

SEQ ID NO: 20267 - RNA, 21 nt, Artificial Sequence
  ELANE RNA Guide
acguugcugcgacgcagaggg

SEQ ID NO: 20268 - RNA, 21 nt, Artificial Sequence
  ELANE RNA Guide
agacguugcugcgacgcagag

SEQ ID NO: 20269 - RNA, 21 nt, Artificial Sequence
  ELANE RNA Guide
cagacguugcugcgacgcaga

SEQ ID NO: 20270 - RNA, 21 nt, Artificial Sequence
  ELANE RNA Guide
cccucugcgucgcagcaacgu

SEQ ID NO: 20271 - RNA, 21 nt, Artificial Sequence
  ELANE RNA Guide
ccucugcgucgcagcaacguc

SEQ ID NO: 20272 - RNA, 21 nt, Artificial Sequence
  ELANE RNA Guide
cgacgcagagggacgucacca

SEQ ID NO: 20273 - RNA, 21 nt, Artificial Sequence
  ELANE RNA Guide
cgcagagggacgucaccaccg

SEQ ID NO: 20274 - RNA, 21 nt, Artificial Sequence
  ELANE RNA Guide
cgguggugacgucccucugcg

SEQ ID NO: 20275 - RNA, 21 nt, Artificial Sequence
  ELANE RNA Guide
cgucccucugcgucgcagcaa

SEQ ID NO: 20276 - RNA, 21 nt, Artificial Sequence
  ELANE RNA Guide
cguugcugcgacgcagaggga

SEQ ID NO: 20277 - RNA, 21 nt, Artificial Sequence
  ELANE RNA Guide
cucugcgucgcagcaacgucu

SEQ ID NO: 20278 - RNA, 21 nt, Artificial Sequence
  ELANE RNA Guide
cugcgacgcagagggacguca

SEQ ID NO: 20279 - RNA, 21 nt, Artificial Sequence
  ELANE RNA Guide
cugcgucgcagcaacgucugc

SEQ ID NO: 20280 - RNA, 21 nt, Artificial Sequence
  ELANE RNA Guide
gacgcagagggacgucaccac

SEQ ID NO: 20281 - RNA, 21 nt, Artificial Sequence
  ELANE RNA Guide
gacgguggugacgucccucug

SEQ ID NO: 20282 - RNA, 21 nt, Artificial Sequence
  ELANE RNA Guide
gacgucccucugcgucgcagc

SEQ ID NO: 20283 - RNA, 21 nt, Artificial Sequence
  ELANE RNA Guide
gacguugcugcgacgcagagg

SEQ ID NO: 20284 - RNA, 21 nt, Artificial Sequence
  ELANE RNA Guide
gagagugcagacguugcugcg

SEQ ID NO: 20285 - RNA, 21 nt, Artificial Sequence
  ELANE RNA Guide
gcagacguugcugcgacgcag

SEQ ID NO: 20286 - RNA, 21 nt, Artificial Sequence
  ELANE RNA Guide
gcgacgcagagggacgucacc

SEQ ID NO: 20287 - RNA, 21 nt, Artificial Sequence
  ELANE RNA Guide
gcugcgacgcagagggacguc

SEQ ID NO: 20288 - RNA, 21 nt, Artificial Sequence
  ELANE RNA Guide
ggugacgucccucugcgucgc

SEQ ID NO: 20289 - RNA, 21 nt, Artificial Sequence
  ELANE RNA Guide
gguggugacgucccucugcgu

SEQ ID NO: 20290 - RNA, 21 nt, Artificial Sequence
  ELANE RNA Guide
gucccucugcgucgcagcaac

SEQ ID NO: 20291 - RNA, 21 nt, Artificial Sequence
  ELANE RNA Guide
gugacgucccucugcgucgca

SEQ ID NO: 20292 - RNA, 21 nt, Artificial Sequence
  ELANE RNA Guide
gugcagacguugcugcgacgc

SEQ ID NO: 20293 - RNA, 21 nt, Artificial Sequence
  ELANE RNA Guide
guggugacgucccucugcguc

SEQ ID NO: 20294 - RNA, 21 nt, Artificial Sequence
  ELANE RNA Guide
guugcugcgacgcagagggac

SEQ ID NO: 20295 - RNA, 21 nt, Artificial Sequence
  ELANE RNA Guide
ucccucugcgucgcagcaacg

SEQ ID NO: 20296 - RNA, 21 nt, Artificial Sequence
  ELANE RNA Guide
ucugcgucgcagcaacgucug

SEQ ID NO: 20297 - RNA, 21 nt, Artificial Sequence
  ELANE RNA Guide
ugacgucccucugcgucgcag

SEQ ID NO: 20298 - RNA, 21 nt, Artificial Sequence
  ELANE RNA Guide
ugcagacguugcugcgacgca

SEQ ID NO: 20299 - RNA, 21 nt, Artificial Sequence
  ELANE RNA Guide
ugcgacgcagagggacgucac

SEQ ID NO: 20300 - RNA, 21 nt, Artificial Sequence
  ELANE RNA Guide
ugcgucgcagcaacgucugca

SEQ ID NO: 20301 - RNA, 21 nt, Artificial Sequence
  ELANE RNA Guide
ugcugcgacgcagagggacgu

SEQ ID NO: 20302 - RNA, 21 nt, Artificial Sequence
  ELANE RNA Guide
uggugacgucccucugcgucg

SEQ ID NO: 20303 - RNA, 21 nt, Artificial Sequence
  ELANE RNA Guide
uugcugcgacgcagagggacg

SEQ ID NO: 20304 - RNA, 22 nt, Artificial Sequence
  ELANE RNA Guide
acgcagagggacgucaccaccg

SEQ ID NO: 20305 - RNA, 22 nt, Artificial Sequence
  ELANE RNA Guide
acgguggugacgucccucugcg

SEQ ID NO: 20306 - RNA, 22 nt, Artificial Sequence
  ELANE RNA Guide
acgucccucugcgucgcagcaa

SEQ ID NO: 20307 - RNA, 22 nt, Artificial Sequence
  ELANE RNA Guide
acguugcugcgacgcagaggga

SEQ ID NO: 20308 - RNA, 22 nt, Artificial Sequence
  ELANE RNA Guide
agacguugcugcgacgcagagg

SEQ ID NO: 20309 - RNA, 22 nt, Artificial Sequence
  ELANE RNA Guide
agugcagacguugcugcgacgc

SEQ ID NO: 20310 - RNA, 22 nt, Artificial Sequence
  ELANE RNA Guide
cagacguugcugcgacgcagag

SEQ ID NO: 20311 - RNA, 22 nt, Artificial Sequence
  ELANE RNA Guide
cccucugcgucgcagcaacguc

SEQ ID NO: 20312 - RNA, 22 nt, Artificial Sequence
  ELANE RNA Guide
ccucugcgucgcagcaacgucu

SEQ ID NO: 20313 - RNA, 22 nt, Artificial Sequence
  ELANE RNA Guide
cgacgcagagggacgucaccac

SEQ ID NO: 20314 - RNA, 22 nt, Artificial Sequence
  ELANE RNA Guide
cgagagugcagacguugcugcg

SEQ ID NO: 20315 - RNA, 22 nt, Artificial Sequence
  ELANE RNA Guide
cgcagagggacgucaccaccgu

SEQ ID NO: 20316 - RNA, 22 nt, Artificial Sequence
  ELANE RNA Guide
cgguggugacgucccucugcgu

SEQ ID NO: 20317 - RNA, 22 nt, Artificial Sequence
  ELANE RNA Guide
cgucccucugcgucgcagcaac

SEQ ID NO: 20318 - RNA, 22 nt, Artificial Sequence
  ELANE RNA Guide
cguugcugcgacgcagagggac

SEQ ID NO: 20319 - RNA, 22 nt, Artificial Sequence
  ELANE RNA Guide
cucugcgucgcagcaacgucug

SEQ ID NO: 20320 - RNA, 22 nt, Artificial Sequence
  ELANE RNA Guide
cugcgacgcagagggacgucac

SEQ ID NO: 20321 - RNA, 22 nt, Artificial Sequence
  ELANE RNA Guide
cugcgucgcagcaacgucugca

SEQ ID NO: 20322 - RNA, 22 nt, Artificial Sequence
  ELANE RNA Guide
gacgcagagggacgucaccacc

SEQ ID NO: 20323 - RNA, 22 nt, Artificial Sequence
  ELANE RNA Guide
gacgguggugacgucccucugc

SEQ ID NO: 20324 - RNA, 22 nt, Artificial Sequence
  ELANE RNA Guide
gacgucccucugcgucgcagca

SEQ ID NO: 20325 - RNA, 22 nt, Artificial Sequence
  ELANE RNA Guide
gacguugcugcgacgcagaggg

SEQ ID NO: 20326 - RNA, 22 nt, Artificial Sequence
  ELANE RNA Guide
gcagacguugcugcgacgcaga

SEQ ID NO: 20327 - RNA, 22 nt, Artificial Sequence
  ELANE RNA Guide
gcgacgcagagggacgucacca

SEQ ID NO: 20328 - RNA, 22 nt, Artificial Sequence
  ELANE RNA Guide
gcugcgacgcagagggacguca

SEQ ID NO: 20329 - RNA, 22 nt, Artificial Sequence
  ELANE RNA Guide
ggugacgucccucugcgucgca

SEQ ID NO: 20330 - RNA, 22 nt, Artificial Sequence
  ELANE RNA Guide
gguggugacgucccucugcguc

SEQ ID NO: 20331 - RNA, 22 nt, Artificial Sequence
  ELANE RNA Guide
gucccucugcgucgcagcaacg

SEQ ID NO: 20332 - RNA, 22 nt, Artificial Sequence
  ELANE RNA Guide
gugacgucccucugcgucgcag

SEQ ID NO: 20333 - RNA, 22 nt, Artificial Sequence
  ELANE RNA Guide
gugcagacguugcugcgacgca

SEQ ID NO: 20334 - RNA, 22 nt, Artificial Sequence
  ELANE RNA Guide
guggugacgucccucugcgucg

SEQ ID NO: 20335 - RNA, 22 nt, Artificial Sequence
  ELANE RNA Guide
guugcugcgacgcagagggacg

SEQ ID NO: 20336 - RNA, 22 nt, Artificial Sequence
  ELANE RNA Guide
ucccucugcgucgcagcaacgu

SEQ ID NO: 20337 - RNA, 22 nt, Artificial Sequence
  ELANE RNA Guide
ucugcgucgcagcaacgucugc

SEQ ID NO: 20338 - RNA, 22 nt, Artificial Sequence
  ELANE RNA Guide
ugacgguggugacgucccucug

SEQ ID NO: 20339 - RNA, 22 nt, Artificial Sequence
  ELANE RNA Guide
ugacgucccucugcgucgcagc

SEQ ID NO: 20340 - RNA, 22 nt, Artificial Sequence
  ELANE RNA Guide
ugcagacguugcugcgacgcag

SEQ ID NO: 20341 - RNA, 22 nt, Artificial Sequence
  ELANE RNA Guide
ugcgacgcagagggacgucacc

SEQ ID NO: 20342 - RNA, 22 nt, Artificial Sequence
  ELANE RNA Guide
ugcgucgcagcaacgucugcac

SEQ ID NO: 20343 - RNA, 22 nt, Artificial Sequence
  ELANE RNA Guide
ugcugcgacgcagagggacguc

SEQ ID NO: 20344 - RNA, 22 nt, Artificial Sequence
  ELANE RNA Guide
uggugacgucccucugcgucgc

SEQ ID NO: 20345 - RNA, 22 nt, Artificial Sequence
  ELANE RNA Guide
uugcugcgacgcagagggacgu

SEQ ID NO: 20346 - RNA, 20 nt, Artificial Sequence
  ELANE RNA Guide
acgucccucugccucgcagc

SEQ ID NO: 20347 - RNA, 20 nt, Artificial Sequence
  ELANE RNA Guide
acguugcugcgaggcagagg

SEQ ID NO: 20348 - RNA, 20 nt, Artificial Sequence
  ELANE RNA Guide
agacguugcugcgaggcaga

SEQ ID NO: 20349 - RNA, 20 nt, Artificial Sequence
  ELANE RNA Guide
aggcagagggacgucaccac

SEQ ID NO: 20350 - RNA, 20 nt, Artificial Sequence
  ELANE RNA Guide
agugcagacguugcugcgag

SEQ ID NO: 20351 - RNA, 20 nt, Artificial Sequence
  ELANE RNA Guide
cagacguugcugcgaggcag

SEQ ID NO: 20352 - RNA, 20 nt, Artificial Sequence
  ELANE RNA Guide
cccucugccucgcagcaacg

SEQ ID NO: 20353 - RNA, 20 nt, Artificial Sequence
  ELANE RNA Guide
ccucgcagcaacgucugcac

SEQ ID NO: 20354 - RNA, 20 nt, Artificial Sequence
  ELANE RNA Guide
ccucugccucgcagcaacgu

SEQ ID NO: 20355 - RNA, 20 nt, Artificial Sequence
  ELANE RNA Guide
cgagagugcagacguugcug

SEQ ID NO: 20356 - RNA, 20 nt, Artificial Sequence
  ELANE RNA Guide
cgaggcagagggacgucacc

SEQ ID NO: 20357 - RNA, 20 nt, Artificial Sequence
  ELANE RNA Guide
cgucccucugccucgcagca

SEQ ID NO: 20358 - RNA, 20 nt, Artificial Sequence
  ELANE RNA Guide
cguugcugcgaggcagaggg

SEQ ID NO: 20359 - RNA, 20 nt, Artificial Sequence
  ELANE RNA Guide
cucugccucgcagcaacguc

SEQ ID NO: 20360 - RNA, 20 nt, Artificial Sequence
  ELANE RNA Guide
cugccucgcagcaacgucug

SEQ ID NO: 20361 - RNA, 20 nt, Artificial Sequence
  ELANE RNA Guide
cugcgaggcagagggacguc

SEQ ID NO: 20362 - RNA, 20 nt, Artificial Sequence
  ELANE RNA Guide
gacgucccucugccucgcag

SEQ ID NO: 20363 - RNA, 20 nt, Artificial Sequence
  ELANE RNA Guide
gacguugcugcgaggcagag

SEQ ID NO: 20364 - RNA, 20 nt, Artificial Sequence
  ELANE RNA Guide
gagagugcagacguugcugc

SEQ ID NO: 20365 - RNA, 20 nt, Artificial Sequence
  ELANE RNA Guide
gaggcagagggacgucacca

SEQ ID NO: 20366 - RNA, 20 nt, Artificial Sequence
  ELANE RNA Guide
gcagacguugcugcgaggca

SEQ ID NO: 20367 - RNA, 20 nt, Artificial Sequence
  ELANE RNA Guide
gccucgcagcaacgucugca

SEQ ID NO: 20368 - RNA, 20 nt, Artificial Sequence
  ELANE RNA Guide
gcgaggcagagggacgucac

SEQ ID NO: 20369 - RNA, 20 nt, Artificial Sequence
  ELANE RNA Guide
gcugcgaggcagagggacgu

SEQ ID NO: 20370 - RNA, 20 nt, Artificial Sequence
  ELANE RNA Guide
ggugacgucccucugccucg

SEQ ID NO: 20371 - RNA, 20 nt, Artificial Sequence
  ELANE RNA Guide
gguggugacgucccucugcc

SEQ ID NO: 20372 - RNA, 20 nt, Artificial Sequence
  ELANE RNA Guide
gucccucugccucgcagcaa

SEQ ID NO: 20373 - RNA, 20 nt, Artificial Sequence
  ELANE RNA Guide
gugacgucccucugccucgc

SEQ ID NO: 20374 - RNA, 20 nt, Artificial Sequence
  ELANE RNA Guide
gugcagacguugcugcgagg

SEQ ID NO: 20375 - RNA, 20 nt, Artificial Sequence
  ELANE RNA Guide
guggugacgucccucugccu

SEQ ID NO: 20376 - RNA, 20 nt, Artificial Sequence
  ELANE RNA Guide
guugcugcgaggcagaggga

SEQ ID NO: 20377 - RNA, 20 nt, Artificial Sequence
  ELANE RNA Guide
ucccucugccucgcagcaac

SEQ ID NO: 20378 - RNA, 20 nt, Artificial Sequence
  ELANE RNA Guide
ucugccucgcagcaacgucu

SEQ ID NO: 20379 - RNA, 20 nt, Artificial Sequence
  ELANE RNA Guide
ugacgucccucugccucgca

SEQ ID NO: 20380 - RNA, 20 nt, Artificial Sequence
  ELANE RNA Guide
ugcagacguugcugcgaggc

SEQ ID NO: 20381 - RNA, 20 nt, Artificial Sequence
  ELANE RNA Guide
ugccucgcagcaacgucugc

SEQ ID NO: 20382 - RNA, 20 nt, Artificial Sequence
  ELANE RNA Guide
ugcgaggcagagggacguca

SEQ ID NO: 20383 - RNA, 20 nt, Artificial Sequence
  ELANE RNA Guide
ugcugcgaggcagagggacg

SEQ ID NO: 20384 - RNA, 20 nt, Artificial Sequence
  ELANE RNA Guide
uggugacgucccucugccuc

SEQ ID NO: 20385 - RNA, 20 nt, Artificial Sequence
  ELANE RNA Guide
uugcugcgaggcagagggac

SEQ ID NO: 20386 - RNA, 21 nt, Artificial Sequence
  ELANE RNA Guide
acgagagugcagacguugcug

SEQ ID NO: 20387 - RNA, 21 nt, Artificial Sequence
  ELANE RNA Guide
acgucccucugccucgcagca

SEQ ID NO: 20388 - RNA, 21 nt, Artificial Sequence
  ELANE RNA Guide
acguugcugcgaggcagaggg

SEQ ID NO: 20389 - RNA, 21 nt, Artificial Sequence
  ELANE RNA Guide
agacguugcugcgaggcagag

SEQ ID NO: 20390 - RNA, 21 nt, Artificial Sequence
  ELANE RNA Guide
aggcagagggacgucaccacc

SEQ ID NO: 20391 - RNA, 21 nt, Artificial Sequence
  ELANE RNA Guide
agugcagacguugcugcgagg

SEQ ID NO: 20392 - RNA, 21 nt, Artificial Sequence
  ELANE RNA Guide
cagacguugcugcgaggcaga

SEQ ID NO: 20393 - RNA, 21 nt, Artificial Sequence
  ELANE RNA Guide
cccucugccucgcagcaacgu

SEQ ID NO: 20394 - RNA, 21 nt, Artificial Sequence
  ELANE RNA Guide
ccucgcagcaacgucugcacu

SEQ ID NO: 20395 - RNA, 21 nt, Artificial Sequence
  ELANE RNA Guide
ccucugccucgcagcaacguc

SEQ ID NO: 20396 - RNA, 21 nt, Artificial Sequence
  ELANE RNA Guide
cgagagugcagacguugcugc

SEQ ID NO: 20397 - RNA, 21 nt, Artificial Sequence
  ELANE RNA Guide
cgaggcagagggacgucacca

SEQ ID NO: 20398 - RNA, 21 nt, Artificial Sequence
  ELANE RNA Guide
cgguggugacgucccucugcc

SEQ ID NO: 20399 - RNA, 21 nt, Artificial Sequence
  ELANE RNA Guide
cgucccucugccucgcagcaa

SEQ ID NO: 20400 - RNA, 21 nt, Artificial Sequence
  ELANE RNA Guide
cguugcugcgaggcagaggga

SEQ ID NO: 20401 - RNA, 21 nt, Artificial Sequence
  ELANE RNA Guide
cucugccucgcagcaacgucu

SEQ ID NO: 20402 - RNA, 21 nt, Artificial Sequence
  ELANE RNA Guide
cugccucgcagcaacgucugc

SEQ ID NO: 20403 - RNA, 21 nt, Artificial Sequence
  ELANE RNA Guide
cugcgaggcagagggacguca

SEQ ID NO: 20404 - RNA, 21 nt, Artificial Sequence
  ELANE RNA Guide
gacgucccucugccucgcagc

SEQ ID NO: 20405 - RNA, 21 nt, Artificial Sequence
  ELANE RNA Guide
gacguugcugcgaggcagagg

SEQ ID NO: 20406 - RNA, 21 nt, Artificial Sequence
  ELANE RNA Guide
gaggcagagggacgucaccac

SEQ ID NO: 20407 - RNA, 21 nt, Artificial Sequence
  ELANE RNA Guide
gagugcagacguugcugcgag

SEQ ID NO: 20408 - RNA, 21 nt, Artificial Sequence
  ELANE RNA Guide
gcagacguugcugcgaggcag

SEQ ID NO: 20409 - RNA, 21 nt, Artificial Sequence
  ELANE RNA Guide
gccucgcagcaacgucugcac

SEQ ID NO: 20410 - RNA, 21 nt, Artificial Sequence
  ELANE RNA Guide
gcgaggcagagggacgucacc

SEQ ID NO: 20411 - RNA, 21 nt, Artificial Sequence
  ELANE RNA Guide
gcugcgaggcagagggacguc

SEQ ID NO: 20412 - RNA, 21 nt, Artificial Sequence
  ELANE RNA Guide
ggugacgucccucugccucgc

SEQ ID NO: 20413 - RNA, 21 nt, Artificial Sequence
  ELANE RNA Guide
gguggugacgucccucugccu

SEQ ID NO: 20414 - RNA, 21 nt, Artificial Sequence
  ELANE RNA Guide
gucccucugccucgcagcaac

SEQ ID NO: 20415 - RNA, 21 nt, Artificial Sequence
  ELANE RNA Guide
gugacgucccucugccucgca

SEQ ID NO: 20416 - RNA, 21 nt, Artificial Sequence
  ELANE RNA Guide
gugcagacguugcugcgaggc

SEQ ID NO: 20417 - RNA, 21 nt, Artificial Sequence
  ELANE RNA Guide
guggugacgucccucugccuc

SEQ ID NO: 20418 - RNA, 21 nt, Artificial Sequence
  ELANE RNA Guide
guugcugcgaggcagagggac

SEQ ID NO: 20419 - RNA, 21 nt, Artificial Sequence
  ELANE RNA Guide
ucccucugccucgcagcaacg

SEQ ID NO: 20420 - RNA, 21 nt, Artificial Sequence
  ELANE RNA Guide
ucugccucgcagcaacgucug

SEQ ID NO: 20421 - RNA, 21 nt, Artificial Sequence
  ELANE RNA Guide
ugacgucccucugccucgcag

SEQ ID NO: 20422 - RNA, 21 nt, Artificial Sequence
  ELANE RNA Guide
ugcagacguugcugcgaggca

SEQ ID NO: 20423 - RNA, 21 nt, Artificial Sequence
  ELANE RNA Guide
ugccucgcagcaacgucugca

SEQ ID NO: 20424 - RNA, 21 nt, Artificial Sequence
  ELANE RNA Guide
ugcgaggcagagggacgucac

SEQ ID NO: 20425 - RNA, 21 nt, Artificial Sequence
  ELANE RNA Guide
ugcugcgaggcagagggacgu

SEQ ID NO: 20426 - RNA, 21 nt, Artificial Sequence
  ELANE RNA Guide
uggugacgucccucugccucg

SEQ ID NO: 20427 - RNA, 21 nt, Artificial Sequence
  ELANE RNA Guide
uugcugcgaggcagagggacg

SEQ ID NO: 20428 - RNA, 22 nt, Artificial Sequence
  ELANE RNA Guide
acgagagugcagacguugcugc

SEQ ID NO: 20429 - RNA, 22 nt, Artificial Sequence
  ELANE RNA Guide
acgguggugacgucccucugcc

SEQ ID NO: 20430 - RNA, 22 nt, Artificial Sequence
  ELANE RNA Guide
acgucccucugccucgcagcaa

SEQ ID NO: 20431 - RNA, 22 nt, Artificial Sequence
  ELANE RNA Guide
acguugcugcgaggcagaggga

SEQ ID NO: 20432 - RNA, 22 nt, Artificial Sequence
  ELANE RNA Guide
agacguugcugcgaggcagagg

SEQ ID NO: 20433 - RNA, 22 nt, Artificial Sequence
  ELANE RNA Guide
agagugcagacguugcugcgag

SEQ ID NO: 20434 - RNA, 22 nt, Artificial Sequence
  ELANE RNA Guide
aggcagagggacgucaccaccg

SEQ ID NO: 20435 - RNA, 22 nt, Artificial Sequence
  ELANE RNA Guide
agugcagacguugcugcgaggc

SEQ ID NO: 20436 - RNA, 22 nt, Artificial Sequence
  ELANE RNA Guide
cacgagagugcagacguugcug

SEQ ID NO: 20437 - RNA, 22 nt, Artificial Sequence
  ELANE RNA Guide
cagacguugcugcgaggcagag

SEQ ID NO: 20438 - RNA, 22 nt, Artificial Sequence
  ELANE RNA Guide
cccucugccucgcagcaacguc

SEQ ID NO: 20439 - RNA, 22 nt, Artificial Sequence
  ELANE RNA Guide
ccucgcagcaacgucugcacuc

SEQ ID NO: 20440 - RNA, 22 nt, Artificial Sequence
  ELANE RNA Guide
ccucugccucgcagcaacgucu

SEQ ID NO: 20441 - RNA, 22 nt, Artificial Sequence
  ELANE RNA Guide
cgaggcagagggacgucaccac

SEQ ID NO: 20442 - RNA, 22 nt, Artificial Sequence
  ELANE RNA Guide
cgguggugacgucccucugccu

SEQ ID NO: 20443 - RNA, 22 nt, Artificial Sequence
  ELANE RNA Guide
cgucccucugccucgcagcaac

SEQ ID NO: 20444 - RNA, 22 nt, Artificial Sequence
  ELANE RNA Guide
cguugcugcgaggcagagggac

SEQ ID NO: 20445 - RNA, 22 nt, Artificial Sequence
  ELANE RNA Guide
cucugccucgcagcaacgucug

SEQ ID NO: 20446 - RNA, 22 nt, Artificial Sequence
  ELANE RNA Guide
cugccucgcagcaacgucugca

SEQ ID NO: 20447 - RNA, 22 nt, Artificial Sequence
  ELANE RNA Guide
cugcgaggcagagggacgucac

SEQ ID NO: 20448 - RNA, 22 nt, Artificial Sequence
  ELANE RNA Guide
gacgucccucugccucgcagca

SEQ ID NO: 20449 - RNA, 22 nt, Artificial Sequence
  ELANE RNA Guide
gacguugcugcgaggcagaggg

SEQ ID NO: 20450 - RNA, 22 nt, Artificial Sequence
  ELANE RNA Guide
gaggcagagggacgucaccacc

SEQ ID NO: 20451 - RNA, 22 nt, Artificial Sequence
  ELANE RNA Guide
gagugcagacguugcugcgagg

SEQ ID NO: 20452 - RNA, 22 nt, Artificial Sequence
  ELANE RNA Guide
gcagacguugcugcgaggcaga

SEQ ID NO: 20453 - RNA, 22 nt, Artificial Sequence
  ELANE RNA Guide
gccucgcagcaacgucugcacu

SEQ ID NO: 20454 - RNA, 22 nt, Artificial Sequence
  ELANE RNA Guide
gcgaggcagagggacgucacca

SEQ ID NO: 20455 - RNA, 22 nt, Artificial Sequence
  ELANE RNA Guide
gcugcgaggcagagggacguca

SEQ ID NO: 20456 - RNA, 22 nt, Artificial Sequence
  ELANE RNA Guide
ggugacgucccucugccucgca

SEQ ID NO: 20457 - RNA, 22 nt, Artificial Sequence
  ELANE RNA Guide
gguggugacgucccucugccuc

SEQ ID NO: 20458 - RNA, 22 nt, Artificial Sequence
  ELANE RNA Guide
gucccucugccucgcagcaacg

SEQ ID NO: 20459 - RNA, 22 nt, Artificial Sequence
  ELANE RNA Guide
gugacgucccucugccucgcag

SEQ ID NO: 20460 - RNA, 22 nt, Artificial Sequence
  ELANE RNA Guide
gugcagacguugcugcgaggca

SEQ ID NO: 20461 - RNA, 22 nt, Artificial Sequence
  ELANE RNA Guide
guggugacgucccucugccucg

SEQ ID NO: 20462 - RNA, 22 nt, Artificial Sequence
  ELANE RNA Guide
guugcugcgaggcagagggacg

SEQ ID NO: 20463 - RNA, 22 nt, Artificial Sequence
  ELANE RNA Guide
ucccucugccucgcagcaacgu

SEQ ID NO: 20464 - RNA, 22 nt, Artificial Sequence
  ELANE RNA Guide
ucugccucgcagcaacgucugc

SEQ ID NO: 20465 - RNA, 22 nt, Artificial Sequence
  ELANE RNA Guide
ugacgucccucugccucgcagc

SEQ ID NO: 20466 - RNA, 22 nt, Artificial Sequence
  ELANE RNA Guide
ugcagacguugcugcgaggcag

SEQ ID NO: 20467 - RNA, 22 nt, Artificial Sequence
  ELANE RNA Guide
ugccucgcagcaacgucugcac

SEQ ID NO: 20468 - RNA, 22 nt, Artificial Sequence
  ELANE RNA Guide
ugcgaggcagagggacgucacc

SEQ ID NO: 20469 - RNA, 22 nt, Artificial Sequence
  ELANE RNA Guide
ugcugcgaggcagagggacguc

SEQ ID NO: 20470 - RNA, 22 nt, Artificial Sequence
  ELANE RNA Guide
uggugacgucccucugccucgc

SEQ ID NO: 20471 - RNA, 22 nt, Artificial Sequence
  ELANE RNA Guide
uugcugcgaggcagagggacgu

SEQ ID NO: 20472 - RNA, 20 nt, Artificial Sequence
  ELANE RNA Guide
aacaucugcacucucgugag

SEQ ID NO: 20473 - RNA, 20 nt, Artificial Sequence
  ELANE RNA Guide
acaucugcacucucgugagg

SEQ ID NO: 20474 - RNA, 20 nt, Artificial Sequence
  ELANE RNA Guide
acgagagugcagauguugcu

SEQ ID NO: 20475 - RNA, 20 nt, Artificial Sequence
  ELANE RNA Guide
agagugcagauguugcugcg

SEQ ID NO: 20476 - RNA, 20 nt, Artificial Sequence
  ELANE RNA Guide
agauguugcugcgacggcag

SEQ ID NO: 20477 - RNA, 20 nt, Artificial Sequence
  ELANE RNA Guide
agcaacaucugcacucucgu

SEQ ID NO: 20478 - RNA, 20 nt, Artificial Sequence
  ELANE RNA Guide
agugcagauguugcugcgac

SEQ ID NO: 20479 - RNA, 20 nt, Artificial Sequence
  ELANE RNA Guide
auguugcugcgacggcagag

SEQ ID NO: 20480 - RNA, 20 nt, Artificial Sequence
  ELANE RNA Guide
caacaucugcacucucguga

SEQ ID NO: 20481 - RNA, 20 nt, Artificial Sequence
  ELANE RNA Guide
cacgagagugcagauguugc

SEQ ID NO: 20482 - RNA, 20 nt, Artificial Sequence
  ELANE RNA Guide
cagauguugcugcgacggca

SEQ ID NO: 20483 - RNA, 20 nt, Artificial Sequence
  ELANE RNA Guide
cagcaacaucugcacucucg

SEQ ID NO: 20484 - RNA, 20 nt, Artificial Sequence
  ELANE RNA Guide
caucugcacucucgugaggg

SEQ ID NO: 20485 - RNA, 20 nt, Artificial Sequence
  ELANE RNA Guide
ccccucacgagagugcagau

SEQ ID NO: 20486 - RNA, 20 nt, Artificial Sequence
  ELANE RNA Guide
cccucacgagagugcagaug

SEQ ID NO: 20487 - RNA, 20 nt, Artificial Sequence
  ELANE RNA Guide
cccucugccgucgcagcaac

SEQ ID NO: 20488 - RNA, 20 nt, Artificial Sequence
  ELANE RNA Guide
ccggccccucacgagagugc

SEQ ID NO: 20489 - RNA, 20 nt, Artificial Sequence
  ELANE RNA Guide
ccgucgcagcaacaucugca

SEQ ID NO: 20490 - RNA, 20 nt, Artificial Sequence
  ELANE RNA Guide
ccucacgagagugcagaugu

SEQ ID NO: 20491 - RNA, 20 nt, Artificial Sequence
  ELANE RNA Guide
ccucugccgucgcagcaaca

SEQ ID NO: 20492 - RNA, 20 nt, Artificial Sequence
  ELANE RNA Guide
cgagagugcagauguugcug

SEQ ID NO: 20493 - RNA, 20 nt, Artificial Sequence
  ELANE RNA Guide
cgcagcaacaucugcacucu

SEQ ID NO: 20494 - RNA, 20 nt, Artificial Sequence
  ELANE RNA Guide
cggccccucacgagagugca

SEQ ID NO: 20495 - RNA, 20 nt, Artificial Sequence
  ELANE RNA Guide
cgucccucugccgucgcagc

SEQ ID NO: 20496 - RNA, 20 nt, Artificial Sequence
  ELANE RNA Guide
cgucgcagcaacaucugcac

SEQ ID NO: 20497 - RNA, 20 nt, Artificial Sequence
  ELANE RNA Guide
cucacgagagugcagauguu

SEQ ID NO: 20498 - RNA, 20 nt, Artificial Sequence
  ELANE RNA Guide
cucugccgucgcagcaacau

SEQ ID NO: 20499 - RNA, 20 nt, Artificial Sequence
  ELANE RNA Guide
cugccgucgcagcaacaucu

SEQ ID NO: 20500 - RNA, 20 nt, Artificial Sequence
  ELANE RNA Guide
gagagugcagauguugcugc

SEQ ID NO: 20501 - RNA, 20 nt, Artificial Sequence
  ELANE RNA Guide
gagugcagauguugcugcga

SEQ ID NO: 20502 - RNA, 20 nt, Artificial Sequence
  ELANE RNA Guide
gauguugcugcgacggcaga

SEQ ID NO: 20503 - RNA, 20 nt, Artificial Sequence
  ELANE RNA Guide
gcaacaucugcacucucgug

SEQ ID NO: 20504 - RNA, 20 nt, Artificial Sequence
  ELANE RNA Guide
gcagauguugcugcgacggc

SEQ ID NO: 20505 - RNA, 20 nt, Artificial Sequence
  ELANE RNA Guide
gcagcaacaucugcacucuc

SEQ ID NO: 20506 - RNA, 20 nt, Artificial Sequence
  ELANE RNA Guide
gccccucacgagagugcaga

SEQ ID NO: 20507 - RNA, 20 nt, Artificial Sequence
  ELANE RNA Guide
gccgucgcagcaacaucugc

SEQ ID NO: 20508 - RNA, 20 nt, Artificial Sequence
  ELANE RNA Guide
ggccccucacgagagugcag

SEQ ID NO: 20509 - RNA, 20 nt, Artificial Sequence
  ELANE RNA Guide
gucccucugccgucgcagca

SEQ ID NO: 20510 - RNA, 20 nt, Artificial Sequence
  ELANE RNA Guide
gucgcagcaacaucugcacu

SEQ ID NO: 20511 - RNA, 20 nt, Artificial Sequence
  ELANE RNA Guide
gugcagauguugcugcgacg

SEQ ID NO: 20512 - RNA, 20 nt, Artificial Sequence
  ELANE RNA Guide
ucacgagagugcagauguug

SEQ ID NO: 20513 - RNA, 20 nt, Artificial Sequence
  ELANE RNA Guide
ucccucugccgucgcagcaa

SEQ ID NO: 20514 - RNA, 20 nt, Artificial Sequence
  ELANE RNA Guide
ucgcagcaacaucugcacuc

SEQ ID NO: 20515 - RNA, 20 nt, Artificial Sequence
  ELANE RNA Guide
ucugccgucgcagcaacauc

SEQ ID NO: 20516 - RNA, 20 nt, Artificial Sequence
  ELANE RNA Guide
ugcagauguugcugcgacgg

SEQ ID NO: 20517 - RNA, 20 nt, Artificial Sequence
  ELANE RNA Guide
ugccgucgcagcaacaucug

SEQ ID NO: 20518 - RNA, 21 nt, Artificial Sequence
  ELANE RNA Guide
aacaucugcacucucgugagg

SEQ ID NO: 20519 - RNA, 21 nt, Artificial Sequence
  ELANE RNA Guide
acaucugcacucucgugaggg

SEQ ID NO: 20520 - RNA, 21 nt, Artificial Sequence
  ELANE RNA Guide
acgagagugcagauguugcug

SEQ ID NO: 20521 - RNA, 21 nt, Artificial Sequence
  ELANE RNA Guide
acgucccucugccgucgcagc

SEQ ID NO: 20522 - RNA, 21 nt, Artificial Sequence
  ELANE RNA Guide
agagugcagauguugcugcga

SEQ ID NO: 20523 - RNA, 21 nt, Artificial Sequence
  ELANE RNA Guide
agauguugcugcgacggcaga

SEQ ID NO: 20524 - RNA, 21 nt, Artificial Sequence
  ELANE RNA Guide
agcaacaucugcacucucgug

SEQ ID NO: 20525 - RNA, 21 nt, Artificial Sequence
  ELANE RNA Guide
agugcagauguugcugcgacg

SEQ ID NO: 20526 - RNA, 21 nt, Artificial Sequence
  ELANE RNA Guide
auguugcugcgacggcagagg

SEQ ID NO: 20527 - RNA, 21 nt, Artificial Sequence
  ELANE RNA Guide
caacaucugcacucucgugag

SEQ ID NO: 20528 - RNA, 21 nt, Artificial Sequence
  ELANE RNA Guide
cacgagagugcagauguugcu

SEQ ID NO: 20529 - RNA, 21 nt, Artificial Sequence
  ELANE RNA Guide
cagauguugcugcgacggcag

SEQ ID NO: 20530 - RNA, 21 nt, Artificial Sequence
  ELANE RNA Guide
cagcaacaucugcacucucgu

SEQ ID NO: 20531 - RNA, 21 nt, Artificial Sequence
  ELANE RNA Guide
caucugcacucucgugagggg

SEQ ID NO: 20532 - RNA, 21 nt, Artificial Sequence
  ELANE RNA Guide
ccccucacgagagugcagaug

SEQ ID NO: 20533 - RNA, 21 nt, Artificial Sequence
  ELANE RNA Guide
cccucacgagagugcagaugu

SEQ ID NO: 20534 - RNA, 21 nt, Artificial Sequence
  ELANE RNA Guide
cccucugccgucgcagcaaca

SEQ ID NO: 20535 - RNA, 21 nt, Artificial Sequence
  ELANE RNA Guide
ccggccccucacgagagugca

SEQ ID NO: 20536 - RNA, 21 nt, Artificial Sequence
  ELANE RNA Guide
ccgucgcagcaacaucugcac

SEQ ID NO: 20537 - RNA, 21 nt, Artificial Sequence
  ELANE RNA Guide
ccucacgagagugcagauguu

SEQ ID NO: 20538 - RNA, 21 nt, Artificial Sequence
  ELANE RNA Guide
ccucugccgucgcagcaacau

SEQ ID NO: 20539 - RNA, 21 nt, Artificial Sequence
  ELANE RNA Guide
cgagagugcagauguugcugc

SEQ ID NO: 20540 - RNA, 21 nt, Artificial Sequence
  ELANE RNA Guide
cgcagcaacaucugcacucuc

SEQ ID NO: 20541 - RNA, 21 nt, Artificial Sequence
  ELANE RNA Guide
cggccccucacgagagugcag

SEQ ID NO: 20542 - RNA, 21 nt, Artificial Sequence
  ELANE RNA Guide
cgucccucugccgucgcagca

SEQ ID NO: 20543 - RNA, 21 nt, Artificial Sequence
  ELANE RNA Guide
cgucgcagcaacaucugcacu

SEQ ID NO: 20544 - RNA, 21 nt, Artificial Sequence
  ELANE RNA Guide
cucacgagagugcagauguug

SEQ ID NO: 20545 - RNA, 21 nt, Artificial Sequence
  ELANE RNA Guide
cucugccgucgcagcaacauc

SEQ ID NO: 20546 - RNA, 21 nt, Artificial Sequence
  ELANE RNA Guide
cugccgucgcagcaacaucug

SEQ ID NO: 20547 - RNA, 21 nt, Artificial Sequence
  ELANE RNA Guide
gagagugcagauguugcugcg

SEQ ID NO: 20548 - RNA, 21 nt, Artificial Sequence
  ELANE RNA Guide
gagugcagauguugcugcgac

SEQ ID NO: 20549 - RNA, 21 nt, Artificial Sequence
  ELANE RNA Guide
gauguugcugcgacggcagag

SEQ ID NO: 20550 - RNA, 21 nt, Artificial Sequence
  ELANE RNA Guide
gcaacaucugcacucucguga

SEQ ID NO: 20551 - RNA, 21 nt, Artificial Sequence
  ELANE RNA Guide
gcagauguugcugcgacggca

SEQ ID NO: 20552 - RNA, 21 nt, Artificial Sequence
  ELANE RNA Guide
gcagcaacaucugcacucucg

SEQ ID NO: 20553 - RNA, 21 nt, Artificial Sequence
  ELANE RNA Guide
gccccucacgagagugcagau

SEQ ID NO: 20554 - RNA, 21 nt, Artificial Sequence
  ELANE RNA Guide
gccggccccucacgagagugc

SEQ ID NO: 20555 - RNA, 21 nt, Artificial Sequence
  ELANE RNA Guide
gccgucgcagcaacaucugca

SEQ ID NO: 20556 - RNA, 21 nt, Artificial Sequence
  ELANE RNA Guide
ggccccucacgagagugcaga

SEQ ID NO: 20557 - RNA, 21 nt, Artificial Sequence
  ELANE RNA Guide
gucccucugccgucgcagcaa

SEQ ID NO: 20558 - RNA, 21 nt, Artificial Sequence
  ELANE RNA Guide
gucgcagcaacaucugcacuc

SEQ ID NO: 20559 - RNA, 21 nt, Artificial Sequence
  ELANE RNA Guide
gugcagauguugcugcgacgg

SEQ ID NO: 20560 - RNA, 21 nt, Artificial Sequence
  ELANE RNA Guide
ucacgagagugcagauguugc

SEQ ID NO: 20561 - RNA, 21 nt, Artificial Sequence
  ELANE RNA Guide
ucccucugccgucgcagcaac

SEQ ID NO: 20562 - RNA, 21 nt, Artificial Sequence
  ELANE RNA Guide
ucgcagcaacaucugcacucu

SEQ ID NO: 20563 - RNA, 21 nt, Artificial Sequence
  ELANE RNA Guide
ucugccgucgcagcaacaucu

SEQ ID NO: 20564 - RNA, 21 nt, Artificial Sequence
  ELANE RNA Guide
ugcagauguugcugcgacggc

SEQ ID NO: 20565 - RNA, 21 nt, Artificial Sequence
  ELANE RNA Guide
ugccgucgcagcaacaucugc

SEQ ID NO: 20566 - RNA, 22 nt, Artificial Sequence
  ELANE RNA Guide
aacaucugcacucucgugaggg

SEQ ID NO: 20567 - RNA, 22 nt, Artificial Sequence
  ELANE RNA Guide
acaucugcacucucgugagggg

SEQ ID NO: 20568 - RNA, 22 nt, Artificial Sequence
  ELANE RNA Guide
acgagagugcagauguugcugc

SEQ ID NO: 20569 - RNA, 22 nt, Artificial Sequence
  ELANE RNA Guide
acgucccucugccgucgcagca

SEQ ID NO: 20570 - RNA, 22 nt, Artificial Sequence
  ELANE RNA Guide
agagugcagauguugcugcgac

SEQ ID NO: 20571 - RNA, 22 nt, Artificial Sequence
  ELANE RNA Guide
agauguugcugcgacggcagag

SEQ ID NO: 20572 - RNA, 22 nt, Artificial Sequence
  ELANE RNA Guide
agcaacaucugcacucucguga

SEQ ID NO: 20573 - RNA, 22 nt, Artificial Sequence
  ELANE RNA Guide
agugcagauguugcugcgacgg

SEQ ID NO: 20574 - RNA, 22 nt, Artificial Sequence
  ELANE RNA Guide
auguugcugcgacggcagaggg

SEQ ID NO: 20575 - RNA, 22 nt, Artificial Sequence
  ELANE RNA Guide
caacaucugcacucucgugagg

SEQ ID NO: 20576 - RNA, 22 nt, Artificial Sequence
  ELANE RNA Guide
cacgagagugcagauguugcug

SEQ ID NO: 20577 - RNA, 22 nt, Artificial Sequence
  ELANE RNA Guide
cagauguugcugcgacggcaga

SEQ ID NO: 20578 - RNA, 22 nt, Artificial Sequence
  ELANE RNA Guide
cagcaacaucugcacucucgug

SEQ ID NO: 20579 - RNA, 22 nt, Artificial Sequence
  ELANE RNA Guide
caucugcacucucgugaggggc

SEQ ID NO: 20580 - RNA, 22 nt, Artificial Sequence
  ELANE RNA Guide
ccccucacgagagugcagaugu

SEQ ID NO: 20581 - RNA, 22 nt, Artificial Sequence
  ELANE RNA Guide
cccucacgagagugcagauguu

SEQ ID NO: 20582 - RNA, 22 nt, Artificial Sequence
  ELANE RNA Guide
cccucugccgucgcagcaacau

SEQ ID NO: 20583 - RNA, 22 nt, Artificial Sequence
  ELANE RNA Guide
ccggccccucacgagagugcag

SEQ ID NO: 20584 - RNA, 22 nt, Artificial Sequence
  ELANE RNA Guide
ccgucgcagcaacaucugcacu

SEQ ID NO: 20585 - RNA, 22 nt, Artificial Sequence
  ELANE RNA Guide
ccucacgagagugcagauguug

SEQ ID NO: 20586 - RNA, 22 nt, Artificial Sequence
  ELANE RNA Guide
ccucugccgucgcagcaacauc

SEQ ID NO: 20587 - RNA, 22 nt, Artificial Sequence
  ELANE RNA Guide
cgagagugcagauguugcugcg

SEQ ID NO: 20588 - RNA, 22 nt, Artificial Sequence
  ELANE RNA Guide
cgcagcaacaucugcacucucg

SEQ ID NO: 20589 - RNA, 22 nt, Artificial Sequence
  ELANE RNA Guide
cggccccucacgagagugcaga

SEQ ID NO: 20590 - RNA, 22 nt, Artificial Sequence
  ELANE RNA Guide
cgucccucugccgucgcagcaa

SEQ ID NO: 20591 - RNA, 22 nt, Artificial Sequence
  ELANE RNA Guide
cgucgcagcaacaucugcacuc

SEQ ID NO: 20592 - RNA, 22 nt, Artificial Sequence
  ELANE RNA Guide
cucacgagagugcagauguugc

SEQ ID NO: 20593 - RNA, 22 nt, Artificial Sequence
  ELANE RNA Guide
cucugccgucgcagcaacaucu

SEQ ID NO: 20594 - RNA, 22 nt, Artificial Sequence
  ELANE RNA Guide
cugccgucgcagcaacaucugc

SEQ ID NO: 20595 - RNA, 22 nt, Artificial Sequence
  ELANE RNA Guide
gacgucccucugccgucgcagc

SEQ ID NO: 20596 - RNA, 22 nt, Artificial Sequence
  ELANE RNA Guide
gagagugcagauguugcugcga

SEQ ID NO: 20597 - RNA, 22 nt, Artificial Sequence
  ELANE RNA Guide
gagugcagauguugcugcgacg

SEQ ID NO: 20598 - RNA, 22 nt, Artificial Sequence
  ELANE RNA Guide
gauguugcugcgacggcagagg

SEQ ID NO: 20599 - RNA, 22 nt, Artificial Sequence
  ELANE RNA Guide
gcaacaucugcacucucgugag

SEQ ID NO: 20600 - RNA, 22 nt, Artificial Sequence
  ELANE RNA Guide
gcagauguugcugcgacggcag

SEQ ID NO: 20601 - RNA, 22 nt, Artificial Sequence
  ELANE RNA Guide
gcagcaacaucugcacucucgu

SEQ ID NO: 20602 - RNA, 22 nt, Artificial Sequence
  ELANE RNA Guide
gccccucacgagagugcagaug

SEQ ID NO: 20603 - RNA, 22 nt, Artificial Sequence
  ELANE RNA Guide
gccggccccucacgagagugca

SEQ ID NO: 20604 - RNA, 22 nt, Artificial Sequence
  ELANE RNA Guide
gccgucgcagcaacaucugcac

SEQ ID NO: 20605 - RNA, 22 nt, Artificial Sequence
  ELANE RNA Guide
ggccccucacgagagugcagau

SEQ ID NO: 20606 - RNA, 22 nt, Artificial Sequence
  ELANE RNA Guide
gucccucugccgucgcagcaac

SEQ ID NO: 20607 - RNA, 22 nt, Artificial Sequence
  ELANE RNA Guide
gucgcagcaacaucugcacucu

SEQ ID NO: 20608 - RNA, 22 nt, Artificial Sequence
  ELANE RNA Guide
gugcagauguugcugcgacggc

SEQ ID NO: 20609 - RNA, 22 nt, Artificial Sequence
  ELANE RNA Guide
ucacgagagugcagauguugcu

SEQ ID NO: 20610 - RNA, 22 nt, Artificial Sequence
  ELANE RNA Guide
ucccucugccgucgcagcaaca

SEQ ID NO: 20611 - RNA, 22 nt, Artificial Sequence
  ELANE RNA Guide
ucgcagcaacaucugcacucuc

SEQ ID NO: 20612 - RNA, 22 nt, Artificial Sequence
  ELANE RNA Guide
ucugccgucgcagcaacaucug

SEQ ID NO: 20613 - RNA, 22 nt, Artificial Sequence
  ELANE RNA Guide
ugcagauguugcugcgacggca

SEQ ID NO: 20614 - RNA, 22 nt, Artificial Sequence
  ELANE RNA Guide
ugccggccccucacgagagugc

SEQ ID NO: 20615 - RNA, 22 nt, Artificial Sequence
  ELANE RNA Guide
ugccgucgcagcaacaucugca

SEQ ID NO: 20616 - RNA, 20 nt, Artificial Sequence
  ELANE RNA Guide
aacguaugcacucucgugag

SEQ ID NO: 20617 - RNA, 20 nt, Artificial Sequence
  ELANE RNA Guide
acgagagugcauacguugcu

SEQ ID NO: 20618 - RNA, 20 nt, Artificial Sequence
  ELANE RNA Guide
acguaugcacucucgugagg

SEQ ID NO: 20619 - RNA, 20 nt, Artificial Sequence
  ELANE RNA Guide
agagugcauacguugcugcg

SEQ ID NO: 20620 - RNA, 20 nt, Artificial Sequence
  ELANE RNA Guide
agcaacguaugcacucucgu

SEQ ID NO: 20621 - RNA, 20 nt, Artificial Sequence
  ELANE RNA Guide
agugcauacguugcugcgac

SEQ ID NO: 20622 - RNA, 20 nt, Artificial Sequence
  ELANE RNA Guide
auacguugcugcgacggcag

SEQ ID NO: 20623 - RNA, 20 nt, Artificial Sequence
  ELANE RNA Guide
caacguaugcacucucguga

SEQ ID NO: 20624 - RNA, 20 nt, Artificial Sequence
  ELANE RNA Guide
cacgagagugcauacguugc

SEQ ID NO: 20625 - RNA, 20 nt, Artificial Sequence
  ELANE RNA Guide
cagcaacguaugcacucucg

SEQ ID NO: 20626 - RNA, 20 nt, Artificial Sequence
  ELANE RNA Guide
cauacguugcugcgacggca

SEQ ID NO: 20627 - RNA, 20 nt, Artificial Sequence
  ELANE RNA Guide
ccccucacgagagugcauac

SEQ ID NO: 20628 - RNA, 20 nt, Artificial Sequence
  ELANE RNA Guide
cccucacgagagugcauacg

SEQ ID NO: 20629 - RNA, 20 nt, Artificial Sequence
  ELANE RNA Guide
ccgucgcagcaacguaugca

SEQ ID NO: 20630 - RNA, 20 nt, Artificial Sequence
  ELANE RNA Guide
ccucacgagagugcauacgu

SEQ ID NO: 20631 - RNA, 20 nt, Artificial Sequence
  ELANE RNA Guide
ccucugccgucgcagcaacg

SEQ ID NO: 20632 - RNA, 20 nt, Artificial Sequence
  ELANE RNA Guide
cgagagugcauacguugcug

SEQ ID NO: 20633 - RNA, 20 nt, Artificial Sequence
  ELANE RNA Guide
cgcagcaacguaugcacucu

SEQ ID NO: 20634 - RNA, 20 nt, Artificial Sequence
  ELANE RNA Guide
cguaugcacucucgugaggg

SEQ ID NO: 20635 - RNA, 20 nt, Artificial Sequence
  ELANE RNA Guide
cgucgcagcaacguaugcac

SEQ ID NO: 20636 - RNA, 20 nt, Artificial Sequence
  ELANE RNA Guide
cucacgagagugcauacguu

SEQ ID NO: 20637 - RNA, 20 nt, Artificial Sequence
  ELANE RNA Guide
cucugccgucgcagcaacgu

SEQ ID NO: 20638 - RNA, 20 nt, Artificial Sequence
  ELANE RNA Guide
cugccgucgcagcaacguau

SEQ ID NO: 20639 - RNA, 20 nt, Artificial Sequence
  ELANE RNA Guide
gagagugcauacguugcugc

SEQ ID NO: 20640 - RNA, 20 nt, Artificial Sequence
  ELANE RNA Guide
gagugcauacguugcugcga

SEQ ID NO: 20641 - RNA, 20 nt, Artificial Sequence
  ELANE RNA Guide
gcaacguaugcacucucgug

SEQ ID NO: 20642 - RNA, 20 nt, Artificial Sequence
  ELANE RNA Guide
gcagcaacguaugcacucuc

SEQ ID NO: 20643 - RNA, 20 nt, Artificial Sequence
  ELANE RNA Guide
gcauacguugcugcgacggc

SEQ ID NO: 20644 - RNA, 20 nt, Artificial Sequence
  ELANE RNA Guide
gccccucacgagagugcaua

SEQ ID NO: 20645 - RNA, 20 nt, Artificial Sequence
  ELANE RNA Guide
gccggccccucacgagagug

SEQ ID NO: 20646 - RNA, 20 nt, Artificial Sequence
  ELANE RNA Guide
gccgucgcagcaacguaugc

SEQ ID NO: 20647 - RNA, 20 nt, Artificial Sequence
  ELANE RNA Guide
ggccccucacgagagugcau

SEQ ID NO: 20648 - RNA, 20 nt, Artificial Sequence
  ELANE RNA Guide
guaugcacucucgugagggg

SEQ ID NO: 20649 - RNA, 20 nt, Artificial Sequence
  ELANE RNA Guide
gucgcagcaacguaugcacu

SEQ ID NO: 20650 - RNA, 20 nt, Artificial Sequence
  ELANE RNA Guide
gugcauacguugcugcgacg

SEQ ID NO: 20651 - RNA, 20 nt, Artificial Sequence
  ELANE RNA Guide
uaugcacucucgugaggggc

SEQ ID NO: 20652 - RNA, 20 nt, Artificial Sequence
  ELANE RNA Guide
ucacgagagugcauacguug

SEQ ID NO: 20653 - RNA, 20 nt, Artificial Sequence
  ELANE RNA Guide
ucgcagcaacguaugcacuc

SEQ ID NO: 20654 - RNA, 20 nt, Artificial Sequence
  ELANE RNA Guide
ucugccgucgcagcaacgua

SEQ ID NO: 20655 - RNA, 20 nt, Artificial Sequence
  ELANE RNA Guide
ugcauacguugcugcgacgg

SEQ ID NO: 20656 - RNA, 20 nt, Artificial Sequence
  ELANE RNA Guide
ugccggccccucacgagagu

SEQ ID NO: 20657 - RNA, 20 nt, Artificial Sequence
  ELANE RNA Guide
ugccgucgcagcaacguaug

SEQ ID NO: 20658 - RNA, 21 nt, Artificial Sequence
  ELANE RNA Guide
aacguaugcacucucgugagg

SEQ ID NO: 20659 - RNA, 21 nt, Artificial Sequence
  ELANE RNA Guide
acgagagugcauacguugcug

SEQ ID NO: 20660 - RNA, 21 nt, Artificial Sequence
  ELANE RNA Guide
acguaugcacucucgugaggg

SEQ ID NO: 20661 - RNA, 21 nt, Artificial Sequence
  ELANE RNA Guide
agagugcauacguugcugcga

SEQ ID NO: 20662 - RNA, 21 nt, Artificial Sequence
  ELANE RNA Guide
agcaacguaugcacucucgug

SEQ ID NO: 20663 - RNA, 21 nt, Artificial Sequence
  ELANE RNA Guide
agugcauacguugcugcgacg

SEQ ID NO: 20664 - RNA, 21 nt, Artificial Sequence
  ELANE RNA Guide
auacguugcugcgacggcaga

SEQ ID NO: 20665 - RNA, 21 nt, Artificial Sequence
  ELANE RNA Guide
caacguaugcacucucgugag

SEQ ID NO: 20666 - RNA, 21 nt, Artificial Sequence
  ELANE RNA Guide
cacgagagugcauacguugcu

SEQ ID NO: 20667 - RNA, 21 nt, Artificial Sequence
  ELANE RNA Guide
cagcaacguaugcacucucgu

SEQ ID NO: 20668 - RNA, 21 nt, Artificial Sequence
  ELANE RNA Guide
cauacguugcugcgacggcag

SEQ ID NO: 20669 - RNA, 21 nt, Artificial Sequence
  ELANE RNA Guide
ccccucacgagagugcauacg

SEQ ID NO: 20670 - RNA, 21 nt, Artificial Sequence
  ELANE RNA Guide
cccucacgagagugcauacgu

SEQ ID NO: 20671 - RNA, 21 nt, Artificial Sequence
  ELANE RNA Guide
cccucugccgucgcagcaacg

SEQ ID NO: 20672 - RNA, 21 nt, Artificial Sequence
  ELANE RNA Guide
ccgucgcagcaacguaugcac

SEQ ID NO: 20673 - RNA, 21 nt, Artificial Sequence
  ELANE RNA Guide
ccucacgagagugcauacguu

SEQ ID NO: 20674 - RNA, 21 nt, Artificial Sequence
  ELANE RNA Guide
ccucugccgucgcagcaacgu

SEQ ID NO: 20675 - RNA, 21 nt, Artificial Sequence
  ELANE RNA Guide
cgagagugcauacguugcugc

SEQ ID NO: 20676 - RNA, 21 nt, Artificial Sequence
  ELANE RNA Guide
cgcagcaacguaugcacucuc

SEQ ID NO: 20677 - RNA, 21 nt, Artificial Sequence
  ELANE RNA Guide
cggccccucacgagagugcau

SEQ ID NO: 20678 - RNA, 21 nt, Artificial Sequence
  ELANE RNA Guide
cguaugcacucucgugagggg

SEQ ID NO: 20679 - RNA, 21 nt, Artificial Sequence
  ELANE RNA Guide
cgucgcagcaacguaugcacu

SEQ ID NO: 20680 - RNA, 21 nt, Artificial Sequence
  ELANE RNA Guide
cucacgagagugcauacguug

SEQ ID NO: 20681 - RNA, 21 nt, Artificial Sequence
  ELANE RNA Guide
cucugccgucgcagcaacgua

SEQ ID NO: 20682 - RNA, 21 nt, Artificial Sequence
  ELANE RNA Guide
cugccggccccucacgagagu

SEQ ID NO: 20683 - RNA, 21 nt, Artificial Sequence
  ELANE RNA Guide
cugccgucgcagcaacguaug

SEQ ID NO: 20684 - RNA, 21 nt, Artificial Sequence
  ELANE RNA Guide
gagagugcauacguugcugcg

SEQ ID NO: 20685 - RNA, 21 nt, Artificial Sequence
  ELANE RNA Guide
gagugcauacguugcugcgac

SEQ ID NO: 20686 - RNA, 21 nt, Artificial Sequence
  ELANE RNA Guide
gcaacguaugcacucucguga

SEQ ID NO: 20687 - RNA, 21 nt, Artificial Sequence
  ELANE RNA Guide
gcagcaacguaugcacucucg

SEQ ID NO: 20688 - RNA, 21 nt, Artificial Sequence
  ELANE RNA Guide
gcauacguugcugcgacggca

SEQ ID NO: 20689 - RNA, 21 nt, Artificial Sequence
  ELANE RNA Guide
gccccucacgagagugcauac

SEQ ID NO: 20690 - RNA, 21 nt, Artificial Sequence
  ELANE RNA Guide
gccgucgcagcaacguaugca

SEQ ID NO: 20691 - RNA, 21 nt, Artificial Sequence
  ELANE RNA Guide
ggccccucacgagagugcaua

SEQ ID NO: 20692 - RNA, 21 nt, Artificial Sequence
  ELANE RNA Guide
guaugcacucucgugaggggc

SEQ ID NO: 20693 - RNA, 21 nt, Artificial Sequence
  ELANE RNA Guide
gucgcagcaacguaugcacuc

SEQ ID NO: 20694 - RNA, 21 nt, Artificial Sequence
  ELANE RNA Guide
gugcauacguugcugcgacgg

SEQ ID NO: 20695 - RNA, 21 nt, Artificial Sequence
  ELANE RNA Guide
uaugcacucucgugaggggcc

SEQ ID NO: 20696 - RNA, 21 nt, Artificial Sequence
  ELANE RNA Guide
ucacgagagugcauacguugc

SEQ ID NO: 20697 - RNA, 21 nt, Artificial Sequence
  ELANE RNA Guide
ucgcagcaacguaugcacucu

SEQ ID NO: 20698 - RNA, 21 nt, Artificial Sequence
  ELANE RNA Guide
ucugccgucgcagcaacguau

SEQ ID NO: 20699 - RNA, 21 nt, Artificial Sequence
  ELANE RNA Guide
ugcauacguugcugcgacggc

SEQ ID NO: 20700 - RNA, 21 nt, Artificial Sequence
  ELANE RNA Guide
ugccggccccucacgagagug

SEQ ID NO: 20701 - RNA, 21 nt, Artificial Sequence
  ELANE RNA Guide
ugccgucgcagcaacguaugc

SEQ ID NO: 20702 - RNA, 22 nt, Artificial Sequence
  ELANE RNA Guide
aacguaugcacucucgugaggg

SEQ ID NO: 20703 - RNA, 22 nt, Artificial Sequence
  ELANE RNA Guide
acgagagugcauacguugcugc

SEQ ID NO: 20704 - RNA, 22 nt, Artificial Sequence
  ELANE RNA Guide
acguaugcacucucgugagggg

SEQ ID NO: 20705 - RNA, 22 nt, Artificial Sequence
  ELANE RNA Guide
agagugcauacguugcugcgac

SEQ ID NO: 20706 - RNA, 22 nt, Artificial Sequence
  ELANE RNA Guide
agcaacguaugcacucucguga

SEQ ID NO: 20707 - RNA, 22 nt, Artificial Sequence
  ELANE RNA Guide
agugcauacguugcugcgacgg

SEQ ID NO: 20708 - RNA, 22 nt, Artificial Sequence
  ELANE RNA Guide
auacguugcugcgacggcagag

SEQ ID NO: 20709 - RNA, 22 nt, Artificial Sequence
  ELANE RNA Guide
caacguaugcacucucgugagg

SEQ ID NO: 20710 - RNA, 22 nt, Artificial Sequence
  ELANE RNA Guide
cacgagagugcauacguugcug

SEQ ID NO: 20711 - RNA, 22 nt, Artificial Sequence
  ELANE RNA Guide
cagcaacguaugcacucucgug

SEQ ID NO: 20712 - RNA, 22 nt, Artificial Sequence
  ELANE RNA Guide
cauacguugcugcgacggcaga

SEQ ID NO: 20713 - RNA, 22 nt, Artificial Sequence
  ELANE RNA Guide
ccccucacgagagugcauacgu

SEQ ID NO: 20714 - RNA, 22 nt, Artificial Sequence
  ELANE RNA Guide
cccucacgagagugcauacguu

SEQ ID NO: 20715 - RNA, 22 nt, Artificial Sequence
  ELANE RNA Guide
cccucugccgucgcagcaacgu

SEQ ID NO: 20716 - RNA, 22 nt, Artificial Sequence
  ELANE RNA Guide
ccggccccucacgagagugcau

SEQ ID NO: 20717 - RNA, 22 nt, Artificial Sequence
  ELANE RNA Guide
ccgucgcagcaacguaugcacu

SEQ ID NO: 20718 - RNA, 22 nt, Artificial Sequence
  ELANE RNA Guide
ccucacgagagugcauacguug

SEQ ID NO: 20719 - RNA, 22 nt, Artificial Sequence
  ELANE RNA Guide
ccucugccgucgcagcaacgua

SEQ ID NO: 20720 - RNA, 22 nt, Artificial Sequence
  ELANE RNA Guide
ccugccggccccucacgagagu

SEQ ID NO: 20721 - RNA, 22 nt, Artificial Sequence
  ELANE RNA Guide
cgagagugcauacguugcugcg

SEQ ID NO: 20722 - RNA, 22 nt, Artificial Sequence
  ELANE RNA Guide
cgcagcaacguaugcacucucg

SEQ ID NO: 20723 - RNA, 22 nt, Artificial Sequence
  ELANE RNA Guide
cggccccucacgagagugcaua

SEQ ID NO: 20724 - RNA, 22 nt, Artificial Sequence
  ELANE RNA Guide
cguaugcacucucgugaggggc

SEQ ID NO: 20725 - RNA, 22 nt, Artificial Sequence
  ELANE RNA Guide
cgucgcagcaacguaugcacuc

SEQ ID NO: 20726 - RNA, 22 nt, Artificial Sequence
  ELANE RNA Guide
cucacgagagugcauacguugc

SEQ ID NO: 20727 - RNA, 22 nt, Artificial Sequence
  ELANE RNA Guide
cucugccgucgcagcaacguau

SEQ ID NO: 20728 - RNA, 22 nt, Artificial Sequence
  ELANE RNA Guide
cugccggccccucacgagagug

SEQ ID NO: 20729 - RNA, 22 nt, Artificial Sequence
  ELANE RNA Guide
cugccgucgcagcaacguaugc

SEQ ID NO: 20730 - RNA, 22 nt, Artificial Sequence
  ELANE RNA Guide
gagagugcauacguugcugcga

SEQ ID NO: 20731 - RNA, 22 nt, Artificial Sequence
  ELANE RNA Guide
gagugcauacguugcugcgacg

SEQ ID NO: 20732 - RNA, 22 nt, Artificial Sequence
  ELANE RNA Guide
gcaacguaugcacucucgugag

SEQ ID NO: 20733 - RNA, 22 nt, Artificial Sequence
  ELANE RNA Guide
gcagcaacguaugcacucucgu

SEQ ID NO: 20734 - RNA, 22 nt, Artificial Sequence
  ELANE RNA Guide
gcauacguugcugcgacggcag

SEQ ID NO: 20735 - RNA, 22 nt, Artificial Sequence
  ELANE RNA Guide
gccccucacgagagugcauacg

SEQ ID NO: 20736 - RNA, 22 nt, Artificial Sequence
  ELANE RNA Guide
gccgucgcagcaacguaugcac

SEQ ID NO: 20737 - RNA, 22 nt, Artificial Sequence
  ELANE RNA Guide
ggccccucacgagagugcauac

SEQ ID NO: 20738 - RNA, 22 nt, Artificial Sequence
  ELANE RNA Guide
guaugcacucucgugaggggcc

SEQ ID NO: 20739 - RNA, 22 nt, Artificial Sequence
  ELANE RNA Guide
gucgcagcaacguaugcacucu

SEQ ID NO: 20740 - RNA, 22 nt, Artificial Sequence
  ELANE RNA Guide
gugcauacguugcugcgacggc

SEQ ID NO: 20741 - RNA, 22 nt, Artificial Sequence
  ELANE RNA Guide
uaugcacucucgugaggggccg

SEQ ID NO: 20742 - RNA, 22 nt, Artificial Sequence
  ELANE RNA Guide
ucacgagagugcauacguugcu

SEQ ID NO: 20743 - RNA, 22 nt, Artificial Sequence
  ELANE RNA Guide
ucccucugccgucgcagcaacg

SEQ ID NO: 20744 - RNA, 22 nt, Artificial Sequence
  ELANE RNA Guide
ucgcagcaacguaugcacucuc

SEQ ID NO: 20745 - RNA, 22 nt, Artificial Sequence
  ELANE RNA Guide
ucugccgucgcagcaacguaug

SEQ ID NO: 20746 - RNA, 22 nt, Artificial Sequence
  ELANE RNA Guide
ugcauacguugcugcgacggca

SEQ ID NO: 20747 - RNA, 22 nt, Artificial Sequence
  ELANE RNA Guide
ugccgucgcagcaacguaugca

SEQ ID NO: 20748 - RNA, 20 nt, Artificial Sequence
  ELANE RNA Guide
aacgucugaacucucgugag

SEQ ID NO: 20749 - RNA, 20 nt, Artificial Sequence
  ELANE RNA Guide
acgagaguucagacguugcu

SEQ ID NO: 20750 - RNA, 20 nt, Artificial Sequence
  ELANE RNA Guide
acgucugaacucucgugagg

SEQ ID NO: 20751 - RNA, 20 nt, Artificial Sequence
  ELANE RNA Guide
agaguucagacguugcugcg

SEQ ID NO: 20752 - RNA, 20 nt, Artificial Sequence
  ELANE RNA Guide
agcaacgucugaacucucgu

SEQ ID NO: 20753 - RNA, 20 nt, Artificial Sequence
  ELANE RNA Guide
aguucagacguugcugcgac

SEQ ID NO: 20754 - RNA, 20 nt, Artificial Sequence
  ELANE RNA Guide
caacgucugaacucucguga

SEQ ID NO: 20755 - RNA, 20 nt, Artificial Sequence
  ELANE RNA Guide
cacgagaguucagacguugc

SEQ ID NO: 20756 - RNA, 20 nt, Artificial Sequence
  ELANE RNA Guide
cagcaacgucugaacucucg

SEQ ID NO: 20757 - RNA, 20 nt, Artificial Sequence
  ELANE RNA Guide
ccccucacgagaguucagac

SEQ ID NO: 20758 - RNA, 20 nt, Artificial Sequence
  ELANE RNA Guide
cccucacgagaguucagacg

SEQ ID NO: 20759 - RNA, 20 nt, Artificial Sequence
  ELANE RNA Guide
ccggccccucacgagaguuc

SEQ ID NO: 20760 - RNA, 20 nt, Artificial Sequence
  ELANE RNA Guide
ccgucgcagcaacgucugaa

SEQ ID NO: 20761 - RNA, 20 nt, Artificial Sequence
  ELANE RNA Guide
ccucacgagaguucagacgu

SEQ ID NO: 20762 - RNA, 20 nt, Artificial Sequence
  ELANE RNA Guide
ccugccggccccucacgaga

SEQ ID NO: 20763 - RNA, 20 nt, Artificial Sequence
  ELANE RNA Guide
cgagaguucagacguugcug

SEQ ID NO: 20764 - RNA, 20 nt, Artificial Sequence
  ELANE RNA Guide
cgcagcaacgucugaacucu

SEQ ID NO: 20765 - RNA, 20 nt, Artificial Sequence
  ELANE RNA Guide
cggccccucacgagaguuca

SEQ ID NO: 20766 - RNA, 20 nt, Artificial Sequence
  ELANE RNA Guide
cgucgcagcaacgucugaac

SEQ ID NO: 20767 - RNA, 20 nt, Artificial Sequence
  ELANE RNA Guide
cgucugaacucucgugaggg

SEQ ID NO: 20768 - RNA, 20 nt, Artificial Sequence
  ELANE RNA Guide
cucacgagaguucagacguu

SEQ ID NO: 20769 - RNA, 20 nt, Artificial Sequence
  ELANE RNA Guide
cugaacucucgugaggggcc

SEQ ID NO: 20770 - RNA, 20 nt, Artificial Sequence
  ELANE RNA Guide
cugccggccccucacgagag

SEQ ID NO: 20771 - RNA, 20 nt, Artificial Sequence
  ELANE RNA Guide
cugccgucgcagcaacgucu

SEQ ID NO: 20772 - RNA, 20 nt, Artificial Sequence
  ELANE RNA Guide
gaacucucgugaggggccgg

SEQ ID NO: 20773 - RNA, 20 nt, Artificial Sequence
  ELANE RNA Guide
gagaguucagacguugcugc

SEQ ID NO: 20774 - RNA, 20 nt, Artificial Sequence
  ELANE RNA Guide
gaguucagacguugcugcga

SEQ ID NO: 20775 - RNA, 20 nt, Artificial Sequence
  ELANE RNA Guide
gcaacgucugaacucucgug

SEQ ID NO: 20776 - RNA, 20 nt, Artificial Sequence
  ELANE RNA Guide
gcagcaacgucugaacucuc

SEQ ID NO: 20777 - RNA, 20 nt, Artificial Sequence
  ELANE RNA Guide
gccccucacgagaguucaga

SEQ ID NO: 20778 - RNA, 20 nt, Artificial Sequence
  ELANE RNA Guide
gccggccccucacgagaguu

SEQ ID NO: 20779 - RNA, 20 nt, Artificial Sequence
  ELANE RNA Guide
gccgucgcagcaacgucuga

SEQ ID NO: 20780 - RNA, 20 nt, Artificial Sequence
  ELANE RNA Guide
gccugccggccccucacgag

SEQ ID NO: 20781 - RNA, 20 nt, Artificial Sequence
  ELANE RNA Guide
ggccccucacgagaguucag

SEQ ID NO: 20782 - RNA, 20 nt, Artificial Sequence
  ELANE RNA Guide
gucgcagcaacgucugaacu

SEQ ID NO: 20783 - RNA, 20 nt, Artificial Sequence
  ELANE RNA Guide
gucugaacucucgugagggg

SEQ ID NO: 20784 - RNA, 20 nt, Artificial Sequence
  ELANE RNA Guide
guucagacguugcugcgacg

SEQ ID NO: 20785 - RNA, 20 nt, Artificial Sequence
  ELANE RNA Guide
ucacgagaguucagacguug

SEQ ID NO: 20786 - RNA, 20 nt, Artificial Sequence
  ELANE RNA Guide
ucgcagcaacgucugaacuc

SEQ ID NO: 20787 - RNA, 20 nt, Artificial Sequence
  ELANE RNA Guide
ucugaacucucgugaggggc

SEQ ID NO: 20788 - RNA, 20 nt, Artificial Sequence
  ELANE RNA Guide
ucugccgucgcagcaacguc

SEQ ID NO: 20789 - RNA, 20 nt, Artificial Sequence
  ELANE RNA Guide
ugaacucucgugaggggccg

SEQ ID NO: 20790 - RNA, 20 nt, Artificial Sequence
  ELANE RNA Guide
ugccgucgcagcaacgucug

SEQ ID NO: 20791 - RNA, 20 nt, Artificial Sequence
  ELANE RNA Guide
uucagacguugcugcgacgg

SEQ ID NO: 20792 - RNA, 21 nt, Artificial Sequence
  ELANE RNA Guide
aacgucugaacucucgugagg

SEQ ID NO: 20793 - RNA, 21 nt, Artificial Sequence
  ELANE RNA Guide
acgagaguucagacguugcug

SEQ ID NO: 20794 - RNA, 21 nt, Artificial Sequence
  ELANE RNA Guide
acgucugaacucucgugaggg

SEQ ID NO: 20795 - RNA, 21 nt, Artificial Sequence
  ELANE RNA Guide
agaguucagacguugcugcga

SEQ ID NO: 20796 - RNA, 21 nt, Artificial Sequence
  ELANE RNA Guide
agcaacgucugaacucucgug

SEQ ID NO: 20797 - RNA, 21 nt, Artificial Sequence
  ELANE RNA Guide
aguucagacguugcugcgacg

SEQ ID NO: 20798 - RNA, 21 nt, Artificial Sequence
  ELANE RNA Guide
caacgucugaacucucgugag

SEQ ID NO: 20799 - RNA, 21 nt, Artificial Sequence
  ELANE RNA Guide
cacgagaguucagacguugcu

SEQ ID NO: 20800 - RNA, 21 nt, Artificial Sequence
  ELANE RNA Guide
cagcaacgucugaacucucgu

SEQ ID NO: 20801 - RNA, 21 nt, Artificial Sequence
  ELANE RNA Guide
ccccucacgagaguucagacg

SEQ ID NO: 20802 - RNA, 21 nt, Artificial Sequence
  ELANE RNA Guide
cccucacgagaguucagacgu

SEQ ID NO: 20803 - RNA, 21 nt, Artificial Sequence
  ELANE RNA Guide
ccggccccucacgagaguuca

SEQ ID NO: 20804 - RNA, 21 nt, Artificial Sequence
  ELANE RNA Guide
ccgucgcagcaacgucugaac

SEQ ID NO: 20805 - RNA, 21 nt, Artificial Sequence
  ELANE RNA Guide
ccucacgagaguucagacguu

SEQ ID NO: 20806 - RNA, 21 nt, Artificial Sequence
  ELANE RNA Guide
ccugccggccccucacgagag

SEQ ID NO: 20807 - RNA, 21 nt, Artificial Sequence
  ELANE RNA Guide
cgagaguucagacguugcugc

SEQ ID NO: 20808 - RNA, 21 nt, Artificial Sequence
  ELANE RNA Guide
cgcagcaacgucugaacucuc

SEQ ID NO: 20809 - RNA, 21 nt, Artificial Sequence
  ELANE RNA Guide
cggccccucacgagaguucag

SEQ ID NO: 20810 - RNA, 21 nt, Artificial Sequence
  ELANE RNA Guide
cgucgcagcaacgucugaacu

SEQ ID NO: 20811 - RNA, 21 nt, Artificial Sequence
  ELANE RNA Guide
cgucugaacucucgugagggg

SEQ ID NO: 20812 - RNA, 21 nt, Artificial Sequence
  ELANE RNA Guide
cucacgagaguucagacguug

SEQ ID NO: 20813 - RNA, 21 nt, Artificial Sequence
  ELANE RNA Guide
cucugccgucgcagcaacguc

SEQ ID NO: 20814 - RNA, 21 nt, Artificial Sequence
  ELANE RNA Guide
cugaacucucgugaggggccg

SEQ ID NO: 20815 - RNA, 21 nt, Artificial Sequence
  ELANE RNA Guide
cugccgucgcagcaacgucug

SEQ ID NO: 20816 - RNA, 21 nt, Artificial Sequence
  ELANE RNA Guide
gaacucucgugaggggccggc

SEQ ID NO: 20817 - RNA, 21 nt, Artificial Sequence
  ELANE RNA Guide
gagaguucagacguugcugcg

SEQ ID NO: 20818 - RNA, 21 nt, Artificial Sequence
  ELANE RNA Guide
gaguucagacguugcugcgac

SEQ ID NO: 20819 - RNA, 21 nt, Artificial Sequence
  ELANE RNA Guide
gcaacgucugaacucucguga

SEQ ID NO: 20820 - RNA, 21 nt, Artificial Sequence
  ELANE RNA Guide
gcagcaacgucugaacucucg

SEQ ID NO: 20821 - RNA, 21 nt, Artificial Sequence
  ELANE RNA Guide
gccccucacgagaguucagac

SEQ ID NO: 20822 - RNA, 21 nt, Artificial Sequence
  ELANE RNA Guide
gccggccccucacgagaguuc

SEQ ID NO: 20823 - RNA, 21 nt, Artificial Sequence
  ELANE RNA Guide
gccgucgcagcaacgucugaa

SEQ ID NO: 20824 - RNA, 21 nt, Artificial Sequence
  ELANE RNA Guide
gccugccggccccucacgaga

SEQ ID NO: 20825 - RNA, 21 nt, Artificial Sequence
  ELANE RNA Guide
ggccccucacgagaguucaga

SEQ ID NO: 20826 - RNA, 21 nt, Artificial Sequence
  ELANE RNA Guide
gucgcagcaacgucugaacuc

SEQ ID NO: 20827 - RNA, 21 nt, Artificial Sequence
  ELANE RNA Guide
gucugaacucucgugaggggc

SEQ ID NO: 20828 - RNA, 21 nt, Artificial Sequence
  ELANE RNA Guide
guucagacguugcugcgacgg

SEQ ID NO: 20829 - RNA, 21 nt, Artificial Sequence
  ELANE RNA Guide
ucacgagaguucagacguugc

SEQ ID NO: 20830 - RNA, 21 nt, Artificial Sequence
  ELANE RNA Guide
ucgcagcaacgucugaacucu

SEQ ID NO: 20831 - RNA, 21 nt, Artificial Sequence
  ELANE RNA Guide
ucugaacucucgugaggggcc

SEQ ID NO: 20832 - RNA, 21 nt, Artificial Sequence
  ELANE RNA Guide
ucugccgucgcagcaacgucu

SEQ ID NO: 20833 - RNA, 21 nt, Artificial Sequence
  ELANE RNA Guide
ugaacucucgugaggggccgg

SEQ ID NO: 20834 - RNA, 21 nt, Artificial Sequence
  ELANE RNA Guide
ugccggccccucacgagaguu

SEQ ID NO: 20835 - RNA, 21 nt, Artificial Sequence
  ELANE RNA Guide
ugccgucgcagcaacgucuga

SEQ ID NO: 20836 - RNA, 21 nt, Artificial Sequence
  ELANE RNA Guide
uucagacguugcugcgacggc

SEQ ID NO: 20837 - RNA, 22 nt, Artificial Sequence
  ELANE RNA Guide
aacgucugaacucucgugaggg

SEQ ID NO: 20838 - RNA, 22 nt, Artificial Sequence
  ELANE RNA Guide
acgagaguucagacguugcugc

SEQ ID NO: 20839 - RNA, 22 nt, Artificial Sequence
  ELANE RNA Guide
acgucugaacucucgugagggg

SEQ ID NO: 20840 - RNA, 22 nt, Artificial Sequence
  ELANE RNA Guide
agaguucagacguugcugcgac

SEQ ID NO: 20841 - RNA, 22 nt, Artificial Sequence
  ELANE RNA Guide
agcaacgucugaacucucguga

SEQ ID NO: 20842 - RNA, 22 nt, Artificial Sequence
  ELANE RNA Guide
aguucagacguugcugcgacgg

SEQ ID NO: 20843 - RNA, 22 nt, Artificial Sequence
  ELANE RNA Guide
caacgucugaacucucgugagg

SEQ ID NO: 20844 - RNA, 22 nt, Artificial Sequence
  ELANE RNA Guide
cacgagaguucagacguugcug

SEQ ID NO: 20845 - RNA, 22 nt, Artificial Sequence
  ELANE RNA Guide
cagcaacgucugaacucucgug

SEQ ID NO: 20846 - RNA, 22 nt, Artificial Sequence
  ELANE RNA Guide
ccccucacgagaguucagacgu

SEQ ID NO: 20847 - RNA, 22 nt, Artificial Sequence
  ELANE RNA Guide
cccucacgagaguucagacguu

SEQ ID NO: 20848 - RNA, 22 nt, Artificial Sequence
  ELANE RNA Guide
ccggccccucacgagaguucag

SEQ ID NO: 20849 - RNA, 22 nt, Artificial Sequence
  ELANE RNA Guide
ccgucgcagcaacgucugaacu

SEQ ID NO: 20850 - RNA, 22 nt, Artificial Sequence
  ELANE RNA Guide
ccucacgagaguucagacguug

SEQ ID NO: 20851 - RNA, 22 nt, Artificial Sequence
  ELANE RNA Guide
ccucugccgucgcagcaacguc

SEQ ID NO: 20852 - RNA, 22 nt, Artificial Sequence
  ELANE RNA Guide
cgagaguucagacguugcugcg

SEQ ID NO: 20853 - RNA, 22 nt, Artificial Sequence
  ELANE RNA Guide
cgcagcaacgucugaacucucg

SEQ ID NO: 20854 - RNA, 22 nt, Artificial Sequence
  ELANE RNA Guide
cggccccucacgagaguucaga

SEQ ID NO: 20855 - RNA, 22 nt, Artificial Sequence
  ELANE RNA Guide
cgucgcagcaacgucugaacuc

SEQ ID NO: 20856 - RNA, 22 nt, Artificial Sequence
  ELANE RNA Guide
cgucugaacucucgugaggggc

SEQ ID NO: 20857 - RNA, 22 nt, Artificial Sequence
  ELANE RNA Guide
cucacgagaguucagacguugc

SEQ ID NO: 20858 - RNA, 22 nt, Artificial Sequence
  ELANE RNA Guide
cucugccgucgcagcaacgucu

SEQ ID NO: 20859 - RNA, 22 nt, Artificial Sequence
  ELANE RNA Guide
cugaacucucgugaggggccgg

SEQ ID NO: 20860 - RNA, 22 nt, Artificial Sequence
  ELANE RNA Guide
cugccggccccucacgagaguu

SEQ ID NO: 20861 - RNA, 22 nt, Artificial Sequence
  ELANE RNA Guide
cugccgucgcagcaacgucuga

SEQ ID NO: 20862 - RNA, 22 nt, Artificial Sequence
  ELANE RNA Guide
gaacucucgugaggggccggca

SEQ ID NO: 20863 - RNA, 22 nt, Artificial Sequence
  ELANE RNA Guide
gagaguucagacguugcugcga

SEQ ID NO: 20864 - RNA, 22 nt, Artificial Sequence
  ELANE RNA Guide
gaguucagacguugcugcgacg

SEQ ID NO: 20865 - RNA, 22 nt, Artificial Sequence
  ELANE RNA Guide
gcaacgucugaacucucgugag

SEQ ID NO: 20866 - RNA, 22 nt, Artificial Sequence
  ELANE RNA Guide
gcagcaacgucugaacucucgu

SEQ ID NO: 20867 - RNA, 22 nt, Artificial Sequence
  ELANE RNA Guide
gccccucacgagaguucagacg

SEQ ID NO: 20868 - RNA, 22 nt, Artificial Sequence
  ELANE RNA Guide
gccggccccucacgagaguuca

SEQ ID NO: 20869 - RNA, 22 nt, Artificial Sequence
  ELANE RNA Guide
gccgucgcagcaacgucugaac

SEQ ID NO: 20870 - RNA, 22 nt, Artificial Sequence
  ELANE RNA Guide
gccugccggccccucacgagag

SEQ ID NO: 20871 - RNA, 22 nt, Artificial Sequence
  ELANE RNA Guide
ggccccucacgagaguucagac

SEQ ID NO: 20872 - RNA, 22 nt, Artificial Sequence
  ELANE RNA Guide
ggccugccggccccucacgaga

SEQ ID NO: 20873 - RNA, 22 nt, Artificial Sequence
  ELANE RNA Guide
gucgcagcaacgucugaacucu

SEQ ID NO: 20874 - RNA, 22 nt, Artificial Sequence
  ELANE RNA Guide
gucugaacucucgugaggggcc

SEQ ID NO: 20875 - RNA, 22 nt, Artificial Sequence
  ELANE RNA Guide
guucagacguugcugcgacggc

SEQ ID NO: 20876 - RNA, 22 nt, Artificial Sequence
  ELANE RNA Guide
ucacgagaguucagacguugcu

SEQ ID NO: 20877 - RNA, 22 nt, Artificial Sequence
  ELANE RNA Guide
ucgcagcaacgucugaacucuc

SEQ ID NO: 20878 - RNA, 22 nt, Artificial Sequence
  ELANE RNA Guide
ucugaacucucgugaggggccg

SEQ ID NO: 20879 - RNA, 22 nt, Artificial Sequence
  ELANE RNA Guide
ucugccgucgcagcaacgucug

SEQ ID NO: 20880 - RNA, 22 nt, Artificial Sequence
  ELANE RNA Guide
ugaacucucgugaggggccggc

SEQ ID NO: 20881 - RNA, 22 nt, Artificial Sequence
  ELANE RNA Guide
ugccggccccucacgagaguuc

SEQ ID NO: 20882 - RNA, 22 nt, Artificial Sequence
  ELANE RNA Guide
ugccgucgcagcaacgucugaa

SEQ ID NO: 20883 - RNA, 22 nt, Artificial Sequence
  ELANE RNA Guide
uucagacguugcugcgacggca

SEQ ID NO: 20884 - RNA, 20 nt, Artificial Sequence
  ELANE RNA Guide
aacgucugcacucuggugag

SEQ ID NO: 20885 - RNA, 20 nt, Artificial Sequence
  ELANE RNA Guide
accagagugcagacguugcu

SEQ ID NO: 20886 - RNA, 20 nt, Artificial Sequence
  ELANE RNA Guide
acgucugcacucuggugagg

SEQ ID NO: 20887 - RNA, 20 nt, Artificial Sequence
  ELANE RNA Guide
acucuggugaggggccggca

SEQ ID NO: 20888 - RNA, 20 nt, Artificial Sequence
  ELANE RNA Guide
agcaacgucugcacucuggu

SEQ ID NO: 20889 - RNA, 20 nt, Artificial Sequence
  ELANE RNA Guide
caacgucugcacucugguga

SEQ ID NO: 20890 - RNA, 20 nt, Artificial Sequence
  ELANE RNA Guide
caccagagugcagacguugc

SEQ ID NO: 20891 - RNA, 20 nt, Artificial Sequence
  ELANE RNA Guide
cacucuggugaggggccggc

SEQ ID NO: 20892 - RNA, 20 nt, Artificial Sequence
  ELANE RNA Guide
cagcaacgucugcacucugg

SEQ ID NO: 20893 - RNA, 20 nt, Artificial Sequence
  ELANE RNA Guide
ccagagugcagacguugcug

SEQ ID NO: 20894 - RNA, 20 nt, Artificial Sequence
  ELANE RNA Guide
ccccucaccagagugcagac

SEQ ID NO: 20895 - RNA, 20 nt, Artificial Sequence
  ELANE RNA Guide
cccucaccagagugcagacg

SEQ ID NO: 20896 - RNA, 20 nt, Artificial Sequence
  ELANE RNA Guide
ccggccccucaccagagugc

SEQ ID NO: 20897 - RNA, 20 nt, Artificial Sequence
  ELANE RNA Guide
ccucaccagagugcagacgu

SEQ ID NO: 20898 - RNA, 20 nt, Artificial Sequence
  ELANE RNA Guide
ccugccggccccucaccaga

SEQ ID NO: 20899 - RNA, 20 nt, Artificial Sequence
  ELANE RNA Guide
cgcagcaacgucugcacucu

SEQ ID NO: 20900 - RNA, 20 nt, Artificial Sequence
  ELANE RNA Guide
cggccccucaccagagugca

SEQ ID NO: 20901 - RNA, 20 nt, Artificial Sequence
  ELANE RNA Guide
cgucgcagcaacgucugcac

SEQ ID NO: 20902 - RNA, 20 nt, Artificial Sequence
  ELANE RNA Guide
cgucugcacucuggugaggg

SEQ ID NO: 20903 - RNA, 20 nt, Artificial Sequence
  ELANE RNA Guide
cucaccagagugcagacguu

SEQ ID NO: 20904 - RNA, 20 nt, Artificial Sequence
  ELANE RNA Guide
cucuggugaggggccggcag

SEQ ID NO: 20905 - RNA, 20 nt, Artificial Sequence
  ELANE RNA Guide
cugcacucuggugaggggcc

SEQ ID NO: 20906 - RNA, 20 nt, Artificial Sequence
  ELANE RNA Guide
cugccggccccucaccagag

SEQ ID NO: 20907 - RNA, 20 nt, Artificial Sequence
  ELANE RNA Guide
cuggugaggggccggcaggc

SEQ ID NO: 20908 - RNA, 20 nt, Artificial Sequence
  ELANE RNA Guide
gcaacgucugcacucuggug

SEQ ID NO: 20909 - RNA, 20 nt, Artificial Sequence
  ELANE RNA Guide
gcacucuggugaggggccgg

SEQ ID NO: 20910 - RNA, 20 nt, Artificial Sequence
  ELANE RNA Guide
gcagcaacgucugcacucug

SEQ ID NO: 20911 - RNA, 20 nt, Artificial Sequence
  ELANE RNA Guide
gccccucaccagagugcaga

SEQ ID NO: 20912 - RNA, 20 nt, Artificial Sequence
  ELANE RNA Guide
gccggccccucaccagagug

SEQ ID NO: 20913 - RNA, 20 nt, Artificial Sequence
  ELANE RNA Guide
gccugccggccccucaccag

SEQ ID NO: 20914 - RNA, 20 nt, Artificial Sequence
  ELANE RNA Guide
ggccccucaccagagugcag

SEQ ID NO: 20915 - RNA, 20 nt, Artificial Sequence
  ELANE RNA Guide
ggccugccggccccucacca

SEQ ID NO: 20916 - RNA, 20 nt, Artificial Sequence
  ELANE RNA Guide
gucgcagcaacgucugcacu

SEQ ID NO: 20917 - RNA, 20 nt, Artificial Sequence
  ELANE RNA Guide
gucugcacucuggugagggg

SEQ ID NO: 20918 - RNA, 20 nt, Artificial Sequence
  ELANE RNA Guide
ucaccagagugcagacguug

SEQ ID NO: 20919 - RNA, 20 nt, Artificial Sequence
  ELANE RNA Guide
ucgcagcaacgucugcacuc

SEQ ID NO: 20920 - RNA, 20 nt, Artificial Sequence
  ELANE RNA Guide
ucugcacucuggugaggggc

SEQ ID NO: 20921 - RNA, 20 nt, Artificial Sequence
  ELANE RNA Guide
ucuggugaggggccggcagg

SEQ ID NO: 20922 - RNA, 20 nt, Artificial Sequence
  ELANE RNA Guide
ugcacucuggugaggggccg

SEQ ID NO: 20923 - RNA, 20 nt, Artificial Sequence
  ELANE RNA Guide
ugccggccccucaccagagu

SEQ ID NO: 20924 - RNA, 20 nt, Artificial Sequence
  ELANE RNA Guide
uggugaggggccggcaggcc

SEQ ID NO: 20925 - RNA, 21 nt, Artificial Sequence
  ELANE RNA Guide
aacgucugcacucuggugagg

SEQ ID NO: 20926 - RNA, 21 nt, Artificial Sequence
  ELANE RNA Guide
accagagugcagacguugcug

SEQ ID NO: 20927 - RNA, 21 nt, Artificial Sequence
  ELANE RNA Guide
acgucugcacucuggugaggg

SEQ ID NO: 20928 - RNA, 21 nt, Artificial Sequence
  ELANE RNA Guide
acucuggugaggggccggcag

SEQ ID NO: 20929 - RNA, 21 nt, Artificial Sequence
  ELANE RNA Guide
agcaacgucugcacucuggug

SEQ ID NO: 20930 - RNA, 21 nt, Artificial Sequence
  ELANE RNA Guide
caacgucugcacucuggugag

SEQ ID NO: 20931 - RNA, 21 nt, Artificial Sequence
  ELANE RNA Guide
caccagagugcagacguugcu

SEQ ID NO: 20932 - RNA, 21 nt, Artificial Sequence
  ELANE RNA Guide
cacucuggugaggggccggca

SEQ ID NO: 20933 - RNA, 21 nt, Artificial Sequence
  ELANE RNA Guide
cagcaacgucugcacucuggu

SEQ ID NO: 20934 - RNA, 21 nt, Artificial Sequence
  ELANE RNA Guide
ccagagugcagacguugcugc

SEQ ID NO: 20935 - RNA, 21 nt, Artificial Sequence
  ELANE RNA Guide
ccccucaccagagugcagacg

SEQ ID NO: 20936 - RNA, 21 nt, Artificial Sequence
  ELANE RNA Guide
cccucaccagagugcagacgu

SEQ ID NO: 20937 - RNA, 21 nt, Artificial Sequence
  ELANE RNA Guide
ccggccccucaccagagugca

SEQ ID NO: 20938 - RNA, 21 nt, Artificial Sequence
  ELANE RNA Guide
ccgucgcagcaacgucugcac

SEQ ID NO: 20939 - RNA, 21 nt, Artificial Sequence
  ELANE RNA Guide
ccucaccagagugcagacguu

SEQ ID NO: 20940 - RNA, 21 nt, Artificial Sequence
  ELANE RNA Guide
ccugccggccccucaccagag

SEQ ID NO: 20941 - RNA, 21 nt, Artificial Sequence
  ELANE RNA Guide
cgcagcaacgucugcacucug

SEQ ID NO: 20942 - RNA, 21 nt, Artificial Sequence
  ELANE RNA Guide
cggccccucaccagagugcag

SEQ ID NO: 20943 - RNA, 21 nt, Artificial Sequence
  ELANE RNA Guide
cgucgcagcaacgucugcacu

SEQ ID NO: 20944 - RNA, 21 nt, Artificial Sequence
  ELANE RNA Guide
cgucugcacucuggugagggg

SEQ ID NO: 20945 - RNA, 21 nt, Artificial Sequence
  ELANE RNA Guide
cucaccagagugcagacguug

SEQ ID NO: 20946 - RNA, 21 nt, Artificial Sequence
  ELANE RNA Guide
cucuggugaggggccggcagg

SEQ ID NO: 20947 - RNA, 21 nt, Artificial Sequence
  ELANE RNA Guide
cugcacucuggugaggggccg

SEQ ID NO: 20948 - RNA, 21 nt, Artificial Sequence
  ELANE RNA Guide
cugccggccccucaccagagu

SEQ ID NO: 20949 - RNA, 21 nt, Artificial Sequence
  ELANE RNA Guide
gcaacgucugcacucugguga

SEQ ID NO: 20950 - RNA, 21 nt, Artificial Sequence
  ELANE RNA Guide
gcacucuggugaggggccggc

SEQ ID NO: 20951 - RNA, 21 nt, Artificial Sequence
  ELANE RNA Guide
gcagcaacgucugcacucugg

SEQ ID NO: 20952 - RNA, 21 nt, Artificial Sequence
  ELANE RNA Guide
gccccucaccagagugcagac

SEQ ID NO: 20953 - RNA, 21 nt, Artificial Sequence
  ELANE RNA Guide
gccggccccucaccagagugc

SEQ ID NO: 20954 - RNA, 21 nt, Artificial Sequence
  ELANE RNA Guide
gccugccggccccucaccaga

SEQ ID NO: 20955 - RNA, 21 nt, Artificial Sequence
  ELANE RNA Guide
ggccccucaccagagugcaga

SEQ ID NO: 20956 - RNA, 21 nt, Artificial Sequence
  ELANE RNA Guide
gucgcagcaacgucugcacuc

SEQ ID NO: 20957 - RNA, 21 nt, Artificial Sequence
  ELANE RNA Guide
gucugcacucuggugaggggc

SEQ ID NO: 20958 - RNA, 21 nt, Artificial Sequence
  ELANE RNA Guide
ucaccagagugcagacguugc

SEQ ID NO: 20959 - RNA, 21 nt, Artificial Sequence
  ELANE RNA Guide
ucgcagcaacgucugcacucu

SEQ ID NO: 20960 - RNA, 21 nt, Artificial Sequence
  ELANE RNA Guide
ucugcacucuggugaggggcc

SEQ ID NO: 20961 - RNA, 21 nt, Artificial Sequence
  ELANE RNA Guide
ucuggugaggggccggcaggc

SEQ ID NO: 20962 - RNA, 21 nt, Artificial Sequence
  ELANE RNA Guide
ugcacucuggugaggggccgg

SEQ ID NO: 20963 - RNA, 21 nt, Artificial Sequence
  ELANE RNA Guide
ugccggccccucaccagagug

SEQ ID NO: 20964 - RNA, 22 nt, Artificial Sequence
  ELANE RNA Guide
aacgucugcacucuggugaggg

SEQ ID NO: 20965 - RNA, 22 nt, Artificial Sequence
  ELANE RNA Guide
accagagugcagacguugcugc

SEQ ID NO: 20966 - RNA, 22 nt, Artificial Sequence
  ELANE RNA Guide
acgucugcacucuggugagggg

SEQ ID NO: 20967 - RNA, 22 nt, Artificial Sequence
  ELANE RNA Guide
acucuggugaggggccggcagg

SEQ ID NO: 20968 - RNA, 22 nt, Artificial Sequence
  ELANE RNA Guide
agcaacgucugcacucugguga

SEQ ID NO: 20969 - RNA, 22 nt, Artificial Sequence
  ELANE RNA Guide
caacgucugcacucuggugagg

SEQ ID NO: 20970 - RNA, 22 nt, Artificial Sequence
  ELANE RNA Guide
caccagagugcagacguugcug

SEQ ID NO: 20971 - RNA, 22 nt, Artificial Sequence
  ELANE RNA Guide
cacucuggugaggggccggcag

SEQ ID NO: 20972 - RNA, 22 nt, Artificial Sequence
  ELANE RNA Guide
cagcaacgucugcacucuggug

SEQ ID NO: 20973 - RNA, 22 nt, Artificial Sequence
  ELANE RNA Guide
ccagagugcagacguugcugcg

SEQ ID NO: 20974 - RNA, 22 nt, Artificial Sequence
  ELANE RNA Guide
ccccucaccagagugcagacgu

SEQ ID NO: 20975 - RNA, 22 nt, Artificial Sequence
  ELANE RNA Guide
cccucaccagagugcagacguu

SEQ ID NO: 20976 - RNA, 22 nt, Artificial Sequence
  ELANE RNA Guide
ccggccccucaccagagugcag

SEQ ID NO: 20977 - RNA, 22 nt, Artificial Sequence
  ELANE RNA Guide
ccgucgcagcaacgucugcacu

SEQ ID NO: 20978 - RNA, 22 nt, Artificial Sequence
  ELANE RNA Guide
ccucaccagagugcagacguug

SEQ ID NO: 20979 - RNA, 22 nt, Artificial Sequence
  ELANE RNA Guide
ccugccggccccucaccagagu

SEQ ID NO: 20980 - RNA, 22 nt, Artificial Sequence
  ELANE RNA Guide
cgcagcaacgucugcacucugg

SEQ ID NO: 20981 - RNA, 22 nt, Artificial Sequence
  ELANE RNA Guide
cggccccucaccagagugcaga

SEQ ID NO: 20982 - RNA, 22 nt, Artificial Sequence
  ELANE RNA Guide
cgucgcagcaacgucugcacuc

SEQ ID NO: 20983 - RNA, 22 nt, Artificial Sequence
  ELANE RNA Guide
cgucugcacucuggugaggggc

SEQ ID NO: 20984 - RNA, 22 nt, Artificial Sequence
  ELANE RNA Guide
cucaccagagugcagacguugc

SEQ ID NO: 20985 - RNA, 22 nt, Artificial Sequence
  ELANE RNA Guide
cucuggugaggggccggcaggc

SEQ ID NO: 20986 - RNA, 22 nt, Artificial Sequence
  ELANE RNA Guide
cugcacucuggugaggggccgg

SEQ ID NO: 20987 - RNA, 22 nt, Artificial Sequence
  ELANE RNA Guide
cugccggccccucaccagagug

SEQ ID NO: 20988 - RNA, 22 nt, Artificial Sequence
  ELANE RNA Guide
gcaacgucugcacucuggugag

SEQ ID NO: 20989 - RNA, 22 nt, Artificial Sequence
  ELANE RNA Guide
gcacucuggugaggggccggca

SEQ ID NO: 20990 - RNA, 22 nt, Artificial Sequence
  ELANE RNA Guide
gcagcaacgucugcacucuggu

SEQ ID NO: 20991 - RNA, 22 nt, Artificial Sequence
  ELANE RNA Guide
gccccucaccagagugcagacg

SEQ ID NO: 20992 - RNA, 22 nt, Artificial Sequence
  ELANE RNA Guide
gccggccccucaccagagugca

SEQ ID NO: 20993 - RNA, 22 nt, Artificial Sequence
  ELANE RNA Guide
gccgucgcagcaacgucugcac

SEQ ID NO: 20994 - RNA, 22 nt, Artificial Sequence
  ELANE RNA Guide
gccugccggccccucaccagag

SEQ ID NO: 20995 - RNA, 22 nt, Artificial Sequence
  ELANE RNA Guide
ggccccucaccagagugcagac

SEQ ID NO: 20996 - RNA, 22 nt, Artificial Sequence
  ELANE RNA Guide
ggccugccggccccucaccaga

SEQ ID NO: 20997 - RNA, 22 nt, Artificial Sequence
  ELANE RNA Guide
gucgcagcaacgucugcacucu

SEQ ID NO: 20998 - RNA, 22 nt, Artificial Sequence
  ELANE RNA Guide
gucugcacucuggugaggggcc

SEQ ID NO: 20999 - RNA, 22 nt, Artificial Sequence
  ELANE RNA Guide
ucaccagagugcagacguugcu

SEQ ID NO: 21000 - RNA, 22 nt, Artificial Sequence
  ELANE RNA Guide
ucgcagcaacgucugcacucug

SEQ ID NO: 21001 - RNA, 22 nt, Artificial Sequence
  ELANE RNA Guide
ucugcacucuggugaggggccg

SEQ ID NO: 21002 - RNA, 22 nt, Artificial Sequence
  ELANE RNA Guide
ucuggugaggggccggcaggcc

SEQ ID NO: 21003 - RNA, 22 nt, Artificial Sequence
  ELANE RNA Guide
ugcacucuggugaggggccggc

SEQ ID NO: 21004 - RNA, 22 nt, Artificial Sequence
  ELANE RNA Guide
ugccggccccucaccagagugc

SEQ ID NO: 21005 - RNA, 20 nt, Artificial Sequence
  ELANE RNA Guide
aacgucugcacucucaugag

SEQ ID NO: 21006 - RNA, 20 nt, Artificial Sequence
  ELANE RNA Guide
acgucugcacucucaugagg

SEQ ID NO: 21007 - RNA, 20 nt, Artificial Sequence
  ELANE RNA Guide
acucucaugaggggccggca

SEQ ID NO: 21008 - RNA, 20 nt, Artificial Sequence
  ELANE RNA Guide
agcaacgucugcacucucau

SEQ ID NO: 21009 - RNA, 20 nt, Artificial Sequence
  ELANE RNA Guide
augagagugcagacguugcu

SEQ ID NO: 21010 - RNA, 20 nt, Artificial Sequence
  ELANE RNA Guide
caacgucugcacucucauga

SEQ ID NO: 21011 - RNA, 20 nt, Artificial Sequence
  ELANE RNA Guide
cacucucaugaggggccggc

SEQ ID NO: 21012 - RNA, 20 nt, Artificial Sequence
  ELANE RNA Guide
cagcaacgucugcacucuca

SEQ ID NO: 21013 - RNA, 20 nt, Artificial Sequence
  ELANE RNA Guide
caugagagugcagacguugc

SEQ ID NO: 21014 - RNA, 20 nt, Artificial Sequence
  ELANE RNA Guide
caugaggggccggcaggccg

SEQ ID NO: 21015 - RNA, 20 nt, Artificial Sequence
  ELANE RNA Guide
ccccucaugagagugcagac

SEQ ID NO: 21016 - RNA, 20 nt, Artificial Sequence
  ELANE RNA Guide
cccucaugagagugcagacg

SEQ ID NO: 21017 - RNA, 20 nt, Artificial Sequence
  ELANE RNA Guide
ccggccccucaugagagugc

SEQ ID NO: 21018 - RNA, 20 nt, Artificial Sequence
  ELANE RNA Guide
ccggccugccggccccucau

SEQ ID NO: 21019 - RNA, 20 nt, Artificial Sequence
  ELANE RNA Guide
ccucaugagagugcagacgu

SEQ ID NO: 21020 - RNA, 20 nt, Artificial Sequence
  ELANE RNA Guide
ccugccggccccucaugaga

SEQ ID NO: 21021 - RNA, 20 nt, Artificial Sequence
  ELANE RNA Guide
cggccccucaugagagugca

SEQ ID NO: 21022 - RNA, 20 nt, Artificial Sequence
  ELANE RNA Guide
cggccugccggccccucaug

SEQ ID NO: 21023 - RNA, 20 nt, Artificial Sequence
  ELANE RNA Guide
cgucugcacucucaugaggg

SEQ ID NO: 21024 - RNA, 20 nt, Artificial Sequence
  ELANE RNA Guide
cucaugagagugcagacguu

SEQ ID NO: 21025 - RNA, 20 nt, Artificial Sequence
  ELANE RNA Guide
cucaugaggggccggcaggc

SEQ ID NO: 21026 - RNA, 20 nt, Artificial Sequence
  ELANE RNA Guide
cucucaugaggggccggcag

SEQ ID NO: 21027 - RNA, 20 nt, Artificial Sequence
  ELANE RNA Guide
cugcacucucaugaggggcc

SEQ ID NO: 21028 - RNA, 20 nt, Artificial Sequence
  ELANE RNA Guide
cugccggccccucaugagag

SEQ ID NO: 21029 - RNA, 20 nt, Artificial Sequence
  ELANE RNA Guide
gcaacgucugcacucucaug

SEQ ID NO: 21030 - RNA, 20 nt, Artificial Sequence
  ELANE RNA Guide
gcacucucaugaggggccgg

SEQ ID NO: 21031 - RNA, 20 nt, Artificial Sequence
  ELANE RNA Guide
gcagcaacgucugcacucuc

SEQ ID NO: 21032 - RNA, 20 nt, Artificial Sequence
  ELANE RNA Guide
gccccucaugagagugcaga

SEQ ID NO: 21033 - RNA, 20 nt, Artificial Sequence
  ELANE RNA Guide
gccggccccucaugagagug

SEQ ID NO: 21034 - RNA, 20 nt, Artificial Sequence
  ELANE RNA Guide
gccugccggccccucaugag

SEQ ID NO: 21035 - RNA, 20 nt, Artificial Sequence
  ELANE RNA Guide
ggccccucaugagagugcag

SEQ ID NO: 21036 - RNA, 20 nt, Artificial Sequence
  ELANE RNA Guide
ggccugccggccccucauga

SEQ ID NO: 21037 - RNA, 20 nt, Artificial Sequence
  ELANE RNA Guide
gucugcacucucaugagggg

SEQ ID NO: 21038 - RNA, 20 nt, Artificial Sequence
  ELANE RNA Guide
ucaugagagugcagacguug

SEQ ID NO: 21039 - RNA, 20 nt, Artificial Sequence
  ELANE RNA Guide
ucaugaggggccggcaggcc

SEQ ID NO: 21040 - RNA, 20 nt, Artificial Sequence
  ELANE RNA Guide
ucucaugaggggccggcagg

SEQ ID NO: 21041 - RNA, 20 nt, Artificial Sequence
  ELANE RNA Guide
ucugcacucucaugaggggc

SEQ ID NO: 21042 - RNA, 20 nt, Artificial Sequence
  ELANE RNA Guide
ugcacucucaugaggggccg

SEQ ID NO: 21043 - RNA, 20 nt, Artificial Sequence
  ELANE RNA Guide
ugccggccccucaugagagu

SEQ ID NO: 21044 - RNA, 21 nt, Artificial Sequence
  ELANE RNA Guide
aacgucugcacucucaugagg

SEQ ID NO: 21045 - RNA, 21 nt, Artificial Sequence
  ELANE RNA Guide
acgucugcacucucaugaggg

SEQ ID NO: 21046 - RNA, 21 nt, Artificial Sequence
  ELANE RNA Guide
acucucaugaggggccggcag

SEQ ID NO: 21047 - RNA, 21 nt, Artificial Sequence
  ELANE RNA Guide
agcaacgucugcacucucaug

SEQ ID NO: 21048 - RNA, 21 nt, Artificial Sequence
  ELANE RNA Guide
augagagugcagacguugcug

SEQ ID NO: 21049 - RNA, 21 nt, Artificial Sequence
  ELANE RNA Guide
caacgucugcacucucaugag

SEQ ID NO: 21050 - RNA, 21 nt, Artificial Sequence
  ELANE RNA Guide
cacucucaugaggggccggca

SEQ ID NO: 21051 - RNA, 21 nt, Artificial Sequence
  ELANE RNA Guide
cagcaacgucugcacucucau

SEQ ID NO: 21052 - RNA, 21 nt, Artificial Sequence
  ELANE RNA Guide
caugagagugcagacguugcu

SEQ ID NO: 21053 - RNA, 21 nt, Artificial Sequence
  ELANE RNA Guide
ccccucaugagagugcagacg

SEQ ID NO: 21054 - RNA, 21 nt, Artificial Sequence
  ELANE RNA Guide
cccucaugagagugcagacgu

SEQ ID NO: 21055 - RNA, 21 nt, Artificial Sequence
  ELANE RNA Guide
ccggccccucaugagagugca

SEQ ID NO: 21056 - RNA, 21 nt, Artificial Sequence
  ELANE RNA Guide
ccucaugagagugcagacguu

SEQ ID NO: 21057 - RNA, 21 nt, Artificial Sequence
  ELANE RNA Guide
ccugccggccccucaugagag

SEQ ID NO: 21058 - RNA, 21 nt, Artificial Sequence
  ELANE RNA Guide
cgcagcaacgucugcacucuc

SEQ ID NO: 21059 - RNA, 21 nt, Artificial Sequence
  ELANE RNA Guide
cggccccucaugagagugcag

SEQ ID NO: 21060 - RNA, 21 nt, Artificial Sequence
  ELANE RNA Guide
cggccugccggccccucauga

SEQ ID NO: 21061 - RNA, 21 nt, Artificial Sequence
  ELANE RNA Guide
cgucugcacucucaugagggg

SEQ ID NO: 21062 - RNA, 21 nt, Artificial Sequence
  ELANE RNA Guide
cucaugagagugcagacguug

SEQ ID NO: 21063 - RNA, 21 nt, Artificial Sequence
  ELANE RNA Guide
cucaugaggggccggcaggcc

SEQ ID NO: 21064 - RNA, 21 nt, Artificial Sequence
  ELANE RNA Guide
cucucaugaggggccggcagg

SEQ ID NO: 21065 - RNA, 21 nt, Artificial Sequence
  ELANE RNA Guide
cugcacucucaugaggggccg

SEQ ID NO: 21066 - RNA, 21 nt, Artificial Sequence
  ELANE RNA Guide
cugccggccccucaugagagu

SEQ ID NO: 21067 - RNA, 21 nt, Artificial Sequence
  ELANE RNA Guide
gcaacgucugcacucucauga

SEQ ID NO: 21068 - RNA, 21 nt, Artificial Sequence
  ELANE RNA Guide
gcacucucaugaggggccggc

SEQ ID NO: 21069 - RNA, 21 nt, Artificial Sequence
  ELANE RNA Guide
gcagcaacgucugcacucuca

SEQ ID NO: 21070 - RNA, 21 nt, Artificial Sequence
  ELANE RNA Guide
gccccucaugagagugcagac

SEQ ID NO: 21071 - RNA, 21 nt, Artificial Sequence
  ELANE RNA Guide
gccggccccucaugagagugc

SEQ ID NO: 21072 - RNA, 21 nt, Artificial Sequence
  ELANE RNA Guide
gccugccggccccucaugaga

SEQ ID NO: 21073 - RNA, 21 nt, Artificial Sequence
  ELANE RNA Guide
ggccccucaugagagugcaga

SEQ ID NO: 21074 - RNA, 21 nt, Artificial Sequence
  ELANE RNA Guide
ggccugccggccccucaugag

SEQ ID NO: 21075 - RNA, 21 nt, Artificial Sequence
  ELANE RNA Guide
gucugcacucucaugaggggc

SEQ ID NO: 21076 - RNA, 21 nt, Artificial Sequence
  ELANE RNA Guide
ucaugagagugcagacguugc

SEQ ID NO: 21077 - RNA, 21 nt, Artificial Sequence
  ELANE RNA Guide
ucaugaggggccggcaggccg

SEQ ID NO: 21078 - RNA, 21 nt, Artificial Sequence
  ELANE RNA Guide
ucucaugaggggccggcaggc

SEQ ID NO: 21079 - RNA, 21 nt, Artificial Sequence
  ELANE RNA Guide
ucugcacucucaugaggggcc

SEQ ID NO: 21080 - RNA, 21 nt, Artificial Sequence
  ELANE RNA Guide
ugcacucucaugaggggccgg

SEQ ID NO: 21081 - RNA, 21 nt, Artificial Sequence
  ELANE RNA Guide
ugccggccccucaugagagug

SEQ ID NO: 21082 - RNA, 22 nt, Artificial Sequence
  ELANE RNA Guide
aacgucugcacucucaugaggg

SEQ ID NO: 21083 - RNA, 22 nt, Artificial Sequence
  ELANE RNA Guide
acgucugcacucucaugagggg

SEQ ID NO: 21084 - RNA, 22 nt, Artificial Sequence
  ELANE RNA Guide
acucucaugaggggccggcagg

SEQ ID NO: 21085 - RNA, 22 nt, Artificial Sequence
  ELANE RNA Guide
agcaacgucugcacucucauga

SEQ ID NO: 21086 - RNA, 22 nt, Artificial Sequence
  ELANE RNA Guide
augagagugcagacguugcugc

SEQ ID NO: 21087 - RNA, 22 nt, Artificial Sequence
  ELANE RNA Guide
caacgucugcacucucaugagg

SEQ ID NO: 21088 - RNA, 22 nt, Artificial Sequence
  ELANE RNA Guide
cacucucaugaggggccggcag

SEQ ID NO: 21089 - RNA, 22 nt, Artificial Sequence
  ELANE RNA Guide
cagcaacgucugcacucucaug

SEQ ID NO: 21090 - RNA, 22 nt, Artificial Sequence
  ELANE RNA Guide
caugagagugcagacguugcug

SEQ ID NO: 21091 - RNA, 22 nt, Artificial Sequence
  ELANE RNA Guide
ccccucaugagagugcagacgu

SEQ ID NO: 21092 - RNA, 22 nt, Artificial Sequence
  ELANE RNA Guide
cccucaugagagugcagacguu

SEQ ID NO: 21093 - RNA, 22 nt, Artificial Sequence
  ELANE RNA Guide
ccggccccucaugagagugcag

SEQ ID NO: 21094 - RNA, 22 nt, Artificial Sequence
  ELANE RNA Guide
ccggccugccggccccucauga

SEQ ID NO: 21095 - RNA, 22 nt, Artificial Sequence
  ELANE RNA Guide
ccucaugagagugcagacguug

SEQ ID NO: 21096 - RNA, 22 nt, Artificial Sequence
  ELANE RNA Guide
ccugccggccccucaugagagu

SEQ ID NO: 21097 - RNA, 22 nt, Artificial Sequence
  ELANE RNA Guide
cgcagcaacgucugcacucuca

SEQ ID NO: 21098 - RNA, 22 nt, Artificial Sequence
  ELANE RNA Guide
cggccccucaugagagugcaga

SEQ ID NO: 21099 - RNA, 22 nt, Artificial Sequence
  ELANE RNA Guide
cggccugccggccccucaugag

SEQ ID NO: 21100 - RNA, 22 nt, Artificial Sequence
  ELANE RNA Guide
cgucugcacucucaugaggggc

SEQ ID NO: 21101 - RNA, 22 nt, Artificial Sequence
  ELANE RNA Guide
cucaugagagugcagacguugc

SEQ ID NO: 21102 - RNA, 22 nt, Artificial Sequence
  ELANE RNA Guide
cucaugaggggccggcaggccg

SEQ ID NO: 21103 - RNA, 22 nt, Artificial Sequence
  ELANE RNA Guide
cucucaugaggggccggcaggc

SEQ ID NO: 21104 - RNA, 22 nt, Artificial Sequence
  ELANE RNA Guide
cugcacucucaugaggggccgg

SEQ ID NO: 21105 - RNA, 22 nt, Artificial Sequence
  ELANE RNA Guide
cugccggccccucaugagagug

SEQ ID NO: 21106 - RNA, 22 nt, Artificial Sequence
  ELANE RNA Guide
gcaacgucugcacucucaugag

SEQ ID NO: 21107 - RNA, 22 nt, Artificial Sequence
  ELANE RNA Guide
gcacucucaugaggggccggca

SEQ ID NO: 21108 - RNA, 22 nt, Artificial Sequence
  ELANE RNA Guide
gcagcaacgucugcacucucau

SEQ ID NO: 21109 - RNA, 22 nt, Artificial Sequence
  ELANE RNA Guide
gccccucaugagagugcagacg

SEQ ID NO: 21110 - RNA, 22 nt, Artificial Sequence
  ELANE RNA Guide
gccggccccucaugagagugca

SEQ ID NO: 21111 - RNA, 22 nt, Artificial Sequence
  ELANE RNA Guide
gccugccggccccucaugagag

SEQ ID NO: 21112 - RNA, 22 nt, Artificial Sequence
  ELANE RNA Guide
ggccccucaugagagugcagac

SEQ ID NO: 21113 - RNA, 22 nt, Artificial Sequence
  ELANE RNA Guide
ggccugccggccccucaugaga

SEQ ID NO: 21114 - RNA, 22 nt, Artificial Sequence
  ELANE RNA Guide
gucugcacucucaugaggggcc

SEQ ID NO: 21115 - RNA, 22 nt, Artificial Sequence
  ELANE RNA Guide
ucaugagagugcagacguugcu

SEQ ID NO: 21116 - RNA, 22 nt, Artificial Sequence
  ELANE RNA Guide
ucaugaggggccggcaggccgg

SEQ ID NO: 21117 - RNA, 22 nt, Artificial Sequence
  ELANE RNA Guide
ucgcagcaacgucugcacucuc

SEQ ID NO: 21118 - RNA, 22 nt, Artificial Sequence
  ELANE RNA Guide
ucucaugaggggccggcaggcc

SEQ ID NO: 21119 - RNA, 22 nt, Artificial Sequence
  ELANE RNA Guide
ucugcacucucaugaggggccg

SEQ ID NO: 21120 - RNA, 22 nt, Artificial Sequence
  ELANE RNA Guide
ugcacucucaugaggggccggc

SEQ ID NO: 21121 - RNA, 22 nt, Artificial Sequence
  ELANE RNA Guide
ugccggccccucaugagagugc

SEQ ID NO: 21122 - RNA, 20 nt, Artificial Sequence
  ELANE RNA Guide
aacgucugcacucucguaag

SEQ ID NO: 21123 - RNA, 20 nt, Artificial Sequence
  ELANE RNA Guide
acgucugcacucucguaagg

SEQ ID NO: 21124 - RNA, 20 nt, Artificial Sequence
  ELANE RNA Guide
acucucguaaggggccggca

SEQ ID NO: 21125 - RNA, 20 nt, Artificial Sequence
  ELANE RNA Guide
agcaacgucugcacucucgu

SEQ ID NO: 21126 - RNA, 20 nt, Artificial Sequence
  ELANE RNA Guide
caacgucugcacucucguaa

SEQ ID NO: 21127 - RNA, 20 nt, Artificial Sequence
  ELANE RNA Guide
cacucucguaaggggccggc

SEQ ID NO: 21128 - RNA, 20 nt, Artificial Sequence
  ELANE RNA Guide
cagcaacgucugcacucucg

SEQ ID NO: 21129 - RNA, 20 nt, Artificial Sequence
  ELANE RNA Guide
ccccuuacgagagugcagac

SEQ ID NO: 21130 - RNA, 20 nt, Artificial Sequence
  ELANE RNA Guide
cccuuacgagagugcagacg

SEQ ID NO: 21131 - RNA, 20 nt, Artificial Sequence
  ELANE RNA Guide
ccggccccuuacgagagugc

SEQ ID NO: 21132 - RNA, 20 nt, Artificial Sequence
  ELANE RNA Guide
ccggccugccggccccuuac

SEQ ID NO: 21133 - RNA, 20 nt, Artificial Sequence
  ELANE RNA Guide
ccugccggccccuuacgaga

SEQ ID NO: 21134 - RNA, 20 nt, Artificial Sequence
  ELANE RNA Guide
ccuuacgagagugcagacgu

SEQ ID NO: 21135 - RNA, 20 nt, Artificial Sequence
  ELANE RNA Guide
cggccccuuacgagagugca

SEQ ID NO: 21136 - RNA, 20 nt, Artificial Sequence
  ELANE RNA Guide
cggccugccggccccuuacg

SEQ ID NO: 21137 - RNA, 20 nt, Artificial Sequence
  ELANE RNA Guide
cguaaggggccggcaggccg

SEQ ID NO: 21138 - RNA, 20 nt, Artificial Sequence
  ELANE RNA Guide
cgucugcacucucguaaggg

SEQ ID NO: 21139 - RNA, 20 nt, Artificial Sequence
  ELANE RNA Guide
cucguaaggggccggcaggc

SEQ ID NO: 21140 - RNA, 20 nt, Artificial Sequence
  ELANE RNA Guide
cucucguaaggggccggcag

SEQ ID NO: 21141 - RNA, 20 nt, Artificial Sequence
  ELANE RNA Guide
cugcacucucguaaggggcc

SEQ ID NO: 21142 - RNA, 20 nt, Artificial Sequence
  ELANE RNA Guide
cugccggccccuuacgagag

SEQ ID NO: 21143 - RNA, 20 nt, Artificial Sequence
  ELANE RNA Guide
cuuacgagagugcagacguu

SEQ ID NO: 21144 - RNA, 20 nt, Artificial Sequence
  ELANE RNA Guide
gcaacgucugcacucucgua

SEQ ID NO: 21145 - RNA, 20 nt, Artificial Sequence
  ELANE RNA Guide
gcacucucguaaggggccgg

SEQ ID NO: 21146 - RNA, 20 nt, Artificial Sequence
  ELANE RNA Guide
gccccuuacgagagugcaga

SEQ ID NO: 21147 - RNA, 20 nt, Artificial Sequence
  ELANE RNA Guide
gccggccccuuacgagagug

SEQ ID NO: 21148 - RNA, 20 nt, Artificial Sequence
  ELANE RNA Guide
gccggccugccggccccuua

SEQ ID NO: 21149 - RNA, 20 nt, Artificial Sequence
  ELANE RNA Guide
gccugccggccccuuacgag

SEQ ID NO: 21150 - RNA, 20 nt, Artificial Sequence
  ELANE RNA Guide
ggccccuuacgagagugcag

SEQ ID NO: 21151 - RNA, 20 nt, Artificial Sequence
  ELANE RNA Guide
ggccugccggccccuuacga

SEQ ID NO: 21152 - RNA, 20 nt, Artificial Sequence
  ELANE RNA Guide
guaaggggccggcaggccgg

SEQ ID NO: 21153 - RNA, 20 nt, Artificial Sequence
  ELANE RNA Guide
gucugcacucucguaagggg

SEQ ID NO: 21154 - RNA, 20 nt, Artificial Sequence
  ELANE RNA Guide
uaaggggccggcaggccggc

SEQ ID NO: 21155 - RNA, 20 nt, Artificial Sequence
  ELANE RNA Guide
ucguaaggggccggcaggcc

SEQ ID NO: 21156 - RNA, 20 nt, Artificial Sequence
  ELANE RNA Guide
ucucguaaggggccggcagg

SEQ ID NO: 21157 - RNA, 20 nt, Artificial Sequence
  ELANE RNA Guide
ucugcacucucguaaggggc

SEQ ID NO: 21158 - RNA, 20 nt, Artificial Sequence
  ELANE RNA Guide
ugcacucucguaaggggccg

SEQ ID NO: 21159 - RNA, 20 nt, Artificial Sequence
  ELANE RNA Guide
ugccggccccuuacgagagu

SEQ ID NO: 21160 - RNA, 20 nt, Artificial Sequence
  ELANE RNA Guide
uuacgagagugcagacguug

SEQ ID NO: 21161 - RNA, 21 nt, Artificial Sequence
  ELANE RNA Guide
aacgucugcacucucguaagg

SEQ ID NO: 21162 - RNA, 21 nt, Artificial Sequence
  ELANE RNA Guide
acgucugcacucucguaaggg

SEQ ID NO: 21163 - RNA, 21 nt, Artificial Sequence
  ELANE RNA Guide
acucucguaaggggccggcag

SEQ ID NO: 21164 - RNA, 21 nt, Artificial Sequence
  ELANE RNA Guide
agcaacgucugcacucucgua

SEQ ID NO: 21165 - RNA, 21 nt, Artificial Sequence
  ELANE RNA Guide
caacgucugcacucucguaag

SEQ ID NO: 21166 - RNA, 21 nt, Artificial Sequence
  ELANE RNA Guide
cacucucguaaggggccggca

SEQ ID NO: 21167 - RNA, 21 nt, Artificial Sequence
  ELANE RNA Guide
cagcaacgucugcacucucgu

SEQ ID NO: 21168 - RNA, 21 nt, Artificial Sequence
  ELANE RNA Guide
ccccuuacgagagugcagacg

SEQ ID NO: 21169 - RNA, 21 nt, Artificial Sequence
  ELANE RNA Guide
cccuuacgagagugcagacgu

SEQ ID NO: 21170 - RNA, 21 nt, Artificial Sequence
  ELANE RNA Guide
ccggccccuuacgagagugca

SEQ ID NO: 21171 - RNA, 21 nt, Artificial Sequence
  ELANE RNA Guide
ccugccggccccuuacgagag

SEQ ID NO: 21172 - RNA, 21 nt, Artificial Sequence
  ELANE RNA Guide
ccuuacgagagugcagacguu

SEQ ID NO: 21173 - RNA, 21 nt, Artificial Sequence
  ELANE RNA Guide
cggccccuuacgagagugcag

SEQ ID NO: 21174 - RNA, 21 nt, Artificial Sequence
  ELANE RNA Guide
cggccugccggccccuuacga

SEQ ID NO: 21175 - RNA, 21 nt, Artificial Sequence
  ELANE RNA Guide
cgucugcacucucguaagggg

SEQ ID NO: 21176 - RNA, 21 nt, Artificial Sequence
  ELANE RNA Guide
cucguaaggggccggcaggcc

SEQ ID NO: 21177 - RNA, 21 nt, Artificial Sequence
  ELANE RNA Guide
cucucguaaggggccggcagg

SEQ ID NO: 21178 - RNA, 21 nt, Artificial Sequence
  ELANE RNA Guide
cugcacucucguaaggggccg

SEQ ID NO: 21179 - RNA, 21 nt, Artificial Sequence
  ELANE RNA Guide
cugccggccccuuacgagagu

SEQ ID NO: 21180 - RNA, 21 nt, Artificial Sequence
  ELANE RNA Guide
cuuacgagagugcagacguug

SEQ ID NO: 21181 - RNA, 21 nt, Artificial Sequence
  ELANE RNA Guide
gcaacgucugcacucucguaa

SEQ ID NO: 21182 - RNA, 21 nt, Artificial Sequence
  ELANE RNA Guide
gcacucucguaaggggccggc

SEQ ID NO: 21183 - RNA, 21 nt, Artificial Sequence
  ELANE RNA Guide
gcagcaacgucugcacucucg

SEQ ID NO: 21184 - RNA, 21 nt, Artificial Sequence
  ELANE RNA Guide
gccccuuacgagagugcagac

SEQ ID NO: 21185 - RNA, 21 nt, Artificial Sequence
  ELANE RNA Guide
gccggccccuuacgagagugc

SEQ ID NO: 21186 - RNA, 21 nt, Artificial Sequence
  ELANE RNA Guide
gccugccggccccuuacgaga

SEQ ID NO: 21187 - RNA, 21 nt, Artificial Sequence
  ELANE RNA Guide
ggccccuuacgagagugcaga

SEQ ID NO: 21188 - RNA, 21 nt, Artificial Sequence
  ELANE RNA Guide
ggccugccggccccuuacgag

SEQ ID NO: 21189 - RNA, 21 nt, Artificial Sequence
  ELANE RNA Guide
gucugcacucucguaaggggc

SEQ ID NO: 21190 - RNA, 21 nt, Artificial Sequence
  ELANE RNA Guide
ucguaaggggccggcaggccg

SEQ ID NO: 21191 - RNA, 21 nt, Artificial Sequence
  ELANE RNA Guide
ucucguaaggggccggcaggc

SEQ ID NO: 21192 - RNA, 21 nt, Artificial Sequence
  ELANE RNA Guide
ucugcacucucguaaggggcc

SEQ ID NO: 21193 - RNA, 21 nt, Artificial Sequence
  ELANE RNA Guide
ugcacucucguaaggggccgg

SEQ ID NO: 21194 - RNA, 21 nt, Artificial Sequence
  ELANE RNA Guide
ugccggccccuuacgagagug

SEQ ID NO: 21195 - RNA, 21 nt, Artificial Sequence
  ELANE RNA Guide
uuacgagagugcagacguugc

SEQ ID NO: 21196 - RNA, 22 nt, Artificial Sequence
  ELANE RNA Guide
aacagacgccggccugccggcc

SEQ ID NO: 21197 - RNA, 22 nt, Artificial Sequence
  ELANE RNA Guide
aacgucugcacucucguaaggg

SEQ ID NO: 21198 - RNA, 22 nt, Artificial Sequence
  ELANE RNA Guide
acgccggccugccggccccuua

SEQ ID NO: 21199 - RNA, 22 nt, Artificial Sequence
  ELANE RNA Guide
acgucugcacucucguaagggg

SEQ ID NO: 21200 - RNA, 22 nt, Artificial Sequence
  ELANE RNA Guide
acucucguaaggggccggcagg

SEQ ID NO: 21201 - RNA, 22 nt, Artificial Sequence
  ELANE RNA Guide
agcaacgucugcacucucguaa

SEQ ID NO: 21202 - RNA, 22 nt, Artificial Sequence
  ELANE RNA Guide
caacgucugcacucucguaagg

SEQ ID NO: 21203 - RNA, 22 nt, Artificial Sequence
  ELANE RNA Guide
cacucucguaaggggccggcag

SEQ ID NO: 21204 - RNA, 22 nt, Artificial Sequence
  ELANE RNA Guide
cagcaacgucugcacucucgua

SEQ ID NO: 21205 - RNA, 22 nt, Artificial Sequence
  ELANE RNA Guide
ccccuuacgagagugcagacgu

SEQ ID NO: 21206 - RNA, 22 nt, Artificial Sequence
  ELANE RNA Guide
cccuuacgagagugcagacguu

SEQ ID NO: 21207 - RNA, 22 nt, Artificial Sequence
  ELANE RNA Guide
ccggccccuuacgagagugcag

SEQ ID NO: 21208 - RNA, 22 nt, Artificial Sequence
  ELANE RNA Guide
ccggccugccggccccuuacga

SEQ ID NO: 21209 - RNA, 22 nt, Artificial Sequence
  ELANE RNA Guide
ccugccggccccuuacgagagu

SEQ ID NO: 21210 - RNA, 22 nt, Artificial Sequence
  ELANE RNA Guide
ccuuacgagagugcagacguug

SEQ ID NO: 21211 - RNA, 22 nt, Artificial Sequence
  ELANE RNA Guide
cgcagcaacgucugcacucucg

SEQ ID NO: 21212 - RNA, 22 nt, Artificial Sequence
  ELANE RNA Guide
cggccccuuacgagagugcaga

SEQ ID NO: 21213 - RNA, 22 nt, Artificial Sequence
  ELANE RNA Guide
cggccugccggccccuuacgag

SEQ ID NO: 21214 - RNA, 22 nt, Artificial Sequence
  ELANE RNA Guide
cgucugcacucucguaaggggc

SEQ ID NO: 21215 - RNA, 22 nt, Artificial Sequence
  ELANE RNA Guide
cucguaaggggccggcaggccg

SEQ ID NO: 21216 - RNA, 22 nt, Artificial Sequence
  ELANE RNA Guide
cucucguaaggggccggcaggc

SEQ ID NO: 21217 - RNA, 22 nt, Artificial Sequence
  ELANE RNA Guide
cugcacucucguaaggggccgg

SEQ ID NO: 21218 - RNA, 22 nt, Artificial Sequence
  ELANE RNA Guide
cugccggccccuuacgagagug

SEQ ID NO: 21219 - RNA, 22 nt, Artificial Sequence
  ELANE RNA Guide
cuuacgagagugcagacguugc

SEQ ID NO: 21220 - RNA, 22 nt, Artificial Sequence
  ELANE RNA Guide
gcaacgucugcacucucguaag

SEQ ID NO: 21221 - RNA, 22 nt, Artificial Sequence
  ELANE RNA Guide
gcacucucguaaggggccggca

SEQ ID NO: 21222 - RNA, 22 nt, Artificial Sequence
  ELANE RNA Guide
gcagcaacgucugcacucucgu

SEQ ID NO: 21223 - RNA, 22 nt, Artificial Sequence
  ELANE RNA Guide
gccccuuacgagagugcagacg

SEQ ID NO: 21224 - RNA, 22 nt, Artificial Sequence
  ELANE RNA Guide
gccggccccuuacgagagugca

SEQ ID NO: 21225 - RNA, 22 nt, Artificial Sequence
  ELANE RNA Guide
gccugccggccccuuacgagag

SEQ ID NO: 21226 - RNA, 22 nt, Artificial Sequence
  ELANE RNA Guide
ggccccuuacgagagugcagac

SEQ ID NO: 21227 - RNA, 22 nt, Artificial Sequence
  ELANE RNA Guide
ggccugccggccccuuacgaga

SEQ ID NO: 21228 - RNA, 22 nt, Artificial Sequence
  ELANE RNA Guide
gucugcacucucguaaggggcc

SEQ ID NO: 21229 - RNA, 22 nt, Artificial Sequence
  ELANE RNA Guide
uaaggggccggcaggccggcgu

SEQ ID NO: 21230 - RNA, 22 nt, Artificial Sequence
  ELANE RNA Guide
ucguaaggggccggcaggccgg

SEQ ID NO: 21231 - RNA, 22 nt, Artificial Sequence
  ELANE RNA Guide
ucucguaaggggccggcaggcc

SEQ ID NO: 21232 - RNA, 22 nt, Artificial Sequence
  ELANE RNA Guide
ucugcacucucguaaggggccg

SEQ ID NO: 21233 - RNA, 22 nt, Artificial Sequence
  ELANE RNA Guide
ugcacucucguaaggggccggc

SEQ ID NO: 21234 - RNA, 22 nt, Artificial Sequence
  ELANE RNA Guide
ugccggccccuuacgagagugc

SEQ ID NO: 21235 - RNA, 22 nt, Artificial Sequence
  ELANE RNA Guide
uuacgagagugcagacguugcu

SEQ ID NO: 21236 - RNA, 20 nt, Artificial Sequence
  ELANE RNA Guide
aaacagacgccggccugccg

SEQ ID NO: 21237 - RNA, 20 nt, Artificial Sequence
  ELANE RNA Guide
aacagacgccggccugccgg

SEQ ID NO: 21238 - RNA, 20 nt, Artificial Sequence
  ELANE RNA Guide
aacgucugcacucucgugag

SEQ ID NO: 21239 - RNA, 20 nt, Artificial Sequence
  ELANE RNA Guide
acagacgccggccugccggc

SEQ ID NO: 21240 - RNA, 20 nt, Artificial Sequence
  ELANE RNA Guide
acgucugcacucucgugagc

SEQ ID NO: 21241 - RNA, 20 nt, Artificial Sequence
  ELANE RNA Guide
acucucgugagcggccggca

SEQ ID NO: 21242 - RNA, 20 nt, Artificial Sequence
  ELANE RNA Guide
caacgucugcacucucguga

SEQ ID NO: 21243 - RNA, 20 nt, Artificial Sequence
  ELANE RNA Guide
cacucucgugagcggccggc

SEQ ID NO: 21244 - RNA, 20 nt, Artificial Sequence
  ELANE RNA Guide
ccgcucacgagagugcagac

SEQ ID NO: 21245 - RNA, 20 nt, Artificial Sequence
  ELANE RNA Guide
ccggccgcucacgagagugc

SEQ ID NO: 21246 - RNA, 20 nt, Artificial Sequence
  ELANE RNA Guide
ccugccggccgcucacgaga

SEQ ID NO: 21247 - RNA, 20 nt, Artificial Sequence
  ELANE RNA Guide
cgcucacgagagugcagacg

SEQ ID NO: 21248 - RNA, 20 nt, Artificial Sequence
  ELANE RNA Guide
cggccgcucacgagagugca

SEQ ID NO: 21249 - RNA, 20 nt, Artificial Sequence
  ELANE RNA Guide
cgucugcacucucgugagcg

SEQ ID NO: 21250 - RNA, 20 nt, Artificial Sequence
  ELANE RNA Guide
cucgugagcggccggcaggc

SEQ ID NO: 21251 - RNA, 20 nt, Artificial Sequence
  ELANE RNA Guide
cucucgugagcggccggcag

SEQ ID NO: 21252 - RNA, 20 nt, Artificial Sequence
  ELANE RNA Guide
cugcacucucgugagcggcc

SEQ ID NO: 21253 - RNA, 20 nt, Artificial Sequence
  ELANE RNA Guide
cugccggccgcucacgagag

SEQ ID NO: 21254 - RNA, 20 nt, Artificial Sequence
  ELANE RNA Guide
gcaacgucugcacucucgug

SEQ ID NO: 21255 - RNA, 20 nt, Artificial Sequence
  ELANE RNA Guide
gcacucucgugagcggccgg

SEQ ID NO: 21256 - RNA, 20 nt, Artificial Sequence
  ELANE RNA Guide
gccgcucacgagagugcaga

SEQ ID NO: 21257 - RNA, 20 nt, Artificial Sequence
  ELANE RNA Guide
gccggccgcucacgagagug

SEQ ID NO: 21258 - RNA, 20 nt, Artificial Sequence
  ELANE RNA Guide
gccugccggccgcucacgag

SEQ ID NO: 21259 - RNA, 20 nt, Artificial Sequence
  ELANE RNA Guide
ggccgcucacgagagugcag

SEQ ID NO: 21260 - RNA, 20 nt, Artificial Sequence
  ELANE RNA Guide
ggccugccggccgcucacga

SEQ ID NO: 21261 - RNA, 20 nt, Artificial Sequence
  ELANE RNA Guide
gucugcacucucgugagcgg

SEQ ID NO: 21262 - RNA, 20 nt, Artificial Sequence
  ELANE RNA Guide
ucgugagcggccggcaggcc

SEQ ID NO: 21263 - RNA, 20 nt, Artificial Sequence
  ELANE RNA Guide
ucucgugagcggccggcagg

SEQ ID NO: 21264 - RNA, 20 nt, Artificial Sequence
  ELANE RNA Guide
ucugcacucucgugagcggc

SEQ ID NO: 21265 - RNA, 20 nt, Artificial Sequence
  ELANE RNA Guide
ugcacucucgugagcggccg

SEQ ID NO: 21266 - RNA, 20 nt, Artificial Sequence
  ELANE RNA Guide
ugccggccgcucacgagagu

SEQ ID NO: 21267 - RNA, 21 nt, Artificial Sequence
  ELANE RNA Guide
aaacagacgccggccugccgg

SEQ ID NO: 21268 - RNA, 21 nt, Artificial Sequence
  ELANE RNA Guide
aacagacgccggccugccggc

SEQ ID NO: 21269 - RNA, 21 nt, Artificial Sequence
  ELANE RNA Guide
aacgucugcacucucgugagc

SEQ ID NO: 21270 - RNA, 21 nt, Artificial Sequence
  ELANE RNA Guide
acgucugcacucucgugagcg

SEQ ID NO: 21271 - RNA, 21 nt, Artificial Sequence
  ELANE RNA Guide
acucucgugagcggccggcag

SEQ ID NO: 21272 - RNA, 21 nt, Artificial Sequence
  ELANE RNA Guide
agcaacgucugcacucucgug

SEQ ID NO: 21273 - RNA, 21 nt, Artificial Sequence
  ELANE RNA Guide
caacgucugcacucucgugag

SEQ ID NO: 21274 - RNA, 21 nt, Artificial Sequence
  ELANE RNA Guide
cacucucgugagcggccggca

SEQ ID NO: 21275 - RNA, 21 nt, Artificial Sequence
  ELANE RNA Guide
ccgcucacgagagugcagacg

SEQ ID NO: 21276 - RNA, 21 nt, Artificial Sequence
  ELANE RNA Guide
ccggccgcucacgagagugca

SEQ ID NO: 21277 - RNA, 21 nt, Artificial Sequence
  ELANE RNA Guide
ccugccggccgcucacgagag

SEQ ID NO: 21278 - RNA, 21 nt, Artificial Sequence
  ELANE RNA Guide
cgcucacgagagugcagacgu

SEQ ID NO: 21279 - RNA, 21 nt, Artificial Sequence
  ELANE RNA Guide
cggccgcucacgagagugcag

SEQ ID NO: 21280 - RNA, 21 nt, Artificial Sequence
  ELANE RNA Guide
cgucugcacucucgugagcgg

SEQ ID NO: 21281 - RNA, 21 nt, Artificial Sequence
  ELANE RNA Guide
cucucgugagcggccggcagg

SEQ ID NO: 21282 - RNA, 21 nt, Artificial Sequence
  ELANE RNA Guide
cugcacucucgugagcggccg

SEQ ID NO: 21283 - RNA, 21 nt, Artificial Sequence
  ELANE RNA Guide
cugccggccgcucacgagagu

SEQ ID NO: 21284 - RNA, 21 nt, Artificial Sequence
  ELANE RNA Guide
gaaacagacgccggccugccg

SEQ ID NO: 21285 - RNA, 21 nt, Artificial Sequence
  ELANE RNA Guide
gcaacgucugcacucucguga

SEQ ID NO: 21286 - RNA, 21 nt, Artificial Sequence
  ELANE RNA Guide
gcacucucgugagcggccggc

SEQ ID NO: 21287 - RNA, 21 nt, Artificial Sequence
  ELANE RNA Guide
gccgcucacgagagugcagac

SEQ ID NO: 21288 - RNA, 21 nt, Artificial Sequence
  ELANE RNA Guide
gccggccgcucacgagagugc

SEQ ID NO: 21289 - RNA, 21 nt, Artificial Sequence
  ELANE RNA Guide
gccugccggccgcucacgaga

SEQ ID NO: 21290 - RNA, 21 nt, Artificial Sequence
  ELANE RNA Guide
ggccgcucacgagagugcaga

SEQ ID NO: 21291 - RNA, 21 nt, Artificial Sequence
  ELANE RNA Guide
gucugcacucucgugagcggc

SEQ ID NO: 21292 - RNA, 21 nt, Artificial Sequence
  ELANE RNA Guide
ucucgugagcggccggcaggc

SEQ ID NO: 21293 - RNA, 21 nt, Artificial Sequence
  ELANE RNA Guide
ucugcacucucgugagcggcc

SEQ ID NO: 21294 - RNA, 21 nt, Artificial Sequence
  ELANE RNA Guide
ugcacucucgugagcggccgg

SEQ ID NO: 21295 - RNA, 21 nt, Artificial Sequence
  ELANE RNA Guide
ugccggccgcucacgagagug

SEQ ID NO: 21296 - RNA, 22 nt, Artificial Sequence
  ELANE RNA Guide
aaacagacgccggccugccggc

SEQ ID NO: 21297 - RNA, 22 nt, Artificial Sequence
  ELANE RNA Guide
aacgucugcacucucgugagcg

SEQ ID NO: 21298 - RNA, 22 nt, Artificial Sequence
  ELANE RNA Guide
acgucugcacucucgugagcgg

SEQ ID NO: 21299 - RNA, 22 nt, Artificial Sequence
  ELANE RNA Guide
acucucgugagcggccggcagg

SEQ ID NO: 21300 - RNA, 22 nt, Artificial Sequence
  ELANE RNA Guide
agcaacgucugcacucucguga

SEQ ID NO: 21301 - RNA, 22 nt, Artificial Sequence
  ELANE RNA Guide
caacgucugcacucucgugagc

SEQ ID NO: 21302 - RNA, 22 nt, Artificial Sequence
  ELANE RNA Guide
cacucucgugagcggccggcag

SEQ ID NO: 21303 - RNA, 22 nt, Artificial Sequence
  ELANE RNA Guide
cagcaacgucugcacucucgug

SEQ ID NO: 21304 - RNA, 22 nt, Artificial Sequence
  ELANE RNA Guide
ccgcucacgagagugcagacgu

SEQ ID NO: 21305 - RNA, 22 nt, Artificial Sequence
  ELANE RNA Guide
ccggccgcucacgagagugcag

SEQ ID NO: 21306 - RNA, 22 nt, Artificial Sequence
  ELANE RNA Guide
ccugccggccgcucacgagagu

SEQ ID NO: 21307 - RNA, 22 nt, Artificial Sequence
  ELANE RNA Guide
cgaaacagacgccggccugccg

SEQ ID NO: 21308 - RNA, 22 nt, Artificial Sequence
  ELANE RNA Guide
cgcucacgagagugcagacguu

SEQ ID NO: 21309 - RNA, 22 nt, Artificial Sequence
  ELANE RNA Guide
cggccgcucacgagagugcaga

SEQ ID NO: 21310 - RNA, 22 nt, Artificial Sequence
  ELANE RNA Guide
cgucugcacucucgugagcggc

SEQ ID NO: 21311 - RNA, 22 nt, Artificial Sequence
  ELANE RNA Guide
cucucgugagcggccggcaggc

SEQ ID NO: 21312 - RNA, 22 nt, Artificial Sequence
  ELANE RNA Guide
cugcacucucgugagcggccgg

SEQ ID NO: 21313 - RNA, 22 nt, Artificial Sequence
  ELANE RNA Guide
cugccggccgcucacgagagug

SEQ ID NO: 21314 - RNA, 22 nt, Artificial Sequence
  ELANE RNA Guide
gaaacagacgccggccugccgg

SEQ ID NO: 21315 - RNA, 22 nt, Artificial Sequence
  ELANE RNA Guide
gcaacgucugcacucucgugag

SEQ ID NO: 21316 - RNA, 22 nt, Artificial Sequence
  ELANE RNA Guide
gcacucucgugagcggccggca

SEQ ID NO: 21317 - RNA, 22 nt, Artificial Sequence
  ELANE RNA Guide
gccgcucacgagagugcagacg

SEQ ID NO: 21318 - RNA, 22 nt, Artificial Sequence
  ELANE RNA Guide
gccggccgcucacgagagugca

SEQ ID NO: 21319 - RNA, 22 nt, Artificial Sequence
  ELANE RNA Guide
gccugccggccgcucacgagag

SEQ ID NO: 21320 - RNA, 22 nt, Artificial Sequence
  ELANE RNA Guide
ggccgcucacgagagugcagac

SEQ ID NO: 21321 - RNA, 22 nt, Artificial Sequence
  ELANE RNA Guide
ggccugccggccgcucacgaga

SEQ ID NO: 21322 - RNA, 22 nt, Artificial Sequence
  ELANE RNA Guide
gucugcacucucgugagcggcc

SEQ ID NO: 21323 - RNA, 22 nt, Artificial Sequence
  ELANE RNA Guide
ucucgugagcggccggcaggcc

SEQ ID NO: 21324 - RNA, 22 nt, Artificial Sequence
  ELANE RNA Guide
ucugcacucucgugagcggccg

SEQ ID NO: 21325 - RNA, 22 nt, Artificial Sequence
  ELANE RNA Guide
ugcacucucgugagcggccggc

SEQ ID NO: 21326 - RNA, 22 nt, Artificial Sequence
  ELANE RNA Guide
ugccggccgcucacgagagugc

SEQ ID NO: 21327 - RNA, 20 nt, Artificial Sequence
  ELANE RNA Guide
acgccggccugccggccacu

SEQ ID NO: 21328 - RNA, 20 nt, Artificial Sequence
  ELANE RNA Guide
acgucugcacucucgugagu

SEQ ID NO: 21329 - RNA, 20 nt, Artificial Sequence
  ELANE RNA Guide
acucucgugaguggccggca

SEQ ID NO: 21330 - RNA, 20 nt, Artificial Sequence
  ELANE RNA Guide
agacgccggccugccggcca

SEQ ID NO: 21331 - RNA, 20 nt, Artificial Sequence
  ELANE RNA Guide
aguggccggcaggccggcgu

SEQ ID NO: 21332 - RNA, 20 nt, Artificial Sequence
  ELANE RNA Guide
cacucacgagagugcagacg

SEQ ID NO: 21333 - RNA, 20 nt, Artificial Sequence
  ELANE RNA Guide
cacucucgugaguggccggc

SEQ ID NO: 21334 - RNA, 20 nt, Artificial Sequence
  ELANE RNA Guide
ccacucacgagagugcagac

SEQ ID NO: 21335 - RNA, 20 nt, Artificial Sequence
  ELANE RNA Guide
ccggccacucacgagagugc

SEQ ID NO: 21336 - RNA, 20 nt, Artificial Sequence
  ELANE RNA Guide
ccggccugccggccacucac

SEQ ID NO: 21337 - RNA, 20 nt, Artificial Sequence
  ELANE RNA Guide
ccugccggccacucacgaga

SEQ ID NO: 21338 - RNA, 20 nt, Artificial Sequence
  ELANE RNA Guide
cggccacucacgagagugca

SEQ ID NO: 21339 - RNA, 20 nt, Artificial Sequence
  ELANE RNA Guide
cggccugccggccacucacg

SEQ ID NO: 21340 - RNA, 20 nt, Artificial Sequence
  ELANE RNA Guide
cgucugcacucucgugagug

SEQ ID NO: 21341 - RNA, 20 nt, Artificial Sequence
  ELANE RNA Guide
cgugaguggccggcaggccg

SEQ ID NO: 21342 - RNA, 20 nt, Artificial Sequence
  ELANE RNA Guide
cucgugaguggccggcaggc

SEQ ID NO: 21343 - RNA, 20 nt, Artificial Sequence
  ELANE RNA Guide
cucucgugaguggccggcag

SEQ ID NO: 21344 - RNA, 20 nt, Artificial Sequence
  ELANE RNA Guide
cugcacucucgugaguggcc

SEQ ID NO: 21345 - RNA, 20 nt, Artificial Sequence
  ELANE RNA Guide
cugccggccacucacgagag

SEQ ID NO: 21346 - RNA, 20 nt, Artificial Sequence
  ELANE RNA Guide
gcacucucgugaguggccgg

SEQ ID NO: 21347 - RNA, 20 nt, Artificial Sequence
  ELANE RNA Guide
gccacucacgagagugcaga

SEQ ID NO: 21348 - RNA, 20 nt, Artificial Sequence
  ELANE RNA Guide
gccggccacucacgagagug

SEQ ID NO: 21349 - RNA, 20 nt, Artificial Sequence
  ELANE RNA Guide
gccggccugccggccacuca

SEQ ID NO: 21350 - RNA, 20 nt, Artificial Sequence
  ELANE RNA Guide
gccugccggccacucacgag

SEQ ID NO: 21351 - RNA, 20 nt, Artificial Sequence
  ELANE RNA Guide
ggccacucacgagagugcag

SEQ ID NO: 21352 - RNA, 20 nt, Artificial Sequence
  ELANE RNA Guide
ggccugccggccacucacga

SEQ ID NO: 21353 - RNA, 20 nt, Artificial Sequence
  ELANE RNA Guide
gucugcacucucgugagugg

SEQ ID NO: 21354 - RNA, 20 nt, Artificial Sequence
  ELANE RNA Guide
gugaguggccggcaggccgg

SEQ ID NO: 21355 - RNA, 20 nt, Artificial Sequence
  ELANE RNA Guide
ucgugaguggccggcaggcc

SEQ ID NO: 21356 - RNA, 20 nt, Artificial Sequence
  ELANE RNA Guide
ucucgugaguggccggcagg

SEQ ID NO: 21357 - RNA, 20 nt, Artificial Sequence
  ELANE RNA Guide
ucugcacucucgugaguggc

SEQ ID NO: 21358 - RNA, 20 nt, Artificial Sequence
  ELANE RNA Guide
ugaguggccggcaggccggc

SEQ ID NO: 21359 - RNA, 20 nt, Artificial Sequence
  ELANE RNA Guide
ugcacucucgugaguggccg

SEQ ID NO: 21360 - RNA, 20 nt, Artificial Sequence
  ELANE RNA Guide
ugccggccacucacgagagu

SEQ ID NO: 21361 - RNA, 21 nt, Artificial Sequence
  ELANE RNA Guide
aacgucugcacucucgugagu

SEQ ID NO: 21362 - RNA, 21 nt, Artificial Sequence
  ELANE RNA Guide
acgucugcacucucgugagug

SEQ ID NO: 21363 - RNA, 21 nt, Artificial Sequence
  ELANE RNA Guide
acucucgugaguggccggcag

SEQ ID NO: 21364 - RNA, 21 nt, Artificial Sequence
  ELANE RNA Guide
cacucacgagagugcagacgu

SEQ ID NO: 21365 - RNA, 21 nt, Artificial Sequence
  ELANE RNA Guide
cacucucgugaguggccggca

SEQ ID NO: 21366 - RNA, 21 nt, Artificial Sequence
  ELANE RNA Guide
ccacucacgagagugcagacg

SEQ ID NO: 21367 - RNA, 21 nt, Artificial Sequence
  ELANE RNA Guide
ccggccacucacgagagugca

SEQ ID NO: 21368 - RNA, 21 nt, Artificial Sequence
  ELANE RNA Guide
ccugccggccacucacgagag

SEQ ID NO: 21369 - RNA, 21 nt, Artificial Sequence
  ELANE RNA Guide
cggccacucacgagagugcag

SEQ ID NO: 21370 - RNA, 21 nt, Artificial Sequence
  ELANE RNA Guide
cggccugccggccacucacga

SEQ ID NO: 21371 - RNA, 21 nt, Artificial Sequence
  ELANE RNA Guide
cgucugcacucucgugagugg

SEQ ID NO: 21372 - RNA, 21 nt, Artificial Sequence
  ELANE RNA Guide
cucgugaguggccggcaggcc

SEQ ID NO: 21373 - RNA, 21 nt, Artificial Sequence
  ELANE RNA Guide
cucucgugaguggccggcagg

SEQ ID NO: 21374 - RNA, 21 nt, Artificial Sequence
  ELANE RNA Guide
cugcacucucgugaguggccg

SEQ ID NO: 21375 - RNA, 21 nt, Artificial Sequence
  ELANE RNA Guide
cugccggccacucacgagagu

SEQ ID NO: 21376 - RNA, 21 nt, Artificial Sequence
  ELANE RNA Guide
gcacucucgugaguggccggc

SEQ ID NO: 21377 - RNA, 21 nt, Artificial Sequence
  ELANE RNA Guide
gccacucacgagagugcagac

SEQ ID NO: 21378 - RNA, 21 nt, Artificial Sequence
  ELANE RNA Guide
gccggccacucacgagagugc

SEQ ID NO: 21379 - RNA, 21 nt, Artificial Sequence
  ELANE RNA Guide
gccugccggccacucacgaga

SEQ ID NO: 21380 - RNA, 21 nt, Artificial Sequence
  ELANE RNA Guide
ggccacucacgagagugcaga

SEQ ID NO: 21381 - RNA, 21 nt, Artificial Sequence
  ELANE RNA Guide
ggccugccggccacucacgag

SEQ ID NO: 21382 - RNA, 21 nt, Artificial Sequence
  ELANE RNA Guide
gucugcacucucgugaguggc

SEQ ID NO: 21383 - RNA, 21 nt, Artificial Sequence
  ELANE RNA Guide
ucgugaguggccggcaggccg

SEQ ID NO: 21384 - RNA, 21 nt, Artificial Sequence
  ELANE RNA Guide
ucucgugaguggccggcaggc

SEQ ID NO: 21385 - RNA, 21 nt, Artificial Sequence
  ELANE RNA Guide
ucugcacucucgugaguggcc

SEQ ID NO: 21386 - RNA, 21 nt, Artificial Sequence
  ELANE RNA Guide
ugcacucucgugaguggccgg

SEQ ID NO: 21387 - RNA, 21 nt, Artificial Sequence
  ELANE RNA Guide
ugccggccacucacgagagug

SEQ ID NO: 21388 - RNA, 22 nt, Artificial Sequence
  ELANE RNA Guide
aacgucugcacucucgugagug

SEQ ID NO: 21389 - RNA, 22 nt, Artificial Sequence
  ELANE RNA Guide
acagacgccggccugccggcca

SEQ ID NO: 21390 - RNA, 22 nt, Artificial Sequence
  ELANE RNA Guide
acgccggccugccggccacuca

SEQ ID NO: 21391 - RNA, 22 nt, Artificial Sequence
  ELANE RNA Guide
acgucugcacucucgugagugg

SEQ ID NO: 21392 - RNA, 22 nt, Artificial Sequence
  ELANE RNA Guide
acucucgugaguggccggcagg

SEQ ID NO: 21393 - RNA, 22 nt, Artificial Sequence
  ELANE RNA Guide
agacgccggccugccggccacu

SEQ ID NO: 21394 - RNA, 22 nt, Artificial Sequence
  ELANE RNA Guide
aguggccggcaggccggcgucu

SEQ ID NO: 21395 - RNA, 22 nt, Artificial Sequence
  ELANE RNA Guide
caacgucugcacucucgugagu

SEQ ID NO: 21396 - RNA, 22 nt, Artificial Sequence
  ELANE RNA Guide
cacucacgagagugcagacguu

SEQ ID NO: 21397 - RNA, 22 nt, Artificial Sequence
  ELANE RNA Guide
cacucucgugaguggccggcag

SEQ ID NO: 21398 - RNA, 22 nt, Artificial Sequence
  ELANE RNA Guide
ccacucacgagagugcagacgu

SEQ ID NO: 21399 - RNA, 22 nt, Artificial Sequence
  ELANE RNA Guide
ccggccacucacgagagugcag

SEQ ID NO: 21400 - RNA, 22 nt, Artificial Sequence
  ELANE RNA Guide
ccggccugccggccacucacga

SEQ ID NO: 21401 - RNA, 22 nt, Artificial Sequence
  ELANE RNA Guide
ccugccggccacucacgagagu

SEQ ID NO: 21402 - RNA, 22 nt, Artificial Sequence
  ELANE RNA Guide
cggccacucacgagagugcaga

SEQ ID NO: 21403 - RNA, 22 nt, Artificial Sequence
  ELANE RNA Guide
cggccugccggccacucacgag

SEQ ID NO: 21404 - RNA, 22 nt, Artificial Sequence
  ELANE RNA Guide
cgucugcacucucgugaguggc

SEQ ID NO: 21405 - RNA, 22 nt, Artificial Sequence
  ELANE RNA Guide
cucgugaguggccggcaggccg

SEQ ID NO: 21406 - RNA, 22 nt, Artificial Sequence
  ELANE RNA Guide
cucucgugaguggccggcaggc

SEQ ID NO: 21407 - RNA, 22 nt, Artificial Sequence
  ELANE RNA Guide
cugcacucucgugaguggccgg

SEQ ID NO: 21408 - RNA, 22 nt, Artificial Sequence
  ELANE RNA Guide
cugccggccacucacgagagug

SEQ ID NO: 21409 - RNA, 22 nt, Artificial Sequence
  ELANE RNA Guide
gcacucucgugaguggccggca

SEQ ID NO: 21410 - RNA, 22 nt, Artificial Sequence
  ELANE RNA Guide
gccacucacgagagugcagacg

SEQ ID NO: 21411 - RNA, 22 nt, Artificial Sequence
  ELANE RNA Guide
gccggccacucacgagagugca

SEQ ID NO: 21412 - RNA, 22 nt, Artificial Sequence
  ELANE RNA Guide
gccugccggccacucacgagag

SEQ ID NO: 21413 - RNA, 22 nt, Artificial Sequence
  ELANE RNA Guide
ggccacucacgagagugcagac

SEQ ID NO: 21414 - RNA, 22 nt, Artificial Sequence
  ELANE RNA Guide
ggccugccggccacucacgaga

SEQ ID NO: 21415 - RNA, 22 nt, Artificial Sequence
  ELANE RNA Guide
gucugcacucucgugaguggcc

SEQ ID NO: 21416 - RNA, 22 nt, Artificial Sequence
  ELANE RNA Guide
ucgugaguggccggcaggccgg

SEQ ID NO: 21417 - RNA, 22 nt, Artificial Sequence
  ELANE RNA Guide
ucucgugaguggccggcaggcc

SEQ ID NO: 21418 - RNA, 22 nt, Artificial Sequence
  ELANE RNA Guide
ucugcacucucgugaguggccg

SEQ ID NO: 21419 - RNA, 22 nt, Artificial Sequence
  ELANE RNA Guide
ugaguggccggcaggccggcgu

SEQ ID NO: 21420 - RNA, 22 nt, Artificial Sequence
  ELANE RNA Guide
ugcacucucgugaguggccggc

SEQ ID NO: 21421 - RNA, 22 nt, Artificial Sequence
  ELANE RNA Guide
ugccggccacucacgagagugc

SEQ ID NO: 21422 - RNA, 20 nt, Artificial Sequence
  ELANE RNA Guide
aaacagacgccggccugcug

SEQ ID NO: 21423 - RNA, 20 nt, Artificial Sequence
  ELANE RNA Guide
aacagacgccggccugcugg

SEQ ID NO: 21424 - RNA, 20 nt, Artificial Sequence
  ELANE RNA Guide
acagacgccggccugcuggc

SEQ ID NO: 21425 - RNA, 20 nt, Artificial Sequence
  ELANE RNA Guide
acgaaacagacgccggccug

SEQ ID NO: 21426 - RNA, 20 nt, Artificial Sequence
  ELANE RNA Guide
acgccggccugcuggccccu

SEQ ID NO: 21427 - RNA, 20 nt, Artificial Sequence
  ELANE RNA Guide
acucucgugaggggccagca

SEQ ID NO: 21428 - RNA, 20 nt, Artificial Sequence
  ELANE RNA Guide
agacgccggccugcuggccc

SEQ ID NO: 21429 - RNA, 20 nt, Artificial Sequence
  ELANE RNA Guide
aggggccagcaggccggcgu

SEQ ID NO: 21430 - RNA, 20 nt, Artificial Sequence
  ELANE RNA Guide
cacucucgugaggggccagc

SEQ ID NO: 21431 - RNA, 20 nt, Artificial Sequence
  ELANE RNA Guide
cagacgccggccugcuggcc

SEQ ID NO: 21432 - RNA, 20 nt, Artificial Sequence
  ELANE RNA Guide
cagcaggccggcgucuguuu

SEQ ID NO: 21433 - RNA, 20 nt, Artificial Sequence
  ELANE RNA Guide
ccagcaggccggcgucuguu

SEQ ID NO: 21434 - RNA, 20 nt, Artificial Sequence
  ELANE RNA Guide
ccggccugcuggccccucac

SEQ ID NO: 21435 - RNA, 20 nt, Artificial Sequence
  ELANE RNA Guide
ccugcuggccccucacgaga

SEQ ID NO: 21436 - RNA, 20 nt, Artificial Sequence
  ELANE RNA Guide
cgaaacagacgccggccugc

SEQ ID NO: 21437 - RNA, 20 nt, Artificial Sequence
  ELANE RNA Guide
cggccugcuggccccucacg

SEQ ID NO: 21438 - RNA, 20 nt, Artificial Sequence
  ELANE RNA Guide
cgucugcacucucgugaggg

SEQ ID NO: 21439 - RNA, 20 nt, Artificial Sequence
  ELANE RNA Guide
cgugaggggccagcaggccg

SEQ ID NO: 21440 - RNA, 20 nt, Artificial Sequence
  ELANE RNA Guide
cucgugaggggccagcaggc

SEQ ID NO: 21441 - RNA, 20 nt, Artificial Sequence
  ELANE RNA Guide
cucucgugaggggccagcag

SEQ ID NO: 21442 - RNA, 20 nt, Artificial Sequence
  ELANE RNA Guide
cugcacucucgugaggggcc

SEQ ID NO: 21443 - RNA, 20 nt, Artificial Sequence
  ELANE RNA Guide
cugcuggccccucacgagag

SEQ ID NO: 21444 - RNA, 20 nt, Artificial Sequence
  ELANE RNA Guide
cuggccccucacgagagugc

SEQ ID NO: 21445 - RNA, 20 nt, Artificial Sequence
  ELANE RNA Guide
gaaacagacgccggccugcu

SEQ ID NO: 21446 - RNA, 20 nt, Artificial Sequence
  ELANE RNA Guide
gcacucucgugaggggccag

SEQ ID NO: 21447 - RNA, 20 nt, Artificial Sequence
  ELANE RNA Guide
gccagcaggccggcgucugu

SEQ ID NO: 21448 - RNA, 20 nt, Artificial Sequence
  ELANE RNA Guide
gccggccugcuggccccuca

SEQ ID NO: 21449 - RNA, 20 nt, Artificial Sequence
  ELANE RNA Guide
gccugcuggccccucacgag

SEQ ID NO: 21450 - RNA, 20 nt, Artificial Sequence
  ELANE RNA Guide
gcuggccccucacgagagug

SEQ ID NO: 21451 - RNA, 20 nt, Artificial Sequence
  ELANE RNA Guide
ggccagcaggccggcgucug

SEQ ID NO: 21452 - RNA, 20 nt, Artificial Sequence
  ELANE RNA Guide
ggccugcuggccccucacga

SEQ ID NO: 21453 - RNA, 20 nt, Artificial Sequence
  ELANE RNA Guide
gggccagcaggccggcgucu

SEQ ID NO: 21454 - RNA, 20 nt, Artificial Sequence
  ELANE RNA Guide
guacgaaacagacgccggcc

SEQ ID NO: 21455 - RNA, 20 nt, Artificial Sequence
  ELANE RNA Guide
gucugcacucucgugagggg

SEQ ID NO: 21456 - RNA, 20 nt, Artificial Sequence
  ELANE RNA Guide
gugaggggccagcaggccgg

SEQ ID NO: 21457 - RNA, 20 nt, Artificial Sequence
  ELANE RNA Guide
uacgaaacagacgccggccu

SEQ ID NO: 21458 - RNA, 20 nt, Artificial Sequence
  ELANE RNA Guide
ucgugaggggccagcaggcc

SEQ ID NO: 21459 - RNA, 20 nt, Artificial Sequence
  ELANE RNA Guide
ucucgugaggggccagcagg

SEQ ID NO: 21460 - RNA, 20 nt, Artificial Sequence
  ELANE RNA Guide
ucugcacucucgugaggggc

SEQ ID NO: 21461 - RNA, 20 nt, Artificial Sequence
  ELANE RNA Guide
ugaggggccagcaggccggc

SEQ ID NO: 21462 - RNA, 20 nt, Artificial Sequence
  ELANE RNA Guide
ugcacucucgugaggggcca

SEQ ID NO: 21463 - RNA, 20 nt, Artificial Sequence
  ELANE RNA Guide
ugcuggccccucacgagagu

SEQ ID NO: 21464 - RNA, 21 nt, Artificial Sequence
  ELANE RNA Guide
aaacagacgccggccugcugg

SEQ ID NO: 21465 - RNA, 21 nt, Artificial Sequence
  ELANE RNA Guide
aacagacgccggccugcuggc

SEQ ID NO: 21466 - RNA, 21 nt, Artificial Sequence
  ELANE RNA Guide
acagacgccggccugcuggcc

SEQ ID NO: 21467 - RNA, 21 nt, Artificial Sequence
  ELANE RNA Guide
acgaaacagacgccggccugc

SEQ ID NO: 21468 - RNA, 21 nt, Artificial Sequence
  ELANE RNA Guide
acgucugcacucucgugaggg

SEQ ID NO: 21469 - RNA, 21 nt, Artificial Sequence
  ELANE RNA Guide
acucucgugaggggccagcag

SEQ ID NO: 21470 - RNA, 21 nt, Artificial Sequence
  ELANE RNA Guide
cacucucgugaggggccagca

SEQ ID NO: 21471 - RNA, 21 nt, Artificial Sequence
  ELANE RNA Guide
cagcaggccggcgucuguuuc

SEQ ID NO: 21472 - RNA, 21 nt, Artificial Sequence
  ELANE RNA Guide
ccagcaggccggcgucuguuu

SEQ ID NO: 21473 - RNA, 21 nt, Artificial Sequence
  ELANE RNA Guide
ccugcuggccccucacgagag

SEQ ID NO: 21474 - RNA, 21 nt, Artificial Sequence
  ELANE RNA Guide
cgaaacagacgccggccugcu

SEQ ID NO: 21475 - RNA, 21 nt, Artificial Sequence
  ELANE RNA Guide
cggccugcuggccccucacga

SEQ ID NO: 21476 - RNA, 21 nt, Artificial Sequence
  ELANE RNA Guide
cguacgaaacagacgccggcc

SEQ ID NO: 21477 - RNA, 21 nt, Artificial Sequence
  ELANE RNA Guide
cgucugcacucucgugagggg

SEQ ID NO: 21478 - RNA, 21 nt, Artificial Sequence
  ELANE RNA Guide
cucgugaggggccagcaggcc

SEQ ID NO: 21479 - RNA, 21 nt, Artificial Sequence
  ELANE RNA Guide
cucucgugaggggccagcagg

SEQ ID NO: 21480 - RNA, 21 nt, Artificial Sequence
  ELANE RNA Guide
cugcacucucgugaggggcca

SEQ ID NO: 21481 - RNA, 21 nt, Artificial Sequence
  ELANE RNA Guide
cugcuggccccucacgagagu

SEQ ID NO: 21482 - RNA, 21 nt, Artificial Sequence
  ELANE RNA Guide
cuggccccucacgagagugca

SEQ ID NO: 21483 - RNA, 21 nt, Artificial Sequence
  ELANE RNA Guide
gaaacagacgccggccugcug

SEQ ID NO: 21484 - RNA, 21 nt, Artificial Sequence
  ELANE RNA Guide
gcacucucgugaggggccagc

SEQ ID NO: 21485 - RNA, 21 nt, Artificial Sequence
  ELANE RNA Guide
gccagcaggccggcgucuguu

SEQ ID NO: 21486 - RNA, 21 nt, Artificial Sequence
  ELANE RNA Guide
gccugcuggccccucacgaga

SEQ ID NO: 21487 - RNA, 21 nt, Artificial Sequence
  ELANE RNA Guide
gcuggccccucacgagagugc

SEQ ID NO: 21488 - RNA, 21 nt, Artificial Sequence
  ELANE RNA Guide
ggccagcaggccggcgucugu

SEQ ID NO: 21489 - RNA, 21 nt, Artificial Sequence
  ELANE RNA Guide
ggccugcuggccccucacgag

SEQ ID NO: 21490 - RNA, 21 nt, Artificial Sequence
  ELANE RNA Guide
guacgaaacagacgccggccu

SEQ ID NO: 21491 - RNA, 21 nt, Artificial Sequence
  ELANE RNA Guide
gucugcacucucgugaggggc

SEQ ID NO: 21492 - RNA, 21 nt, Artificial Sequence
  ELANE RNA Guide
uacgaaacagacgccggccug

SEQ ID NO: 21493 - RNA, 21 nt, Artificial Sequence
  ELANE RNA Guide
ucgugaggggccagcaggccg

SEQ ID NO: 21494 - RNA, 21 nt, Artificial Sequence
  ELANE RNA Guide
ucucgugaggggccagcaggc

SEQ ID NO: 21495 - RNA, 21 nt, Artificial Sequence
  ELANE RNA Guide
ucugcacucucgugaggggcc

SEQ ID NO: 21496 - RNA, 21 nt, Artificial Sequence
  ELANE RNA Guide
ugcacucucgugaggggccag

SEQ ID NO: 21497 - RNA, 21 nt, Artificial Sequence
  ELANE RNA Guide
ugcuggccccucacgagagug

SEQ ID NO: 21498 - RNA, 22 nt, Artificial Sequence
  ELANE RNA Guide
aaacagacgccggccugcuggc

SEQ ID NO: 21499 - RNA, 22 nt, Artificial Sequence
  ELANE RNA Guide
aacagacgccggccugcuggcc

SEQ ID NO: 21500 - RNA, 22 nt, Artificial Sequence
  ELANE RNA Guide
aacgucugcacucucgugaggg

SEQ ID NO: 21501 - RNA, 22 nt, Artificial Sequence
  ELANE RNA Guide
acagacgccggccugcuggccc

SEQ ID NO: 21502 - RNA, 22 nt, Artificial Sequence
  ELANE RNA Guide
acgaaacagacgccggccugcu

SEQ ID NO: 21503 - RNA, 22 nt, Artificial Sequence
  ELANE RNA Guide
acgccggccugcuggccccuca

SEQ ID NO: 21504 - RNA, 22 nt, Artificial Sequence
  ELANE RNA Guide
acguacgaaacagacgccggcc

SEQ ID NO: 21505 - RNA, 22 nt, Artificial Sequence
  ELANE RNA Guide
acgucugcacucucgugagggg

SEQ ID NO: 21506 - RNA, 22 nt, Artificial Sequence
  ELANE RNA Guide
acucucgugaggggccagcagg

SEQ ID NO: 21507 - RNA, 22 nt, Artificial Sequence
  ELANE RNA Guide
agacgccggccugcuggccccu

SEQ ID NO: 21508 - RNA, 22 nt, Artificial Sequence
  ELANE RNA Guide
aggggccagcaggccggcgucu

SEQ ID NO: 21509 - RNA, 22 nt, Artificial Sequence
  ELANE RNA Guide
cacucucgugaggggccagcag

SEQ ID NO: 21510 - RNA, 22 nt, Artificial Sequence
  ELANE RNA Guide
cagcaggccggcgucuguuucg

SEQ ID NO: 21511 - RNA, 22 nt, Artificial Sequence
  ELANE RNA Guide
ccagcaggccggcgucuguuuc

SEQ ID NO: 21512 - RNA, 22 nt, Artificial Sequence
  ELANE RNA Guide
ccggccugcuggccccucacga

SEQ ID NO: 21513 - RNA, 22 nt, Artificial Sequence
  ELANE RNA Guide
ccugcuggccccucacgagagu

SEQ ID NO: 21514 - RNA, 22 nt, Artificial Sequence
  ELANE RNA Guide
cgaaacagacgccggccugcug

SEQ ID NO: 21515 - RNA, 22 nt, Artificial Sequence
  ELANE RNA Guide
cggccugcuggccccucacgag

SEQ ID NO: 21516 - RNA, 22 nt, Artificial Sequence
  ELANE RNA Guide
cguacgaaacagacgccggccu

SEQ ID NO: 21517 - RNA, 22 nt, Artificial Sequence
  ELANE RNA Guide
cgucugcacucucgugaggggc

SEQ ID NO: 21518 - RNA, 22 nt, Artificial Sequence
  ELANE RNA Guide
cucgugaggggccagcaggccg

SEQ ID NO: 21519 - RNA, 22 nt, Artificial Sequence
  ELANE RNA Guide
cucucgugaggggccagcaggc

SEQ ID NO: 21520 - RNA, 22 nt, Artificial Sequence
  ELANE RNA Guide
cugcacucucgugaggggccag

SEQ ID NO: 21521 - RNA, 22 nt, Artificial Sequence
  ELANE RNA Guide
cugcuggccccucacgagagug

SEQ ID NO: 21522 - RNA, 22 nt, Artificial Sequence
  ELANE RNA Guide
cuggccccucacgagagugcag

SEQ ID NO: 21523 - RNA, 22 nt, Artificial Sequence
  ELANE RNA Guide
gaaacagacgccggccugcugg

SEQ ID NO: 21524 - RNA, 22 nt, Artificial Sequence
  ELANE RNA Guide
gcacucucgugaggggccagca

SEQ ID NO: 21525 - RNA, 22 nt, Artificial Sequence
  ELANE RNA Guide
gccagcaggccggcgucuguuu

SEQ ID NO: 21526 - RNA, 22 nt, Artificial Sequence
  ELANE RNA Guide
gccugcuggccccucacgagag

SEQ ID NO: 21527 - RNA, 22 nt, Artificial Sequence
  ELANE RNA Guide
gcuggccccucacgagagugca

SEQ ID NO: 21528 - RNA, 22 nt, Artificial Sequence
  ELANE RNA Guide
ggccagcaggccggcgucuguu

SEQ ID NO: 21529 - RNA, 22 nt, Artificial Sequence
  ELANE RNA Guide
ggccugcuggccccucacgaga

SEQ ID NO: 21530 - RNA, 22 nt, Artificial Sequence
  ELANE RNA Guide
gggccagcaggccggcgucugu

SEQ ID NO: 21531 - RNA, 22 nt, Artificial Sequence
  ELANE RNA Guide
guacgaaacagacgccggccug

SEQ ID NO: 21532 - RNA, 22 nt, Artificial Sequence
  ELANE RNA Guide
gucugcacucucgugaggggcc

SEQ ID NO: 21533 - RNA, 22 nt, Artificial Sequence
  ELANE RNA Guide
uacgaaacagacgccggccugc

SEQ ID NO: 21534 - RNA, 22 nt, Artificial Sequence
  ELANE RNA Guide
ucgugaggggccagcaggccgg

SEQ ID NO: 21535 - RNA, 22 nt, Artificial Sequence
  ELANE RNA Guide
ucucgugaggggccagcaggcc

SEQ ID NO: 21536 - RNA, 22 nt, Artificial Sequence
  ELANE RNA Guide
ucugcacucucgugaggggcca

SEQ ID NO: 21537 - RNA, 22 nt, Artificial Sequence
  ELANE RNA Guide
ugaggggccagcaggccggcgu

SEQ ID NO: 21538 - RNA, 22 nt, Artificial Sequence
  ELANE RNA Guide
ugcacucucgugaggggccagc

SEQ ID NO: 21539 - RNA, 22 nt, Artificial Sequence
  ELANE RNA Guide
ugcuggccccucacgagagugc

SEQ ID NO: 21540 - RNA, 20 nt, Artificial Sequence
  ELANE RNA Guide
aaacagacgccggccuaccg

SEQ ID NO: 21541 - RNA, 20 nt, Artificial Sequence
  ELANE RNA Guide
aacagacgccggccuaccgg

SEQ ID NO: 21542 - RNA, 20 nt, Artificial Sequence
  ELANE RNA Guide
acagacgccggccuaccggc

SEQ ID NO: 21543 - RNA, 20 nt, Artificial Sequence
  ELANE RNA Guide
acgaaacagacgccggccua

SEQ ID NO: 21544 - RNA, 20 nt, Artificial Sequence
  ELANE RNA Guide
acgccggccuaccggccccu

SEQ ID NO: 21545 - RNA, 20 nt, Artificial Sequence
  ELANE RNA Guide
acguacgaaacagacgccgg

SEQ ID NO: 21546 - RNA, 20 nt, Artificial Sequence
  ELANE RNA Guide
acucucgugaggggccggua

SEQ ID NO: 21547 - RNA, 20 nt, Artificial Sequence
  ELANE RNA Guide
agacgccggccuaccggccc

SEQ ID NO: 21548 - RNA, 20 nt, Artificial Sequence
  ELANE RNA Guide
aggggccgguaggccggcgu

SEQ ID NO: 21549 - RNA, 20 nt, Artificial Sequence
  ELANE RNA Guide
cacucucgugaggggccggu

SEQ ID NO: 21550 - RNA, 20 nt, Artificial Sequence
  ELANE RNA Guide
cagacgccggccuaccggcc

SEQ ID NO: 21551 - RNA, 20 nt, Artificial Sequence
  ELANE RNA Guide
ccggccuaccggccccucac

SEQ ID NO: 21552 - RNA, 20 nt, Artificial Sequence
  ELANE RNA Guide
ccgguaggccggcgucuguu

SEQ ID NO: 21553 - RNA, 20 nt, Artificial Sequence
  ELANE RNA Guide
ccuaccggccccucacgaga

SEQ ID NO: 21554 - RNA, 20 nt, Artificial Sequence
  ELANE RNA Guide
cgaaacagacgccggccuac

SEQ ID NO: 21555 - RNA, 20 nt, Artificial Sequence
  ELANE RNA Guide
cggccuaccggccccucacg

SEQ ID NO: 21556 - RNA, 20 nt, Artificial Sequence
  ELANE RNA Guide
cgguaggccggcgucuguuu

SEQ ID NO: 21557 - RNA, 20 nt, Artificial Sequence
  ELANE RNA Guide
cguacgaaacagacgccggc

SEQ ID NO: 21558 - RNA, 20 nt, Artificial Sequence
  ELANE RNA Guide
cgugaggggccgguaggccg

SEQ ID NO: 21559 - RNA, 20 nt, Artificial Sequence
  ELANE RNA Guide
cuaccggccccucacgagag

SEQ ID NO: 21560 - RNA, 20 nt, Artificial Sequence
  ELANE RNA Guide
cucgugaggggccgguaggc

SEQ ID NO: 21561 - RNA, 20 nt, Artificial Sequence
  ELANE RNA Guide
cucucgugaggggccgguag

SEQ ID NO: 21562 - RNA, 20 nt, Artificial Sequence
  ELANE RNA Guide
gaaacagacgccggccuacc

SEQ ID NO: 21563 - RNA, 20 nt, Artificial Sequence
  ELANE RNA Guide
gcacucucgugaggggccgg

SEQ ID NO: 21564 - RNA, 20 nt, Artificial Sequence
  ELANE RNA Guide
gccggccuaccggccccuca

SEQ ID NO: 21565 - RNA, 20 nt, Artificial Sequence
  ELANE RNA Guide
gccgguaggccggcgucugu

SEQ ID NO: 21566 - RNA, 20 nt, Artificial Sequence
  ELANE RNA Guide
gccuaccggccccucacgag

SEQ ID NO: 21567 - RNA, 20 nt, Artificial Sequence
  ELANE RNA Guide
ggccgguaggccggcgucug

SEQ ID NO: 21568 - RNA, 20 nt, Artificial Sequence
  ELANE RNA Guide
ggccuaccggccccucacga

SEQ ID NO: 21569 - RNA, 20 nt, Artificial Sequence
  ELANE RNA Guide
gggccgguaggccggcgucu

SEQ ID NO: 21570 - RNA, 20 nt, Artificial Sequence
  ELANE RNA Guide
gguaggccggcgucuguuuc

SEQ ID NO: 21571 - RNA, 20 nt, Artificial Sequence
  ELANE RNA Guide
guaggccggcgucuguuucg

SEQ ID NO: 21572 - RNA, 20 nt, Artificial Sequence
  ELANE RNA Guide
gugaggggccgguaggccgg

SEQ ID NO: 21573 - RNA, 20 nt, Artificial Sequence
  ELANE RNA Guide
uaccggccccucacgagagu

SEQ ID NO: 21574 - RNA, 20 nt, Artificial Sequence
  ELANE RNA Guide
ucgugaggggccgguaggcc

SEQ ID NO: 21575 - RNA, 20 nt, Artificial Sequence
  ELANE RNA Guide
ucucgugaggggccgguagg

SEQ ID NO: 21576 - RNA, 20 nt, Artificial Sequence
  ELANE RNA Guide
ugaggggccgguaggccggc

SEQ ID NO: 21577 - RNA, 20 nt, Artificial Sequence
  ELANE RNA Guide
ugcacucucgugaggggccg

SEQ ID NO: 21578 - RNA, 21 nt, Artificial Sequence
  ELANE RNA Guide
aaacagacgccggccuaccgg

SEQ ID NO: 21579 - RNA, 21 nt, Artificial Sequence
  ELANE RNA Guide
aacagacgccggccuaccggc

SEQ ID NO: 21580 - RNA, 21 nt, Artificial Sequence
  ELANE RNA Guide
acagacgccggccuaccggcc

SEQ ID NO: 21581 - RNA, 21 nt, Artificial Sequence
  ELANE RNA Guide
acgaaacagacgccggccuac

SEQ ID NO: 21582 - RNA, 21 nt, Artificial Sequence
  ELANE RNA Guide
acguacgaaacagacgccggc

SEQ ID NO: 21583 - RNA, 21 nt, Artificial Sequence
  ELANE RNA Guide
acucucgugaggggccgguag

SEQ ID NO: 21584 - RNA, 21 nt, Artificial Sequence
  ELANE RNA Guide
cacguacgaaacagacgccgg

SEQ ID NO: 21585 - RNA, 21 nt, Artificial Sequence
  ELANE RNA Guide
cacucucgugaggggccggua

SEQ ID NO: 21586 - RNA, 21 nt, Artificial Sequence
  ELANE RNA Guide
ccgguaggccggcgucuguuu

SEQ ID NO: 21587 - RNA, 21 nt, Artificial Sequence
  ELANE RNA Guide
ccuaccggccccucacgagag

SEQ ID NO: 21588 - RNA, 21 nt, Artificial Sequence
  ELANE RNA Guide
cgaaacagacgccggccuacc

SEQ ID NO: 21589 - RNA, 21 nt, Artificial Sequence
  ELANE RNA Guide
cggccuaccggccccucacga

SEQ ID NO: 21590 - RNA, 21 nt, Artificial Sequence
  ELANE RNA Guide
cgguaggccggcgucuguuuc

SEQ ID NO: 21591 - RNA, 21 nt, Artificial Sequence
  ELANE RNA Guide
cuaccggccccucacgagagu

SEQ ID NO: 21592 - RNA, 21 nt, Artificial Sequence
  ELANE RNA Guide
cucgugaggggccgguaggcc

SEQ ID NO: 21593 - RNA, 21 nt, Artificial Sequence
  ELANE RNA Guide
cucucgugaggggccgguagg

SEQ ID NO: 21594 - RNA, 21 nt, Artificial Sequence
  ELANE RNA Guide
cugcacucucgugaggggccg

SEQ ID NO: 21595 - RNA, 21 nt, Artificial Sequence
  ELANE RNA Guide
gaaacagacgccggccuaccg

SEQ ID NO: 21596 - RNA, 21 nt, Artificial Sequence
  ELANE RNA Guide
gcacucucgugaggggccggu

SEQ ID NO: 21597 - RNA, 21 nt, Artificial Sequence
  ELANE RNA Guide
gccgguaggccggcgucuguu

SEQ ID NO: 21598 - RNA, 21 nt, Artificial Sequence
  ELANE RNA Guide
gccuaccggccccucacgaga

SEQ ID NO: 21599 - RNA, 21 nt, Artificial Sequence
  ELANE RNA Guide
ggccgguaggccggcgucugu

SEQ ID NO: 21600 - RNA, 21 nt, Artificial Sequence
  ELANE RNA Guide
ggccuaccggccccucacgag

SEQ ID NO: 21601 - RNA, 21 nt, Artificial Sequence
  ELANE RNA Guide
gguaggccggcgucuguuucg

SEQ ID NO: 21602 - RNA, 21 nt, Artificial Sequence
  ELANE RNA Guide
guaggccggcgucuguuucgu

SEQ ID NO: 21603 - RNA, 21 nt, Artificial Sequence
  ELANE RNA Guide
uaccggccccucacgagagug

SEQ ID NO: 21604 - RNA, 21 nt, Artificial Sequence
  ELANE RNA Guide
uacgaaacagacgccggccua

SEQ ID NO: 21605 - RNA, 21 nt, Artificial Sequence
  ELANE RNA Guide
ucgugaggggccgguaggccg

SEQ ID NO: 21606 - RNA, 21 nt, Artificial Sequence
  ELANE RNA Guide
ucucgugaggggccgguaggc

SEQ ID NO: 21607 - RNA, 21 nt, Artificial Sequence
  ELANE RNA Guide
ugcacucucgugaggggccgg

SEQ ID NO: 21608 - RNA, 22 nt, Artificial Sequence
  ELANE RNA Guide
aaacagacgccggccuaccggc

SEQ ID NO: 21609 - RNA, 22 nt, Artificial Sequence
  ELANE RNA Guide
aacagacgccggccuaccggcc

SEQ ID NO: 21610 - RNA, 22 nt, Artificial Sequence
  ELANE RNA Guide
acagacgccggccuaccggccc

SEQ ID NO: 21611 - RNA, 22 nt, Artificial Sequence
  ELANE RNA Guide
acgaaacagacgccggccuacc

SEQ ID NO: 21612 - RNA, 22 nt, Artificial Sequence
  ELANE RNA Guide
acgccggccuaccggccccuca

SEQ ID NO: 21613 - RNA, 22 nt, Artificial Sequence
  ELANE RNA Guide
acucucgugaggggccgguagg

SEQ ID NO: 21614 - RNA, 22 nt, Artificial Sequence
  ELANE RNA Guide
agacgccggccuaccggccccu

SEQ ID NO: 21615 - RNA, 22 nt, Artificial Sequence
  ELANE RNA Guide
aggggccgguaggccggcgucu

SEQ ID NO: 21616 - RNA, 22 nt, Artificial Sequence
  ELANE RNA Guide
cacguacgaaacagacgccggc

SEQ ID NO: 21617 - RNA, 22 nt, Artificial Sequence
  ELANE RNA Guide
cacucucgugaggggccgguag

SEQ ID NO: 21618 - RNA, 22 nt, Artificial Sequence
  ELANE RNA Guide
ccggccuaccggccccucacga

SEQ ID NO: 21619 - RNA, 22 nt, Artificial Sequence
  ELANE RNA Guide
ccgguaggccggcgucuguuuc

SEQ ID NO: 21620 - RNA, 22 nt, Artificial Sequence
  ELANE RNA Guide
ccuaccggccccucacgagagu

SEQ ID NO: 21621 - RNA, 22 nt, Artificial Sequence
  ELANE RNA Guide
cgaaacagacgccggccuaccg

SEQ ID NO: 21622 - RNA, 22 nt, Artificial Sequence
  ELANE RNA Guide
cggccuaccggccccucacgag

SEQ ID NO: 21623 - RNA, 22 nt, Artificial Sequence
  ELANE RNA Guide
cgguaggccggcgucuguuucg

SEQ ID NO: 21624 - RNA, 22 nt, Artificial Sequence
  ELANE RNA Guide
cuaccggccccucacgagagug

SEQ ID NO: 21625 - RNA, 22 nt, Artificial Sequence
  ELANE RNA Guide
cucgugaggggccgguaggccg

SEQ ID NO: 21626 - RNA, 22 nt, Artificial Sequence
  ELANE RNA Guide
cucucgugaggggccgguaggc

SEQ ID NO: 21627 - RNA, 22 nt, Artificial Sequence
  ELANE RNA Guide
cugcacucucgugaggggccgg

SEQ ID NO: 21628 - RNA, 22 nt, Artificial Sequence
  ELANE RNA Guide
gaaacagacgccggccuaccgg

SEQ ID NO: 21629 - RNA, 22 nt, Artificial Sequence
  ELANE RNA Guide
gcacguacgaaacagacgccgg

SEQ ID NO: 21630 - RNA, 22 nt, Artificial Sequence
  ELANE RNA Guide
gcacucucgugaggggccggua

SEQ ID NO: 21631 - RNA, 22 nt, Artificial Sequence
  ELANE RNA Guide
gccgguaggccggcgucuguuu

SEQ ID NO: 21632 - RNA, 22 nt, Artificial Sequence
  ELANE RNA Guide
gccuaccggccccucacgagag

SEQ ID NO: 21633 - RNA, 22 nt, Artificial Sequence
  ELANE RNA Guide
ggccgguaggccggcgucuguu

SEQ ID NO: 21634 - RNA, 22 nt, Artificial Sequence
  ELANE RNA Guide
ggccuaccggccccucacgaga

SEQ ID NO: 21635 - RNA, 22 nt, Artificial Sequence
  ELANE RNA Guide
gggccgguaggccggcgucugu

SEQ ID NO: 21636 - RNA, 22 nt, Artificial Sequence
  ELANE RNA Guide
gguaggccggcgucuguuucgu

SEQ ID NO: 21637 - RNA, 22 nt, Artificial Sequence
  ELANE RNA Guide
guacgaaacagacgccggccua

SEQ ID NO: 21638 - RNA, 22 nt, Artificial Sequence
  ELANE RNA Guide
guaggccggcgucuguuucgua

SEQ ID NO: 21639 - RNA, 22 nt, Artificial Sequence
  ELANE RNA Guide
uaccggccccucacgagagugc

SEQ ID NO: 21640 - RNA, 22 nt, Artificial Sequence
  ELANE RNA Guide
uacgaaacagacgccggccuac

SEQ ID NO: 21641 - RNA, 22 nt, Artificial Sequence
  ELANE RNA Guide
ucgugaggggccgguaggccgg

SEQ ID NO: 21642 - RNA, 22 nt, Artificial Sequence
  ELANE RNA Guide
ucucgugaggggccgguaggcc

SEQ ID NO: 21643 - RNA, 22 nt, Artificial Sequence
  ELANE RNA Guide
ucugcacucucgugaggggccg

SEQ ID NO: 21644 - RNA, 22 nt, Artificial Sequence
  ELANE RNA Guide
ugaggggccgguaggccggcgu

SEQ ID NO: 21645 - RNA, 22 nt, Artificial Sequence
  ELANE RNA Guide
ugcacucucgugaggggccggu

SEQ ID NO: 21646 - RNA, 20 nt, Artificial Sequence
  ELANE RNA Guide
aaacagacgccggcaggccg

SEQ ID NO: 21647 - RNA, 20 nt, Artificial Sequence
  ELANE RNA Guide
aacagacgccggcaggccgg

SEQ ID NO: 21648 - RNA, 20 nt, Artificial Sequence
  ELANE RNA Guide
acagacgccggcaggccggc

SEQ ID NO: 21649 - RNA, 20 nt, Artificial Sequence
  ELANE RNA Guide
acgaaacagacgccggcagg

SEQ ID NO: 21650 - RNA, 20 nt, Artificial Sequence
  ELANE RNA Guide
acucucgugaggggccggcc

SEQ ID NO: 21651 - RNA, 20 nt, Artificial Sequence
  ELANE RNA Guide
aggccggccccucacgagag

SEQ ID NO: 21652 - RNA, 20 nt, Artificial Sequence
  ELANE RNA Guide
cacguacgaaacagacgccg

SEQ ID NO: 21653 - RNA, 20 nt, Artificial Sequence
  ELANE RNA Guide
cacucucgugaggggccggc

SEQ ID NO: 21654 - RNA, 20 nt, Artificial Sequence
  ELANE RNA Guide
caggccggccccucacgaga

SEQ ID NO: 21655 - RNA, 20 nt, Artificial Sequence
  ELANE RNA Guide
ccggccugccggcgucuguu

SEQ ID NO: 21656 - RNA, 20 nt, Artificial Sequence
  ELANE RNA Guide
ccugccggcgucuguuucgu

SEQ ID NO: 21657 - RNA, 20 nt, Artificial Sequence
  ELANE RNA Guide
cgaaacagacgccggcaggc

SEQ ID NO: 21658 - RNA, 20 nt, Artificial Sequence
  ELANE RNA Guide
cggccugccggcgucuguuu

SEQ ID NO: 21659 - RNA, 20 nt, Artificial Sequence
  ELANE RNA Guide
cucgugaggggccggccugc

SEQ ID NO: 21660 - RNA, 20 nt, Artificial Sequence
  ELANE RNA Guide
cucucgugaggggccggccu

SEQ ID NO: 21661 - RNA, 20 nt, Artificial Sequence
  ELANE RNA Guide
gaaacagacgccggcaggcc

SEQ ID NO: 21662 - RNA, 20 nt, Artificial Sequence
  ELANE RNA Guide
gcaggccggccccucacgag

SEQ ID NO: 21663 - RNA, 20 nt, Artificial Sequence
  ELANE RNA Guide
gccggccugccggcgucugu

SEQ ID NO: 21664 - RNA, 20 nt, Artificial Sequence
  ELANE RNA Guide
gccugccggcgucuguuucg

SEQ ID NO: 21665 - RNA, 20 nt, Artificial Sequence
  ELANE RNA Guide
ggcaggccggccccucacga

SEQ ID NO: 21666 - RNA, 20 nt, Artificial Sequence
  ELANE RNA Guide
ggccugccggcgucuguuuc

SEQ ID NO: 21667 - RNA, 20 nt, Artificial Sequence
  ELANE RNA Guide
guacgaaacagacgccggca

SEQ ID NO: 21668 - RNA, 20 nt, Artificial Sequence
  ELANE RNA Guide
uacgaaacagacgccggcag

SEQ ID NO: 21669 - RNA, 20 nt, Artificial Sequence
  ELANE RNA Guide
ucgugaggggccggccugcc

SEQ ID NO: 21670 - RNA, 20 nt, Artificial Sequence
  ELANE RNA Guide
ucucgugaggggccggccug

SEQ ID NO: 21671 - RNA, 21 nt, Artificial Sequence
  ELANE RNA Guide
aaacagacgccggcaggccgg

SEQ ID NO: 21672 - RNA, 21 nt, Artificial Sequence
  ELANE RNA Guide
aacagacgccggcaggccggc

SEQ ID NO: 21673 - RNA, 21 nt, Artificial Sequence
  ELANE RNA Guide
acgaaacagacgccggcaggc

SEQ ID NO: 21674 - RNA, 21 nt, Artificial Sequence
  ELANE RNA Guide
acucucgugaggggccggccu

SEQ ID NO: 21675 - RNA, 21 nt, Artificial Sequence
  ELANE RNA Guide
aggccggccccucacgagagu

SEQ ID NO: 21676 - RNA, 21 nt, Artificial Sequence
  ELANE RNA Guide
cacucucgugaggggccggcc

SEQ ID NO: 21677 - RNA, 21 nt, Artificial Sequence
  ELANE RNA Guide
caggccggccccucacgagag

SEQ ID NO: 21678 - RNA, 21 nt, Artificial Sequence
  ELANE RNA Guide
ccggccugccggcgucuguuu

SEQ ID NO: 21679 - RNA, 21 nt, Artificial Sequence
  ELANE RNA Guide
ccugccggcgucuguuucgua

SEQ ID NO: 21680 - RNA, 21 nt, Artificial Sequence
  ELANE RNA Guide
cgaaacagacgccggcaggcc

SEQ ID NO: 21681 - RNA, 21 nt, Artificial Sequence
  ELANE RNA Guide
cggccugccggcgucuguuuc

SEQ ID NO: 21682 - RNA, 21 nt, Artificial Sequence
  ELANE RNA Guide
cguacgaaacagacgccggca

SEQ ID NO: 21683 - RNA, 21 nt, Artificial Sequence
  ELANE RNA Guide
cucucgugaggggccggccug

SEQ ID NO: 21684 - RNA, 21 nt, Artificial Sequence
  ELANE RNA Guide
gaaacagacgccggcaggccg

SEQ ID NO: 21685 - RNA, 21 nt, Artificial Sequence
  ELANE RNA Guide
gcacguacgaaacagacgccg

SEQ ID NO: 21686 - RNA, 21 nt, Artificial Sequence
  ELANE RNA Guide
gcacucucgugaggggccggc

SEQ ID NO: 21687 - RNA, 21 nt, Artificial Sequence
  ELANE RNA Guide
gcaggccggccccucacgaga

SEQ ID NO: 21688 - RNA, 21 nt, Artificial Sequence
  ELANE RNA Guide
gccggccugccggcgucuguu

SEQ ID NO: 21689 - RNA, 21 nt, Artificial Sequence
  ELANE RNA Guide
gccugccggcgucuguuucgu

SEQ ID NO: 21690 - RNA, 21 nt, Artificial Sequence
  ELANE RNA Guide
ggccugccggcgucuguuucg

SEQ ID NO: 21691 - RNA, 21 nt, Artificial Sequence
  ELANE RNA Guide
guacgaaacagacgccggcag

SEQ ID NO: 21692 - RNA, 21 nt, Artificial Sequence
  ELANE RNA Guide
uacgaaacagacgccggcagg

SEQ ID NO: 21693 - RNA, 21 nt, Artificial Sequence
  ELANE RNA Guide
ucucgugaggggccggccugc

SEQ ID NO: 21694 - RNA, 22 nt, Artificial Sequence
  ELANE RNA Guide
aaacagacgccggcaggccggc

SEQ ID NO: 21695 - RNA, 22 nt, Artificial Sequence
  ELANE RNA Guide
aacagacgccggcaggccggcc

SEQ ID NO: 21696 - RNA, 22 nt, Artificial Sequence
  ELANE RNA Guide
acgaaacagacgccggcaggcc

SEQ ID NO: 21697 - RNA, 22 nt, Artificial Sequence
  ELANE RNA Guide
acguacgaaacagacgccggca

SEQ ID NO: 21698 - RNA, 22 nt, Artificial Sequence
  ELANE RNA Guide
acucucgugaggggccggccug

SEQ ID NO: 21699 - RNA, 22 nt, Artificial Sequence
  ELANE RNA Guide
aggccggccccucacgagagug

SEQ ID NO: 21700 - RNA, 22 nt, Artificial Sequence
  ELANE RNA Guide
cacucucgugaggggccggccu

SEQ ID NO: 21701 - RNA, 22 nt, Artificial Sequence
  ELANE RNA Guide
caggccggccccucacgagagu

SEQ ID NO: 21702 - RNA, 22 nt, Artificial Sequence
  ELANE RNA Guide
ccggccugccggcgucuguuuc

SEQ ID NO: 21703 - RNA, 22 nt, Artificial Sequence
  ELANE RNA Guide
ccugccggcgucuguuucguac

SEQ ID NO: 21704 - RNA, 22 nt, Artificial Sequence
  ELANE RNA Guide
cgaaacagacgccggcaggccg

SEQ ID NO: 21705 - RNA, 22 nt, Artificial Sequence
  ELANE RNA Guide
cggccugccggcgucuguuucg

SEQ ID NO: 21706 - RNA, 22 nt, Artificial Sequence
  ELANE RNA Guide
cguacgaaacagacgccggcag

SEQ ID NO: 21707 - RNA, 22 nt, Artificial Sequence
  ELANE RNA Guide
cucucgugaggggccggccugc

SEQ ID NO: 21708 - RNA, 22 nt, Artificial Sequence
  ELANE RNA Guide
gaaacagacgccggcaggccgg

SEQ ID NO: 21709 - RNA, 22 nt, Artificial Sequence
  ELANE RNA Guide
gcacucucgugaggggccggcc

SEQ ID NO: 21710 - RNA, 22 nt, Artificial Sequence
  ELANE RNA Guide
gcaggccggccccucacgagag

SEQ ID NO: 21711 - RNA, 22 nt, Artificial Sequence
  ELANE RNA Guide
gccggccugccggcgucuguuu

SEQ ID NO: 21712 - RNA, 22 nt, Artificial Sequence
  ELANE RNA Guide
gccugccggcgucuguuucgua

SEQ ID NO: 21713 - RNA, 22 nt, Artificial Sequence
  ELANE RNA Guide
ggcacguacgaaacagacgccg

SEQ ID NO: 21714 - RNA, 22 nt, Artificial Sequence
  ELANE RNA Guide
ggcaggccggccccucacgaga

SEQ ID NO: 21715 - RNA, 22 nt, Artificial Sequence
  ELANE RNA Guide
ggccggccugccggcgucuguu

SEQ ID NO: 21716 - RNA, 22 nt, Artificial Sequence
  ELANE RNA Guide
ggccugccggcgucuguuucgu

SEQ ID NO: 21717 - RNA, 22 nt, Artificial Sequence
  ELANE RNA Guide
guacgaaacagacgccggcagg

SEQ ID NO: 21718 - RNA, 22 nt, Artificial Sequence
  ELANE RNA Guide
uacgaaacagacgccggcaggc

SEQ ID NO: 21719 - RNA, 22 nt, Artificial Sequence
  ELANE RNA Guide
ucucgugaggggccggccugcc

SEQ ID NO: 21720 - RNA, 22 nt, Artificial Sequence
  ELANE RNA Guide
ugcacucucgugaggggccggc

SEQ ID NO: 21721 - RNA, 20 nt, Artificial Sequence
  ELANE RNA Guide
aaacagacgccggcgccugc

SEQ ID NO: 21722 - RNA, 20 nt, Artificial Sequence
  ELANE RNA Guide
aacagacgccggcgccugcc

SEQ ID NO: 21723 - RNA, 20 nt, Artificial Sequence
  ELANE RNA Guide
acagacgccggcgccugccg

SEQ ID NO: 21724 - RNA, 20 nt, Artificial Sequence
  ELANE RNA Guide
acgaaacagacgccggcgcc

SEQ ID NO: 21725 - RNA, 20 nt, Artificial Sequence
  ELANE RNA Guide
acucucgugaggggccggca

SEQ ID NO: 21726 - RNA, 20 nt, Artificial Sequence
  ELANE RNA Guide
aggcgccggcgucuguuucg

SEQ ID NO: 21727 - RNA, 20 nt, Artificial Sequence
  ELANE RNA Guide
caggcgccggcgucuguuuc

SEQ ID NO: 21728 - RNA, 20 nt, Artificial Sequence
  ELANE RNA Guide
cgaaacagacgccggcgccu

SEQ ID NO: 21729 - RNA, 20 nt, Artificial Sequence
  ELANE RNA Guide
cgccugccggccccucacga

SEQ ID NO: 21730 - RNA, 20 nt, Artificial Sequence
  ELANE RNA Guide
cggcaggcgccggcgucugu

SEQ ID NO: 21731 - RNA, 20 nt, Artificial Sequence
  ELANE RNA Guide
cucgugaggggccggcaggc

SEQ ID NO: 21732 - RNA, 20 nt, Artificial Sequence
  ELANE RNA Guide
cucucgugaggggccggcag

SEQ ID NO: 21733 - RNA, 20 nt, Artificial Sequence
  ELANE RNA Guide
gaaacagacgccggcgccug

SEQ ID NO: 21734 - RNA, 20 nt, Artificial Sequence
  ELANE RNA Guide
gcaggcgccggcgucuguuu

SEQ ID NO: 21735 - RNA, 20 nt, Artificial Sequence
  ELANE RNA Guide
ggcaggcgccggcgucuguu

SEQ ID NO: 21736 - RNA, 20 nt, Artificial Sequence
  ELANE RNA Guide
guacgaaacagacgccggcg

SEQ ID NO: 21737 - RNA, 20 nt, Artificial Sequence
  ELANE RNA Guide
uacgaaacagacgccggcgc

SEQ ID NO: 21738 - RNA, 20 nt, Artificial Sequence
  ELANE RNA Guide
ucgugaggggccggcaggcg

SEQ ID NO: 21739 - RNA, 20 nt, Artificial Sequence
  ELANE RNA Guide
ucucgugaggggccggcagg

SEQ ID NO: 21740 - RNA, 21 nt, Artificial Sequence
  ELANE RNA Guide
aaacagacgccggcgccugcc

SEQ ID NO: 21741 - RNA, 21 nt, Artificial Sequence
  ELANE RNA Guide
aacagacgccggcgccugccg

SEQ ID NO: 21742 - RNA, 21 nt, Artificial Sequence
  ELANE RNA Guide
acgaaacagacgccggcgccu

SEQ ID NO: 21743 - RNA, 21 nt, Artificial Sequence
  ELANE RNA Guide
acucucgugaggggccggcag

SEQ ID NO: 21744 - RNA, 21 nt, Artificial Sequence
  ELANE RNA Guide
aggcgccggcgucuguuucgu

SEQ ID NO: 21745 - RNA, 21 nt, Artificial Sequence
  ELANE RNA Guide
cacucucgugaggggccggca

SEQ ID NO: 21746 - RNA, 21 nt, Artificial Sequence
  ELANE RNA Guide
caggcgccggcgucuguuucg

SEQ ID NO: 21747 - RNA, 21 nt, Artificial Sequence
  ELANE RNA Guide
cgaaacagacgccggcgccug

SEQ ID NO: 21748 - RNA, 21 nt, Artificial Sequence
  ELANE RNA Guide
cggcaggcgccggcgucuguu

SEQ ID NO: 21749 - RNA, 21 nt, Artificial Sequence
  ELANE RNA Guide
cguacgaaacagacgccggcg

SEQ ID NO: 21750 - RNA, 21 nt, Artificial Sequence
  ELANE RNA Guide
cucucgugaggggccggcagg

SEQ ID NO: 21751 - RNA, 21 nt, Artificial Sequence
  ELANE RNA Guide
gaaacagacgccggcgccugc

SEQ ID NO: 21752 - RNA, 21 nt, Artificial Sequence
  ELANE RNA Guide
gcaggcgccggcgucuguuuc

SEQ ID NO: 21753 - RNA, 21 nt, Artificial Sequence
  ELANE RNA Guide
ggcaggcgccggcgucuguuu

SEQ ID NO: 21754 - RNA, 21 nt, Artificial Sequence
  ELANE RNA Guide
guacgaaacagacgccggcgc

SEQ ID NO: 21755 - RNA, 21 nt, Artificial Sequence
  ELANE RNA Guide
uacgaaacagacgccggcgcc

SEQ ID NO: 21756 - RNA, 21 nt, Artificial Sequence
  ELANE RNA Guide
ucucgugaggggccggcaggc

SEQ ID NO: 21757 - RNA, 22 nt, Artificial Sequence
  ELANE RNA Guide
aaacagacgccggcgccugccg

SEQ ID NO: 21758 - RNA, 22 nt, Artificial Sequence
  ELANE RNA Guide
aacagacgccggcgccugccgg

SEQ ID NO: 21759 - RNA, 22 nt, Artificial Sequence
  ELANE RNA Guide
acgaaacagacgccggcgccug

SEQ ID NO: 21760 - RNA, 22 nt, Artificial Sequence
  ELANE RNA Guide
acguacgaaacagacgccggcg

SEQ ID NO: 21761 - RNA, 22 nt, Artificial Sequence
  ELANE RNA Guide
acucucgugaggggccggcagg

SEQ ID NO: 21762 - RNA, 22 nt, Artificial Sequence
  ELANE RNA Guide
aggcgccggcgucuguuucgua

SEQ ID NO: 21763 - RNA, 22 nt, Artificial Sequence
  ELANE RNA Guide
cacucucgugaggggccggcag

SEQ ID NO: 21764 - RNA, 22 nt, Artificial Sequence
  ELANE RNA Guide
caggcgccggcgucuguuucgu

SEQ ID NO: 21765 - RNA, 22 nt, Artificial Sequence
  ELANE RNA Guide
ccggcaggcgccggcgucuguu

SEQ ID NO: 21766 - RNA, 22 nt, Artificial Sequence
  ELANE RNA Guide
cgaaacagacgccggcgccugc

SEQ ID NO: 21767 - RNA, 22 nt, Artificial Sequence
  ELANE RNA Guide
cgccugccggccccucacgaga

SEQ ID NO: 21768 - RNA, 22 nt, Artificial Sequence
  ELANE RNA Guide
cggcaggcgccggcgucuguuu

SEQ ID NO: 21769 - RNA, 22 nt, Artificial Sequence
  ELANE RNA Guide
cguacgaaacagacgccggcgc

SEQ ID NO: 21770 - RNA, 22 nt, Artificial Sequence
  ELANE RNA Guide
cucucgugaggggccggcaggc

SEQ ID NO: 21771 - RNA, 22 nt, Artificial Sequence
  ELANE RNA Guide
gaaacagacgccggcgccugcc

SEQ ID NO: 21772 - RNA, 22 nt, Artificial Sequence
  ELANE RNA Guide
gcacucucgugaggggccggca

SEQ ID NO: 21773 - RNA, 22 nt, Artificial Sequence
  ELANE RNA Guide
gcaggcgccggcgucuguuucg

SEQ ID NO: 21774 - RNA, 22 nt, Artificial Sequence
  ELANE RNA Guide
ggcaggcgccggcgucuguuuc

SEQ ID NO: 21775 - RNA, 22 nt, Artificial Sequence
  ELANE RNA Guide
guacgaaacagacgccggcgcc

SEQ ID NO: 21776 - RNA, 22 nt, Artificial Sequence
  ELANE RNA Guide
uacgaaacagacgccggcgccu

SEQ ID NO: 21777 - RNA, 22 nt, Artificial Sequence
  ELANE RNA Guide
ucucgugaggggccggcaggcg

SEQ ID NO: 21778 - RNA, 20 nt, Artificial Sequence
  ELANE RNA Guide
aaacagacgccgccugccgg

SEQ ID NO: 21779 - RNA, 20 nt, Artificial Sequence
  ELANE RNA Guide
aacagacgccgccugccggc

SEQ ID NO: 21780 - RNA, 20 nt, Artificial Sequence
  ELANE RNA Guide
acagacgccgccugccggcc

SEQ ID NO: 21781 - RNA, 20 nt, Artificial Sequence
  ELANE RNA Guide
acgaaacagacgccgccugc

SEQ ID NO: 21782 - RNA, 20 nt, Artificial Sequence
  ELANE RNA Guide
acguacgaaacagacgccgc

SEQ ID NO: 21783 - RNA, 20 nt, Artificial Sequence
  ELANE RNA Guide
aggcggcgucuguuucguac

SEQ ID NO: 21784 - RNA, 20 nt, Artificial Sequence
  ELANE RNA Guide
caggcggcgucuguuucgua

SEQ ID NO: 21785 - RNA, 20 nt, Artificial Sequence
  ELANE RNA Guide
ccggcaggcggcgucuguuu

SEQ ID NO: 21786 - RNA, 20 nt, Artificial Sequence
  ELANE RNA Guide
cgaaacagacgccgccugcc

SEQ ID NO: 21787 - RNA, 20 nt, Artificial Sequence
  ELANE RNA Guide
cggcaggcggcgucuguuuc

SEQ ID NO: 21788 - RNA, 20 nt, Artificial Sequence
  ELANE RNA Guide
cguacgaaacagacgccgcc

SEQ ID NO: 21789 - RNA, 20 nt, Artificial Sequence
  ELANE RNA Guide
gaaacagacgccgccugccg

SEQ ID NO: 21790 - RNA, 20 nt, Artificial Sequence
  ELANE RNA Guide
gcacguacgaaacagacgcc

SEQ ID NO: 21791 - RNA, 20 nt, Artificial Sequence
  ELANE RNA Guide
gcaggcggcgucuguuucgu

SEQ ID NO: 21792 - RNA, 20 nt, Artificial Sequence
  ELANE RNA Guide
gccggcaggcggcgucuguu

SEQ ID NO: 21793 - RNA, 20 nt, Artificial Sequence
  ELANE RNA Guide
ggcacguacgaaacagacgc

SEQ ID NO: 21794 - RNA, 20 nt, Artificial Sequence
  ELANE RNA Guide
ggcaggcggcgucuguuucg

SEQ ID NO: 21795 - RNA, 20 nt, Artificial Sequence
  ELANE RNA Guide
ggccggcaggcggcgucugu

SEQ ID NO: 21796 - RNA, 20 nt, Artificial Sequence
  ELANE RNA Guide
ggcggcgucuguuucguacg

SEQ ID NO: 21797 - RNA, 20 nt, Artificial Sequence
  ELANE RNA Guide
gggcacguacgaaacagacg

SEQ ID NO: 21798 - RNA, 20 nt, Artificial Sequence
  ELANE RNA Guide
guacgaaacagacgccgccu

SEQ ID NO: 21799 - RNA, 20 nt, Artificial Sequence
  ELANE RNA Guide
uacgaaacagacgccgccug

SEQ ID NO: 21800 - RNA, 21 nt, Artificial Sequence
  ELANE RNA Guide
aaacagacgccgccugccggc

SEQ ID NO: 21801 - RNA, 21 nt, Artificial Sequence
  ELANE RNA Guide
aacagacgccgccugccggcc

SEQ ID NO: 21802 - RNA, 21 nt, Artificial Sequence
  ELANE RNA Guide
acgaaacagacgccgccugcc

SEQ ID NO: 21803 - RNA, 21 nt, Artificial Sequence
  ELANE RNA Guide
acguacgaaacagacgccgcc

SEQ ID NO: 21804 - RNA, 21 nt, Artificial Sequence
  ELANE RNA Guide
aggcggcgucuguuucguacg

SEQ ID NO: 21805 - RNA, 21 nt, Artificial Sequence
  ELANE RNA Guide
agggcacguacgaaacagacg

SEQ ID NO: 21806 - RNA, 21 nt, Artificial Sequence
  ELANE RNA Guide
cacguacgaaacagacgccgc

SEQ ID NO: 21807 - RNA, 21 nt, Artificial Sequence
  ELANE RNA Guide
caggcggcgucuguuucguac

SEQ ID NO: 21808 - RNA, 21 nt, Artificial Sequence
  ELANE RNA Guide
ccggcaggcggcgucuguuuc

SEQ ID NO: 21809 - RNA, 21 nt, Artificial Sequence
  ELANE RNA Guide
cgaaacagacgccgccugccg

SEQ ID NO: 21810 - RNA, 21 nt, Artificial Sequence
  ELANE RNA Guide
cggcaggcggcgucuguuucg

SEQ ID NO: 21811 - RNA, 21 nt, Artificial Sequence
  ELANE RNA Guide
cguacgaaacagacgccgccu

SEQ ID NO: 21812 - RNA, 21 nt, Artificial Sequence
  ELANE RNA Guide
gaaacagacgccgccugccgg

SEQ ID NO: 21813 - RNA, 21 nt, Artificial Sequence
  ELANE RNA Guide
gcaggcggcgucuguuucgua

SEQ ID NO: 21814 - RNA, 21 nt, Artificial Sequence
  ELANE RNA Guide
gccggcaggcggcgucuguuu

SEQ ID NO: 21815 - RNA, 21 nt, Artificial Sequence
  ELANE RNA Guide
ggcacguacgaaacagacgcc

SEQ ID NO: 21816 - RNA, 21 nt, Artificial Sequence
  ELANE RNA Guide
ggcaggcggcgucuguuucgu

SEQ ID NO: 21817 - RNA, 21 nt, Artificial Sequence
  ELANE RNA Guide
ggccggcaggcggcgucuguu

SEQ ID NO: 21818 - RNA, 21 nt, Artificial Sequence
  ELANE RNA Guide
ggcggcgucuguuucguacgu

SEQ ID NO: 21819 - RNA, 21 nt, Artificial Sequence
  ELANE RNA Guide
gggcacguacgaaacagacgc

SEQ ID NO: 21820 - RNA, 21 nt, Artificial Sequence
  ELANE RNA Guide
guacgaaacagacgccgccug

SEQ ID NO: 21821 - RNA, 21 nt, Artificial Sequence
  ELANE RNA Guide
uacgaaacagacgccgccugc

SEQ ID NO: 21822 - RNA, 22 nt, Artificial Sequence
  ELANE RNA Guide
aaacagacgccgccugccggcc

SEQ ID NO: 21823 - RNA, 22 nt, Artificial Sequence
  ELANE RNA Guide
aacagacgccgccugccggccc

SEQ ID NO: 21824 - RNA, 22 nt, Artificial Sequence
  ELANE RNA Guide
acgaaacagacgccgccugccg

SEQ ID NO: 21825 - RNA, 22 nt, Artificial Sequence
  ELANE RNA Guide
acguacgaaacagacgccgccu

SEQ ID NO: 21826 - RNA, 22 nt, Artificial Sequence
  ELANE RNA Guide
aggcggcgucuguuucguacgu

SEQ ID NO: 21827 - RNA, 22 nt, Artificial Sequence
  ELANE RNA Guide
agggcacguacgaaacagacgc

SEQ ID NO: 21828 - RNA, 22 nt, Artificial Sequence
  ELANE RNA Guide
cacguacgaaacagacgccgcc

SEQ ID NO: 21829 - RNA, 22 nt, Artificial Sequence
  ELANE RNA Guide
caggcggcgucuguuucguacg

SEQ ID NO: 21830 - RNA, 22 nt, Artificial Sequence
  ELANE RNA Guide
cagggcacguacgaaacagacg

SEQ ID NO: 21831 - RNA, 22 nt, Artificial Sequence
  ELANE RNA Guide
ccggcaggcggcgucuguuucg

SEQ ID NO: 21832 - RNA, 22 nt, Artificial Sequence
  ELANE RNA Guide
cgaaacagacgccgccugccgg

SEQ ID NO: 21833 - RNA, 22 nt, Artificial Sequence
  ELANE RNA Guide
cggcaggcggcgucuguuucgu

SEQ ID NO: 21834 - RNA, 22 nt, Artificial Sequence
  ELANE RNA Guide
cguacgaaacagacgccgccug

SEQ ID NO: 21835 - RNA, 22 nt, Artificial Sequence
  ELANE RNA Guide
gaaacagacgccgccugccggc

SEQ ID NO: 21836 - RNA, 22 nt, Artificial Sequence
  ELANE RNA Guide
gcacguacgaaacagacgccgc

SEQ ID NO: 21837 - RNA, 22 nt, Artificial Sequence
  ELANE RNA Guide
gcaggcggcgucuguuucguac

SEQ ID NO: 21838 - RNA, 22 nt, Artificial Sequence
  ELANE RNA Guide
gccggcaggcggcgucuguuuc

SEQ ID NO: 21839 - RNA, 22 nt, Artificial Sequence
  ELANE RNA Guide
ggcaggcggcgucuguuucgua

SEQ ID NO: 21840 - RNA, 22 nt, Artificial Sequence
  ELANE RNA Guide
ggccggcaggcggcgucuguuu

SEQ ID NO: 21841 - RNA, 22 nt, Artificial Sequence
  ELANE RNA Guide
ggcggcgucuguuucguacgug

SEQ ID NO: 21842 - RNA, 22 nt, Artificial Sequence
  ELANE RNA Guide
gggcacguacgaaacagacgcc

SEQ ID NO: 21843 - RNA, 22 nt, Artificial Sequence
  ELANE RNA Guide
gggccggcaggcggcgucuguu

SEQ ID NO: 21844 - RNA, 22 nt, Artificial Sequence
  ELANE RNA Guide
guacgaaacagacgccgccugc

SEQ ID NO: 21845 - RNA, 22 nt, Artificial Sequence
  ELANE RNA Guide
uacgaaacagacgccgccugcc

SEQ ID NO: 21846 - RNA, 20 nt, Artificial Sequence
  ELANE RNA Guide
aaacagacgcgccggccugc

SEQ ID NO: 21847 - RNA, 20 nt, Artificial Sequence
  ELANE RNA Guide
aacagacgcgccggccugcc

SEQ ID NO: 21848 - RNA, 20 nt, Artificial Sequence
  ELANE RNA Guide
acagacgcgccggccugccg

SEQ ID NO: 21849 - RNA, 20 nt, Artificial Sequence
  ELANE RNA Guide
acgaaacagacgcgccggcc

SEQ ID NO: 21850 - RNA, 20 nt, Artificial Sequence
  ELANE RNA Guide
acguacgaaacagacgcgcc

SEQ ID NO: 21851 - RNA, 20 nt, Artificial Sequence
  ELANE RNA Guide
aggccggcgcgucuguuucg

SEQ ID NO: 21852 - RNA, 20 nt, Artificial Sequence
  ELANE RNA Guide
cacguacgaaacagacgcgc

SEQ ID NO: 21853 - RNA, 20 nt, Artificial Sequence
  ELANE RNA Guide
caggccggcgcgucuguuuc

SEQ ID NO: 21854 - RNA, 20 nt, Artificial Sequence
  ELANE RNA Guide
ccggcgcgucuguuucguac

SEQ ID NO: 21855 - RNA, 20 nt, Artificial Sequence
  ELANE RNA Guide
cgaaacagacgcgccggccu

SEQ ID NO: 21856 - RNA, 20 nt, Artificial Sequence
  ELANE RNA Guide
cggcaggccggcgcgucugu

SEQ ID NO: 21857 - RNA, 20 nt, Artificial Sequence
  ELANE RNA Guide
cggcgcgucuguuucguacg

SEQ ID NO: 21858 - RNA, 20 nt, Artificial Sequence
  ELANE RNA Guide
cguacgaaacagacgcgccg

SEQ ID NO: 21859 - RNA, 20 nt, Artificial Sequence
  ELANE RNA Guide
gaaacagacgcgccggccug

SEQ ID NO: 21860 - RNA, 20 nt, Artificial Sequence
  ELANE RNA Guide
gcacguacgaaacagacgcg

SEQ ID NO: 21861 - RNA, 20 nt, Artificial Sequence
  ELANE RNA Guide
gcaggccggcgcgucuguuu

SEQ ID NO: 21862 - RNA, 20 nt, Artificial Sequence
  ELANE RNA Guide
gccggcgcgucuguuucgua

SEQ ID NO: 21863 - RNA, 20 nt, Artificial Sequence
  ELANE RNA Guide
ggcaggccggcgcgucuguu

SEQ ID NO: 21864 - RNA, 20 nt, Artificial Sequence
  ELANE RNA Guide
ggccggcgcgucuguuucgu

SEQ ID NO: 21865 - RNA, 20 nt, Artificial Sequence
  ELANE RNA Guide
guacgaaacagacgcgccgg

SEQ ID NO: 21866 - RNA, 20 nt, Artificial Sequence
  ELANE RNA Guide
uacgaaacagacgcgccggc

SEQ ID NO: 21867 - RNA, 21 nt, Artificial Sequence
  ELANE RNA Guide
aaacagacgcgccggccugcc

SEQ ID NO: 21868 - RNA, 21 nt, Artificial Sequence
  ELANE RNA Guide
aacagacgcgccggccugccg

SEQ ID NO: 21869 - RNA, 21 nt, Artificial Sequence
  ELANE RNA Guide
acgaaacagacgcgccggccu

SEQ ID NO: 21870 - RNA, 21 nt, Artificial Sequence
  ELANE RNA Guide
acguacgaaacagacgcgccg

SEQ ID NO: 21871 - RNA, 21 nt, Artificial Sequence
  ELANE RNA Guide
aggccggcgcgucuguuucgu

SEQ ID NO: 21872 - RNA, 21 nt, Artificial Sequence
  ELANE RNA Guide
cacguacgaaacagacgcgcc

SEQ ID NO: 21873 - RNA, 21 nt, Artificial Sequence
  ELANE RNA Guide
caggccggcgcgucuguuucg

SEQ ID NO: 21874 - RNA, 21 nt, Artificial Sequence
  ELANE RNA Guide
ccggcgcgucuguuucguacg

SEQ ID NO: 21875 - RNA, 21 nt, Artificial Sequence
  ELANE RNA Guide
cgaaacagacgcgccggccug

SEQ ID NO: 21876 - RNA, 21 nt, Artificial Sequence
  ELANE RNA Guide
cggcaggccggcgcgucuguu

SEQ ID NO: 21877 - RNA, 21 nt, Artificial Sequence
  ELANE RNA Guide
cggcgcgucuguuucguacgu

SEQ ID NO: 21878 - RNA, 21 nt, Artificial Sequence
  ELANE RNA Guide
cguacgaaacagacgcgccgg

SEQ ID NO: 21879 - RNA, 21 nt, Artificial Sequence
  ELANE RNA Guide
gaaacagacgcgccggccugc

SEQ ID NO: 21880 - RNA, 21 nt, Artificial Sequence
  ELANE RNA Guide
gcacguacgaaacagacgcgc

SEQ ID NO: 21881 - RNA, 21 nt, Artificial Sequence
  ELANE RNA Guide
gcaggccggcgcgucuguuuc

SEQ ID NO: 21882 - RNA, 21 nt, Artificial Sequence
  ELANE RNA Guide
gccggcgcgucuguuucguac

SEQ ID NO: 21883 - RNA, 21 nt, Artificial Sequence
  ELANE RNA Guide
ggcacguacgaaacagacgcg

SEQ ID NO: 21884 - RNA, 21 nt, Artificial Sequence
  ELANE RNA Guide
ggcaggccggcgcgucuguuu

SEQ ID NO: 21885 - RNA, 21 nt, Artificial Sequence
  ELANE RNA Guide
ggccggcgcgucuguuucgua

SEQ ID NO: 21886 - RNA, 21 nt, Artificial Sequence
  ELANE RNA Guide
guacgaaacagacgcgccggc

SEQ ID NO: 21887 - RNA, 21 nt, Artificial Sequence
  ELANE RNA Guide
uacgaaacagacgcgccggcc

SEQ ID NO: 21888 - RNA, 22 nt, Artificial Sequence
  ELANE RNA Guide
aaacagacgcgccggccugccg

SEQ ID NO: 21889 - RNA, 22 nt, Artificial Sequence
  ELANE RNA Guide
aacagacgcgccggccugccgg

SEQ ID NO: 21890 - RNA, 22 nt, Artificial Sequence
  ELANE RNA Guide
acgaaacagacgcgccggccug

SEQ ID NO: 21891 - RNA, 22 nt, Artificial Sequence
  ELANE RNA Guide
acguacgaaacagacgcgccgg

SEQ ID NO: 21892 - RNA, 22 nt, Artificial Sequence
  ELANE RNA Guide
aggccggcgcgucuguuucgua

SEQ ID NO: 21893 - RNA, 22 nt, Artificial Sequence
  ELANE RNA Guide
cacguacgaaacagacgcgccg

SEQ ID NO: 21894 - RNA, 22 nt, Artificial Sequence
  ELANE RNA Guide
caggccggcgcgucuguuucgu

SEQ ID NO: 21895 - RNA, 22 nt, Artificial Sequence
  ELANE RNA Guide
ccggcaggccggcgcgucuguu

SEQ ID NO: 21896 - RNA, 22 nt, Artificial Sequence
  ELANE RNA Guide
ccggcgcgucuguuucguacgu

SEQ ID NO: 21897 - RNA, 22 nt, Artificial Sequence
  ELANE RNA Guide
cgaaacagacgcgccggccugc

SEQ ID NO: 21898 - RNA, 22 nt, Artificial Sequence
  ELANE RNA Guide
cggcaggccggcgcgucuguuu

SEQ ID NO: 21899 - RNA, 22 nt, Artificial Sequence
  ELANE RNA Guide
cggcgcgucuguuucguacgug

SEQ ID NO: 21900 - RNA, 22 nt, Artificial Sequence
  ELANE RNA Guide
cguacgaaacagacgcgccggc

SEQ ID NO: 21901 - RNA, 22 nt, Artificial Sequence
  ELANE RNA Guide
gaaacagacgcgccggccugcc

SEQ ID NO: 21902 - RNA, 22 nt, Artificial Sequence
  ELANE RNA Guide
gcacguacgaaacagacgcgcc

SEQ ID NO: 21903 - RNA, 22 nt, Artificial Sequence
  ELANE RNA Guide
gcaggccggcgcgucuguuucg

SEQ ID NO: 21904 - RNA, 22 nt, Artificial Sequence
  ELANE RNA Guide
gccggcgcgucuguuucguacg

SEQ ID NO: 21905 - RNA, 22 nt, Artificial Sequence
  ELANE RNA Guide
ggcacguacgaaacagacgcgc

SEQ ID NO: 21906 - RNA, 22 nt, Artificial Sequence
  ELANE RNA Guide
ggcaggccggcgcgucuguuuc

SEQ ID NO: 21907 - RNA, 22 nt, Artificial Sequence
  ELANE RNA Guide
ggccggcgcgucuguuucguac

SEQ ID NO: 21908 - RNA, 22 nt, Artificial Sequence
  ELANE RNA Guide
gggcacguacgaaacagacgcg

SEQ ID NO: 21909 - RNA, 22 nt, Artificial Sequence
  ELANE RNA Guide
guacgaaacagacgcgccggcc

SEQ ID NO: 21910 - RNA, 22 nt, Artificial Sequence
  ELANE RNA Guide
uacgaaacagacgcgccggccu

SEQ ID NO: 21911 - RNA, 20 nt, Artificial Sequence
  ELANE RNA Guide
aaacagacaaacagacgccg

SEQ ID NO: 21912 - RNA, 20 nt, Artificial Sequence
  ELANE RNA Guide
aacagacaaacagacgccgg

SEQ ID NO: 21913 - RNA, 20 nt, Artificial Sequence
  ELANE RNA Guide
acaaacagacgccggccugc

SEQ ID NO: 21914 - RNA, 20 nt, Artificial Sequence
  ELANE RNA Guide
acagacaaacagacgccggc

SEQ ID NO: 21915 - RNA, 20 nt, Artificial Sequence
  ELANE RNA Guide
acgaaacagacaaacagacg

SEQ ID NO: 21916 - RNA, 20 nt, Artificial Sequence
  ELANE RNA Guide
acguacgaaacagacaaaca

SEQ ID NO: 21917 - RNA, 20 nt, Artificial Sequence
  ELANE RNA Guide
agacaaacagacgccggccu

SEQ ID NO: 21918 - RNA, 20 nt, Artificial Sequence
  ELANE RNA Guide
aggccggcgucuguuugucu

SEQ ID NO: 21919 - RNA, 20 nt, Artificial Sequence
  ELANE RNA Guide
caaacagacgccggccugcc

SEQ ID NO: 21920 - RNA, 20 nt, Artificial Sequence
  ELANE RNA Guide
cagacaaacagacgccggcc

SEQ ID NO: 21921 - RNA, 20 nt, Artificial Sequence
  ELANE RNA Guide
caggccggcgucuguuuguc

SEQ ID NO: 21922 - RNA, 20 nt, Artificial Sequence
  ELANE RNA Guide
ccggcaggccggcgucuguu

SEQ ID NO: 21923 - RNA, 20 nt, Artificial Sequence
  ELANE RNA Guide
ccggcgucuguuugucuguu

SEQ ID NO: 21924 - RNA, 20 nt, Artificial Sequence
  ELANE RNA Guide
cgaaacagacaaacagacgc

SEQ ID NO: 21925 - RNA, 20 nt, Artificial Sequence
  ELANE RNA Guide
cggcaggccggcgucuguuu

SEQ ID NO: 21926 - RNA, 20 nt, Artificial Sequence
  ELANE RNA Guide
cggcgucuguuugucuguuu

SEQ ID NO: 21927 - RNA, 20 nt, Artificial Sequence
  ELANE RNA Guide
cguacgaaacagacaaacag

SEQ ID NO: 21928 - RNA, 20 nt, Artificial Sequence
  ELANE RNA Guide
gaaacagacaaacagacgcc

SEQ ID NO: 21929 - RNA, 20 nt, Artificial Sequence
  ELANE RNA Guide
gacaaacagacgccggccug

SEQ ID NO: 21930 - RNA, 20 nt, Artificial Sequence
  ELANE RNA Guide
gcaggccggcgucuguuugu

SEQ ID NO: 21931 - RNA, 20 nt, Artificial Sequence
  ELANE RNA Guide
gccggcaggccggcgucugu

SEQ ID NO: 21932 - RNA, 20 nt, Artificial Sequence
  ELANE RNA Guide
gccggcgucuguuugucugu

SEQ ID NO: 21933 - RNA, 20 nt, Artificial Sequence
  ELANE RNA Guide
gcgucuguuugucuguuucg

SEQ ID NO: 21934 - RNA, 20 nt, Artificial Sequence
  ELANE RNA Guide
ggcaggccggcgucuguuug

SEQ ID NO: 21935 - RNA, 20 nt, Artificial Sequence
  ELANE RNA Guide
ggccggcgucuguuugucug

SEQ ID NO: 21936 - RNA, 20 nt, Artificial Sequence
  ELANE RNA Guide
ggcgucuguuugucuguuuc

SEQ ID NO: 21937 - RNA, 20 nt, Artificial Sequence
  ELANE RNA Guide
guacgaaacagacaaacaga

SEQ ID NO: 21938 - RNA, 20 nt, Artificial Sequence
  ELANE RNA Guide
uacgaaacagacaaacagac

SEQ ID NO: 21939 - RNA, 21 nt, Artificial Sequence
  ELANE RNA Guide
aaacagacaaacagacgccgg

SEQ ID NO: 21940 - RNA, 21 nt, Artificial Sequence
  ELANE RNA Guide
aacagacaaacagacgccggc

SEQ ID NO: 21941 - RNA, 21 nt, Artificial Sequence
  ELANE RNA Guide
acaaacagacgccggccugcc

SEQ ID NO: 21942 - RNA, 21 nt, Artificial Sequence
  ELANE RNA Guide
acagacaaacagacgccggcc

SEQ ID NO: 21943 - RNA, 21 nt, Artificial Sequence
  ELANE RNA Guide
acgaaacagacaaacagacgc

SEQ ID NO: 21944 - RNA, 21 nt, Artificial Sequence
  ELANE RNA Guide
acguacgaaacagacaaacag

SEQ ID NO: 21945 - RNA, 21 nt, Artificial Sequence
  ELANE RNA Guide
agacaaacagacgccggccug

SEQ ID NO: 21946 - RNA, 21 nt, Artificial Sequence
  ELANE RNA Guide
aggccggcgucuguuugucug

SEQ ID NO: 21947 - RNA, 21 nt, Artificial Sequence
  ELANE RNA Guide
caaacagacgccggccugccg

SEQ ID NO: 21948 - RNA, 21 nt, Artificial Sequence
  ELANE RNA Guide
cacguacgaaacagacaaaca

SEQ ID NO: 21949 - RNA, 21 nt, Artificial Sequence
  ELANE RNA Guide
cagacaaacagacgccggccu

SEQ ID NO: 21950 - RNA, 21 nt, Artificial Sequence
  ELANE RNA Guide
caggccggcgucuguuugucu

SEQ ID NO: 21951 - RNA, 21 nt, Artificial Sequence
  ELANE RNA Guide
ccggcaggccggcgucuguuu

SEQ ID NO: 21952 - RNA, 21 nt, Artificial Sequence
  ELANE RNA Guide
ccggcgucuguuugucuguuu

SEQ ID NO: 21953 - RNA, 21 nt, Artificial Sequence
  ELANE RNA Guide
cgaaacagacaaacagacgcc

SEQ ID NO: 21954 - RNA, 21 nt, Artificial Sequence
  ELANE RNA Guide
cggcaggccggcgucuguuug

SEQ ID NO: 21955 - RNA, 21 nt, Artificial Sequence
  ELANE RNA Guide
cggcgucuguuugucuguuuc

SEQ ID NO: 21956 - RNA, 21 nt, Artificial Sequence
  ELANE RNA Guide
cguacgaaacagacaaacaga

SEQ ID NO: 21957 - RNA, 21 nt, Artificial Sequence
  ELANE RNA Guide
gaaacagacaaacagacgccg

SEQ ID NO: 21958 - RNA, 21 nt, Artificial Sequence
  ELANE RNA Guide
gacaaacagacgccggccugc

SEQ ID NO: 21959 - RNA, 21 nt, Artificial Sequence
  ELANE RNA Guide
gcaggccggcgucuguuuguc

SEQ ID NO: 21960 - RNA, 21 nt, Artificial Sequence
  ELANE RNA Guide
gccggcaggccggcgucuguu

SEQ ID NO: 21961 - RNA, 21 nt, Artificial Sequence
  ELANE RNA Guide
gccggcgucuguuugucuguu

SEQ ID NO: 21962 - RNA, 21 nt, Artificial Sequence
  ELANE RNA Guide
gcgucuguuugucuguuucgu

SEQ ID NO: 21963 - RNA, 21 nt, Artificial Sequence
  ELANE RNA Guide
ggcaggccggcgucuguuugu

SEQ ID NO: 21964 - RNA, 21 nt, Artificial Sequence
  ELANE RNA Guide
ggccggcgucuguuugucugu

SEQ ID NO: 21965 - RNA, 21 nt, Artificial Sequence
  ELANE RNA Guide
ggcgucuguuugucuguuucg

SEQ ID NO: 21966 - RNA, 21 nt, Artificial Sequence
  ELANE RNA Guide
guacgaaacagacaaacagac

SEQ ID NO: 21967 - RNA, 21 nt, Artificial Sequence
  ELANE RNA Guide
uacgaaacagacaaacagacg

SEQ ID NO: 21968 - RNA, 22 nt, Artificial Sequence
  ELANE RNA Guide
aaacagacaaacagacgccggc

SEQ ID NO: 21969 - RNA, 22 nt, Artificial Sequence
  ELANE RNA Guide
aacagacaaacagacgccggcc

SEQ ID NO: 21970 - RNA, 22 nt, Artificial Sequence
  ELANE RNA Guide
acaaacagacgccggccugccg

SEQ ID NO: 21971 - RNA, 22 nt, Artificial Sequence
  ELANE RNA Guide
acagacaaacagacgccggccu

SEQ ID NO: 21972 - RNA, 22 nt, Artificial Sequence
  ELANE RNA Guide
acgaaacagacaaacagacgcc

SEQ ID NO: 21973 - RNA, 22 nt, Artificial Sequence
  ELANE RNA Guide
acguacgaaacagacaaacaga

SEQ ID NO: 21974 - RNA, 22 nt, Artificial Sequence
  ELANE RNA Guide
agacaaacagacgccggccugc

SEQ ID NO: 21975 - RNA, 22 nt, Artificial Sequence
  ELANE RNA Guide
aggccggcgucuguuugucugu

SEQ ID NO: 21976 - RNA, 22 nt, Artificial Sequence
  ELANE RNA Guide
caaacagacgccggccugccgg

SEQ ID NO: 21977 - RNA, 22 nt, Artificial Sequence
  ELANE RNA Guide
cacguacgaaacagacaaacag

SEQ ID NO: 21978 - RNA, 22 nt, Artificial Sequence
  ELANE RNA Guide
cagacaaacagacgccggccug

SEQ ID NO: 21979 - RNA, 22 nt, Artificial Sequence
  ELANE RNA Guide
caggccggcgucuguuugucug

SEQ ID NO: 21980 - RNA, 22 nt, Artificial Sequence
  ELANE RNA Guide
ccggcaggccggcgucuguuug

SEQ ID NO: 21981 - RNA, 22 nt, Artificial Sequence
  ELANE RNA Guide
ccggcgucuguuugucuguuuc

SEQ ID NO: 21982 - RNA, 22 nt, Artificial Sequence
  ELANE RNA Guide
cgaaacagacaaacagacgccg

SEQ ID NO: 21983 - RNA, 22 nt, Artificial Sequence
  ELANE RNA Guide
cggcaggccggcgucuguuugu

SEQ ID NO: 21984 - RNA, 22 nt, Artificial Sequence
  ELANE RNA Guide
cggcgucuguuugucuguuucg

SEQ ID NO: 21985 - RNA, 22 nt, Artificial Sequence
  ELANE RNA Guide
cguacgaaacagacaaacagac

SEQ ID NO: 21986 - RNA, 22 nt, Artificial Sequence
  ELANE RNA Guide
gaaacagacaaacagacgccgg

SEQ ID NO: 21987 - RNA, 22 nt, Artificial Sequence
  ELANE RNA Guide
gacaaacagacgccggccugcc

SEQ ID NO: 21988 - RNA, 22 nt, Artificial Sequence
  ELANE RNA Guide
gcacguacgaaacagacaaaca

SEQ ID NO: 21989 - RNA, 22 nt, Artificial Sequence
  ELANE RNA Guide
gcaggccggcgucuguuugucu

SEQ ID NO: 21990 - RNA, 22 nt, Artificial Sequence
  ELANE RNA Guide
gccggcaggccggcgucuguuu

SEQ ID NO: 21991 - RNA, 22 nt, Artificial Sequence
  ELANE RNA Guide
gccggcgucuguuugucuguuu

SEQ ID NO: 21992 - RNA, 22 nt, Artificial Sequence
  ELANE RNA Guide
gcgucuguuugucuguuucgua

SEQ ID NO: 21993 - RNA, 22 nt, Artificial Sequence
  ELANE RNA Guide
ggcaggccggcgucuguuuguc

SEQ ID NO: 21994 - RNA, 22 nt, Artificial Sequence
  ELANE RNA Guide
ggccggcaggccggcgucuguu

SEQ ID NO: 21995 - RNA, 22 nt, Artificial Sequence
  ELANE RNA Guide
ggccggcgucuguuugucuguu

SEQ ID NO: 21996 - RNA, 22 nt, Artificial Sequence
  ELANE RNA Guide
ggcgucuguuugucuguuucgu

SEQ ID NO: 21997 - RNA, 22 nt, Artificial Sequence
  ELANE RNA Guide
guacgaaacagacaaacagacg

SEQ ID NO: 21998 - RNA, 22 nt, Artificial Sequence
  ELANE RNA Guide
uacgaaacagacaaacagacgc

SEQ ID NO: 21999 - RNA, 20 nt, Artificial Sequence
  ELANE RNA Guide
aaacagaugccggccugccg

SEQ ID NO: 22000 - RNA, 20 nt, Artificial Sequence
  ELANE RNA Guide
aacagaugccggccugccgg

SEQ ID NO: 22001 - RNA, 20 nt, Artificial Sequence
  ELANE RNA Guide
acagaugccggccugccggc

SEQ ID NO: 22002 - RNA, 20 nt, Artificial Sequence
  ELANE RNA Guide
acccagggcacguacgaaac

SEQ ID NO: 22003 - RNA, 20 nt, Artificial Sequence
  ELANE RNA Guide
acgaaacagaugccggccug

SEQ ID NO: 22004 - RNA, 20 nt, Artificial Sequence
  ELANE RNA Guide
acguacgaaacagaugccgg

SEQ ID NO: 22005 - RNA, 20 nt, Artificial Sequence
  ELANE RNA Guide
agaugccggccugccggccc

SEQ ID NO: 22006 - RNA, 20 nt, Artificial Sequence
  ELANE RNA Guide
aggccggcaucuguuucgua

SEQ ID NO: 22007 - RNA, 20 nt, Artificial Sequence
  ELANE RNA Guide
agggcacguacgaaacagau

SEQ ID NO: 22008 - RNA, 20 nt, Artificial Sequence
  ELANE RNA Guide
aggggccggcaggccggcau

SEQ ID NO: 22009 - RNA, 20 nt, Artificial Sequence
  ELANE RNA Guide
augccggccugccggccccu

SEQ ID NO: 22010 - RNA, 20 nt, Artificial Sequence
  ELANE RNA Guide
cacguacgaaacagaugccg

SEQ ID NO: 22011 - RNA, 20 nt, Artificial Sequence
  ELANE RNA Guide
cagaugccggccugccggcc

SEQ ID NO: 22012 - RNA, 20 nt, Artificial Sequence
  ELANE RNA Guide
caggccggcaucuguuucgu

SEQ ID NO: 22013 - RNA, 20 nt, Artificial Sequence
  ELANE RNA Guide
cagggcacguacgaaacaga

SEQ ID NO: 22014 - RNA, 20 nt, Artificial Sequence
  ELANE RNA Guide
caucuguuucguacgugccc

SEQ ID NO: 22015 - RNA, 20 nt, Artificial Sequence
  ELANE RNA Guide
ccagggcacguacgaaacag

SEQ ID NO: 22016 - RNA, 20 nt, Artificial Sequence
  ELANE RNA Guide
cccagggcacguacgaaaca

SEQ ID NO: 22017 - RNA, 20 nt, Artificial Sequence
  ELANE RNA Guide
ccggcaggccggcaucuguu

SEQ ID NO: 22018 - RNA, 20 nt, Artificial Sequence
  ELANE RNA Guide
ccggcaucuguuucguacgu

SEQ ID NO: 22019 - RNA, 20 nt, Artificial Sequence
  ELANE RNA Guide
cgaaacagaugccggccugc

SEQ ID NO: 22020 - RNA, 20 nt, Artificial Sequence
  ELANE RNA Guide
cggcaggccggcaucuguuu

SEQ ID NO: 22021 - RNA, 20 nt, Artificial Sequence
  ELANE RNA Guide
cggcaucuguuucguacgug

SEQ ID NO: 22022 - RNA, 20 nt, Artificial Sequence
  ELANE RNA Guide
cguacgaaacagaugccggc

SEQ ID NO: 22023 - RNA, 20 nt, Artificial Sequence
  ELANE RNA Guide
gaaacagaugccggccugcc

SEQ ID NO: 22024 - RNA, 20 nt, Artificial Sequence
  ELANE RNA Guide
gcacguacgaaacagaugcc

SEQ ID NO: 22025 - RNA, 20 nt, Artificial Sequence
  ELANE RNA Guide
gcaggccggcaucuguuucg

SEQ ID NO: 22026 - RNA, 20 nt, Artificial Sequence
  ELANE RNA Guide
gcaucuguuucguacgugcc

SEQ ID NO: 22027 - RNA, 20 nt, Artificial Sequence
  ELANE RNA Guide
gccggcaggccggcaucugu

SEQ ID NO: 22028 - RNA, 20 nt, Artificial Sequence
  ELANE RNA Guide
gccggcaucuguuucguacg

SEQ ID NO: 22029 - RNA, 20 nt, Artificial Sequence
  ELANE RNA Guide
ggcacguacgaaacagaugc

SEQ ID NO: 22030 - RNA, 20 nt, Artificial Sequence
  ELANE RNA Guide
ggcaggccggcaucuguuuc

SEQ ID NO: 22031 - RNA, 20 nt, Artificial Sequence
  ELANE RNA Guide
ggcaucuguuucguacgugc

SEQ ID NO: 22032 - RNA, 20 nt, Artificial Sequence
  ELANE RNA Guide
ggccggcaggccggcaucug

SEQ ID NO: 22033 - RNA, 20 nt, Artificial Sequence
  ELANE RNA Guide
ggccggcaucuguuucguac

SEQ ID NO: 22034 - RNA, 20 nt, Artificial Sequence
  ELANE RNA Guide
gggcacguacgaaacagaug

SEQ ID NO: 22035 - RNA, 20 nt, Artificial Sequence
  ELANE RNA Guide
gggccggcaggccggcaucu

SEQ ID NO: 22036 - RNA, 20 nt, Artificial Sequence
  ELANE RNA Guide
guacgaaacagaugccggcc

SEQ ID NO: 22037 - RNA, 20 nt, Artificial Sequence
  ELANE RNA Guide
uacgaaacagaugccggccu

SEQ ID NO: 22038 - RNA, 20 nt, Artificial Sequence
  ELANE RNA Guide
ucgugaggggccggcaggcc

SEQ ID NO: 22039 - RNA, 21 nt, Artificial Sequence
  ELANE RNA Guide
aaacagaugccggccugccgg

SEQ ID NO: 22040 - RNA, 21 nt, Artificial Sequence
  ELANE RNA Guide
aacagaugccggccugccggc

SEQ ID NO: 22041 - RNA, 21 nt, Artificial Sequence
  ELANE RNA Guide
acagaugccggccugccggcc

SEQ ID NO: 22042 - RNA, 21 nt, Artificial Sequence
  ELANE RNA Guide
acccagggcacguacgaaaca

SEQ ID NO: 22043 - RNA, 21 nt, Artificial Sequence
  ELANE RNA Guide
acgaaacagaugccggccugc

SEQ ID NO: 22044 - RNA, 21 nt, Artificial Sequence
  ELANE RNA Guide
acguacgaaacagaugccggc

SEQ ID NO: 22045 - RNA, 21 nt, Artificial Sequence
  ELANE RNA Guide
aggccggcaucuguuucguac

SEQ ID NO: 22046 - RNA, 21 nt, Artificial Sequence
  ELANE RNA Guide
agggcacguacgaaacagaug

SEQ ID NO: 22047 - RNA, 21 nt, Artificial Sequence
  ELANE RNA Guide
cacccagggcacguacgaaac

SEQ ID NO: 22048 - RNA, 21 nt, Artificial Sequence
  ELANE RNA Guide
cacguacgaaacagaugccgg

SEQ ID NO: 22049 - RNA, 21 nt, Artificial Sequence
  ELANE RNA Guide
caggccggcaucuguuucgua

SEQ ID NO: 22050 - RNA, 21 nt, Artificial Sequence
  ELANE RNA Guide
cagggcacguacgaaacagau

SEQ ID NO: 22051 - RNA, 21 nt, Artificial Sequence
  ELANE RNA Guide
caucuguuucguacgugcccu

SEQ ID NO: 22052 - RNA, 21 nt, Artificial Sequence
  ELANE RNA Guide
ccagggcacguacgaaacaga

SEQ ID NO: 22053 - RNA, 21 nt, Artificial Sequence
  ELANE RNA Guide
cccagggcacguacgaaacag

SEQ ID NO: 22054 - RNA, 21 nt, Artificial Sequence
  ELANE RNA Guide
ccggcaggccggcaucuguuu

SEQ ID NO: 22055 - RNA, 21 nt, Artificial Sequence
  ELANE RNA Guide
ccggcaucuguuucguacgug

SEQ ID NO: 22056 - RNA, 21 nt, Artificial Sequence
  ELANE RNA Guide
cgaaacagaugccggccugcc

SEQ ID NO: 22057 - RNA, 21 nt, Artificial Sequence
  ELANE RNA Guide
cggcaggccggcaucuguuuc

SEQ ID NO: 22058 - RNA, 21 nt, Artificial Sequence
  ELANE RNA Guide
cggcaucuguuucguacgugc

SEQ ID NO: 22059 - RNA, 21 nt, Artificial Sequence
  ELANE RNA Guide
cguacgaaacagaugccggcc

SEQ ID NO: 22060 - RNA, 21 nt, Artificial Sequence
  ELANE RNA Guide
gaaacagaugccggccugccg

SEQ ID NO: 22061 - RNA, 21 nt, Artificial Sequence
  ELANE RNA Guide
gcacguacgaaacagaugccg

SEQ ID NO: 22062 - RNA, 21 nt, Artificial Sequence
  ELANE RNA Guide
gcaggccggcaucuguuucgu

SEQ ID NO: 22063 - RNA, 21 nt, Artificial Sequence
  ELANE RNA Guide
gcaucuguuucguacgugccc

SEQ ID NO: 22064 - RNA, 21 nt, Artificial Sequence
  ELANE RNA Guide
gccggcaggccggcaucuguu

SEQ ID NO: 22065 - RNA, 21 nt, Artificial Sequence
  ELANE RNA Guide
gccggcaucuguuucguacgu

SEQ ID NO: 22066 - RNA, 21 nt, Artificial Sequence
  ELANE RNA Guide
ggcacguacgaaacagaugcc

SEQ ID NO: 22067 - RNA, 21 nt, Artificial Sequence
  ELANE RNA Guide
ggcaggccggcaucuguuucg

SEQ ID NO: 22068 - RNA, 21 nt, Artificial Sequence
  ELANE RNA Guide
ggcaucuguuucguacgugcc

SEQ ID NO: 22069 - RNA, 21 nt, Artificial Sequence
  ELANE RNA Guide
ggccggcaggccggcaucugu

SEQ ID NO: 22070 - RNA, 21 nt, Artificial Sequence
  ELANE RNA Guide
ggccggcaucuguuucguacg

SEQ ID NO: 22071 - RNA, 21 nt, Artificial Sequence
  ELANE RNA Guide
gggcacguacgaaacagaugc

SEQ ID NO: 22072 - RNA, 21 nt, Artificial Sequence
  ELANE RNA Guide
guacgaaacagaugccggccu

SEQ ID NO: 22073 - RNA, 21 nt, Artificial Sequence
  ELANE RNA Guide
uacgaaacagaugccggccug

SEQ ID NO: 22074 - RNA, 22 nt, Artificial Sequence
  ELANE RNA Guide
aaacagaugccggccugccggc

SEQ ID NO: 22075 - RNA, 22 nt, Artificial Sequence
  ELANE RNA Guide
aacagaugccggccugccggcc

SEQ ID NO: 22076 - RNA, 22 nt, Artificial Sequence
  ELANE RNA Guide
acacccagggcacguacgaaac

SEQ ID NO: 22077 - RNA, 22 nt, Artificial Sequence
  ELANE RNA Guide
acagaugccggccugccggccc

SEQ ID NO: 22078 - RNA, 22 nt, Artificial Sequence
  ELANE RNA Guide
acccagggcacguacgaaacag

SEQ ID NO: 22079 - RNA, 22 nt, Artificial Sequence
  ELANE RNA Guide
acgaaacagaugccggccugcc

SEQ ID NO: 22080 - RNA, 22 nt, Artificial Sequence
  ELANE RNA Guide
acguacgaaacagaugccggcc

SEQ ID NO: 22081 - RNA, 22 nt, Artificial Sequence
  ELANE RNA Guide
agaugccggccugccggccccu

SEQ ID NO: 22082 - RNA, 22 nt, Artificial Sequence
  ELANE RNA Guide
aggccggcaucuguuucguacg

SEQ ID NO: 22083 - RNA, 22 nt, Artificial Sequence
  ELANE RNA Guide
agggcacguacgaaacagaugc

SEQ ID NO: 22084 - RNA, 22 nt, Artificial Sequence
  ELANE RNA Guide
aggggccggcaggccggcaucu

SEQ ID NO: 22085 - RNA, 22 nt, Artificial Sequence
  ELANE RNA Guide
augccggccugccggccccuca

SEQ ID NO: 22086 - RNA, 22 nt, Artificial Sequence
  ELANE RNA Guide
cacccagggcacguacgaaaca

SEQ ID NO: 22087 - RNA, 22 nt, Artificial Sequence
  ELANE RNA Guide
cacguacgaaacagaugccggc

SEQ ID NO: 22088 - RNA, 22 nt, Artificial Sequence
  ELANE RNA Guide
caggccggcaucuguuucguac

SEQ ID NO: 22089 - RNA, 22 nt, Artificial Sequence
  ELANE RNA Guide
cagggcacguacgaaacagaug

SEQ ID NO: 22090 - RNA, 22 nt, Artificial Sequence
  ELANE RNA Guide
caucuguuucguacgugcccug

SEQ ID NO: 22091 - RNA, 22 nt, Artificial Sequence
  ELANE RNA Guide
ccagggcacguacgaaacagau

SEQ ID NO: 22092 - RNA, 22 nt, Artificial Sequence
  ELANE RNA Guide
cccagggcacguacgaaacaga

SEQ ID NO: 22093 - RNA, 22 nt, Artificial Sequence
  ELANE RNA Guide
ccggcaggccggcaucuguuuc

SEQ ID NO: 22094 - RNA, 22 nt, Artificial Sequence
  ELANE RNA Guide
ccggcaucuguuucguacgugc

SEQ ID NO: 22095 - RNA, 22 nt, Artificial Sequence
  ELANE RNA Guide
cgaaacagaugccggccugccg

SEQ ID NO: 22096 - RNA, 22 nt, Artificial Sequence
  ELANE RNA Guide
cggcaggccggcaucuguuucg

SEQ ID NO: 22097 - RNA, 22 nt, Artificial Sequence
  ELANE RNA Guide
cggcaucuguuucguacgugcc

SEQ ID NO: 22098 - RNA, 22 nt, Artificial Sequence
  ELANE RNA Guide
cguacgaaacagaugccggccu

SEQ ID NO: 22099 - RNA, 22 nt, Artificial Sequence
  ELANE RNA Guide
gaaacagaugccggccugccgg

SEQ ID NO: 22100 - RNA, 22 nt, Artificial Sequence
  ELANE RNA Guide
gcacguacgaaacagaugccgg

SEQ ID NO: 22101 - RNA, 22 nt, Artificial Sequence
  ELANE RNA Guide
gcaggccggcaucuguuucgua

SEQ ID NO: 22102 - RNA, 22 nt, Artificial Sequence
  ELANE RNA Guide
gcaucuguuucguacgugcccu

SEQ ID NO: 22103 - RNA, 22 nt, Artificial Sequence
  ELANE RNA Guide
gccggcaggccggcaucuguuu

SEQ ID NO: 22104 - RNA, 22 nt, Artificial Sequence
  ELANE RNA Guide
gccggcaucuguuucguacgug

SEQ ID NO: 22105 - RNA, 22 nt, Artificial Sequence
  ELANE RNA Guide
ggcacguacgaaacagaugccg

SEQ ID NO: 22106 - RNA, 22 nt, Artificial Sequence
  ELANE RNA Guide
ggcaggccggcaucuguuucgu

SEQ ID NO: 22107 - RNA, 22 nt, Artificial Sequence
  ELANE RNA Guide
ggcaucuguuucguacgugccc

SEQ ID NO: 22108 - RNA, 22 nt, Artificial Sequence
  ELANE RNA Guide
ggccggcaggccggcaucuguu

SEQ ID NO: 22109 - RNA, 22 nt, Artificial Sequence
  ELANE RNA Guide
ggccggcaucuguuucguacgu

SEQ ID NO: 22110 - RNA, 22 nt, Artificial Sequence
  ELANE RNA Guide
gggcacguacgaaacagaugcc

SEQ ID NO: 22111 - RNA, 22 nt, Artificial Sequence
  ELANE RNA Guide
gggccggcaggccggcaucugu

SEQ ID NO: 22112 - RNA, 22 nt, Artificial Sequence
  ELANE RNA Guide
guacgaaacagaugccggccug

SEQ ID NO: 22113 - RNA, 22 nt, Artificial Sequence
  ELANE RNA Guide
uacgaaacagaugccggccugc

SEQ ID NO: 22114 - RNA, 22 nt, Artificial Sequence
  ELANE RNA Guide
ucucgugaggggccggcaggcc

SEQ ID NO: 22115 - RNA, 22 nt, Artificial Sequence
  ELANE RNA Guide
ugaggggccggcaggccggcau

SEQ ID NO: 22116 - RNA, 20 nt, Artificial Sequence
  ELANE RNA Guide
aaacagaagcgccggccugc

SEQ ID NO: 22117 - RNA, 20 nt, Artificial Sequence
  ELANE RNA Guide
aacagaagcgccggccugcc

SEQ ID NO: 22118 - RNA, 20 nt, Artificial Sequence
  ELANE RNA Guide
acagaagcgccggccugccg

SEQ ID NO: 22119 - RNA, 20 nt, Artificial Sequence
  ELANE RNA Guide
acgaaacagaagcgccggcc

SEQ ID NO: 22120 - RNA, 20 nt, Artificial Sequence
  ELANE RNA Guide
acguacgaaacagaagcgcc

SEQ ID NO: 22121 - RNA, 20 nt, Artificial Sequence
  ELANE RNA Guide
agaagcgccggccugccggc

SEQ ID NO: 22122 - RNA, 20 nt, Artificial Sequence
  ELANE RNA Guide
aggccggcgcuucuguuucg

SEQ ID NO: 22123 - RNA, 20 nt, Artificial Sequence
  ELANE RNA Guide
agggcacguacgaaacagaa

SEQ ID NO: 22124 - RNA, 20 nt, Artificial Sequence
  ELANE RNA Guide
cacguacgaaacagaagcgc

SEQ ID NO: 22125 - RNA, 20 nt, Artificial Sequence
  ELANE RNA Guide
cagaagcgccggccugccgg

SEQ ID NO: 22126 - RNA, 20 nt, Artificial Sequence
  ELANE RNA Guide
caggccggcgcuucuguuuc

SEQ ID NO: 22127 - RNA, 20 nt, Artificial Sequence
  ELANE RNA Guide
ccggcaggccggcgcuucug

SEQ ID NO: 22128 - RNA, 20 nt, Artificial Sequence
  ELANE RNA Guide
ccggcgcuucuguuucguac

SEQ ID NO: 22129 - RNA, 20 nt, Artificial Sequence
  ELANE RNA Guide
cgaaacagaagcgccggccu

SEQ ID NO: 22130 - RNA, 20 nt, Artificial Sequence
  ELANE RNA Guide
cgcuucuguuucguacgugc

SEQ ID NO: 22131 - RNA, 20 nt, Artificial Sequence
  ELANE RNA Guide
cggcaggccggcgcuucugu

SEQ ID NO: 22132 - RNA, 20 nt, Artificial Sequence
  ELANE RNA Guide
cggcgcuucuguuucguacg

SEQ ID NO: 22133 - RNA, 20 nt, Artificial Sequence
  ELANE RNA Guide
cguacgaaacagaagcgccg

SEQ ID NO: 22134 - RNA, 20 nt, Artificial Sequence
  ELANE RNA Guide
gaaacagaagcgccggccug

SEQ ID NO: 22135 - RNA, 20 nt, Artificial Sequence
  ELANE RNA Guide
gcacguacgaaacagaagcg

SEQ ID NO: 22136 - RNA, 20 nt, Artificial Sequence
  ELANE RNA Guide
gcaggccggcgcuucuguuu

SEQ ID NO: 22137 - RNA, 20 nt, Artificial Sequence
  ELANE RNA Guide
gccggcaggccggcgcuucu

SEQ ID NO: 22138 - RNA, 20 nt, Artificial Sequence
  ELANE RNA Guide
gccggcgcuucuguuucgua

SEQ ID NO: 22139 - RNA, 20 nt, Artificial Sequence
  ELANE RNA Guide
gcgcuucuguuucguacgug

SEQ ID NO: 22140 - RNA, 20 nt, Artificial Sequence
  ELANE RNA Guide
ggcacguacgaaacagaagc

SEQ ID NO: 22141 - RNA, 20 nt, Artificial Sequence
  ELANE RNA Guide
ggcaggccggcgcuucuguu

SEQ ID NO: 22142 - RNA, 20 nt, Artificial Sequence
  ELANE RNA Guide
ggccggcgcuucuguuucgu

SEQ ID NO: 22143 - RNA, 20 nt, Artificial Sequence
  ELANE RNA Guide
ggcgcuucuguuucguacgu

SEQ ID NO: 22144 - RNA, 20 nt, Artificial Sequence
  ELANE RNA Guide
gggcacguacgaaacagaag

SEQ ID NO: 22145 - RNA, 20 nt, Artificial Sequence
  ELANE RNA Guide
guacgaaacagaagcgccgg

SEQ ID NO: 22146 - RNA, 20 nt, Artificial Sequence
  ELANE RNA Guide
uacgaaacagaagcgccggc

SEQ ID NO: 22147 - RNA, 21 nt, Artificial Sequence
  ELANE RNA Guide
aaacagaagcgccggccugcc

SEQ ID NO: 22148 - RNA, 21 nt, Artificial Sequence
  ELANE RNA Guide
aacagaagcgccggccugccg

SEQ ID NO: 22149 - RNA, 21 nt, Artificial Sequence
  ELANE RNA Guide
acagaagcgccggccugccgg

SEQ ID NO: 22150 - RNA, 21 nt, Artificial Sequence
  ELANE RNA Guide
acgaaacagaagcgccggccu

SEQ ID NO: 22151 - RNA, 21 nt, Artificial Sequence
  ELANE RNA Guide
acguacgaaacagaagcgccg

SEQ ID NO: 22152 - RNA, 21 nt, Artificial Sequence
  ELANE RNA Guide
aggccggcgcuucuguuucgu

SEQ ID NO: 22153 - RNA, 21 nt, Artificial Sequence
  ELANE RNA Guide
agggcacguacgaaacagaag

SEQ ID NO: 22154 - RNA, 21 nt, Artificial Sequence
  ELANE RNA Guide
cacguacgaaacagaagcgcc

SEQ ID NO: 22155 - RNA, 21 nt, Artificial Sequence
  ELANE RNA Guide
caggccggcgcuucuguuucg

SEQ ID NO: 22156 - RNA, 21 nt, Artificial Sequence
  ELANE RNA Guide
cagggcacguacgaaacagaa

SEQ ID NO: 22157 - RNA, 21 nt, Artificial Sequence
  ELANE RNA Guide
ccggcaggccggcgcuucugu

SEQ ID NO: 22158 - RNA, 21 nt, Artificial Sequence
  ELANE RNA Guide
ccggcgcuucuguuucguacg

SEQ ID NO: 22159 - RNA, 21 nt, Artificial Sequence
  ELANE RNA Guide
cgaaacagaagcgccggccug

SEQ ID NO: 22160 - RNA, 21 nt, Artificial Sequence
  ELANE RNA Guide
cgcuucuguuucguacgugcc

SEQ ID NO: 22161 - RNA, 21 nt, Artificial Sequence
  ELANE RNA Guide
cggcaggccggcgcuucuguu

SEQ ID NO: 22162 - RNA, 21 nt, Artificial Sequence
  ELANE RNA Guide
cggcgcuucuguuucguacgu

SEQ ID NO: 22163 - RNA, 21 nt, Artificial Sequence
  ELANE RNA Guide
cguacgaaacagaagcgccgg

SEQ ID NO: 22164 - RNA, 21 nt, Artificial Sequence
  ELANE RNA Guide
gaaacagaagcgccggccugc

SEQ ID NO: 22165 - RNA, 21 nt, Artificial Sequence
  ELANE RNA Guide
gcacguacgaaacagaagcgc

SEQ ID NO: 22166 - RNA, 21 nt, Artificial Sequence
  ELANE RNA Guide
gcaggccggcgcuucuguuuc

SEQ ID NO: 22167 - RNA, 21 nt, Artificial Sequence
  ELANE RNA Guide
gccggcgcuucuguuucguac

SEQ ID NO: 22168 - RNA, 21 nt, Artificial Sequence
  ELANE RNA Guide
gcgcuucuguuucguacgugc

SEQ ID NO: 22169 - RNA, 21 nt, Artificial Sequence
  ELANE RNA Guide
ggcacguacgaaacagaagcg

SEQ ID NO: 22170 - RNA, 21 nt, Artificial Sequence
  ELANE RNA Guide
ggcaggccggcgcuucuguuu

SEQ ID NO: 22171 - RNA, 21 nt, Artificial Sequence
  ELANE RNA Guide
ggccggcgcuucuguuucgua

SEQ ID NO: 22172 - RNA, 21 nt, Artificial Sequence
  ELANE RNA Guide
ggcgcuucuguuucguacgug

SEQ ID NO: 22173 - RNA, 21 nt, Artificial Sequence
  ELANE RNA Guide
gggcacguacgaaacagaagc

SEQ ID NO: 22174 - RNA, 21 nt, Artificial Sequence
  ELANE RNA Guide
guacgaaacagaagcgccggc

SEQ ID NO: 22175 - RNA, 21 nt, Artificial Sequence
  ELANE RNA Guide
uacgaaacagaagcgccggcc

SEQ ID NO: 22176 - RNA, 22 nt, Artificial Sequence
  ELANE RNA Guide
aaacagaagcgccggccugccg

SEQ ID NO: 22177 - RNA, 22 nt, Artificial Sequence
  ELANE RNA Guide
aacagaagcgccggccugccgg

SEQ ID NO: 22178 - RNA, 22 nt, Artificial Sequence
  ELANE RNA Guide
acagaagcgccggccugccggc

SEQ ID NO: 22179 - RNA, 22 nt, Artificial Sequence
  ELANE RNA Guide
acgaaacagaagcgccggccug

SEQ ID NO: 22180 - RNA, 22 nt, Artificial Sequence
  ELANE RNA Guide
acguacgaaacagaagcgccgg

SEQ ID NO: 22181 - RNA, 22 nt, Artificial Sequence
  ELANE RNA Guide
aggccggcgcuucuguuucgua

SEQ ID NO: 22182 - RNA, 22 nt, Artificial Sequence
  ELANE RNA Guide
agggcacguacgaaacagaagc

SEQ ID NO: 22183 - RNA, 22 nt, Artificial Sequence
  ELANE RNA Guide
cacguacgaaacagaagcgccg

SEQ ID NO: 22184 - RNA, 22 nt, Artificial Sequence
  ELANE RNA Guide
caggccggcgcuucuguuucgu

SEQ ID NO: 22185 - RNA, 22 nt, Artificial Sequence
  ELANE RNA Guide
cagggcacguacgaaacagaag

SEQ ID NO: 22186 - RNA, 22 nt, Artificial Sequence
  ELANE RNA Guide
ccagggcacguacgaaacagaa

SEQ ID NO: 22187 - RNA, 22 nt, Artificial Sequence
  ELANE RNA Guide
ccggcaggccggcgcuucuguu

SEQ ID NO: 22188 - RNA, 22 nt, Artificial Sequence
  ELANE RNA Guide
ccggcgcuucuguuucguacgu

SEQ ID NO: 22189 - RNA, 22 nt, Artificial Sequence
  ELANE RNA Guide
cgaaacagaagcgccggccugc

SEQ ID NO: 22190 - RNA, 22 nt, Artificial Sequence
  ELANE RNA Guide
cgcuucuguuucguacgugccc

SEQ ID NO: 22191 - RNA, 22 nt, Artificial Sequence
  ELANE RNA Guide
cggcaggccggcgcuucuguuu

SEQ ID NO: 22192 - RNA, 22 nt, Artificial Sequence
  ELANE RNA Guide
cggcgcuucuguuucguacgug

SEQ ID NO: 22193 - RNA, 22 nt, Artificial Sequence
  ELANE RNA Guide
cguacgaaacagaagcgccggc

SEQ ID NO: 22194 - RNA, 22 nt, Artificial Sequence
  ELANE RNA Guide
gaaacagaagcgccggccugcc

SEQ ID NO: 22195 - RNA, 22 nt, Artificial Sequence
  ELANE RNA Guide
gcacguacgaaacagaagcgcc

SEQ ID NO: 22196 - RNA, 22 nt, Artificial Sequence
  ELANE RNA Guide
gcaggccggcgcuucuguuucg

SEQ ID NO: 22197 - RNA, 22 nt, Artificial Sequence
  ELANE RNA Guide
gccggcaggccggcgcuucugu

SEQ ID NO: 22198 - RNA, 22 nt, Artificial Sequence
  ELANE RNA Guide
gccggcgcuucuguuucguacg

SEQ ID NO: 22199 - RNA, 22 nt, Artificial Sequence
  ELANE RNA Guide
gcgcuucuguuucguacgugcc

SEQ ID NO: 22200 - RNA, 22 nt, Artificial Sequence
  ELANE RNA Guide
ggcacguacgaaacagaagcgc

SEQ ID NO: 22201 - RNA, 22 nt, Artificial Sequence
  ELANE RNA Guide
ggcaggccggcgcuucuguuuc

SEQ ID NO: 22202 - RNA, 22 nt, Artificial Sequence
  ELANE RNA Guide
ggccggcgcuucuguuucguac

SEQ ID NO: 22203 - RNA, 22 nt, Artificial Sequence
  ELANE RNA Guide
ggcgcuucuguuucguacgugc

SEQ ID NO: 22204 - RNA, 22 nt, Artificial Sequence
  ELANE RNA Guide
gggcacguacgaaacagaagcg

SEQ ID NO: 22205 - RNA, 22 nt, Artificial Sequence
  ELANE RNA Guide
guacgaaacagaagcgccggcc

SEQ ID NO: 22206 - RNA, 22 nt, Artificial Sequence
  ELANE RNA Guide
uacgaaacagaagcgccggccu

SEQ ID NO: 22207 - RNA, 20 nt, Artificial Sequence
  ELANE RNA Guide
aaaaaacgccggccugccgg

SEQ ID NO: 22208 - RNA, 20 nt, Artificial Sequence
  ELANE RNA Guide
aaaaacgccggccugccggc

SEQ ID NO: 22209 - RNA, 20 nt, Artificial Sequence
  ELANE RNA Guide
aaaacgccggccugccggcc

SEQ ID NO: 22210 - RNA, 20 nt, Artificial Sequence
  ELANE RNA Guide
aaacagaaaaaacgccggcc

SEQ ID NO: 22211 - RNA, 20 nt, Artificial Sequence
  ELANE RNA Guide
aaacgccggccugccggccc

SEQ ID NO: 22212 - RNA, 20 nt, Artificial Sequence
  ELANE RNA Guide
aacagaaaaaacgccggccu

SEQ ID NO: 22213 - RNA, 20 nt, Artificial Sequence
  ELANE RNA Guide
acagaaaaaacgccggccug

SEQ ID NO: 22214 - RNA, 20 nt, Artificial Sequence
  ELANE RNA Guide
acgaaacagaaaaaacgccg

SEQ ID NO: 22215 - RNA, 20 nt, Artificial Sequence
  ELANE RNA Guide
acguacgaaacagaaaaaac

SEQ ID NO: 22216 - RNA, 20 nt, Artificial Sequence
  ELANE RNA Guide
agaaaaaacgccggccugcc

SEQ ID NO: 22217 - RNA, 20 nt, Artificial Sequence
  ELANE RNA Guide
aggccggcguuuuuucuguu

SEQ ID NO: 22218 - RNA, 20 nt, Artificial Sequence
  ELANE RNA Guide
cacguacgaaacagaaaaaa

SEQ ID NO: 22219 - RNA, 20 nt, Artificial Sequence
  ELANE RNA Guide
cagaaaaaacgccggccugc

SEQ ID NO: 22220 - RNA, 20 nt, Artificial Sequence
  ELANE RNA Guide
caggccggcguuuuuucugu

SEQ ID NO: 22221 - RNA, 20 nt, Artificial Sequence
  ELANE RNA Guide
ccggcaggccggcguuuuuu

SEQ ID NO: 22222 - RNA, 20 nt, Artificial Sequence
  ELANE RNA Guide
ccggcguuuuuucuguuucg

SEQ ID NO: 22223 - RNA, 20 nt, Artificial Sequence
  ELANE RNA Guide
cgaaacagaaaaaacgccgg

SEQ ID NO: 22224 - RNA, 20 nt, Artificial Sequence
  ELANE RNA Guide
cggcaggccggcguuuuuuc

SEQ ID NO: 22225 - RNA, 20 nt, Artificial Sequence
  ELANE RNA Guide
cggcguuuuuucuguuucgu

SEQ ID NO: 22226 - RNA, 20 nt, Artificial Sequence
  ELANE RNA Guide
cguacgaaacagaaaaaacg

SEQ ID NO: 22227 - RNA, 20 nt, Artificial Sequence
  ELANE RNA Guide
cguuuuuucuguuucguacg

SEQ ID NO: 22228 - RNA, 20 nt, Artificial Sequence
  ELANE RNA Guide
gaaaaaacgccggccugccg

SEQ ID NO: 22229 - RNA, 20 nt, Artificial Sequence
  ELANE RNA Guide
gaaacagaaaaaacgccggc

SEQ ID NO: 22230 - RNA, 20 nt, Artificial Sequence
  ELANE RNA Guide
gcacguacgaaacagaaaaa

SEQ ID NO: 22231 - RNA, 20 nt, Artificial Sequence
  ELANE RNA Guide
gcaggccggcguuuuuucug

SEQ ID NO: 22232 - RNA, 20 nt, Artificial Sequence
  ELANE RNA Guide
gccggcaggccggcguuuuu

SEQ ID NO: 22233 - RNA, 20 nt, Artificial Sequence
  ELANE RNA Guide
gccggcguuuuuucuguuuc

SEQ ID NO: 22234 - RNA, 20 nt, Artificial Sequence
  ELANE RNA Guide
gcguuuuuucuguuucguac

SEQ ID NO: 22235 - RNA, 20 nt, Artificial Sequence
  ELANE RNA Guide
ggcacguacgaaacagaaaa

SEQ ID NO: 22236 - RNA, 20 nt, Artificial Sequence
  ELANE RNA Guide
ggcaggccggcguuuuuucu

SEQ ID NO: 22237 - RNA, 20 nt, Artificial Sequence
  ELANE RNA Guide
ggccggcaggccggcguuuu

SEQ ID NO: 22238 - RNA, 20 nt, Artificial Sequence
  ELANE RNA Guide
ggccggcguuuuuucuguuu

SEQ ID NO: 22239 - RNA, 20 nt, Artificial Sequence
  ELANE RNA Guide
ggcguuuuuucuguuucgua

SEQ ID NO: 22240 - RNA, 20 nt, Artificial Sequence
  ELANE RNA Guide
gggcacguacgaaacagaaa

SEQ ID NO: 22241 - RNA, 20 nt, Artificial Sequence
  ELANE RNA Guide
gggccggcaggccggcguuu

SEQ ID NO: 22242 - RNA, 20 nt, Artificial Sequence
  ELANE RNA Guide
guacgaaacagaaaaaacgc

SEQ ID NO: 22243 - RNA, 20 nt, Artificial Sequence
  ELANE RNA Guide
uacgaaacagaaaaaacgcc

SEQ ID NO: 22244 - RNA, 21 nt, Artificial Sequence
  ELANE RNA Guide
aaaaaacgccggccugccggc

SEQ ID NO: 22245 - RNA, 21 nt, Artificial Sequence
  ELANE RNA Guide
aaaaacgccggccugccggcc

SEQ ID NO: 22246 - RNA, 21 nt, Artificial Sequence
  ELANE RNA Guide
aaaacgccggccugccggccc

SEQ ID NO: 22247 - RNA, 21 nt, Artificial Sequence
  ELANE RNA Guide
aaacagaaaaaacgccggccu

SEQ ID NO: 22248 - RNA, 21 nt, Artificial Sequence
  ELANE RNA Guide
aacagaaaaaacgccggccug

SEQ ID NO: 22249 - RNA, 21 nt, Artificial Sequence
  ELANE RNA Guide
acagaaaaaacgccggccugc

SEQ ID NO: 22250 - RNA, 21 nt, Artificial Sequence
  ELANE RNA Guide
acgaaacagaaaaaacgccgg

SEQ ID NO: 22251 - RNA, 21 nt, Artificial Sequence
  ELANE RNA Guide
acguacgaaacagaaaaaacg

SEQ ID NO: 22252 - RNA, 21 nt, Artificial Sequence
  ELANE RNA Guide
agaaaaaacgccggccugccg

SEQ ID NO: 22253 - RNA, 21 nt, Artificial Sequence
  ELANE RNA Guide
aggccggcguuuuuucuguuu

SEQ ID NO: 22254 - RNA, 21 nt, Artificial Sequence
  ELANE RNA Guide
agggcacguacgaaacagaaa

SEQ ID NO: 22255 - RNA, 21 nt, Artificial Sequence
  ELANE RNA Guide
cacguacgaaacagaaaaaac

SEQ ID NO: 22256 - RNA, 21 nt, Artificial Sequence
  ELANE RNA Guide
cagaaaaaacgccggccugcc

SEQ ID NO: 22257 - RNA, 21 nt, Artificial Sequence
  ELANE RNA Guide
caggccggcguuuuuucuguu

SEQ ID NO: 22258 - RNA, 21 nt, Artificial Sequence
  ELANE RNA Guide
ccggcaggccggcguuuuuuc

SEQ ID NO: 22259 - RNA, 21 nt, Artificial Sequence
  ELANE RNA Guide
ccggcguuuuuucuguuucgu

SEQ ID NO: 22260 - RNA, 21 nt, Artificial Sequence
  ELANE RNA Guide
cgaaacagaaaaaacgccggc

SEQ ID NO: 22261 - RNA, 21 nt, Artificial Sequence
  ELANE RNA Guide
cggcaggccggcguuuuuucu

SEQ ID NO: 22262 - RNA, 21 nt, Artificial Sequence
  ELANE RNA Guide
cggcguuuuuucuguuucgua

SEQ ID NO: 22263 - RNA, 21 nt, Artificial Sequence
  ELANE RNA Guide
cguacgaaacagaaaaaacgc

SEQ ID NO: 22264 - RNA, 21 nt, Artificial Sequence
  ELANE RNA Guide
cguuuuuucuguuucguacgu

SEQ ID NO: 22265 - RNA, 21 nt, Artificial Sequence
  ELANE RNA Guide
gaaaaaacgccggccugccgg

SEQ ID NO: 22266 - RNA, 21 nt, Artificial Sequence
  ELANE RNA Guide
gaaacagaaaaaacgccggcc

SEQ ID NO: 22267 - RNA, 21 nt, Artificial Sequence
  ELANE RNA Guide
gcacguacgaaacagaaaaaa

SEQ ID NO: 22268 - RNA, 21 nt, Artificial Sequence
  ELANE RNA Guide
gcaggccggcguuuuuucugu

SEQ ID NO: 22269 - RNA, 21 nt, Artificial Sequence
  ELANE RNA Guide
gccggcaggccggcguuuuuu

SEQ ID NO: 22270 - RNA, 21 nt, Artificial Sequence
  ELANE RNA Guide
gccggcguuuuuucuguuucg

SEQ ID NO: 22271 - RNA, 21 nt, Artificial Sequence
  ELANE RNA Guide
gcguuuuuucuguuucguacg

SEQ ID NO: 22272 - RNA, 21 nt, Artificial Sequence
  ELANE RNA Guide
ggcacguacgaaacagaaaaa

SEQ ID NO: 22273 - RNA, 21 nt, Artificial Sequence
  ELANE RNA Guide
ggcaggccggcguuuuuucug

SEQ ID NO: 22274 - RNA, 21 nt, Artificial Sequence
  ELANE RNA Guide
ggccggcaggccggcguuuuu

SEQ ID NO: 22275 - RNA, 21 nt, Artificial Sequence
  ELANE RNA Guide
ggccggcguuuuuucuguuuc

SEQ ID NO: 22276 - RNA, 21 nt, Artificial Sequence
  ELANE RNA Guide
ggcguuuuuucuguuucguac

SEQ ID NO: 22277 - RNA, 21 nt, Artificial Sequence
  ELANE RNA Guide
gggcacguacgaaacagaaaa

SEQ ID NO: 22278 - RNA, 21 nt, Artificial Sequence
  ELANE RNA Guide
gggccggcaggccggcguuuu

SEQ ID NO: 22279 - RNA, 21 nt, Artificial Sequence
  ELANE RNA Guide
guacgaaacagaaaaaacgcc

SEQ ID NO: 22280 - RNA, 21 nt, Artificial Sequence
  ELANE RNA Guide
uacgaaacagaaaaaacgccg

SEQ ID NO: 22281 - RNA, 22 nt, Artificial Sequence
  ELANE RNA Guide
aaaaaacgccggccugccggcc

SEQ ID NO: 22282 - RNA, 22 nt, Artificial Sequence
  ELANE RNA Guide
aaaaacgccggccugccggccc

SEQ ID NO: 22283 - RNA, 22 nt, Artificial Sequence
  ELANE RNA Guide
aaaacgccggccugccggcccc

SEQ ID NO: 22284 - RNA, 22 nt, Artificial Sequence
  ELANE RNA Guide
aaacagaaaaaacgccggccug

SEQ ID NO: 22285 - RNA, 22 nt, Artificial Sequence
  ELANE RNA Guide
aaacgccggccugccggccccu

SEQ ID NO: 22286 - RNA, 22 nt, Artificial Sequence
  ELANE RNA Guide
aacagaaaaaacgccggccugc

SEQ ID NO: 22287 - RNA, 22 nt, Artificial Sequence
  ELANE RNA Guide
acagaaaaaacgccggccugcc

SEQ ID NO: 22288 - RNA, 22 nt, Artificial Sequence
  ELANE RNA Guide
acgaaacagaaaaaacgccggc

SEQ ID NO: 22289 - RNA, 22 nt, Artificial Sequence
  ELANE RNA Guide
acguacgaaacagaaaaaacgc

SEQ ID NO: 22290 - RNA, 22 nt, Artificial Sequence
  ELANE RNA Guide
agaaaaaacgccggccugccgg

SEQ ID NO: 22291 - RNA, 22 nt, Artificial Sequence
  ELANE RNA Guide
aggccggcguuuuuucuguuuc

SEQ ID NO: 22292 - RNA, 22 nt, Artificial Sequence
  ELANE RNA Guide
agggcacguacgaaacagaaaa

SEQ ID NO: 22293 - RNA, 22 nt, Artificial Sequence
  ELANE RNA Guide
aggggccggcaggccggcguuu

SEQ ID NO: 22294 - RNA, 22 nt, Artificial Sequence
  ELANE RNA Guide
cacguacgaaacagaaaaaacg

SEQ ID NO: 22295 - RNA, 22 nt, Artificial Sequence
  ELANE RNA Guide
cagaaaaaacgccggccugccg

SEQ ID NO: 22296 - RNA, 22 nt, Artificial Sequence
  ELANE RNA Guide
caggccggcguuuuuucuguuu

SEQ ID NO: 22297 - RNA, 22 nt, Artificial Sequence
  ELANE RNA Guide
cagggcacguacgaaacagaaa

SEQ ID NO: 22298 - RNA, 22 nt, Artificial Sequence
  ELANE RNA Guide
ccggcaggccggcguuuuuucu

SEQ ID NO: 22299 - RNA, 22 nt, Artificial Sequence
  ELANE RNA Guide
ccggcguuuuuucuguuucgua

SEQ ID NO: 22300 - RNA, 22 nt, Artificial Sequence
  ELANE RNA Guide
cgaaacagaaaaaacgccggcc

SEQ ID NO: 22301 - RNA, 22 nt, Artificial Sequence
  ELANE RNA Guide
cggcaggccggcguuuuuucug

SEQ ID NO: 22302 - RNA, 22 nt, Artificial Sequence
  ELANE RNA Guide
cggcguuuuuucuguuucguac

SEQ ID NO: 22303 - RNA, 22 nt, Artificial Sequence
  ELANE RNA Guide
cguacgaaacagaaaaaacgcc

SEQ ID NO: 22304 - RNA, 22 nt, Artificial Sequence
  ELANE RNA Guide
cguuuuuucuguuucguacgug

SEQ ID NO: 22305 - RNA, 22 nt, Artificial Sequence
  ELANE RNA Guide
gaaaaaacgccggccugccggc

SEQ ID NO: 22306 - RNA, 22 nt, Artificial Sequence
  ELANE RNA Guide
gaaacagaaaaaacgccggccu

SEQ ID NO: 22307 - RNA, 22 nt, Artificial Sequence
  ELANE RNA Guide
gcacguacgaaacagaaaaaac

SEQ ID NO: 22308 - RNA, 22 nt, Artificial Sequence
  ELANE RNA Guide
gcaggccggcguuuuuucuguu

SEQ ID NO: 22309 - RNA, 22 nt, Artificial Sequence
  ELANE RNA Guide
gccggcaggccggcguuuuuuc

SEQ ID NO: 22310 - RNA, 22 nt, Artificial Sequence
  ELANE RNA Guide
gccggcguuuuuucuguuucgu

SEQ ID NO: 22311 - RNA, 22 nt, Artificial Sequence
  ELANE RNA Guide
gcguuuuuucuguuucguacgu

SEQ ID NO: 22312 - RNA, 22 nt, Artificial Sequence
  ELANE RNA Guide
ggcacguacgaaacagaaaaaa

SEQ ID NO: 22313 - RNA, 22 nt, Artificial Sequence
  ELANE RNA Guide
ggcaggccggcguuuuuucugu

SEQ ID NO: 22314 - RNA, 22 nt, Artificial Sequence
  ELANE RNA Guide
ggccggcaggccggcguuuuuu

SEQ ID NO: 22315 - RNA, 22 nt, Artificial Sequence
  ELANE RNA Guide
ggccggcguuuuuucuguuucg

SEQ ID NO: 22316 - RNA, 22 nt, Artificial Sequence
  ELANE RNA Guide
ggcguuuuuucuguuucguacg

SEQ ID NO: 22317 - RNA, 22 nt, Artificial Sequence
  ELANE RNA Guide
gggcacguacgaaacagaaaaa

SEQ ID NO: 22318 - RNA, 22 nt, Artificial Sequence
  ELANE RNA Guide
gggccggcaggccggcguuuuu

SEQ ID NO: 22319 - RNA, 22 nt, Artificial Sequence
  ELANE RNA Guide
ggggccggcaggccggcguuuu

SEQ ID NO: 22320 - RNA, 22 nt, Artificial Sequence
  ELANE RNA Guide
guacgaaacagaaaaaacgccg

SEQ ID NO: 22321 - RNA, 22 nt, Artificial Sequence
  ELANE RNA Guide
uacgaaacagaaaaaacgccgg

SEQ ID NO: 22322 - RNA, 20 nt, Artificial Sequence
  ELANE RNA Guide
acacccagggcacguaugaa

SEQ ID NO: 22323 - RNA, 20 nt, Artificial Sequence
  ELANE RNA Guide
acccagggcacguaugaaac

SEQ ID NO: 22324 - RNA, 20 nt, Artificial Sequence
  ELANE RNA Guide
acguaugaaacagacgccgg

SEQ ID NO: 22325 - RNA, 20 nt, Artificial Sequence
  ELANE RNA Guide
agagggacacccagggcacg

SEQ ID NO: 22326 - RNA, 20 nt, Artificial Sequence
  ELANE RNA Guide
aggccggcgucuguuucaua

SEQ ID NO: 22327 - RNA, 20 nt, Artificial Sequence
  ELANE RNA Guide
agggacacccagggcacgua

SEQ ID NO: 22328 - RNA, 20 nt, Artificial Sequence
  ELANE RNA Guide
agggcacguaugaaacagac

SEQ ID NO: 22329 - RNA, 20 nt, Artificial Sequence
  ELANE RNA Guide
augaaacagacgccggccug

SEQ ID NO: 22330 - RNA, 20 nt, Artificial Sequence
  ELANE RNA Guide
cacccagggcacguaugaaa

SEQ ID NO: 22331 - RNA, 20 nt, Artificial Sequence
  ELANE RNA Guide
cacguaugaaacagacgccg

SEQ ID NO: 22332 - RNA, 20 nt, Artificial Sequence
  ELANE RNA Guide
cagagggacacccagggcac

SEQ ID NO: 22333 - RNA, 20 nt, Artificial Sequence
  ELANE RNA Guide
caggccggcgucuguuucau

SEQ ID NO: 22334 - RNA, 20 nt, Artificial Sequence
  ELANE RNA Guide
cagggcacguaugaaacaga

SEQ ID NO: 22335 - RNA, 20 nt, Artificial Sequence
  ELANE RNA Guide
cauacgugcccugggugucc

SEQ ID NO: 22336 - RNA, 20 nt, Artificial Sequence
  ELANE RNA Guide
ccagggcacguaugaaacag

SEQ ID NO: 22337 - RNA, 20 nt, Artificial Sequence
  ELANE RNA Guide
cccagggcacguaugaaaca

SEQ ID NO: 22338 - RNA, 20 nt, Artificial Sequence
  ELANE RNA Guide
ccggcgucuguuucauacgu

SEQ ID NO: 22339 - RNA, 20 nt, Artificial Sequence
  ELANE RNA Guide
cggcgucuguuucauacgug

SEQ ID NO: 22340 - RNA, 20 nt, Artificial Sequence
  ELANE RNA Guide
cguaugaaacagacgccggc

SEQ ID NO: 22341 - RNA, 20 nt, Artificial Sequence
  ELANE RNA Guide
cgucuguuucauacgugccc

SEQ ID NO: 22342 - RNA, 20 nt, Artificial Sequence
  ELANE RNA Guide
cuguuucauacgugcccugg

SEQ ID NO: 22343 - RNA, 20 nt, Artificial Sequence
  ELANE RNA Guide
gacacccagggcacguauga

SEQ ID NO: 22344 - RNA, 20 nt, Artificial Sequence
  ELANE RNA Guide
gagggacacccagggcacgu

SEQ ID NO: 22345 - RNA, 20 nt, Artificial Sequence
  ELANE RNA Guide
gcacguaugaaacagacgcc

SEQ ID NO: 22346 - RNA, 20 nt, Artificial Sequence
  ELANE RNA Guide
gcaggccggcgucuguuuca

SEQ ID NO: 22347 - RNA, 20 nt, Artificial Sequence
  ELANE RNA Guide
gccggcgucuguuucauacg

SEQ ID NO: 22348 - RNA, 20 nt, Artificial Sequence
  ELANE RNA Guide
gcgucuguuucauacgugcc

SEQ ID NO: 22349 - RNA, 20 nt, Artificial Sequence
  ELANE RNA Guide
ggacacccagggcacguaug

SEQ ID NO: 22350 - RNA, 20 nt, Artificial Sequence
  ELANE RNA Guide
ggcacguaugaaacagacgc

SEQ ID NO: 22351 - RNA, 20 nt, Artificial Sequence
  ELANE RNA Guide
ggcaggccggcgucuguuuc

SEQ ID NO: 22352 - RNA, 20 nt, Artificial Sequence
  ELANE RNA Guide
ggccggcgucuguuucauac

SEQ ID NO: 22353 - RNA, 20 nt, Artificial Sequence
  ELANE RNA Guide
ggcgucuguuucauacgugc

SEQ ID NO: 22354 - RNA, 20 nt, Artificial Sequence
  ELANE RNA Guide
gggacacccagggcacguau

SEQ ID NO: 22355 - RNA, 20 nt, Artificial Sequence
  ELANE RNA Guide
gggcacguaugaaacagacg

SEQ ID NO: 22356 - RNA, 20 nt, Artificial Sequence
  ELANE RNA Guide
guaugaaacagacgccggcc

SEQ ID NO: 22357 - RNA, 20 nt, Artificial Sequence
  ELANE RNA Guide
gucuguuucauacgugcccu

SEQ ID NO: 22358 - RNA, 20 nt, Artificial Sequence
  ELANE RNA Guide
guuucauacgugcccugggu

SEQ ID NO: 22359 - RNA, 20 nt, Artificial Sequence
  ELANE RNA Guide
uaugaaacagacgccggccu

SEQ ID NO: 22360 - RNA, 20 nt, Artificial Sequence
  ELANE RNA Guide
ucauacgugcccuggguguc

SEQ ID NO: 22361 - RNA, 20 nt, Artificial Sequence
  ELANE RNA Guide
ucuguuucauacgugcccug

SEQ ID NO: 22362 - RNA, 20 nt, Artificial Sequence
  ELANE RNA Guide
uguuucauacgugcccuggg

SEQ ID NO: 22363 - RNA, 20 nt, Artificial Sequence
  ELANE RNA Guide
uucauacgugcccugggugu

SEQ ID NO: 22364 - RNA, 20 nt, Artificial Sequence
  ELANE RNA Guide
uuucauacgugcccugggug

SEQ ID NO: 22365 - RNA, 21 nt, Artificial Sequence
  ELANE RNA Guide
acacccagggcacguaugaaa

SEQ ID NO: 22366 - RNA, 21 nt, Artificial Sequence
  ELANE RNA Guide
acccagggcacguaugaaaca

SEQ ID NO: 22367 - RNA, 21 nt, Artificial Sequence
  ELANE RNA Guide
acguaugaaacagacgccggc

SEQ ID NO: 22368 - RNA, 21 nt, Artificial Sequence
  ELANE RNA Guide
agagggacacccagggcacgu

SEQ ID NO: 22369 - RNA, 21 nt, Artificial Sequence
  ELANE RNA Guide
aggccggcgucuguuucauac

SEQ ID NO: 22370 - RNA, 21 nt, Artificial Sequence
  ELANE RNA Guide
agggacacccagggcacguau

SEQ ID NO: 22371 - RNA, 21 nt, Artificial Sequence
  ELANE RNA Guide
agggcacguaugaaacagacg

SEQ ID NO: 22372 - RNA, 21 nt, Artificial Sequence
  ELANE RNA Guide
augaaacagacgccggccugc

SEQ ID NO: 22373 - RNA, 21 nt, Artificial Sequence
  ELANE RNA Guide
cacccagggcacguaugaaac

SEQ ID NO: 22374 - RNA, 21 nt, Artificial Sequence
  ELANE RNA Guide
cacguaugaaacagacgccgg

SEQ ID NO: 22375 - RNA, 21 nt, Artificial Sequence
  ELANE RNA Guide
cagagggacacccagggcacg

SEQ ID NO: 22376 - RNA, 21 nt, Artificial Sequence
  ELANE RNA Guide
caggccggcgucuguuucaua

SEQ ID NO: 22377 - RNA, 21 nt, Artificial Sequence
  ELANE RNA Guide
cagggcacguaugaaacagac

SEQ ID NO: 22378 - RNA, 21 nt, Artificial Sequence
  ELANE RNA Guide
cauacgugcccuggguguccc

SEQ ID NO: 22379 - RNA, 21 nt, Artificial Sequence
  ELANE RNA Guide
ccagggcacguaugaaacaga

SEQ ID NO: 22380 - RNA, 21 nt, Artificial Sequence
  ELANE RNA Guide
cccagggcacguaugaaacag

SEQ ID NO: 22381 - RNA, 21 nt, Artificial Sequence
  ELANE RNA Guide
ccggcgucuguuucauacgug

SEQ ID NO: 22382 - RNA, 21 nt, Artificial Sequence
  ELANE RNA Guide
cggcaggccggcgucuguuuc

SEQ ID NO: 22383 - RNA, 21 nt, Artificial Sequence
  ELANE RNA Guide
cggcgucuguuucauacgugc

SEQ ID NO: 22384 - RNA, 21 nt, Artificial Sequence
  ELANE RNA Guide
cguaugaaacagacgccggcc

SEQ ID NO: 22385 - RNA, 21 nt, Artificial Sequence
  ELANE RNA Guide
cgucuguuucauacgugcccu

SEQ ID NO: 22386 - RNA, 21 nt, Artificial Sequence
  ELANE RNA Guide
cuguuucauacgugcccuggg

SEQ ID NO: 22387 - RNA, 21 nt, Artificial Sequence
  ELANE RNA Guide
gacacccagggcacguaugaa

SEQ ID NO: 22388 - RNA, 21 nt, Artificial Sequence
  ELANE RNA Guide
gagggacacccagggcacgua

SEQ ID NO: 22389 - RNA, 21 nt, Artificial Sequence
  ELANE RNA Guide
gcacguaugaaacagacgccg

SEQ ID NO: 22390 - RNA, 21 nt, Artificial Sequence
  ELANE RNA Guide
gcagagggacacccagggcac

SEQ ID NO: 22391 - RNA, 21 nt, Artificial Sequence
  ELANE RNA Guide
gcaggccggcgucuguuucau

SEQ ID NO: 22392 - RNA, 21 nt, Artificial Sequence
  ELANE RNA Guide
gccggcgucuguuucauacgu

SEQ ID NO: 22393 - RNA, 21 nt, Artificial Sequence
  ELANE RNA Guide
gcgucuguuucauacgugccc

SEQ ID NO: 22394 - RNA, 21 nt, Artificial Sequence
  ELANE RNA Guide
ggacacccagggcacguauga

SEQ ID NO: 22395 - RNA, 21 nt, Artificial Sequence
  ELANE RNA Guide
ggcacguaugaaacagacgcc

SEQ ID NO: 22396 - RNA, 21 nt, Artificial Sequence
  ELANE RNA Guide
ggcaggccggcgucuguuuca

SEQ ID NO: 22397 - RNA, 21 nt, Artificial Sequence
  ELANE RNA Guide
ggccggcgucuguuucauacg

SEQ ID NO: 22398 - RNA, 21 nt, Artificial Sequence
  ELANE RNA Guide
ggcgucuguuucauacgugcc

SEQ ID NO: 22399 - RNA, 21 nt, Artificial Sequence
  ELANE RNA Guide
gggacacccagggcacguaug

SEQ ID NO: 22400 - RNA, 21 nt, Artificial Sequence
  ELANE RNA Guide
gggcacguaugaaacagacgc

SEQ ID NO: 22401 - RNA, 21 nt, Artificial Sequence
  ELANE RNA Guide
guaugaaacagacgccggccu

SEQ ID NO: 22402 - RNA, 21 nt, Artificial Sequence
  ELANE RNA Guide
gucuguuucauacgugcccug

SEQ ID NO: 22403 - RNA, 21 nt, Artificial Sequence
  ELANE RNA Guide
guuucauacgugcccugggug

SEQ ID NO: 22404 - RNA, 21 nt, Artificial Sequence
  ELANE RNA Guide
uaugaaacagacgccggccug

SEQ ID NO: 22405 - RNA, 21 nt, Artificial Sequence
  ELANE RNA Guide
ucauacgugcccugggugucc

SEQ ID NO: 22406 - RNA, 21 nt, Artificial Sequence
  ELANE RNA Guide
ucuguuucauacgugcccugg

SEQ ID NO: 22407 - RNA, 21 nt, Artificial Sequence
  ELANE RNA Guide
uguuucauacgugcccugggu

SEQ ID NO: 22408 - RNA, 21 nt, Artificial Sequence
  ELANE RNA Guide
uucauacgugcccuggguguc

SEQ ID NO: 22409 - RNA, 21 nt, Artificial Sequence
  ELANE RNA Guide
uuucauacgugcccugggugu

SEQ ID NO: 22410 - RNA, 22 nt, Artificial Sequence
  ELANE RNA Guide
acacccagggcacguaugaaac

SEQ ID NO: 22411 - RNA, 22 nt, Artificial Sequence
  ELANE RNA Guide
acccagggcacguaugaaacag

SEQ ID NO: 22412 - RNA, 22 nt, Artificial Sequence
  ELANE RNA Guide
acguaugaaacagacgccggcc

SEQ ID NO: 22413 - RNA, 22 nt, Artificial Sequence
  ELANE RNA Guide
agagggacacccagggcacgua

SEQ ID NO: 22414 - RNA, 22 nt, Artificial Sequence
  ELANE RNA Guide
agcagagggacacccagggcac

SEQ ID NO: 22415 - RNA, 22 nt, Artificial Sequence
  ELANE RNA Guide
aggccggcgucuguuucauacg

SEQ ID NO: 22416 - RNA, 22 nt, Artificial Sequence
  ELANE RNA Guide
agggacacccagggcacguaug

SEQ ID NO: 22417 - RNA, 22 nt, Artificial Sequence
  ELANE RNA Guide
agggcacguaugaaacagacgc

SEQ ID NO: 22418 - RNA, 22 nt, Artificial Sequence
  ELANE RNA Guide
augaaacagacgccggccugcc

SEQ ID NO: 22419 - RNA, 22 nt, Artificial Sequence
  ELANE RNA Guide
cacccagggcacguaugaaaca

SEQ ID NO: 22420 - RNA, 22 nt, Artificial Sequence
  ELANE RNA Guide
cacguaugaaacagacgccggc

SEQ ID NO: 22421 - RNA, 22 nt, Artificial Sequence
  ELANE RNA Guide
cagagggacacccagggcacgu

SEQ ID NO: 22422 - RNA, 22 nt, Artificial Sequence
  ELANE RNA Guide
caggccggcgucuguuucauac

SEQ ID NO: 22423 - RNA, 22 nt, Artificial Sequence
  ELANE RNA Guide
cagggcacguaugaaacagacg

SEQ ID NO: 22424 - RNA, 22 nt, Artificial Sequence
  ELANE RNA Guide
cauacgugcccugggugucccu

SEQ ID NO: 22425 - RNA, 22 nt, Artificial Sequence
  ELANE RNA Guide
ccagggcacguaugaaacagac

SEQ ID NO: 22426 - RNA, 22 nt, Artificial Sequence
  ELANE RNA Guide
cccagggcacguaugaaacaga

SEQ ID NO: 22427 - RNA, 22 nt, Artificial Sequence
  ELANE RNA Guide
ccggcaggccggcgucuguuuc

SEQ ID NO: 22428 - RNA, 22 nt, Artificial Sequence
  ELANE RNA Guide
ccggcgucuguuucauacgugc

SEQ ID NO: 22429 - RNA, 22 nt, Artificial Sequence
  ELANE RNA Guide
cggcaggccggcgucuguuuca

SEQ ID NO: 22430 - RNA, 22 nt, Artificial Sequence
  ELANE RNA Guide
cggcgucuguuucauacgugcc

SEQ ID NO: 22431 - RNA, 22 nt, Artificial Sequence
  ELANE RNA Guide
cguaugaaacagacgccggccu

SEQ ID NO: 22432 - RNA, 22 nt, Artificial Sequence
  ELANE RNA Guide
cgucuguuucauacgugcccug

SEQ ID NO: 22433 - RNA, 22 nt, Artificial Sequence
  ELANE RNA Guide
cuguuucauacgugcccugggu

SEQ ID NO: 22434 - RNA, 22 nt, Artificial Sequence
  ELANE RNA Guide
gacacccagggcacguaugaaa

SEQ ID NO: 22435 - RNA, 22 nt, Artificial Sequence
  ELANE RNA Guide
gagggacacccagggcacguau

SEQ ID NO: 22436 - RNA, 22 nt, Artificial Sequence
  ELANE RNA Guide
gcacguaugaaacagacgccgg

SEQ ID NO: 22437 - RNA, 22 nt, Artificial Sequence
  ELANE RNA Guide
gcagagggacacccagggcacg

SEQ ID NO: 22438 - RNA, 22 nt, Artificial Sequence
  ELANE RNA Guide
gcaggccggcgucuguuucaua

SEQ ID NO: 22439 - RNA, 22 nt, Artificial Sequence
  ELANE RNA Guide
gccggcgucuguuucauacgug

SEQ ID NO: 22440 - RNA, 22 nt, Artificial Sequence
  ELANE RNA Guide
gcgucuguuucauacgugcccu

SEQ ID NO: 22441 - RNA, 22 nt, Artificial Sequence
  ELANE RNA Guide
ggacacccagggcacguaugaa

SEQ ID NO: 22442 - RNA, 22 nt, Artificial Sequence
  ELANE RNA Guide
ggcacguaugaaacagacgccg

SEQ ID NO: 22443 - RNA, 22 nt, Artificial Sequence
  ELANE RNA Guide
ggcaggccggcgucuguuucau

SEQ ID NO: 22444 - RNA, 22 nt, Artificial Sequence
  ELANE RNA Guide
ggccggcgucuguuucauacgu

SEQ ID NO: 22445 - RNA, 22 nt, Artificial Sequence
  ELANE RNA Guide
ggcgucuguuucauacgugccc

SEQ ID NO: 22446 - RNA, 22 nt, Artificial Sequence
  ELANE RNA Guide
gggacacccagggcacguauga

SEQ ID NO: 22447 - RNA, 22 nt, Artificial Sequence
  ELANE RNA Guide
gggcacguaugaaacagacgcc

SEQ ID NO: 22448 - RNA, 22 nt, Artificial Sequence
  ELANE RNA Guide
guaugaaacagacgccggccug

SEQ ID NO: 22449 - RNA, 22 nt, Artificial Sequence
  ELANE RNA Guide
gucuguuucauacgugcccugg

SEQ ID NO: 22450 - RNA, 22 nt, Artificial Sequence
  ELANE RNA Guide
guuucauacgugcccugggugu

SEQ ID NO: 22451 - RNA, 22 nt, Artificial Sequence
  ELANE RNA Guide
uaugaaacagacgccggccugc

SEQ ID NO: 22452 - RNA, 22 nt, Artificial Sequence
  ELANE RNA Guide
ucauacgugcccuggguguccc

SEQ ID NO: 22453 - RNA, 22 nt, Artificial Sequence
  ELANE RNA Guide
ucuguuucauacgugcccuggg

SEQ ID NO: 22454 - RNA, 22 nt, Artificial Sequence
  ELANE RNA Guide
uguuucauacgugcccugggug

SEQ ID NO: 22455 - RNA, 22 nt, Artificial Sequence
  ELANE RNA Guide
uucauacgugcccugggugucc

SEQ ID NO: 22456 - RNA, 22 nt, Artificial Sequence
  ELANE RNA Guide
uuucauacgugcccuggguguc

SEQ ID NO: 22457 - RNA, 20 nt, Artificial Sequence
  ELANE RNA Guide
acacccagggcacguaggaa

SEQ ID NO: 22458 - RNA, 20 nt, Artificial Sequence
  ELANE RNA Guide
acccagggcacguaggaaac

SEQ ID NO: 22459 - RNA, 20 nt, Artificial Sequence
  ELANE RNA Guide
acguaggaaacagacgccgg

SEQ ID NO: 22460 - RNA, 20 nt, Artificial Sequence
  ELANE RNA Guide
aggaaacagacgccggccug

SEQ ID NO: 22461 - RNA, 20 nt, Artificial Sequence
  ELANE RNA Guide
aggccggcgucuguuuccua

SEQ ID NO: 22462 - RNA, 20 nt, Artificial Sequence
  ELANE RNA Guide
agggcacguaggaaacagac

SEQ ID NO: 22463 - RNA, 20 nt, Artificial Sequence
  ELANE RNA Guide
cacccagggcacguaggaaa

SEQ ID NO: 22464 - RNA, 20 nt, Artificial Sequence
  ELANE RNA Guide
cacguaggaaacagacgccg

SEQ ID NO: 22465 - RNA, 20 nt, Artificial Sequence
  ELANE RNA Guide
caggccggcgucuguuuccu

SEQ ID NO: 22466 - RNA, 20 nt, Artificial Sequence
  ELANE RNA Guide
cagggcacguaggaaacaga

SEQ ID NO: 22467 - RNA, 20 nt, Artificial Sequence
  ELANE RNA Guide
ccagggcacguaggaaacag

SEQ ID NO: 22468 - RNA, 20 nt, Artificial Sequence
  ELANE RNA Guide
cccagggcacguaggaaaca

SEQ ID NO: 22469 - RNA, 20 nt, Artificial Sequence
  ELANE RNA Guide
ccggcgucuguuuccuacgu

SEQ ID NO: 22470 - RNA, 20 nt, Artificial Sequence
  ELANE RNA Guide
ccuacgugcccugggugucc

SEQ ID NO: 22471 - RNA, 20 nt, Artificial Sequence
  ELANE RNA Guide
cggcgucuguuuccuacgug

SEQ ID NO: 22472 - RNA, 20 nt, Artificial Sequence
  ELANE RNA Guide
cguaggaaacagacgccggc

SEQ ID NO: 22473 - RNA, 20 nt, Artificial Sequence
  ELANE RNA Guide
cgucuguuuccuacgugccc

SEQ ID NO: 22474 - RNA, 20 nt, Artificial Sequence
  ELANE RNA Guide
cuguuuccuacgugcccugg

SEQ ID NO: 22475 - RNA, 20 nt, Artificial Sequence
  ELANE RNA Guide
gacacccagggcacguagga

SEQ ID NO: 22476 - RNA, 20 nt, Artificial Sequence
  ELANE RNA Guide
gcacguaggaaacagacgcc

SEQ ID NO: 22477 - RNA, 20 nt, Artificial Sequence
  ELANE RNA Guide
gcaggccggcgucuguuucc

SEQ ID NO: 22478 - RNA, 20 nt, Artificial Sequence
  ELANE RNA Guide
gccggcgucuguuuccuacg

SEQ ID NO: 22479 - RNA, 20 nt, Artificial Sequence
  ELANE RNA Guide
gcgucuguuuccuacgugcc

SEQ ID NO: 22480 - RNA, 20 nt, Artificial Sequence
  ELANE RNA Guide
ggacacccagggcacguagg

SEQ ID NO: 22481 - RNA, 20 nt, Artificial Sequence
  ELANE RNA Guide
ggcacguaggaaacagacgc

SEQ ID NO: 22482 - RNA, 20 nt, Artificial Sequence
  ELANE RNA Guide
ggccggcgucuguuuccuac

SEQ ID NO: 22483 - RNA, 20 nt, Artificial Sequence
  ELANE RNA Guide
ggcgucuguuuccuacgugc

SEQ ID NO: 22484 - RNA, 20 nt, Artificial Sequence
  ELANE RNA Guide
gggacacccagggcacguag

SEQ ID NO: 22485 - RNA, 20 nt, Artificial Sequence
  ELANE RNA Guide
gggcacguaggaaacagacg

SEQ ID NO: 22486 - RNA, 20 nt, Artificial Sequence
  ELANE RNA Guide
guaggaaacagacgccggcc

SEQ ID NO: 22487 - RNA, 20 nt, Artificial Sequence
  ELANE RNA Guide
gucuguuuccuacgugcccu

SEQ ID NO: 22488 - RNA, 20 nt, Artificial Sequence
  ELANE RNA Guide
guuuccuacgugcccugggu

SEQ ID NO: 22489 - RNA, 20 nt, Artificial Sequence
  ELANE RNA Guide
uaggaaacagacgccggccu

SEQ ID NO: 22490 - RNA, 20 nt, Artificial Sequence
  ELANE RNA Guide
uccuacgugcccuggguguc

SEQ ID NO: 22491 - RNA, 20 nt, Artificial Sequence
  ELANE RNA Guide
ucuguuuccuacgugcccug

SEQ ID NO: 22492 - RNA, 20 nt, Artificial Sequence
  ELANE RNA Guide
uguuuccuacgugcccuggg

SEQ ID NO: 22493 - RNA, 20 nt, Artificial Sequence
  ELANE RNA Guide
uuccuacgugcccugggugu

SEQ ID NO: 22494 - RNA, 20 nt, Artificial Sequence
  ELANE RNA Guide
uuuccuacgugcccugggug

SEQ ID NO: 22495 - RNA, 21 nt, Artificial Sequence
  ELANE RNA Guide
acacccagggcacguaggaaa

SEQ ID NO: 22496 - RNA, 21 nt, Artificial Sequence
  ELANE RNA Guide
acccagggcacguaggaaaca

SEQ ID NO: 22497 - RNA, 21 nt, Artificial Sequence
  ELANE RNA Guide
acguaggaaacagacgccggc

SEQ ID NO: 22498 - RNA, 21 nt, Artificial Sequence
  ELANE RNA Guide
aggaaacagacgccggccugc

SEQ ID NO: 22499 - RNA, 21 nt, Artificial Sequence
  ELANE RNA Guide
aggccggcgucuguuuccuac

SEQ ID NO: 22500 - RNA, 21 nt, Artificial Sequence
  ELANE RNA Guide
agggacacccagggcacguag

SEQ ID NO: 22501 - RNA, 21 nt, Artificial Sequence
  ELANE RNA Guide
agggcacguaggaaacagacg

SEQ ID NO: 22502 - RNA, 21 nt, Artificial Sequence
  ELANE RNA Guide
cacccagggcacguaggaaac

SEQ ID NO: 22503 - RNA, 21 nt, Artificial Sequence
  ELANE RNA Guide
cacguaggaaacagacgccgg

SEQ ID NO: 22504 - RNA, 21 nt, Artificial Sequence
  ELANE RNA Guide
caggccggcgucuguuuccua

SEQ ID NO: 22505 - RNA, 21 nt, Artificial Sequence
  ELANE RNA Guide
cagggcacguaggaaacagac

SEQ ID NO: 22506 - RNA, 21 nt, Artificial Sequence
  ELANE RNA Guide
ccagggcacguaggaaacaga

SEQ ID NO: 22507 - RNA, 21 nt, Artificial Sequence
  ELANE RNA Guide
cccagggcacguaggaaacag

SEQ ID NO: 22508 - RNA, 21 nt, Artificial Sequence
  ELANE RNA Guide
ccggcgucuguuuccuacgug

SEQ ID NO: 22509 - RNA, 21 nt, Artificial Sequence
  ELANE RNA Guide
ccuacgugcccuggguguccc

SEQ ID NO: 22510 - RNA, 21 nt, Artificial Sequence
  ELANE RNA Guide
cggcgucuguuuccuacgugc

SEQ ID NO: 22511 - RNA, 21 nt, Artificial Sequence
  ELANE RNA Guide
cguaggaaacagacgccggcc

SEQ ID NO: 22512 - RNA, 21 nt, Artificial Sequence
  ELANE RNA Guide
cgucuguuuccuacgugcccu

SEQ ID NO: 22513 - RNA, 21 nt, Artificial Sequence
  ELANE RNA Guide
cuguuuccuacgugcccuggg

SEQ ID NO: 22514 - RNA, 21 nt, Artificial Sequence
  ELANE RNA Guide
gacacccagggcacguaggaa

SEQ ID NO: 22515 - RNA, 21 nt, Artificial Sequence
  ELANE RNA Guide
gcacguaggaaacagacgccg

SEQ ID NO: 22516 - RNA, 21 nt, Artificial Sequence
  ELANE RNA Guide
gcaggccggcgucuguuuccu

SEQ ID NO: 22517 - RNA, 21 nt, Artificial Sequence
  ELANE RNA Guide
gccggcgucuguuuccuacgu

SEQ ID NO: 22518 - RNA, 21 nt, Artificial Sequence
  ELANE RNA Guide
gcgucuguuuccuacgugccc

SEQ ID NO: 22519 - RNA, 21 nt, Artificial Sequence
  ELANE RNA Guide
ggacacccagggcacguagga

SEQ ID NO: 22520 - RNA, 21 nt, Artificial Sequence
  ELANE RNA Guide
ggcacguaggaaacagacgcc

SEQ ID NO: 22521 - RNA, 21 nt, Artificial Sequence
  ELANE RNA Guide
ggcaggccggcgucuguuucc

SEQ ID NO: 22522 - RNA, 21 nt, Artificial Sequence
  ELANE RNA Guide
ggccggcgucuguuuccuacg

SEQ ID NO: 22523 - RNA, 21 nt, Artificial Sequence
  ELANE RNA Guide
ggcgucuguuuccuacgugcc

SEQ ID NO: 22524 - RNA, 21 nt, Artificial Sequence
  ELANE RNA Guide
gggacacccagggcacguagg

SEQ ID NO: 22525 - RNA, 21 nt, Artificial Sequence
  ELANE RNA Guide
gggcacguaggaaacagacgc

SEQ ID NO: 22526 - RNA, 21 nt, Artificial Sequence
  ELANE RNA Guide
guaggaaacagacgccggccu

SEQ ID NO: 22527 - RNA, 21 nt, Artificial Sequence
  ELANE RNA Guide
gucuguuuccuacgugcccug

SEQ ID NO: 22528 - RNA, 21 nt, Artificial Sequence
  ELANE RNA Guide
guuuccuacgugcccugggug

SEQ ID NO: 22529 - RNA, 21 nt, Artificial Sequence
  ELANE RNA Guide
uaggaaacagacgccggccug

SEQ ID NO: 22530 - RNA, 21 nt, Artificial Sequence
  ELANE RNA Guide
uccuacgugcccugggugucc

SEQ ID NO: 22531 - RNA, 21 nt, Artificial Sequence
  ELANE RNA Guide
ucuguuuccuacgugcccugg

SEQ ID NO: 22532 - RNA, 21 nt, Artificial Sequence
  ELANE RNA Guide
uguuuccuacgugcccugggu

SEQ ID NO: 22533 - RNA, 21 nt, Artificial Sequence
  ELANE RNA Guide
uuccuacgugcccuggguguc

SEQ ID NO: 22534 - RNA, 21 nt, Artificial Sequence
  ELANE RNA Guide
uuuccuacgugcccugggugu

SEQ ID NO: 22535 - RNA, 22 nt, Artificial Sequence
  ELANE RNA Guide
acacccagggcacguaggaaac

SEQ ID NO: 22536 - RNA, 22 nt, Artificial Sequence
  ELANE RNA Guide
acccagggcacguaggaaacag

SEQ ID NO: 22537 - RNA, 22 nt, Artificial Sequence
  ELANE RNA Guide
acguaggaaacagacgccggcc

SEQ ID NO: 22538 - RNA, 22 nt, Artificial Sequence
  ELANE RNA Guide
aggaaacagacgccggccugcc

SEQ ID NO: 22539 - RNA, 22 nt, Artificial Sequence
  ELANE RNA Guide
aggccggcgucuguuuccuacg

SEQ ID NO: 22540 - RNA, 22 nt, Artificial Sequence
  ELANE RNA Guide
agggacacccagggcacguagg

SEQ ID NO: 22541 - RNA, 22 nt, Artificial Sequence
  ELANE RNA Guide
agggcacguaggaaacagacgc

SEQ ID NO: 22542 - RNA, 22 nt, Artificial Sequence
  ELANE RNA Guide
cacccagggcacguaggaaaca

SEQ ID NO: 22543 - RNA, 22 nt, Artificial Sequence
  ELANE RNA Guide
cacguaggaaacagacgccggc

SEQ ID NO: 22544 - RNA, 22 nt, Artificial Sequence
  ELANE RNA Guide
caggccggcgucuguuuccuac

SEQ ID NO: 22545 - RNA, 22 nt, Artificial Sequence
  ELANE RNA Guide
cagggcacguaggaaacagacg

SEQ ID NO: 22546 - RNA, 22 nt, Artificial Sequence
  ELANE RNA Guide
ccagggcacguaggaaacagac

SEQ ID NO: 22547 - RNA, 22 nt, Artificial Sequence
  ELANE RNA Guide
cccagggcacguaggaaacaga

SEQ ID NO: 22548 - RNA, 22 nt, Artificial Sequence
  ELANE RNA Guide
ccggcgucuguuuccuacgugc

SEQ ID NO: 22549 - RNA, 22 nt, Artificial Sequence
  ELANE RNA Guide
ccuacgugcccugggugucccu

SEQ ID NO: 22550 - RNA, 22 nt, Artificial Sequence
  ELANE RNA Guide
cggcaggccggcgucuguuucc

SEQ ID NO: 22551 - RNA, 22 nt, Artificial Sequence
  ELANE RNA Guide
cggcgucuguuuccuacgugcc

SEQ ID NO: 22552 - RNA, 22 nt, Artificial Sequence
  ELANE RNA Guide
cguaggaaacagacgccggccu

SEQ ID NO: 22553 - RNA, 22 nt, Artificial Sequence
  ELANE RNA Guide
cgucuguuuccuacgugcccug

SEQ ID NO: 22554 - RNA, 22 nt, Artificial Sequence
  ELANE RNA Guide
cuguuuccuacgugcccugggu

SEQ ID NO: 22555 - RNA, 22 nt, Artificial Sequence
  ELANE RNA Guide
gacacccagggcacguaggaaa

SEQ ID NO: 22556 - RNA, 22 nt, Artificial Sequence
  ELANE RNA Guide
gagggacacccagggcacguag

SEQ ID NO: 22557 - RNA, 22 nt, Artificial Sequence
  ELANE RNA Guide
gcacguaggaaacagacgccgg

SEQ ID NO: 22558 - RNA, 22 nt, Artificial Sequence
  ELANE RNA Guide
gcaggccggcgucuguuuccua

SEQ ID NO: 22559 - RNA, 22 nt, Artificial Sequence
  ELANE RNA Guide
gccggcgucuguuuccuacgug

SEQ ID NO: 22560 - RNA, 22 nt, Artificial Sequence
  ELANE RNA Guide
gcgucuguuuccuacgugcccu

SEQ ID NO: 22561 - RNA, 22 nt, Artificial Sequence
  ELANE RNA Guide
ggacacccagggcacguaggaa

SEQ ID NO: 22562 - RNA, 22 nt, Artificial Sequence
  ELANE RNA Guide
ggcacguaggaaacagacgccg

SEQ ID NO: 22563 - RNA, 22 nt, Artificial Sequence
  ELANE RNA Guide
ggcaggccggcgucuguuuccu

SEQ ID NO: 22564 - RNA, 22 nt, Artificial Sequence
  ELANE RNA Guide
ggccggcgucuguuuccuacgu

SEQ ID NO: 22565 - RNA, 22 nt, Artificial Sequence
  ELANE RNA Guide
ggcgucuguuuccuacgugccc

SEQ ID NO: 22566 - RNA, 22 nt, Artificial Sequence
  ELANE RNA Guide
gggacacccagggcacguagga

SEQ ID NO: 22567 - RNA, 22 nt, Artificial Sequence
  ELANE RNA Guide
gggcacguaggaaacagacgcc

SEQ ID NO: 22568 - RNA, 22 nt, Artificial Sequence
  ELANE RNA Guide
guaggaaacagacgccggccug

SEQ ID NO: 22569 - RNA, 22 nt, Artificial Sequence
  ELANE RNA Guide
gucuguuuccuacgugcccugg

SEQ ID NO: 22570 - RNA, 22 nt, Artificial Sequence
  ELANE RNA Guide
guuuccuacgugcccugggugu

SEQ ID NO: 22571 - RNA, 22 nt, Artificial Sequence
  ELANE RNA Guide
uaggaaacagacgccggccugc

SEQ ID NO: 22572 - RNA, 22 nt, Artificial Sequence
  ELANE RNA Guide
uccuacgugcccuggguguccc

SEQ ID NO: 22573 - RNA, 22 nt, Artificial Sequence
  ELANE RNA Guide
ucuguuuccuacgugcccuggg

SEQ ID NO: 22574 - RNA, 22 nt, Artificial Sequence
  ELANE RNA Guide
uguuuccuacgugcccugggug

SEQ ID NO: 22575 - RNA, 22 nt, Artificial Sequence
  ELANE RNA Guide
uuccuacgugcccugggugucc

SEQ ID NO: 22576 - RNA, 22 nt, Artificial Sequence
  ELANE RNA Guide
uuuccuacgugcccuggguguc

SEQ ID NO: 22577 - RNA, 20 nt, Artificial Sequence
  ELANE RNA Guide
aagaaacagacgccggccug

SEQ ID NO: 22578 - RNA, 20 nt, Artificial Sequence
  ELANE RNA Guide
acacccagggcacguaagaa

SEQ ID NO: 22579 - RNA, 20 nt, Artificial Sequence
  ELANE RNA Guide
acccagggcacguaagaaac

SEQ ID NO: 22580 - RNA, 20 nt, Artificial Sequence
  ELANE RNA Guide
acguaagaaacagacgccgg

SEQ ID NO: 22581 - RNA, 20 nt, Artificial Sequence
  ELANE RNA Guide
aggccggcgucuguuucuua

SEQ ID NO: 22582 - RNA, 20 nt, Artificial Sequence
  ELANE RNA Guide
agggcacguaagaaacagac

SEQ ID NO: 22583 - RNA, 20 nt, Artificial Sequence
  ELANE RNA Guide
cacccagggcacguaagaaa

SEQ ID NO: 22584 - RNA, 20 nt, Artificial Sequence
  ELANE RNA Guide
cacguaagaaacagacgccg

SEQ ID NO: 22585 - RNA, 20 nt, Artificial Sequence
  ELANE RNA Guide
caggccggcgucuguuucuu

SEQ ID NO: 22586 - RNA, 20 nt, Artificial Sequence
  ELANE RNA Guide
cagggcacguaagaaacaga

SEQ ID NO: 22587 - RNA, 20 nt, Artificial Sequence
  ELANE RNA Guide
ccagggcacguaagaaacag

SEQ ID NO: 22588 - RNA, 20 nt, Artificial Sequence
  ELANE RNA Guide
cccagggcacguaagaaaca

SEQ ID NO: 22589 - RNA, 20 nt, Artificial Sequence
  ELANE RNA Guide
ccggcgucuguuucuuacgu

SEQ ID NO: 22590 - RNA, 20 nt, Artificial Sequence
  ELANE RNA Guide
cggcgucuguuucuuacgug

SEQ ID NO: 22591 - RNA, 20 nt, Artificial Sequence
  ELANE RNA Guide
cguaagaaacagacgccggc

SEQ ID NO: 22592 - RNA, 20 nt, Artificial Sequence
  ELANE RNA Guide
cgucuguuucuuacgugccc

SEQ ID NO: 22593 - RNA, 20 nt, Artificial Sequence
  ELANE RNA Guide
cuguuucuuacgugcccugg

SEQ ID NO: 22594 - RNA, 20 nt, Artificial Sequence
  ELANE RNA Guide
cuuacgugcccugggugucc

SEQ ID NO: 22595 - RNA, 20 nt, Artificial Sequence
  ELANE RNA Guide
gacacccagggcacguaaga

SEQ ID NO: 22596 - RNA, 20 nt, Artificial Sequence
  ELANE RNA Guide
gcacguaagaaacagacgcc

SEQ ID NO: 22597 - RNA, 20 nt, Artificial Sequence
  ELANE RNA Guide
gcaggccggcgucuguuucu

SEQ ID NO: 22598 - RNA, 20 nt, Artificial Sequence
  ELANE RNA Guide
gccggcgucuguuucuuacg

SEQ ID NO: 22599 - RNA, 20 nt, Artificial Sequence
  ELANE RNA Guide
gcgucuguuucuuacgugcc

SEQ ID NO: 22600 - RNA, 20 nt, Artificial Sequence
  ELANE RNA Guide
ggacacccagggcacguaag

SEQ ID NO: 22601 - RNA, 20 nt, Artificial Sequence
  ELANE RNA Guide
ggcacguaagaaacagacgc

SEQ ID NO: 22602 - RNA, 20 nt, Artificial Sequence
  ELANE RNA Guide
ggccggcgucuguuucuuac

SEQ ID NO: 22603 - RNA, 20 nt, Artificial Sequence
  ELANE RNA Guide
ggcgucuguuucuuacgugc

SEQ ID NO: 22604 - RNA, 20 nt, Artificial Sequence
  ELANE RNA Guide
gggacacccagggcacguaa

SEQ ID NO: 22605 - RNA, 20 nt, Artificial Sequence
  ELANE RNA Guide
gggcacguaagaaacagacg

SEQ ID NO: 22606 - RNA, 20 nt, Artificial Sequence
  ELANE RNA Guide
guaagaaacagacgccggcc

SEQ ID NO: 22607 - RNA, 20 nt, Artificial Sequence
  ELANE RNA Guide
gucuguuucuuacgugcccu

SEQ ID NO: 22608 - RNA, 20 nt, Artificial Sequence
  ELANE RNA Guide
guuucuuacgugcccugggu

SEQ ID NO: 22609 - RNA, 20 nt, Artificial Sequence
  ELANE RNA Guide
uaagaaacagacgccggccu

SEQ ID NO: 22610 - RNA, 20 nt, Artificial Sequence
  ELANE RNA Guide
ucuguuucuuacgugcccug

SEQ ID NO: 22611 - RNA, 20 nt, Artificial Sequence
  ELANE RNA Guide
ucuuacgugcccuggguguc

SEQ ID NO: 22612 - RNA, 20 nt, Artificial Sequence
  ELANE RNA Guide
uguuucuuacgugcccuggg

SEQ ID NO: 22613 - RNA, 20 nt, Artificial Sequence
  ELANE RNA Guide
uucuuacgugcccugggugu

SEQ ID NO: 22614 - RNA, 20 nt, Artificial Sequence
  ELANE RNA Guide
uuucuuacgugcccugggug

SEQ ID NO: 22615 - RNA, 21 nt, Artificial Sequence
  ELANE RNA Guide
aagaaacagacgccggccugc

SEQ ID NO: 22616 - RNA, 21 nt, Artificial Sequence
  ELANE RNA Guide
acacccagggcacguaagaaa

SEQ ID NO: 22617 - RNA, 21 nt, Artificial Sequence
  ELANE RNA Guide
acccagggcacguaagaaaca

SEQ ID NO: 22618 - RNA, 21 nt, Artificial Sequence
  ELANE RNA Guide
acguaagaaacagacgccggc

SEQ ID NO: 22619 - RNA, 21 nt, Artificial Sequence
  ELANE RNA Guide
aggccggcgucuguuucuuac

SEQ ID NO: 22620 - RNA, 21 nt, Artificial Sequence
  ELANE RNA Guide
agggacacccagggcacguaa

SEQ ID NO: 22621 - RNA, 21 nt, Artificial Sequence
  ELANE RNA Guide
agggcacguaagaaacagacg

SEQ ID NO: 22622 - RNA, 21 nt, Artificial Sequence
  ELANE RNA Guide
cacccagggcacguaagaaac

SEQ ID NO: 22623 - RNA, 21 nt, Artificial Sequence
  ELANE RNA Guide
cacguaagaaacagacgccgg

SEQ ID NO: 22624 - RNA, 21 nt, Artificial Sequence
  ELANE RNA Guide
caggccggcgucuguuucuua

SEQ ID NO: 22625 - RNA, 21 nt, Artificial Sequence
  ELANE RNA Guide
cagggcacguaagaaacagac

SEQ ID NO: 22626 - RNA, 21 nt, Artificial Sequence
  ELANE RNA Guide
ccagggcacguaagaaacaga

SEQ ID NO: 22627 - RNA, 21 nt, Artificial Sequence
  ELANE RNA Guide
cccagggcacguaagaaacag

SEQ ID NO: 22628 - RNA, 21 nt, Artificial Sequence
  ELANE RNA Guide
ccggcgucuguuucuuacgug

SEQ ID NO: 22629 - RNA, 21 nt, Artificial Sequence
  ELANE RNA Guide
cggcgucuguuucuuacgugc

SEQ ID NO: 22630 - RNA, 21 nt, Artificial Sequence
  ELANE RNA Guide
cguaagaaacagacgccggcc

SEQ ID NO: 22631 - RNA, 21 nt, Artificial Sequence
  ELANE RNA Guide
cgucuguuucuuacgugcccu

SEQ ID NO: 22632 - RNA, 21 nt, Artificial Sequence
  ELANE RNA Guide
cuguuucuuacgugcccuggg

SEQ ID NO: 22633 - RNA, 21 nt, Artificial Sequence
  ELANE RNA Guide
cuuacgugcccuggguguccc

SEQ ID NO: 22634 - RNA, 21 nt, Artificial Sequence
  ELANE RNA Guide
gacacccagggcacguaagaa

SEQ ID NO: 22635 - RNA, 21 nt, Artificial Sequence
  ELANE RNA Guide
gcacguaagaaacagacgccg

SEQ ID NO: 22636 - RNA, 21 nt, Artificial Sequence
  ELANE RNA Guide
gcaggccggcgucuguuucuu

SEQ ID NO: 22637 - RNA, 21 nt, Artificial Sequence
  ELANE RNA Guide
gccggcgucuguuucuuacgu

SEQ ID NO: 22638 - RNA, 21 nt, Artificial Sequence
  ELANE RNA Guide
gcgucuguuucuuacgugccc

SEQ ID NO: 22639 - RNA, 21 nt, Artificial Sequence
  ELANE RNA Guide
ggacacccagggcacguaaga

SEQ ID NO: 22640 - RNA, 21 nt, Artificial Sequence
  ELANE RNA Guide
ggcacguaagaaacagacgcc

SEQ ID NO: 22641 - RNA, 21 nt, Artificial Sequence
  ELANE RNA Guide
ggcaggccggcgucuguuucu

SEQ ID NO: 22642 - RNA, 21 nt, Artificial Sequence
  ELANE RNA Guide
ggccggcgucuguuucuuacg

SEQ ID NO: 22643 - RNA, 21 nt, Artificial Sequence
  ELANE RNA Guide
ggcgucuguuucuuacgugcc

SEQ ID NO: 22644 - RNA, 21 nt, Artificial Sequence
  ELANE RNA Guide
gggacacccagggcacguaag

SEQ ID NO: 22645 - RNA, 21 nt, Artificial Sequence
  ELANE RNA Guide
gggcacguaagaaacagacgc

SEQ ID NO: 22646 - RNA, 21 nt, Artificial Sequence
  ELANE RNA Guide
guaagaaacagacgccggccu

SEQ ID NO: 22647 - RNA, 21 nt, Artificial Sequence
  ELANE RNA Guide
gucuguuucuuacgugcccug

SEQ ID NO: 22648 - RNA, 21 nt, Artificial Sequence
  ELANE RNA Guide
guuucuuacgugcccugggug

SEQ ID NO: 22649 - RNA, 21 nt, Artificial Sequence
  ELANE RNA Guide
uaagaaacagacgccggccug

SEQ ID NO: 22650 - RNA, 21 nt, Artificial Sequence
  ELANE RNA Guide
ucuguuucuuacgugcccugg

SEQ ID NO: 22651 - RNA, 21 nt, Artificial Sequence
  ELANE RNA Guide
ucuuacgugcccugggugucc

SEQ ID NO: 22652 - RNA, 21 nt, Artificial Sequence
  ELANE RNA Guide
uguuucuuacgugcccugggu

SEQ ID NO: 22653 - RNA, 21 nt, Artificial Sequence
  ELANE RNA Guide
uucuuacgugcccuggguguc

SEQ ID NO: 22654 - RNA, 21 nt, Artificial Sequence
  ELANE RNA Guide
uuucuuacgugcccugggugu

SEQ ID NO: 22655 - RNA, 22 nt, Artificial Sequence
  ELANE RNA Guide
aagaaacagacgccggccugcc

SEQ ID NO: 22656 - RNA, 22 nt, Artificial Sequence
  ELANE RNA Guide
acacccagggcacguaagaaac

SEQ ID NO: 22657 - RNA, 22 nt, Artificial Sequence
  ELANE RNA Guide
acccagggcacguaagaaacag

SEQ ID NO: 22658 - RNA, 22 nt, Artificial Sequence
  ELANE RNA Guide
acguaagaaacagacgccggcc

SEQ ID NO: 22659 - RNA, 22 nt, Artificial Sequence
  ELANE RNA Guide
aggccggcgucuguuucuuacg

SEQ ID NO: 22660 - RNA, 22 nt, Artificial Sequence
  ELANE RNA Guide
agggacacccagggcacguaag

SEQ ID NO: 22661 - RNA, 22 nt, Artificial Sequence
  ELANE RNA Guide
agggcacguaagaaacagacgc

SEQ ID NO: 22662 - RNA, 22 nt, Artificial Sequence
  ELANE RNA Guide
cacccagggcacguaagaaaca

SEQ ID NO: 22663 - RNA, 22 nt, Artificial Sequence
  ELANE RNA Guide
cacguaagaaacagacgccggc

SEQ ID NO: 22664 - RNA, 22 nt, Artificial Sequence
  ELANE RNA Guide
caggccggcgucuguuucuuac

SEQ ID NO: 22665 - RNA, 22 nt, Artificial Sequence
  ELANE RNA Guide
cagggcacguaagaaacagacg

SEQ ID NO: 22666 - RNA, 22 nt, Artificial Sequence
  ELANE RNA Guide
ccagggcacguaagaaacagac

SEQ ID NO: 22667 - RNA, 22 nt, Artificial Sequence
  ELANE RNA Guide
cccagggcacguaagaaacaga

SEQ ID NO: 22668 - RNA, 22 nt, Artificial Sequence
  ELANE RNA Guide
ccggcgucuguuucuuacgugc

SEQ ID NO: 22669 - RNA, 22 nt, Artificial Sequence
  ELANE RNA Guide
cggcaggccggcgucuguuucu

SEQ ID NO: 22670 - RNA, 22 nt, Artificial Sequence
  ELANE RNA Guide
cggcgucuguuucuuacgugcc

SEQ ID NO: 22671 - RNA, 22 nt, Artificial Sequence
  ELANE RNA Guide
cguaagaaacagacgccggccu

SEQ ID NO: 22672 - RNA, 22 nt, Artificial Sequence
  ELANE RNA Guide
cgucuguuucuuacgugcccug

SEQ ID NO: 22673 - RNA, 22 nt, Artificial Sequence
  ELANE RNA Guide
cuguuucuuacgugcccugggu

SEQ ID NO: 22674 - RNA, 22 nt, Artificial Sequence
  ELANE RNA Guide
cuuacgugcccugggugucccu

SEQ ID NO: 22675 - RNA, 22 nt, Artificial Sequence
  ELANE RNA Guide
gacacccagggcacguaagaaa

SEQ ID NO: 22676 - RNA, 22 nt, Artificial Sequence
  ELANE RNA Guide
gagggacacccagggcacguaa

SEQ ID NO: 22677 - RNA, 22 nt, Artificial Sequence
  ELANE RNA Guide
gcacguaagaaacagacgccgg

SEQ ID NO: 22678 - RNA, 22 nt, Artificial Sequence
  ELANE RNA Guide
gcaggccggcgucuguuucuua

SEQ ID NO: 22679 - RNA, 22 nt, Artificial Sequence
  ELANE RNA Guide
gccggcgucuguuucuuacgug

SEQ ID NO: 22680 - RNA, 22 nt, Artificial Sequence
  ELANE RNA Guide
gcgucuguuucuuacgugcccu

SEQ ID NO: 22681 - RNA, 22 nt, Artificial Sequence
  ELANE RNA Guide
ggacacccagggcacguaagaa

SEQ ID NO: 22682 - RNA, 22 nt, Artificial Sequence
  ELANE RNA Guide
ggcacguaagaaacagacgccg

SEQ ID NO: 22683 - RNA, 22 nt, Artificial Sequence
  ELANE RNA Guide
ggcaggccggcgucuguuucuu

SEQ ID NO: 22684 - RNA, 22 nt, Artificial Sequence
  ELANE RNA Guide
ggccggcgucuguuucuuacgu

SEQ ID NO: 22685 - RNA, 22 nt, Artificial Sequence
  ELANE RNA Guide
ggcgucuguuucuuacgugccc

SEQ ID NO: 22686 - RNA, 22 nt, Artificial Sequence
  ELANE RNA Guide
gggacacccagggcacguaaga

SEQ ID NO: 22687 - RNA, 22 nt, Artificial Sequence
  ELANE RNA Guide
gggcacguaagaaacagacgcc

SEQ ID NO: 22688 - RNA, 22 nt, Artificial Sequence
  ELANE RNA Guide
guaagaaacagacgccggccug

SEQ ID NO: 22689 - RNA, 22 nt, Artificial Sequence
  ELANE RNA Guide
gucuguuucuuacgugcccugg

SEQ ID NO: 22690 - RNA, 22 nt, Artificial Sequence
  ELANE RNA Guide
guuucuuacgugcccugggugu

SEQ ID NO: 22691 - RNA, 22 nt, Artificial Sequence
  ELANE RNA Guide
uaagaaacagacgccggccugc

SEQ ID NO: 22692 - RNA, 22 nt, Artificial Sequence
  ELANE RNA Guide
ucuguuucuuacgugcccuggg

SEQ ID NO: 22693 - RNA, 22 nt, Artificial Sequence
  ELANE RNA Guide
ucuuacgugcccuggguguccc

SEQ ID NO: 22694 - RNA, 22 nt, Artificial Sequence
  ELANE RNA Guide
uguuucuuacgugcccugggug

SEQ ID NO: 22695 - RNA, 22 nt, Artificial Sequence
  ELANE RNA Guide
uucuuacgugcccugggugucc

SEQ ID NO: 22696 - RNA, 22 nt, Artificial Sequence
  ELANE RNA Guide
uuucuuacgugcccuggguguc

SEQ ID NO: 22697 - RNA, 20 nt, Artificial Sequence
  ELANE RNA Guide
acacccagggcacgaacgaa

SEQ ID NO: 22698 - RNA, 20 nt, Artificial Sequence
  ELANE RNA Guide
acccagggcacgaacgaaac

SEQ ID NO: 22699 - RNA, 20 nt, Artificial Sequence
  ELANE RNA Guide
acgaacgaaacagacgccgg

SEQ ID NO: 22700 - RNA, 20 nt, Artificial Sequence
  ELANE RNA Guide
agcagagggacacccagggc

SEQ ID NO: 22701 - RNA, 20 nt, Artificial Sequence
  ELANE RNA Guide
aggccggcgucuguuucguu

SEQ ID NO: 22702 - RNA, 20 nt, Artificial Sequence
  ELANE RNA Guide
agggacacccagggcacgaa

SEQ ID NO: 22703 - RNA, 20 nt, Artificial Sequence
  ELANE RNA Guide
agggcacgaacgaaacagac

SEQ ID NO: 22704 - RNA, 20 nt, Artificial Sequence
  ELANE RNA Guide
cacccagggcacgaacgaaa

SEQ ID NO: 22705 - RNA, 20 nt, Artificial Sequence
  ELANE RNA Guide
cacgaacgaaacagacgccg

SEQ ID NO: 22706 - RNA, 20 nt, Artificial Sequence
  ELANE RNA Guide
caggccggcgucuguuucgu

SEQ ID NO: 22707 - RNA, 20 nt, Artificial Sequence
  ELANE RNA Guide
cagggcacgaacgaaacaga

SEQ ID NO: 22708 - RNA, 20 nt, Artificial Sequence
  ELANE RNA Guide
ccagggcacgaacgaaacag

SEQ ID NO: 22709 - RNA, 20 nt, Artificial Sequence
  ELANE RNA Guide
cccagggcacgaacgaaaca

SEQ ID NO: 22710 - RNA, 20 nt, Artificial Sequence
  ELANE RNA Guide
ccggcgucuguuucguucgu

SEQ ID NO: 22711 - RNA, 20 nt, Artificial Sequence
  ELANE RNA Guide
cgaacgaaacagacgccggc

SEQ ID NO: 22712 - RNA, 20 nt, Artificial Sequence
  ELANE RNA Guide
cggcgucuguuucguucgug

SEQ ID NO: 22713 - RNA, 20 nt, Artificial Sequence
  ELANE RNA Guide
cgucuguuucguucgugccc

SEQ ID NO: 22714 - RNA, 20 nt, Artificial Sequence
  ELANE RNA Guide
cguucgugcccugggugucc

SEQ ID NO: 22715 - RNA, 20 nt, Artificial Sequence
  ELANE RNA Guide
cuguuucguucgugcccugg

SEQ ID NO: 22716 - RNA, 20 nt, Artificial Sequence
  ELANE RNA Guide
gaacgaaacagacgccggcc

SEQ ID NO: 22717 - RNA, 20 nt, Artificial Sequence
  ELANE RNA Guide
gacacccagggcacgaacga

SEQ ID NO: 22718 - RNA, 20 nt, Artificial Sequence
  ELANE RNA Guide
gagggacacccagggcacga

SEQ ID NO: 22719 - RNA, 20 nt, Artificial Sequence
  ELANE RNA Guide
gcacgaacgaaacagacgcc

SEQ ID NO: 22720 - RNA, 20 nt, Artificial Sequence
  ELANE RNA Guide
gcagagggacacccagggca

SEQ ID NO: 22721 - RNA, 20 nt, Artificial Sequence
  ELANE RNA Guide
gcaggccggcgucuguuucg

SEQ ID NO: 22722 - RNA, 20 nt, Artificial Sequence
  ELANE RNA Guide
gccggcgucuguuucguucg

SEQ ID NO: 22723 - RNA, 20 nt, Artificial Sequence
  ELANE RNA Guide
gcgucuguuucguucgugcc

SEQ ID NO: 22724 - RNA, 20 nt, Artificial Sequence
  ELANE RNA Guide
ggacacccagggcacgaacg

SEQ ID NO: 22725 - RNA, 20 nt, Artificial Sequence
  ELANE RNA Guide
ggcacgaacgaaacagacgc

SEQ ID NO: 22726 - RNA, 20 nt, Artificial Sequence
  ELANE RNA Guide
ggccggcgucuguuucguuc

SEQ ID NO: 22727 - RNA, 20 nt, Artificial Sequence
  ELANE RNA Guide
ggcgucuguuucguucgugc

SEQ ID NO: 22728 - RNA, 20 nt, Artificial Sequence
  ELANE RNA Guide
gggacacccagggcacgaac

SEQ ID NO: 22729 - RNA, 20 nt, Artificial Sequence
  ELANE RNA Guide
gggcacgaacgaaacagacg

SEQ ID NO: 22730 - RNA, 20 nt, Artificial Sequence
  ELANE RNA Guide
gucuguuucguucgugcccu

SEQ ID NO: 22731 - RNA, 20 nt, Artificial Sequence
  ELANE RNA Guide
guucgugcccuggguguccc

SEQ ID NO: 22732 - RNA, 20 nt, Artificial Sequence
  ELANE RNA Guide
guuucguucgugcccugggu

SEQ ID NO: 22733 - RNA, 20 nt, Artificial Sequence
  ELANE RNA Guide
ucguucgugcccuggguguc

SEQ ID NO: 22734 - RNA, 20 nt, Artificial Sequence
  ELANE RNA Guide
ucuguuucguucgugcccug

SEQ ID NO: 22735 - RNA, 20 nt, Artificial Sequence
  ELANE RNA Guide
uguuucguucgugcccuggg

SEQ ID NO: 22736 - RNA, 20 nt, Artificial Sequence
  ELANE RNA Guide
uucgugcccugggugucccu

SEQ ID NO: 22737 - RNA, 20 nt, Artificial Sequence
  ELANE RNA Guide
uucguucgugcccugggugu

SEQ ID NO: 22738 - RNA, 20 nt, Artificial Sequence
  ELANE RNA Guide
uuucguucgugcccugggug

SEQ ID NO: 22739 - RNA, 21 nt, Artificial Sequence
  ELANE RNA Guide
acacccagggcacgaacgaaa

SEQ ID NO: 22740 - RNA, 21 nt, Artificial Sequence
  ELANE RNA Guide
acccagggcacgaacgaaaca

SEQ ID NO: 22741 - RNA, 21 nt, Artificial Sequence
  ELANE RNA Guide
acgaacgaaacagacgccggc

SEQ ID NO: 22742 - RNA, 21 nt, Artificial Sequence
  ELANE RNA Guide
agagggacacccagggcacga

SEQ ID NO: 22743 - RNA, 21 nt, Artificial Sequence
  ELANE RNA Guide
agcagagggacacccagggca

SEQ ID NO: 22744 - RNA, 21 nt, Artificial Sequence
  ELANE RNA Guide
aggccggcgucuguuucguuc

SEQ ID NO: 22745 - RNA, 21 nt, Artificial Sequence
  ELANE RNA Guide
agggacacccagggcacgaac

SEQ ID NO: 22746 - RNA, 21 nt, Artificial Sequence
  ELANE RNA Guide
agggcacgaacgaaacagacg

SEQ ID NO: 22747 - RNA, 21 nt, Artificial Sequence
  ELANE RNA Guide
cacccagggcacgaacgaaac

SEQ ID NO: 22748 - RNA, 21 nt, Artificial Sequence
  ELANE RNA Guide
cacgaacgaaacagacgccgg

SEQ ID NO: 22749 - RNA, 21 nt, Artificial Sequence
  ELANE RNA Guide
caggccggcgucuguuucguu

SEQ ID NO: 22750 - RNA, 21 nt, Artificial Sequence
  ELANE RNA Guide
cagggcacgaacgaaacagac

SEQ ID NO: 22751 - RNA, 21 nt, Artificial Sequence
  ELANE RNA Guide
ccagggcacgaacgaaacaga

SEQ ID NO: 22752 - RNA, 21 nt, Artificial Sequence
  ELANE RNA Guide
cccagggcacgaacgaaacag

SEQ ID NO: 22753 - RNA, 21 nt, Artificial Sequence
  ELANE RNA Guide
ccggcgucuguuucguucgug

SEQ ID NO: 22754 - RNA, 21 nt, Artificial Sequence
  ELANE RNA Guide
cgaacgaaacagacgccggcc

SEQ ID NO: 22755 - RNA, 21 nt, Artificial Sequence
  ELANE RNA Guide
cggcgucuguuucguucgugc

SEQ ID NO: 22756 - RNA, 21 nt, Artificial Sequence
  ELANE RNA Guide
cgucuguuucguucgugcccu

SEQ ID NO: 22757 - RNA, 21 nt, Artificial Sequence
  ELANE RNA Guide
cguucgugcccuggguguccc

SEQ ID NO: 22758 - RNA, 21 nt, Artificial Sequence
  ELANE RNA Guide
cuguuucguucgugcccuggg

SEQ ID NO: 22759 - RNA, 21 nt, Artificial Sequence
  ELANE RNA Guide
gaacgaaacagacgccggccu

SEQ ID NO: 22760 - RNA, 21 nt, Artificial Sequence
  ELANE RNA Guide
gacacccagggcacgaacgaa

SEQ ID NO: 22761 - RNA, 21 nt, Artificial Sequence
  ELANE RNA Guide
gagcagagggacacccagggc

SEQ ID NO: 22762 - RNA, 21 nt, Artificial Sequence
  ELANE RNA Guide
gagggacacccagggcacgaa

SEQ ID NO: 22763 - RNA, 21 nt, Artificial Sequence
  ELANE RNA Guide
gcacgaacgaaacagacgccg

SEQ ID NO: 22764 - RNA, 21 nt, Artificial Sequence
  ELANE RNA Guide
gcaggccggcgucuguuucgu

SEQ ID NO: 22765 - RNA, 21 nt, Artificial Sequence
  ELANE RNA Guide
gccggcgucuguuucguucgu

SEQ ID NO: 22766 - RNA, 21 nt, Artificial Sequence
  ELANE RNA Guide
gcgucuguuucguucgugccc

SEQ ID NO: 22767 - RNA, 21 nt, Artificial Sequence
  ELANE RNA Guide
ggacacccagggcacgaacga

SEQ ID NO: 22768 - RNA, 21 nt, Artificial Sequence
  ELANE RNA Guide
ggcacgaacgaaacagacgcc

SEQ ID NO: 22769 - RNA, 21 nt, Artificial Sequence
  ELANE RNA Guide
ggcaggccggcgucuguuucg

SEQ ID NO: 22770 - RNA, 21 nt, Artificial Sequence
  ELANE RNA Guide
ggccggcgucuguuucguucg

SEQ ID NO: 22771 - RNA, 21 nt, Artificial Sequence
  ELANE RNA Guide
ggcgucuguuucguucgugcc

SEQ ID NO: 22772 - RNA, 21 nt, Artificial Sequence
  ELANE RNA Guide
gggacacccagggcacgaacg

SEQ ID NO: 22773 - RNA, 21 nt, Artificial Sequence
  ELANE RNA Guide
gggcacgaacgaaacagacgc

SEQ ID NO: 22774 - RNA, 21 nt, Artificial Sequence
  ELANE RNA Guide
gucuguuucguucgugcccug

SEQ ID NO: 22775 - RNA, 21 nt, Artificial Sequence
  ELANE RNA Guide
guucgugcccugggugucccu

SEQ ID NO: 22776 - RNA, 21 nt, Artificial Sequence
  ELANE RNA Guide
guuucguucgugcccugggug

SEQ ID NO: 22777 - RNA, 21 nt, Artificial Sequence
  ELANE RNA Guide
ucguucgugcccugggugucc

SEQ ID NO: 22778 - RNA, 21 nt, Artificial Sequence
  ELANE RNA Guide
ucuguuucguucgugcccugg

SEQ ID NO: 22779 - RNA, 21 nt, Artificial Sequence
  ELANE RNA Guide
uguuucguucgugcccugggu

SEQ ID NO: 22780 - RNA, 21 nt, Artificial Sequence
  ELANE RNA Guide
uucgugcccugggugucccuc

SEQ ID NO: 22781 - RNA, 21 nt, Artificial Sequence
  ELANE RNA Guide
uucguucgugcccuggguguc

SEQ ID NO: 22782 - RNA, 21 nt, Artificial Sequence
  ELANE RNA Guide
uuucguucgugcccugggugu

SEQ ID NO: 22783 - RNA, 22 nt, Artificial Sequence
  ELANE RNA Guide
acacccagggcacgaacgaaac

SEQ ID NO: 22784 - RNA, 22 nt, Artificial Sequence
  ELANE RNA Guide
acccagggcacgaacgaaacag

SEQ ID NO: 22785 - RNA, 22 nt, Artificial Sequence
  ELANE RNA Guide
acgaacgaaacagacgccggcc

SEQ ID NO: 22786 - RNA, 22 nt, Artificial Sequence
  ELANE RNA Guide
agagggacacccagggcacgaa

SEQ ID NO: 22787 - RNA, 22 nt, Artificial Sequence
  ELANE RNA Guide
aggccggcgucuguuucguucg

SEQ ID NO: 22788 - RNA, 22 nt, Artificial Sequence
  ELANE RNA Guide
agggacacccagggcacgaacg

SEQ ID NO: 22789 - RNA, 22 nt, Artificial Sequence
  ELANE RNA Guide
agggcacgaacgaaacagacgc

SEQ ID NO: 22790 - RNA, 22 nt, Artificial Sequence
  ELANE RNA Guide
cacccagggcacgaacgaaaca

SEQ ID NO: 22791 - RNA, 22 nt, Artificial Sequence
  ELANE RNA Guide
cacgaacgaaacagacgccggc

SEQ ID NO: 22792 - RNA, 22 nt, Artificial Sequence
  ELANE RNA Guide
cagagggacacccagggcacga

SEQ ID NO: 22793 - RNA, 22 nt, Artificial Sequence
  ELANE RNA Guide
caggccggcgucuguuucguuc

SEQ ID NO: 22794 - RNA, 22 nt, Artificial Sequence
  ELANE RNA Guide
cagggcacgaacgaaacagacg

SEQ ID NO: 22795 - RNA, 22 nt, Artificial Sequence
  ELANE RNA Guide
ccagggcacgaacgaaacagac

SEQ ID NO: 22796 - RNA, 22 nt, Artificial Sequence
  ELANE RNA Guide
cccagggcacgaacgaaacaga

SEQ ID NO: 22797 - RNA, 22 nt, Artificial Sequence
  ELANE RNA Guide
ccggcgucuguuucguucgugc

SEQ ID NO: 22798 - RNA, 22 nt, Artificial Sequence
  ELANE RNA Guide
cgaacgaaacagacgccggccu

SEQ ID NO: 22799 - RNA, 22 nt, Artificial Sequence
  ELANE RNA Guide
cggcaggccggcgucuguuucg

SEQ ID NO: 22800 - RNA, 22 nt, Artificial Sequence
  ELANE RNA Guide
cggcgucuguuucguucgugcc

SEQ ID NO: 22801 - RNA, 22 nt, Artificial Sequence
  ELANE RNA Guide
cgucuguuucguucgugcccug

SEQ ID NO: 22802 - RNA, 22 nt, Artificial Sequence
  ELANE RNA Guide
cguucgugcccugggugucccu

SEQ ID NO: 22803 - RNA, 22 nt, Artificial Sequence
  ELANE RNA Guide
cuguuucguucgugcccugggu

SEQ ID NO: 22804 - RNA, 22 nt, Artificial Sequence
  ELANE RNA Guide
gaacgaaacagacgccggccug

SEQ ID NO: 22805 - RNA, 22 nt, Artificial Sequence
  ELANE RNA Guide
gacacccagggcacgaacgaaa

SEQ ID NO: 22806 - RNA, 22 nt, Artificial Sequence
  ELANE RNA Guide
gagcagagggacacccagggca

SEQ ID NO: 22807 - RNA, 22 nt, Artificial Sequence
  ELANE RNA Guide
gagggacacccagggcacgaac

SEQ ID NO: 22808 - RNA, 22 nt, Artificial Sequence
  ELANE RNA Guide
gcacgaacgaaacagacgccgg

SEQ ID NO: 22809 - RNA, 22 nt, Artificial Sequence
  ELANE RNA Guide
gcaggccggcgucuguuucguu

SEQ ID NO: 22810 - RNA, 22 nt, Artificial Sequence
  ELANE RNA Guide
gccggcgucuguuucguucgug

SEQ ID NO: 22811 - RNA, 22 nt, Artificial Sequence
  ELANE RNA Guide
gcgucuguuucguucgugcccu

SEQ ID NO: 22812 - RNA, 22 nt, Artificial Sequence
  ELANE RNA Guide
ggacacccagggcacgaacgaa

SEQ ID NO: 22813 - RNA, 22 nt, Artificial Sequence
  ELANE RNA Guide
ggagcagagggacacccagggc

SEQ ID NO: 22814 - RNA, 22 nt, Artificial Sequence
  ELANE RNA Guide
ggcacgaacgaaacagacgccg

SEQ ID NO: 22815 - RNA, 22 nt, Artificial Sequence
  ELANE RNA Guide
ggcaggccggcgucuguuucgu

SEQ ID NO: 22816 - RNA, 22 nt, Artificial Sequence
  ELANE RNA Guide
ggccggcgucuguuucguucgu

SEQ ID NO: 22817 - RNA, 22 nt, Artificial Sequence
  ELANE RNA Guide
ggcgucuguuucguucgugccc

SEQ ID NO: 22818 - RNA, 22 nt, Artificial Sequence
  ELANE RNA Guide
gggacacccagggcacgaacga

SEQ ID NO: 22819 - RNA, 22 nt, Artificial Sequence
  ELANE RNA Guide
gggcacgaacgaaacagacgcc

SEQ ID NO: 22820 - RNA, 22 nt, Artificial Sequence
  ELANE RNA Guide
gucuguuucguucgugcccugg

SEQ ID NO: 22821 - RNA, 22 nt, Artificial Sequence
  ELANE RNA Guide
guucgugcccugggugucccuc

SEQ ID NO: 22822 - RNA, 22 nt, Artificial Sequence
  ELANE RNA Guide
guuucguucgugcccugggugu

SEQ ID NO: 22823 - RNA, 22 nt, Artificial Sequence
  ELANE RNA Guide
ucguucgugcccuggguguccc

SEQ ID NO: 22824 - RNA, 22 nt, Artificial Sequence
  ELANE RNA Guide
ucuguuucguucgugcccuggg

SEQ ID NO: 22825 - RNA, 22 nt, Artificial Sequence
  ELANE RNA Guide
uguuucguucgugcccugggug

SEQ ID NO: 22826 - RNA, 22 nt, Artificial Sequence
  ELANE RNA Guide
uucgugcccugggugucccucu

SEQ ID NO: 22827 - RNA, 22 nt, Artificial Sequence
  ELANE RNA Guide
uucguucgugcccugggugucc

SEQ ID NO: 22828 - RNA, 22 nt, Artificial Sequence
  ELANE RNA Guide
uuucguucgugcccuggguguc

SEQ ID NO: 22829 - RNA, 20 nt, Artificial Sequence
  ELANE RNA Guide
acacccagggcauguacgaa

SEQ ID NO: 22830 - RNA, 20 nt, Artificial Sequence
  ELANE RNA Guide
acaugcccugggugucccuc

SEQ ID NO: 22831 - RNA, 20 nt, Artificial Sequence
  ELANE RNA Guide
acccagggcauguacgaaac

SEQ ID NO: 22832 - RNA, 20 nt, Artificial Sequence
  ELANE RNA Guide
agagggacacccagggcaug

SEQ ID NO: 22833 - RNA, 20 nt, Artificial Sequence
  ELANE RNA Guide
aggccggcgucuguuucgua

SEQ ID NO: 22834 - RNA, 20 nt, Artificial Sequence
  ELANE RNA Guide
agggacacccagggcaugua

SEQ ID NO: 22835 - RNA, 20 nt, Artificial Sequence
  ELANE RNA Guide
agggcauguacgaaacagac

SEQ ID NO: 22836 - RNA, 20 nt, Artificial Sequence
  ELANE RNA Guide
auguacgaaacagacgccgg

SEQ ID NO: 22837 - RNA, 20 nt, Artificial Sequence
  ELANE RNA Guide
cacccagggcauguacgaaa

SEQ ID NO: 22838 - RNA, 20 nt, Artificial Sequence
  ELANE RNA Guide
cagagggacacccagggcau

SEQ ID NO: 22839 - RNA, 20 nt, Artificial Sequence
  ELANE RNA Guide
cagggcauguacgaaacaga

SEQ ID NO: 22840 - RNA, 20 nt, Artificial Sequence
  ELANE RNA Guide
caugcccugggugucccucu

SEQ ID NO: 22841 - RNA, 20 nt, Artificial Sequence
  ELANE RNA Guide
cauguacgaaacagacgccg

SEQ ID NO: 22842 - RNA, 20 nt, Artificial Sequence
  ELANE RNA Guide
ccagggcauguacgaaacag

SEQ ID NO: 22843 - RNA, 20 nt, Artificial Sequence
  ELANE RNA Guide
cccagggcauguacgaaaca

SEQ ID NO: 22844 - RNA, 20 nt, Artificial Sequence
  ELANE RNA Guide
ccggcgucuguuucguacau

SEQ ID NO: 22845 - RNA, 20 nt, Artificial Sequence
  ELANE RNA Guide
cggcgucuguuucguacaug

SEQ ID NO: 22846 - RNA, 20 nt, Artificial Sequence
  ELANE RNA Guide
cguacaugcccugggugucc

SEQ ID NO: 22847 - RNA, 20 nt, Artificial Sequence
  ELANE RNA Guide
cgucuguuucguacaugccc

SEQ ID NO: 22848 - RNA, 20 nt, Artificial Sequence
  ELANE RNA Guide
cuguuucguacaugcccugg

SEQ ID NO: 22849 - RNA, 20 nt, Artificial Sequence
  ELANE RNA Guide
gacacccagggcauguacga

SEQ ID NO: 22850 - RNA, 20 nt, Artificial Sequence
  ELANE RNA Guide
gagcagagggacacccaggg

SEQ ID NO: 22851 - RNA, 20 nt, Artificial Sequence
  ELANE RNA Guide
gagggacacccagggcaugu

SEQ ID NO: 22852 - RNA, 20 nt, Artificial Sequence
  ELANE RNA Guide
gcauguacgaaacagacgcc

SEQ ID NO: 22853 - RNA, 20 nt, Artificial Sequence
  ELANE RNA Guide
gccggcgucuguuucguaca

SEQ ID NO: 22854 - RNA, 20 nt, Artificial Sequence
  ELANE RNA Guide
gcgucuguuucguacaugcc

SEQ ID NO: 22855 - RNA, 20 nt, Artificial Sequence
  ELANE RNA Guide
ggacacccagggcauguacg

SEQ ID NO: 22856 - RNA, 20 nt, Artificial Sequence
  ELANE RNA Guide
ggagcagagggacacccagg

SEQ ID NO: 22857 - RNA, 20 nt, Artificial Sequence
  ELANE RNA Guide
ggcauguacgaaacagacgc

SEQ ID NO: 22858 - RNA, 20 nt, Artificial Sequence
  ELANE RNA Guide
ggccggcgucuguuucguac

SEQ ID NO: 22859 - RNA, 20 nt, Artificial Sequence
  ELANE RNA Guide
ggcgucuguuucguacaugc

SEQ ID NO: 22860 - RNA, 20 nt, Artificial Sequence
  ELANE RNA Guide
gggacacccagggcauguac

SEQ ID NO: 22861 - RNA, 20 nt, Artificial Sequence
  ELANE RNA Guide
gggcauguacgaaacagacg

SEQ ID NO: 22862 - RNA, 20 nt, Artificial Sequence
  ELANE RNA Guide
guacaugcccuggguguccc

SEQ ID NO: 22863 - RNA, 20 nt, Artificial Sequence
  ELANE RNA Guide
gucuguuucguacaugcccu

SEQ ID NO: 22864 - RNA, 20 nt, Artificial Sequence
  ELANE RNA Guide
guuucguacaugcccugggu

SEQ ID NO: 22865 - RNA, 20 nt, Artificial Sequence
  ELANE RNA Guide
uacaugcccugggugucccu

SEQ ID NO: 22866 - RNA, 20 nt, Artificial Sequence
  ELANE RNA Guide
ucguacaugcccuggguguc

SEQ ID NO: 22867 - RNA, 20 nt, Artificial Sequence
  ELANE RNA Guide
ucuguuucguacaugcccug

SEQ ID NO: 22868 - RNA, 20 nt, Artificial Sequence
  ELANE RNA Guide
uguuucguacaugcccuggg

SEQ ID NO: 22869 - RNA, 20 nt, Artificial Sequence
  ELANE RNA Guide
uucguacaugcccugggugu

SEQ ID NO: 22870 - RNA, 20 nt, Artificial Sequence
  ELANE RNA Guide
uuucguacaugcccugggug

SEQ ID NO: 22871 - RNA, 21 nt, Artificial Sequence
  ELANE RNA Guide
acacccagggcauguacgaaa

SEQ ID NO: 22872 - RNA, 21 nt, Artificial Sequence
  ELANE RNA Guide
acaugcccugggugucccucu

SEQ ID NO: 22873 - RNA, 21 nt, Artificial Sequence
  ELANE RNA Guide
acccagggcauguacgaaaca

SEQ ID NO: 22874 - RNA, 21 nt, Artificial Sequence
  ELANE RNA Guide
agagggacacccagggcaugu

SEQ ID NO: 22875 - RNA, 21 nt, Artificial Sequence
  ELANE RNA Guide
aggccggcgucuguuucguac

SEQ ID NO: 22876 - RNA, 21 nt, Artificial Sequence
  ELANE RNA Guide
agggacacccagggcauguac

SEQ ID NO: 22877 - RNA, 21 nt, Artificial Sequence
  ELANE RNA Guide
agggcauguacgaaacagacg

SEQ ID NO: 22878 - RNA, 21 nt, Artificial Sequence
  ELANE RNA Guide
auguacgaaacagacgccggc

SEQ ID NO: 22879 - RNA, 21 nt, Artificial Sequence
  ELANE RNA Guide
cacccagggcauguacgaaac

SEQ ID NO: 22880 - RNA, 21 nt, Artificial Sequence
  ELANE RNA Guide
cagagggacacccagggcaug

SEQ ID NO: 22881 - RNA, 21 nt, Artificial Sequence
  ELANE RNA Guide
caggccggcgucuguuucgua

SEQ ID NO: 22882 - RNA, 21 nt, Artificial Sequence
  ELANE RNA Guide
cagggcauguacgaaacagac

SEQ ID NO: 22883 - RNA, 21 nt, Artificial Sequence
  ELANE RNA Guide
caugcccugggugucccucug

SEQ ID NO: 22884 - RNA, 21 nt, Artificial Sequence
  ELANE RNA Guide
cauguacgaaacagacgccgg

SEQ ID NO: 22885 - RNA, 21 nt, Artificial Sequence
  ELANE RNA Guide
ccagggcauguacgaaacaga

SEQ ID NO: 22886 - RNA, 21 nt, Artificial Sequence
  ELANE RNA Guide
cccagggcauguacgaaacag

SEQ ID NO: 22887 - RNA, 21 nt, Artificial Sequence
  ELANE RNA Guide
ccggcgucuguuucguacaug

SEQ ID NO: 22888 - RNA, 21 nt, Artificial Sequence
  ELANE RNA Guide
cggcgucuguuucguacaugc

SEQ ID NO: 22889 - RNA, 21 nt, Artificial Sequence
  ELANE RNA Guide
cguacaugcccuggguguccc

SEQ ID NO: 22890 - RNA, 21 nt, Artificial Sequence
  ELANE RNA Guide
cgucuguuucguacaugcccu

SEQ ID NO: 22891 - RNA, 21 nt, Artificial Sequence
  ELANE RNA Guide
cuguuucguacaugcccuggg

SEQ ID NO: 22892 - RNA, 21 nt, Artificial Sequence
  ELANE RNA Guide
gacacccagggcauguacgaa

SEQ ID NO: 22893 - RNA, 21 nt, Artificial Sequence
  ELANE RNA Guide
gagggacacccagggcaugua

SEQ ID NO: 22894 - RNA, 21 nt, Artificial Sequence
  ELANE RNA Guide
gcagagggacacccagggcau

SEQ ID NO: 22895 - RNA, 21 nt, Artificial Sequence
  ELANE RNA Guide
gcauguacgaaacagacgccg

SEQ ID NO: 22896 - RNA, 21 nt, Artificial Sequence
  ELANE RNA Guide
gccggcgucuguuucguacau

SEQ ID NO: 22897 - RNA, 21 nt, Artificial Sequence
  ELANE RNA Guide
gcgucuguuucguacaugccc

SEQ ID NO: 22898 - RNA, 21 nt, Artificial Sequence
  ELANE RNA Guide
ggacacccagggcauguacga

SEQ ID NO: 22899 - RNA, 21 nt, Artificial Sequence
  ELANE RNA Guide
ggagcagagggacacccaggg

SEQ ID NO: 22900 - RNA, 21 nt, Artificial Sequence
  ELANE RNA Guide
ggcauguacgaaacagacgcc

SEQ ID NO: 22901 - RNA, 21 nt, Artificial Sequence
  ELANE RNA Guide
ggccggcgucuguuucguaca

SEQ ID NO: 22902 - RNA, 21 nt, Artificial Sequence
  ELANE RNA Guide
ggcgucuguuucguacaugcc

SEQ ID NO: 22903 - RNA, 21 nt, Artificial Sequence
  ELANE RNA Guide
gggacacccagggcauguacg

SEQ ID NO: 22904 - RNA, 21 nt, Artificial Sequence
  ELANE RNA Guide
gggagcagagggacacccagg

SEQ ID NO: 22905 - RNA, 21 nt, Artificial Sequence
  ELANE RNA Guide
gggcauguacgaaacagacgc

SEQ ID NO: 22906 - RNA, 21 nt, Artificial Sequence
  ELANE RNA Guide
guacaugcccugggugucccu

SEQ ID NO: 22907 - RNA, 21 nt, Artificial Sequence
  ELANE RNA Guide
gucuguuucguacaugcccug

SEQ ID NO: 22908 - RNA, 21 nt, Artificial Sequence
  ELANE RNA Guide
guuucguacaugcccugggug

SEQ ID NO: 22909 - RNA, 21 nt, Artificial Sequence
  ELANE RNA Guide
uacaugcccugggugucccuc

SEQ ID NO: 22910 - RNA, 21 nt, Artificial Sequence
  ELANE RNA Guide
ucguacaugcccugggugucc

SEQ ID NO: 22911 - RNA, 21 nt, Artificial Sequence
  ELANE RNA Guide
ucuguuucguacaugcccugg

SEQ ID NO: 22912 - RNA, 21 nt, Artificial Sequence
  ELANE RNA Guide
uguuucguacaugcccugggu

SEQ ID NO: 22913 - RNA, 21 nt, Artificial Sequence
  ELANE RNA Guide
uucguacaugcccuggguguc

SEQ ID NO: 22914 - RNA, 21 nt, Artificial Sequence
  ELANE RNA Guide
uuucguacaugcccugggugu

SEQ ID NO: 22915 - RNA, 22 nt, Artificial Sequence
  ELANE RNA Guide
acacccagggcauguacgaaac

SEQ ID NO: 22916 - RNA, 22 nt, Artificial Sequence
  ELANE RNA Guide
acaugcccugggugucccucug

SEQ ID NO: 22917 - RNA, 22 nt, Artificial Sequence
  ELANE RNA Guide
acccagggcauguacgaaacag

SEQ ID NO: 22918 - RNA, 22 nt, Artificial Sequence
  ELANE RNA Guide
agagggacacccagggcaugua

SEQ ID NO: 22919 - RNA, 22 nt, Artificial Sequence
  ELANE RNA Guide
agcagagggacacccagggcau

SEQ ID NO: 22920 - RNA, 22 nt, Artificial Sequence
  ELANE RNA Guide
aggccggcgucuguuucguaca

SEQ ID NO: 22921 - RNA, 22 nt, Artificial Sequence
  ELANE RNA Guide
agggacacccagggcauguacg

SEQ ID NO: 22922 - RNA, 22 nt, Artificial Sequence
  ELANE RNA Guide
agggcauguacgaaacagacgc

SEQ ID NO: 22923 - RNA, 22 nt, Artificial Sequence
  ELANE RNA Guide
auguacgaaacagacgccggcc

SEQ ID NO: 22924 - RNA, 22 nt, Artificial Sequence
  ELANE RNA Guide
cacccagggcauguacgaaaca

SEQ ID NO: 22925 - RNA, 22 nt, Artificial Sequence
  ELANE RNA Guide
cagagggacacccagggcaugu

SEQ ID NO: 22926 - RNA, 22 nt, Artificial Sequence
  ELANE RNA Guide
caggccggcgucuguuucguac

SEQ ID NO: 22927 - RNA, 22 nt, Artificial Sequence
  ELANE RNA Guide
cagggcauguacgaaacagacg

SEQ ID NO: 22928 - RNA, 22 nt, Artificial Sequence
  ELANE RNA Guide
caugcccugggugucccucugc

SEQ ID NO: 22929 - RNA, 22 nt, Artificial Sequence
  ELANE RNA Guide
cauguacgaaacagacgccggc

SEQ ID NO: 22930 - RNA, 22 nt, Artificial Sequence
  ELANE RNA Guide
ccagggcauguacgaaacagac

SEQ ID NO: 22931 - RNA, 22 nt, Artificial Sequence
  ELANE RNA Guide
cccagggcauguacgaaacaga

SEQ ID NO: 22932 - RNA, 22 nt, Artificial Sequence
  ELANE RNA Guide
ccggcgucuguuucguacaugc

SEQ ID NO: 22933 - RNA, 22 nt, Artificial Sequence
  ELANE RNA Guide
cggcgucuguuucguacaugcc

SEQ ID NO: 22934 - RNA, 22 nt, Artificial Sequence
  ELANE RNA Guide
cguacaugcccugggugucccu

SEQ ID NO: 22935 - RNA, 22 nt, Artificial Sequence
  ELANE RNA Guide
cgucuguuucguacaugcccug

SEQ ID NO: 22936 - RNA, 22 nt, Artificial Sequence
  ELANE RNA Guide
cuguuucguacaugcccugggu

SEQ ID NO: 22937 - RNA, 22 nt, Artificial Sequence
  ELANE RNA Guide
gacacccagggcauguacgaaa

SEQ ID NO: 22938 - RNA, 22 nt, Artificial Sequence
  ELANE RNA Guide
gagggacacccagggcauguac

SEQ ID NO: 22939 - RNA, 22 nt, Artificial Sequence
  ELANE RNA Guide
gcagagggacacccagggcaug

SEQ ID NO: 22940 - RNA, 22 nt, Artificial Sequence
  ELANE RNA Guide
gcaggccggcgucuguuucgua

SEQ ID NO: 22941 - RNA, 22 nt, Artificial Sequence
  ELANE RNA Guide
gcauguacgaaacagacgccgg

SEQ ID NO: 22942 - RNA, 22 nt, Artificial Sequence
  ELANE RNA Guide
gccggcgucuguuucguacaug

SEQ ID NO: 22943 - RNA, 22 nt, Artificial Sequence
  ELANE RNA Guide
gcgucuguuucguacaugcccu

SEQ ID NO: 22944 - RNA, 22 nt, Artificial Sequence
  ELANE RNA Guide
ggacacccagggcauguacgaa

SEQ ID NO: 22945 - RNA, 22 nt, Artificial Sequence
  ELANE RNA Guide
ggcauguacgaaacagacgccg

SEQ ID NO: 22946 - RNA, 22 nt, Artificial Sequence
  ELANE RNA Guide
ggccggcgucuguuucguacau

SEQ ID NO: 22947 - RNA, 22 nt, Artificial Sequence
  ELANE RNA Guide
ggcgucuguuucguacaugccc

SEQ ID NO: 22948 - RNA, 22 nt, Artificial Sequence
  ELANE RNA Guide
gggacacccagggcauguacga

SEQ ID NO: 22949 - RNA, 22 nt, Artificial Sequence
  ELANE RNA Guide
gggagcagagggacacccaggg

SEQ ID NO: 22950 - RNA, 22 nt, Artificial Sequence
  ELANE RNA Guide
gggcauguacgaaacagacgcc

SEQ ID NO: 22951 - RNA, 22 nt, Artificial Sequence
  ELANE RNA Guide
ggggagcagagggacacccagg

SEQ ID NO: 22952 - RNA, 22 nt, Artificial Sequence
  ELANE RNA Guide
guacaugcccugggugucccuc

SEQ ID NO: 22953 - RNA, 22 nt, Artificial Sequence
  ELANE RNA Guide
gucuguuucguacaugcccugg

SEQ ID NO: 22954 - RNA, 22 nt, Artificial Sequence
  ELANE RNA Guide
guuucguacaugcccugggugu

SEQ ID NO: 22955 - RNA, 22 nt, Artificial Sequence
  ELANE RNA Guide
uacaugcccugggugucccucu

SEQ ID NO: 22956 - RNA, 22 nt, Artificial Sequence
  ELANE RNA Guide
ucguacaugcccuggguguccc

SEQ ID NO: 22957 - RNA, 22 nt, Artificial Sequence
  ELANE RNA Guide
ucuguuucguacaugcccuggg

SEQ ID NO: 22958 - RNA, 22 nt, Artificial Sequence
  ELANE RNA Guide
uguuucguacaugcccugggug

SEQ ID NO: 22959 - RNA, 22 nt, Artificial Sequence
  ELANE RNA Guide
uucguacaugcccugggugucc

SEQ ID NO: 22960 - RNA, 22 nt, Artificial Sequence
  ELANE RNA Guide
uuucguacaugcccuggguguc

SEQ ID NO: 22961 - RNA, 20 nt, Artificial Sequence
  ELANE RNA Guide
aaguacgaaacagacgccgg

SEQ ID NO: 22962 - RNA, 20 nt, Artificial Sequence
  ELANE RNA Guide
acacccagggcaaguacgaa

SEQ ID NO: 22963 - RNA, 20 nt, Artificial Sequence
  ELANE RNA Guide
acccagggcaaguacgaaac

SEQ ID NO: 22964 - RNA, 20 nt, Artificial Sequence
  ELANE RNA Guide
acuugcccugggugucccuc

SEQ ID NO: 22965 - RNA, 20 nt, Artificial Sequence
  ELANE RNA Guide
agagggacacccagggcaag

SEQ ID NO: 22966 - RNA, 20 nt, Artificial Sequence
  ELANE RNA Guide
agggacacccagggcaagua

SEQ ID NO: 22967 - RNA, 20 nt, Artificial Sequence
  ELANE RNA Guide
agggcaaguacgaaacagac

SEQ ID NO: 22968 - RNA, 20 nt, Artificial Sequence
  ELANE RNA Guide
caaguacgaaacagacgccg

SEQ ID NO: 22969 - RNA, 20 nt, Artificial Sequence
  ELANE RNA Guide
cacccagggcaaguacgaaa

SEQ ID NO: 22970 - RNA, 20 nt, Artificial Sequence
  ELANE RNA Guide
cagagggacacccagggcaa

SEQ ID NO: 22971 - RNA, 20 nt, Artificial Sequence
  ELANE RNA Guide
cagggcaaguacgaaacaga

SEQ ID NO: 22972 - RNA, 20 nt, Artificial Sequence
  ELANE RNA Guide
ccagggcaaguacgaaacag

SEQ ID NO: 22973 - RNA, 20 nt, Artificial Sequence
  ELANE RNA Guide
cccagggcaaguacgaaaca

SEQ ID NO: 22974 - RNA, 20 nt, Artificial Sequence
  ELANE RNA Guide
ccggcgucuguuucguacuu

SEQ ID NO: 22975 - RNA, 20 nt, Artificial Sequence
  ELANE RNA Guide
cggcgucuguuucguacuug

SEQ ID NO: 22976 - RNA, 20 nt, Artificial Sequence
  ELANE RNA Guide
cguacuugcccugggugucc

SEQ ID NO: 22977 - RNA, 20 nt, Artificial Sequence
  ELANE RNA Guide
cgucuguuucguacuugccc

SEQ ID NO: 22978 - RNA, 20 nt, Artificial Sequence
  ELANE RNA Guide
cuguuucguacuugcccugg

SEQ ID NO: 22979 - RNA, 20 nt, Artificial Sequence
  ELANE RNA Guide
cuugcccugggugucccucu

SEQ ID NO: 22980 - RNA, 20 nt, Artificial Sequence
  ELANE RNA Guide
gacacccagggcaaguacga

SEQ ID NO: 22981 - RNA, 20 nt, Artificial Sequence
  ELANE RNA Guide
gagggacacccagggcaagu

SEQ ID NO: 22982 - RNA, 20 nt, Artificial Sequence
  ELANE RNA Guide
gcaaguacgaaacagacgcc

SEQ ID NO: 22983 - RNA, 20 nt, Artificial Sequence
  ELANE RNA Guide
gccggcgucuguuucguacu

SEQ ID NO: 22984 - RNA, 20 nt, Artificial Sequence
  ELANE RNA Guide
gcgucuguuucguacuugcc

SEQ ID NO: 22985 - RNA, 20 nt, Artificial Sequence
  ELANE RNA Guide
ggacacccagggcaaguacg

SEQ ID NO: 22986 - RNA, 20 nt, Artificial Sequence
  ELANE RNA Guide
ggcaaguacgaaacagacgc

SEQ ID NO: 22987 - RNA, 20 nt, Artificial Sequence
  ELANE RNA Guide
ggcgucuguuucguacuugc

SEQ ID NO: 22988 - RNA, 20 nt, Artificial Sequence
  ELANE RNA Guide
gggacacccagggcaaguac

SEQ ID NO: 22989 - RNA, 20 nt, Artificial Sequence
  ELANE RNA Guide
gggcaaguacgaaacagacg

SEQ ID NO: 22990 - RNA, 20 nt, Artificial Sequence
  ELANE RNA Guide
guacuugcccuggguguccc

SEQ ID NO: 22991 - RNA, 20 nt, Artificial Sequence
  ELANE RNA Guide
gucuguuucguacuugcccu

SEQ ID NO: 22992 - RNA, 20 nt, Artificial Sequence
  ELANE RNA Guide
guuucguacuugcccugggu

SEQ ID NO: 22993 - RNA, 20 nt, Artificial Sequence
  ELANE RNA Guide
uacuugcccugggugucccu

SEQ ID NO: 22994 - RNA, 20 nt, Artificial Sequence
  ELANE RNA Guide
ucguacuugcccuggguguc

SEQ ID NO: 22995 - RNA, 20 nt, Artificial Sequence
  ELANE RNA Guide
ucuguuucguacuugcccug

SEQ ID NO: 22996 - RNA, 20 nt, Artificial Sequence
  ELANE RNA Guide
uguuucguacuugcccuggg

SEQ ID NO: 22997 - RNA, 20 nt, Artificial Sequence
  ELANE RNA Guide
uucguacuugcccugggugu

SEQ ID NO: 22998 - RNA, 20 nt, Artificial Sequence
  ELANE RNA Guide
uuucguacuugcccugggug

SEQ ID NO: 22999 - RNA, 21 nt, Artificial Sequence
  ELANE RNA Guide
aaguacgaaacagacgccggc

SEQ ID NO: 23000 - RNA, 21 nt, Artificial Sequence
  ELANE RNA Guide
acacccagggcaaguacgaaa

SEQ ID NO: 23001 - RNA, 21 nt, Artificial Sequence
  ELANE RNA Guide
acccagggcaaguacgaaaca

SEQ ID NO: 23002 - RNA, 21 nt, Artificial Sequence
  ELANE RNA Guide
acuugcccugggugucccucu

SEQ ID NO: 23003 - RNA, 21 nt, Artificial Sequence
  ELANE RNA Guide
agagggacacccagggcaagu

SEQ ID NO: 23004 - RNA, 21 nt, Artificial Sequence
  ELANE RNA Guide
agggacacccagggcaaguac

SEQ ID NO: 23005 - RNA, 21 nt, Artificial Sequence
  ELANE RNA Guide
agggcaaguacgaaacagacg

SEQ ID NO: 23006 - RNA, 21 nt, Artificial Sequence
  ELANE RNA Guide
caaguacgaaacagacgccgg

SEQ ID NO: 23007 - RNA, 21 nt, Artificial Sequence
  ELANE RNA Guide
cacccagggcaaguacgaaac

SEQ ID NO: 23008 - RNA, 21 nt, Artificial Sequence
  ELANE RNA Guide
cagagggacacccagggcaag

SEQ ID NO: 23009 - RNA, 21 nt, Artificial Sequence
  ELANE RNA Guide
cagggcaaguacgaaacagac

SEQ ID NO: 23010 - RNA, 21 nt, Artificial Sequence
  ELANE RNA Guide
ccagggcaaguacgaaacaga

SEQ ID NO: 23011 - RNA, 21 nt, Artificial Sequence
  ELANE RNA Guide
cccagggcaaguacgaaacag

SEQ ID NO: 23012 - RNA, 21 nt, Artificial Sequence
  ELANE RNA Guide
ccggcgucuguuucguacuug

SEQ ID NO: 23013 - RNA, 21 nt, Artificial Sequence
  ELANE RNA Guide
cggcgucuguuucguacuugc

SEQ ID NO: 23014 - RNA, 21 nt, Artificial Sequence
  ELANE RNA Guide
cguacuugcccuggguguccc

SEQ ID NO: 23015 - RNA, 21 nt, Artificial Sequence
  ELANE RNA Guide
cgucuguuucguacuugcccu

SEQ ID NO: 23016 - RNA, 21 nt, Artificial Sequence
  ELANE RNA Guide
cuguuucguacuugcccuggg

SEQ ID NO: 23017 - RNA, 21 nt, Artificial Sequence
  ELANE RNA Guide
cuugcccugggugucccucug

SEQ ID NO: 23018 - RNA, 21 nt, Artificial Sequence
  ELANE RNA Guide
gacacccagggcaaguacgaa

SEQ ID NO: 23019 - RNA, 21 nt, Artificial Sequence
  ELANE RNA Guide
gagggacacccagggcaagua

SEQ ID NO: 23020 - RNA, 21 nt, Artificial Sequence
  ELANE RNA Guide
gcaaguacgaaacagacgccg

SEQ ID NO: 23021 - RNA, 21 nt, Artificial Sequence
  ELANE RNA Guide
gcagagggacacccagggcaa

SEQ ID NO: 23022 - RNA, 21 nt, Artificial Sequence
  ELANE RNA Guide
gccggcgucuguuucguacuu

SEQ ID NO: 23023 - RNA, 21 nt, Artificial Sequence
  ELANE RNA Guide
gcgucuguuucguacuugccc

SEQ ID NO: 23024 - RNA, 21 nt, Artificial Sequence
  ELANE RNA Guide
ggacacccagggcaaguacga

SEQ ID NO: 23025 - RNA, 21 nt, Artificial Sequence
  ELANE RNA Guide
ggcaaguacgaaacagacgcc

SEQ ID NO: 23026 - RNA, 21 nt, Artificial Sequence
  ELANE RNA Guide
ggccggcgucuguuucguacu

SEQ ID NO: 23027 - RNA, 21 nt, Artificial Sequence
  ELANE RNA Guide
ggcgucuguuucguacuugcc

SEQ ID NO: 23028 - RNA, 21 nt, Artificial Sequence
  ELANE RNA Guide
gggacacccagggcaaguacg

SEQ ID NO: 23029 - RNA, 21 nt, Artificial Sequence
  ELANE RNA Guide
gggcaaguacgaaacagacgc

SEQ ID NO: 23030 - RNA, 21 nt, Artificial Sequence
  ELANE RNA Guide
guacuugcccugggugucccu

SEQ ID NO: 23031 - RNA, 21 nt, Artificial Sequence
  ELANE RNA Guide
gucuguuucguacuugcccug

SEQ ID NO: 23032 - RNA, 21 nt, Artificial Sequence
  ELANE RNA Guide
guuucguacuugcccugggug

SEQ ID NO: 23033 - RNA, 21 nt, Artificial Sequence
  ELANE RNA Guide
uacuugcccugggugucccuc

SEQ ID NO: 23034 - RNA, 21 nt, Artificial Sequence
  ELANE RNA Guide
ucguacuugcccugggugucc

SEQ ID NO: 23035 - RNA, 21 nt, Artificial Sequence
  ELANE RNA Guide
ucuguuucguacuugcccugg

SEQ ID NO: 23036 - RNA, 21 nt, Artificial Sequence
  ELANE RNA Guide
uguuucguacuugcccugggu

SEQ ID NO: 23037 - RNA, 21 nt, Artificial Sequence
  ELANE RNA Guide
uucguacuugcccuggguguc

SEQ ID NO: 23038 - RNA, 21 nt, Artificial Sequence
  ELANE RNA Guide
uuucguacuugcccugggugu

SEQ ID NO: 23039 - RNA, 22 nt, Artificial Sequence
  ELANE RNA Guide
aaguacgaaacagacgccggcc

SEQ ID NO: 23040 - RNA, 22 nt, Artificial Sequence
  ELANE RNA Guide
acacccagggcaaguacgaaac

SEQ ID NO: 23041 - RNA, 22 nt, Artificial Sequence
  ELANE RNA Guide
acccagggcaaguacgaaacag

SEQ ID NO: 23042 - RNA, 22 nt, Artificial Sequence
  ELANE RNA Guide
acuugcccugggugucccucug

SEQ ID NO: 23043 - RNA, 22 nt, Artificial Sequence
  ELANE RNA Guide
agagggacacccagggcaagua

SEQ ID NO: 23044 - RNA, 22 nt, Artificial Sequence
  ELANE RNA Guide
agcagagggacacccagggcaa

SEQ ID NO: 23045 - RNA, 22 nt, Artificial Sequence
  ELANE RNA Guide
aggccggcgucuguuucguacu

SEQ ID NO: 23046 - RNA, 22 nt, Artificial Sequence
  ELANE RNA Guide
agggacacccagggcaaguacg

SEQ ID NO: 23047 - RNA, 22 nt, Artificial Sequence
  ELANE RNA Guide
agggcaaguacgaaacagacgc

SEQ ID NO: 23048 - RNA, 22 nt, Artificial Sequence
  ELANE RNA Guide
caaguacgaaacagacgccggc

SEQ ID NO: 23049 - RNA, 22 nt, Artificial Sequence
  ELANE RNA Guide
cacccagggcaaguacgaaaca

SEQ ID NO: 23050 - RNA, 22 nt, Artificial Sequence
  ELANE RNA Guide
cagagggacacccagggcaagu

SEQ ID NO: 23051 - RNA, 22 nt, Artificial Sequence
  ELANE RNA Guide
cagggcaaguacgaaacagacg

SEQ ID NO: 23052 - RNA, 22 nt, Artificial Sequence
  ELANE RNA Guide
ccagggcaaguacgaaacagac

SEQ ID NO: 23053 - RNA, 22 nt, Artificial Sequence
  ELANE RNA Guide
cccagggcaaguacgaaacaga

SEQ ID NO: 23054 - RNA, 22 nt, Artificial Sequence
  ELANE RNA Guide
ccggcgucuguuucguacuugc

SEQ ID NO: 23055 - RNA, 22 nt, Artificial Sequence
  ELANE RNA Guide
cggcgucuguuucguacuugcc

SEQ ID NO: 23056 - RNA, 22 nt, Artificial Sequence
  ELANE RNA Guide
cguacuugcccugggugucccu

SEQ ID NO: 23057 - RNA, 22 nt, Artificial Sequence
  ELANE RNA Guide
cgucuguuucguacuugcccug

SEQ ID NO: 23058 - RNA, 22 nt, Artificial Sequence
  ELANE RNA Guide
cuguuucguacuugcccugggu

SEQ ID NO: 23059 - RNA, 22 nt, Artificial Sequence
  ELANE RNA Guide
cuugcccugggugucccucugc

SEQ ID NO: 23060 - RNA, 22 nt, Artificial Sequence
  ELANE RNA Guide
gacacccagggcaaguacgaaa

SEQ ID NO: 23061 - RNA, 22 nt, Artificial Sequence
  ELANE RNA Guide
gagggacacccagggcaaguac

SEQ ID NO: 23062 - RNA, 22 nt, Artificial Sequence
  ELANE RNA Guide
gcaaguacgaaacagacgccgg

SEQ ID NO: 23063 - RNA, 22 nt, Artificial Sequence
  ELANE RNA Guide
gcagagggacacccagggcaag

SEQ ID NO: 23064 - RNA, 22 nt, Artificial Sequence
  ELANE RNA Guide
gccggcgucuguuucguacuug

SEQ ID NO: 23065 - RNA, 22 nt, Artificial Sequence
  ELANE RNA Guide
gcgucuguuucguacuugcccu

SEQ ID NO: 23066 - RNA, 22 nt, Artificial Sequence
  ELANE RNA Guide
ggacacccagggcaaguacgaa

SEQ ID NO: 23067 - RNA, 22 nt, Artificial Sequence
  ELANE RNA Guide
ggcaaguacgaaacagacgccg

SEQ ID NO: 23068 - RNA, 22 nt, Artificial Sequence
  ELANE RNA Guide
ggccggcgucuguuucguacuu

SEQ ID NO: 23069 - RNA, 22 nt, Artificial Sequence
  ELANE RNA Guide
ggcgucuguuucguacuugccc

SEQ ID NO: 23070 - RNA, 22 nt, Artificial Sequence
  ELANE RNA Guide
gggacacccagggcaaguacga

SEQ ID NO: 23071 - RNA, 22 nt, Artificial Sequence
  ELANE RNA Guide
gggcaaguacgaaacagacgcc

SEQ ID NO: 23072 - RNA, 22 nt, Artificial Sequence
  ELANE RNA Guide
guacuugcccugggugucccuc

SEQ ID NO: 23073 - RNA, 22 nt, Artificial Sequence
  ELANE RNA Guide
gucuguuucguacuugcccugg

SEQ ID NO: 23074 - RNA, 22 nt, Artificial Sequence
  ELANE RNA Guide
guuucguacuugcccugggugu

SEQ ID NO: 23075 - RNA, 22 nt, Artificial Sequence
  ELANE RNA Guide
uacuugcccugggugucccucu

SEQ ID NO: 23076 - RNA, 22 nt, Artificial Sequence
  ELANE RNA Guide
ucguacuugcccuggguguccc

SEQ ID NO: 23077 - RNA, 22 nt, Artificial Sequence
  ELANE RNA Guide
ucuguuucguacuugcccuggg

SEQ ID NO: 23078 - RNA, 22 nt, Artificial Sequence
  ELANE RNA Guide
uguuucguacuugcccugggug

SEQ ID NO: 23079 - RNA, 22 nt, Artificial Sequence
  ELANE RNA Guide
uucguacuugcccugggugucc

SEQ ID NO: 23080 - RNA, 22 nt, Artificial Sequence
  ELANE RNA Guide
uuucguacuugcccuggguguc

SEQ ID NO: 23081 - RNA, 20 nt, Artificial Sequence
  ELANE RNA Guide
aaggggcugccggagucccc

SEQ ID NO: 23082 - RNA, 20 nt, Artificial Sequence
  ELANE RNA Guide
accaaggggcugccggaguc

SEQ ID NO: 23083 - RNA, 20 nt, Artificial Sequence
  ELANE RNA Guide
accuugucugccuccacggg

SEQ ID NO: 23084 - RNA, 20 nt, Artificial Sequence
  ELANE RNA Guide
acggggacuccggcagcccc

SEQ ID NO: 23085 - RNA, 20 nt, Artificial Sequence
  ELANE RNA Guide
aggggcugccggaguccccg

SEQ ID NO: 23086 - RNA, 20 nt, Artificial Sequence
  ELANE RNA Guide
aguccccguggaggcagaca

SEQ ID NO: 23087 - RNA, 20 nt, Artificial Sequence
  ELANE RNA Guide
caaggggcugccggaguccc

SEQ ID NO: 23088 - RNA, 20 nt, Artificial Sequence
  ELANE RNA Guide
caccuugucugccuccacgg

SEQ ID NO: 23089 - RNA, 20 nt, Artificial Sequence
  ELANE RNA Guide
cacggggacuccggcagccc

SEQ ID NO: 23090 - RNA, 20 nt, Artificial Sequence
  ELANE RNA Guide
ccaaggggcugccggagucc

SEQ ID NO: 23091 - RNA, 20 nt, Artificial Sequence
  ELANE RNA Guide
ccaccuugucugccuccacg

SEQ ID NO: 23092 - RNA, 20 nt, Artificial Sequence
  ELANE RNA Guide
ccacggggacuccggcagcc

SEQ ID NO: 23093 - RNA, 20 nt, Artificial Sequence
  ELANE RNA Guide
cccaccuugucugccuccac

SEQ ID NO: 23094 - RNA, 20 nt, Artificial Sequence
  ELANE RNA Guide
ccccaccuugucugccucca

SEQ ID NO: 23095 - RNA, 20 nt, Artificial Sequence
  ELANE RNA Guide
ccccguggaggcagacaagg

SEQ ID NO: 23096 - RNA, 20 nt, Artificial Sequence
  ELANE RNA Guide
cccguggaggcagacaaggu

SEQ ID NO: 23097 - RNA, 20 nt, Artificial Sequence
  ELANE RNA Guide
ccggaguccccguggaggca

SEQ ID NO: 23098 - RNA, 20 nt, Artificial Sequence
  ELANE RNA Guide
ccguggaggcagacaaggug

SEQ ID NO: 23099 - RNA, 20 nt, Artificial Sequence
  ELANE RNA Guide
ccuccacggggacuccggca

SEQ ID NO: 23100 - RNA, 20 nt, Artificial Sequence
  ELANE RNA Guide
ccuugucugccuccacgggg

SEQ ID NO: 23101 - RNA, 20 nt, Artificial Sequence
  ELANE RNA Guide
cggaguccccguggaggcag

SEQ ID NO: 23102 - RNA, 20 nt, Artificial Sequence
  ELANE RNA Guide
cguggaggcagacaaggugg

SEQ ID NO: 23103 - RNA, 20 nt, Artificial Sequence
  ELANE RNA Guide
cuccacggggacuccggcag

SEQ ID NO: 23104 - RNA, 20 nt, Artificial Sequence
  ELANE RNA Guide
cugccggaguccccguggag

SEQ ID NO: 23105 - RNA, 20 nt, Artificial Sequence
  ELANE RNA Guide
cugccuccacggggacuccg

SEQ ID NO: 23106 - RNA, 20 nt, Artificial Sequence
  ELANE RNA Guide
cuugucugccuccacgggga

SEQ ID NO: 23107 - RNA, 20 nt, Artificial Sequence
  ELANE RNA Guide
gaguccccguggaggcagac

SEQ ID NO: 23108 - RNA, 20 nt, Artificial Sequence
  ELANE RNA Guide
gccggaguccccguggaggc

SEQ ID NO: 23109 - RNA, 20 nt, Artificial Sequence
  ELANE RNA Guide
gccuccacggggacuccggc

SEQ ID NO: 23110 - RNA, 20 nt, Artificial Sequence
  ELANE RNA Guide
gcugccggaguccccgugga

SEQ ID NO: 23111 - RNA, 20 nt, Artificial Sequence
  ELANE RNA Guide
ggaguccccguggaggcaga

SEQ ID NO: 23112 - RNA, 20 nt, Artificial Sequence
  ELANE RNA Guide
ggcugccggaguccccgugg

SEQ ID NO: 23113 - RNA, 20 nt, Artificial Sequence
  ELANE RNA Guide
gggcugccggaguccccgug

SEQ ID NO: 23114 - RNA, 20 nt, Artificial Sequence
  ELANE RNA Guide
ggggcugccggaguccccgu

SEQ ID NO: 23115 - RNA, 20 nt, Artificial Sequence
  ELANE RNA Guide
guccccguggaggcagacaa

SEQ ID NO: 23116 - RNA, 20 nt, Artificial Sequence
  ELANE RNA Guide
gucugccuccacggggacuc

SEQ ID NO: 23117 - RNA, 20 nt, Artificial Sequence
  ELANE RNA Guide
uccacggggacuccggcagc

SEQ ID NO: 23118 - RNA, 20 nt, Artificial Sequence
  ELANE RNA Guide
uccccaccuugucugccucc

SEQ ID NO: 23119 - RNA, 20 nt, Artificial Sequence
  ELANE RNA Guide
uccccguggaggcagacaag

SEQ ID NO: 23120 - RNA, 20 nt, Artificial Sequence
  ELANE RNA Guide
ucugccuccacggggacucc

SEQ ID NO: 23121 - RNA, 20 nt, Artificial Sequence
  ELANE RNA Guide
ugccggaguccccguggagg

SEQ ID NO: 23122 - RNA, 20 nt, Artificial Sequence
  ELANE RNA Guide
ugccuccacggggacuccgg

SEQ ID NO: 23123 - RNA, 20 nt, Artificial Sequence
  ELANE RNA Guide
ugucugccuccacggggacu

SEQ ID NO: 23124 - RNA, 20 nt, Artificial Sequence
  ELANE RNA Guide
uuccccaccuugucugccuc

SEQ ID NO: 23125 - RNA, 20 nt, Artificial Sequence
  ELANE RNA Guide
uugucugccuccacggggac

SEQ ID NO: 23126 - RNA, 21 nt, Artificial Sequence
  ELANE RNA Guide
aaggggcugccggaguccccg

SEQ ID NO: 23127 - RNA, 21 nt, Artificial Sequence
  ELANE RNA Guide
accaaggggcugccggagucc

SEQ ID NO: 23128 - RNA, 21 nt, Artificial Sequence
  ELANE RNA Guide
accuugucugccuccacgggg

SEQ ID NO: 23129 - RNA, 21 nt, Artificial Sequence
  ELANE RNA Guide
acggggacuccggcagccccu

SEQ ID NO: 23130 - RNA, 21 nt, Artificial Sequence
  ELANE RNA Guide
aggggcugccggaguccccgu

SEQ ID NO: 23131 - RNA, 21 nt, Artificial Sequence
  ELANE RNA Guide
aguccccguggaggcagacaa

SEQ ID NO: 23132 - RNA, 21 nt, Artificial Sequence
  ELANE RNA Guide
caaggggcugccggagucccc

SEQ ID NO: 23133 - RNA, 21 nt, Artificial Sequence
  ELANE RNA Guide
caccuugucugccuccacggg

SEQ ID NO: 23134 - RNA, 21 nt, Artificial Sequence
  ELANE RNA Guide
ccaaggggcugccggaguccc

SEQ ID NO: 23135 - RNA, 21 nt, Artificial Sequence
  ELANE RNA Guide
ccaccuugucugccuccacgg

SEQ ID NO: 23136 - RNA, 21 nt, Artificial Sequence
  ELANE RNA Guide
cccaccuugucugccuccacg

SEQ ID NO: 23137 - RNA, 21 nt, Artificial Sequence
  ELANE RNA Guide
ccccaccuugucugccuccac

SEQ ID NO: 23138 - RNA, 21 nt, Artificial Sequence
  ELANE RNA Guide
ccccguggaggcagacaaggu

SEQ ID NO: 23139 - RNA, 21 nt, Artificial Sequence
  ELANE RNA Guide
cccguggaggcagacaaggug

SEQ ID NO: 23140 - RNA, 21 nt, Artificial Sequence
  ELANE RNA Guide
ccggaguccccguggaggcag

SEQ ID NO: 23141 - RNA, 21 nt, Artificial Sequence
  ELANE RNA Guide
ccguggaggcagacaaggugg

SEQ ID NO: 23142 - RNA, 21 nt, Artificial Sequence
  ELANE RNA Guide
ccuccacggggacuccggcag

SEQ ID NO: 23143 - RNA, 21 nt, Artificial Sequence
  ELANE RNA Guide
ccuugucugccuccacgggga

SEQ ID NO: 23144 - RNA, 21 nt, Artificial Sequence
  ELANE RNA Guide
cggaguccccguggaggcaga

SEQ ID NO: 23145 - RNA, 21 nt, Artificial Sequence
  ELANE RNA Guide
cguggaggcagacaagguggg

SEQ ID NO: 23146 - RNA, 21 nt, Artificial Sequence
  ELANE RNA Guide
cuccacggggacuccggcagc

SEQ ID NO: 23147 - RNA, 21 nt, Artificial Sequence
  ELANE RNA Guide
cugccggaguccccguggagg

SEQ ID NO: 23148 - RNA, 21 nt, Artificial Sequence
  ELANE RNA Guide
cugccuccacggggacuccgg

SEQ ID NO: 23149 - RNA, 21 nt, Artificial Sequence
  ELANE RNA Guide
cuuccccaccuugucugccuc

SEQ ID NO: 23150 - RNA, 21 nt, Artificial Sequence
  ELANE RNA Guide
cuugucugccuccacggggac

SEQ ID NO: 23151 - RNA, 21 nt, Artificial Sequence
  ELANE RNA Guide
gaccaaggggcugccggaguc

SEQ ID NO: 23152 - RNA, 21 nt, Artificial Sequence
  ELANE RNA Guide
gaguccccguggaggcagaca

SEQ ID NO: 23153 - RNA, 21 nt, Artificial Sequence
  ELANE RNA Guide
gccggaguccccguggaggca

SEQ ID NO: 23154 - RNA, 21 nt, Artificial Sequence
  ELANE RNA Guide
gccuccacggggacuccggca

SEQ ID NO: 23155 - RNA, 21 nt, Artificial Sequence
  ELANE RNA Guide
gcugccggaguccccguggag

SEQ ID NO: 23156 - RNA, 21 nt, Artificial Sequence
  ELANE RNA Guide
ggaguccccguggaggcagac

SEQ ID NO: 23157 - RNA, 21 nt, Artificial Sequence
  ELANE RNA Guide
ggcugccggaguccccgugga

SEQ ID NO: 23158 - RNA, 21 nt, Artificial Sequence
  ELANE RNA Guide
guccccguggaggcagacaag

SEQ ID NO: 23159 - RNA, 21 nt, Artificial Sequence
  ELANE RNA Guide
gucugccuccacggggacucc

SEQ ID NO: 23160 - RNA, 21 nt, Artificial Sequence
  ELANE RNA Guide
uccacggggacuccggcagcc

SEQ ID NO: 23161 - RNA, 21 nt, Artificial Sequence
  ELANE RNA Guide
uccccaccuugucugccucca

SEQ ID NO: 23162 - RNA, 21 nt, Artificial Sequence
  ELANE RNA Guide
uccccguggaggcagacaagg

SEQ ID NO: 23163 - RNA, 21 nt, Artificial Sequence
  ELANE RNA Guide
ucugccuccacggggacuccg

SEQ ID NO: 23164 - RNA, 21 nt, Artificial Sequence
  ELANE RNA Guide
ugccggaguccccguggaggc

SEQ ID NO: 23165 - RNA, 21 nt, Artificial Sequence
  ELANE RNA Guide
ugccuccacggggacuccggc

SEQ ID NO: 23166 - RNA, 21 nt, Artificial Sequence
  ELANE RNA Guide
ugucugccuccacggggacuc

SEQ ID NO: 23167 - RNA, 21 nt, Artificial Sequence
  ELANE RNA Guide
uuccccaccuugucugccucc

SEQ ID NO: 23168 - RNA, 21 nt, Artificial Sequence
  ELANE RNA Guide
uugucugccuccacggggacu

SEQ ID NO: 23169 - RNA, 22 nt, Artificial Sequence
  ELANE RNA Guide
aaggggcugccggaguccccgu

SEQ ID NO: 23170 - RNA, 22 nt, Artificial Sequence
  ELANE RNA Guide
accaaggggcugccggaguccc

SEQ ID NO: 23171 - RNA, 22 nt, Artificial Sequence
  ELANE RNA Guide
accuugucugccuccacgggga

SEQ ID NO: 23172 - RNA, 22 nt, Artificial Sequence
  ELANE RNA Guide
acggggacuccggcagccccuu

SEQ ID NO: 23173 - RNA, 22 nt, Artificial Sequence
  ELANE RNA Guide
agaccaaggggcugccggaguc

SEQ ID NO: 23174 - RNA, 22 nt, Artificial Sequence
  ELANE RNA Guide
aggggcugccggaguccccgug

SEQ ID NO: 23175 - RNA, 22 nt, Artificial Sequence
  ELANE RNA Guide
aguccccguggaggcagacaag

SEQ ID NO: 23176 - RNA, 22 nt, Artificial Sequence
  ELANE RNA Guide
caaggggcugccggaguccccg

SEQ ID NO: 23177 - RNA, 22 nt, Artificial Sequence
  ELANE RNA Guide
caccuugucugccuccacgggg

SEQ ID NO: 23178 - RNA, 22 nt, Artificial Sequence
  ELANE RNA Guide
cacggggacuccggcagccccu

SEQ ID NO: 23179 - RNA, 22 nt, Artificial Sequence
  ELANE RNA Guide
ccaaggggcugccggagucccc

SEQ ID NO: 23180 - RNA, 22 nt, Artificial Sequence
  ELANE RNA Guide
ccaccuugucugccuccacggg

SEQ ID NO: 23181 - RNA, 22 nt, Artificial Sequence
  ELANE RNA Guide
cccaccuugucugccuccacgg

SEQ ID NO: 23182 - RNA, 22 nt, Artificial Sequence
  ELANE RNA Guide
ccccaccuugucugccuccacg

SEQ ID NO: 23183 - RNA, 22 nt, Artificial Sequence
  ELANE RNA Guide
ccccguggaggcagacaaggug

SEQ ID NO: 23184 - RNA, 22 nt, Artificial Sequence
  ELANE RNA Guide
cccguggaggcagacaaggugg

SEQ ID NO: 23185 - RNA, 22 nt, Artificial Sequence
  ELANE RNA Guide
ccggaguccccguggaggcaga

SEQ ID NO: 23186 - RNA, 22 nt, Artificial Sequence
  ELANE RNA Guide
ccguggaggcagacaagguggg

SEQ ID NO: 23187 - RNA, 22 nt, Artificial Sequence
  ELANE RNA Guide
ccuccacggggacuccggcagc

SEQ ID NO: 23188 - RNA, 22 nt, Artificial Sequence
  ELANE RNA Guide
ccuugucugccuccacggggac

SEQ ID NO: 23189 - RNA, 22 nt, Artificial Sequence
  ELANE RNA Guide
cggaguccccguggaggcagac

SEQ ID NO: 23190 - RNA, 22 nt, Artificial Sequence
  ELANE RNA Guide
cguggaggcagacaaggugggg

SEQ ID NO: 23191 - RNA, 22 nt, Artificial Sequence
  ELANE RNA Guide
cuccacggggacuccggcagcc

SEQ ID NO: 23192 - RNA, 22 nt, Artificial Sequence
  ELANE RNA Guide
cugccggaguccccguggaggc

SEQ ID NO: 23193 - RNA, 22 nt, Artificial Sequence
  ELANE RNA Guide
cugccuccacggggacuccggc

SEQ ID NO: 23194 - RNA, 22 nt, Artificial Sequence
  ELANE RNA Guide
cuuccccaccuugucugccucc

SEQ ID NO: 23195 - RNA, 22 nt, Artificial Sequence
  ELANE RNA Guide
cuugucugccuccacggggacu

SEQ ID NO: 23196 - RNA, 22 nt, Artificial Sequence
  ELANE RNA Guide
gaccaaggggcugccggagucc

SEQ ID NO: 23197 - RNA, 22 nt, Artificial Sequence
  ELANE RNA Guide
gaguccccguggaggcagacaa

SEQ ID NO: 23198 - RNA, 22 nt, Artificial Sequence
  ELANE RNA Guide
gccggaguccccguggaggcag

SEQ ID NO: 23199 - RNA, 22 nt, Artificial Sequence
  ELANE RNA Guide
gccuccacggggacuccggcag

SEQ ID NO: 23200 - RNA, 22 nt, Artificial Sequence
  ELANE RNA Guide
gcugccggaguccccguggagg

SEQ ID NO: 23201 - RNA, 22 nt, Artificial Sequence
  ELANE RNA Guide
gcuuccccaccuugucugccuc

SEQ ID NO: 23202 - RNA, 22 nt, Artificial Sequence
  ELANE RNA Guide
ggaguccccguggaggcagaca

SEQ ID NO: 23203 - RNA, 22 nt, Artificial Sequence
  ELANE RNA Guide
ggcugccggaguccccguggag

SEQ ID NO: 23204 - RNA, 22 nt, Artificial Sequence
  ELANE RNA Guide
gggcugccggaguccccgugga

SEQ ID NO: 23205 - RNA, 22 nt, Artificial Sequence
  ELANE RNA Guide
guccccguggaggcagacaagg

SEQ ID NO: 23206 - RNA, 22 nt, Artificial Sequence
  ELANE RNA Guide
gucugccuccacggggacuccg

SEQ ID NO: 23207 - RNA, 22 nt, Artificial Sequence
  ELANE RNA Guide
uccacggggacuccggcagccc

SEQ ID NO: 23208 - RNA, 22 nt, Artificial Sequence
  ELANE RNA Guide
uccccaccuugucugccuccac

SEQ ID NO: 23209 - RNA, 22 nt, Artificial Sequence
  ELANE RNA Guide
uccccguggaggcagacaaggu

SEQ ID NO: 23210 - RNA, 22 nt, Artificial Sequence
  ELANE RNA Guide
ucugccuccacggggacuccgg

SEQ ID NO: 23211 - RNA, 22 nt, Artificial Sequence
  ELANE RNA Guide
ugccggaguccccguggaggca

SEQ ID NO: 23212 - RNA, 22 nt, Artificial Sequence
  ELANE RNA Guide
ugccuccacggggacuccggca

SEQ ID NO: 23213 - RNA, 22 nt, Artificial Sequence
  ELANE RNA Guide
ugucugccuccacggggacucc

SEQ ID NO: 23214 - RNA, 22 nt, Artificial Sequence
  ELANE RNA Guide
uuccccaccuugucugccucca

SEQ ID NO: 23215 - RNA, 22 nt, Artificial Sequence
  ELANE RNA Guide
uugucugccuccacggggacuc

SEQ ID NO: 23216 - RNA, 20 nt, Artificial Sequence
  ELANE RNA Guide
accuugucugccuccagagg

SEQ ID NO: 23217 - RNA, 20 nt, Artificial Sequence
  ELANE RNA Guide
agagggggacuccggcagcc

SEQ ID NO: 23218 - RNA, 20 nt, Artificial Sequence
  ELANE RNA Guide
aggggcugccggaguccccc

SEQ ID NO: 23219 - RNA, 20 nt, Artificial Sequence
  ELANE RNA Guide
agucccccucuggaggcaga

SEQ ID NO: 23220 - RNA, 20 nt, Artificial Sequence
  ELANE RNA Guide
caccuugucugccuccagag

SEQ ID NO: 23221 - RNA, 20 nt, Artificial Sequence
  ELANE RNA Guide
cagagggggacuccggcagc

SEQ ID NO: 23222 - RNA, 20 nt, Artificial Sequence
  ELANE RNA Guide
ccaccuugucugccuccaga

SEQ ID NO: 23223 - RNA, 20 nt, Artificial Sequence
  ELANE RNA Guide
ccagagggggacuccggcag

SEQ ID NO: 23224 - RNA, 20 nt, Artificial Sequence
  ELANE RNA Guide
cccaccuugucugccuccag

SEQ ID NO: 23225 - RNA, 20 nt, Artificial Sequence
  ELANE RNA Guide
cccccucuggaggcagacaa

SEQ ID NO: 23226 - RNA, 20 nt, Artificial Sequence
  ELANE RNA Guide
ccccucuggaggcagacaag

SEQ ID NO: 23227 - RNA, 20 nt, Artificial Sequence
  ELANE RNA Guide
cccucuggaggcagacaagg

SEQ ID NO: 23228 - RNA, 20 nt, Artificial Sequence
  ELANE RNA Guide
ccggagucccccucuggagg

SEQ ID NO: 23229 - RNA, 20 nt, Artificial Sequence
  ELANE RNA Guide
ccuccagagggggacuccgg

SEQ ID NO: 23230 - RNA, 20 nt, Artificial Sequence
  ELANE RNA Guide
ccucuggaggcagacaaggu

SEQ ID NO: 23231 - RNA, 20 nt, Artificial Sequence
  ELANE RNA Guide
ccuugucugccuccagaggg

SEQ ID NO: 23232 - RNA, 20 nt, Artificial Sequence
  ELANE RNA Guide
cggagucccccucuggaggc

SEQ ID NO: 23233 - RNA, 20 nt, Artificial Sequence
  ELANE RNA Guide
cuccagagggggacuccggc

SEQ ID NO: 23234 - RNA, 20 nt, Artificial Sequence
  ELANE RNA Guide
cucuggaggcagacaaggug

SEQ ID NO: 23235 - RNA, 20 nt, Artificial Sequence
  ELANE RNA Guide
cugccggagucccccucugg

SEQ ID NO: 23236 - RNA, 20 nt, Artificial Sequence
  ELANE RNA Guide
cugccuccagagggggacuc

SEQ ID NO: 23237 - RNA, 20 nt, Artificial Sequence
  ELANE RNA Guide
cuuccccaccuugucugccu

SEQ ID NO: 23238 - RNA, 20 nt, Artificial Sequence
  ELANE RNA Guide
cuugucugccuccagagggg

SEQ ID NO: 23239 - RNA, 20 nt, Artificial Sequence
  ELANE RNA Guide
gagucccccucuggaggcag

SEQ ID NO: 23240 - RNA, 20 nt, Artificial Sequence
  ELANE RNA Guide
gccggagucccccucuggag

SEQ ID NO: 23241 - RNA, 20 nt, Artificial Sequence
  ELANE RNA Guide
gccuccagagggggacuccg

SEQ ID NO: 23242 - RNA, 20 nt, Artificial Sequence
  ELANE RNA Guide
gcugccggagucccccucug

SEQ ID NO: 23243 - RNA, 20 nt, Artificial Sequence
  ELANE RNA Guide
ggagucccccucuggaggca

SEQ ID NO: 23244 - RNA, 20 nt, Artificial Sequence
  ELANE RNA Guide
ggcugccggagucccccucu

SEQ ID NO: 23245 - RNA, 20 nt, Artificial Sequence
  ELANE RNA Guide
gggcugccggagucccccuc

SEQ ID NO: 23246 - RNA, 20 nt, Artificial Sequence
  ELANE RNA Guide
ggggcugccggagucccccu

SEQ ID NO: 23247 - RNA, 20 nt, Artificial Sequence
  ELANE RNA Guide
gucccccucuggaggcagac

SEQ ID NO: 23248 - RNA, 20 nt, Artificial Sequence
  ELANE RNA Guide
gucugccuccagagggggac

SEQ ID NO: 23249 - RNA, 20 nt, Artificial Sequence
  ELANE RNA Guide
uccagagggggacuccggca

SEQ ID NO: 23250 - RNA, 20 nt, Artificial Sequence
  ELANE RNA Guide
ucccccucuggaggcagaca

SEQ ID NO: 23251 - RNA, 20 nt, Artificial Sequence
  ELANE RNA Guide
ucugccuccagagggggacu

SEQ ID NO: 23252 - RNA, 20 nt, Artificial Sequence
  ELANE RNA Guide
ucuggaggcagacaaggugg

SEQ ID NO: 23253 - RNA, 20 nt, Artificial Sequence
  ELANE RNA Guide
ugccggagucccccucugga

SEQ ID NO: 23254 - RNA, 20 nt, Artificial Sequence
  ELANE RNA Guide
ugccuccagagggggacucc

SEQ ID NO: 23255 - RNA, 20 nt, Artificial Sequence
  ELANE RNA Guide
ugucugccuccagaggggga

SEQ ID NO: 23256 - RNA, 20 nt, Artificial Sequence
  ELANE RNA Guide
uugucugccuccagaggggg

SEQ ID NO: 23257 - RNA, 21 nt, Artificial Sequence
  ELANE RNA Guide
aaggggcugccggaguccccc

SEQ ID NO: 23258 - RNA, 21 nt, Artificial Sequence
  ELANE RNA Guide
accuugucugccuccagaggg

SEQ ID NO: 23259 - RNA, 21 nt, Artificial Sequence
  ELANE RNA Guide
agagggggacuccggcagccc

SEQ ID NO: 23260 - RNA, 21 nt, Artificial Sequence
  ELANE RNA Guide
aggggcugccggagucccccu

SEQ ID NO: 23261 - RNA, 21 nt, Artificial Sequence
  ELANE RNA Guide
agucccccucuggaggcagac

SEQ ID NO: 23262 - RNA, 21 nt, Artificial Sequence
  ELANE RNA Guide
caccuugucugccuccagagg

SEQ ID NO: 23263 - RNA, 21 nt, Artificial Sequence
  ELANE RNA Guide
cagagggggacuccggcagcc

SEQ ID NO: 23264 - RNA, 21 nt, Artificial Sequence
  ELANE RNA Guide
ccaccuugucugccuccagag

SEQ ID NO: 23265 - RNA, 21 nt, Artificial Sequence
  ELANE RNA Guide
ccagagggggacuccggcagc

SEQ ID NO: 23266 - RNA, 21 nt, Artificial Sequence
  ELANE RNA Guide
cccaccuugucugccuccaga

SEQ ID NO: 23267 - RNA, 21 nt, Artificial Sequence
  ELANE RNA Guide
ccccaccuugucugccuccag

SEQ ID NO: 23268 - RNA, 21 nt, Artificial Sequence
  ELANE RNA Guide
cccccucuggaggcagacaag

SEQ ID NO: 23269 - RNA, 21 nt, Artificial Sequence
  ELANE RNA Guide
ccccucuggaggcagacaagg

SEQ ID NO: 23270 - RNA, 21 nt, Artificial Sequence
  ELANE RNA Guide
cccucuggaggcagacaaggu

SEQ ID NO: 23271 - RNA, 21 nt, Artificial Sequence
  ELANE RNA Guide
ccggagucccccucuggaggc

SEQ ID NO: 23272 - RNA, 21 nt, Artificial Sequence
  ELANE RNA Guide
ccuccagagggggacuccggc

SEQ ID NO: 23273 - RNA, 21 nt, Artificial Sequence
  ELANE RNA Guide
ccucuggaggcagacaaggug

SEQ ID NO: 23274 - RNA, 21 nt, Artificial Sequence
  ELANE RNA Guide
ccuugucugccuccagagggg

SEQ ID NO: 23275 - RNA, 21 nt, Artificial Sequence
  ELANE RNA Guide
cggagucccccucuggaggca

SEQ ID NO: 23276 - RNA, 21 nt, Artificial Sequence
  ELANE RNA Guide
cuccagagggggacuccggca

SEQ ID NO: 23277 - RNA, 21 nt, Artificial Sequence
  ELANE RNA Guide
cucuggaggcagacaaggugg

SEQ ID NO: 23278 - RNA, 21 nt, Artificial Sequence
  ELANE RNA Guide
cugccggagucccccucugga

SEQ ID NO: 23279 - RNA, 21 nt, Artificial Sequence
  ELANE RNA Guide
cugccuccagagggggacucc

SEQ ID NO: 23280 - RNA, 21 nt, Artificial Sequence
  ELANE RNA Guide
cuugucugccuccagaggggg

SEQ ID NO: 23281 - RNA, 21 nt, Artificial Sequence
  ELANE RNA Guide
gagucccccucuggaggcaga

SEQ ID NO: 23282 - RNA, 21 nt, Artificial Sequence
  ELANE RNA Guide
gccggagucccccucuggagg

SEQ ID NO: 23283 - RNA, 21 nt, Artificial Sequence
  ELANE RNA Guide
gccuccagagggggacuccgg

SEQ ID NO: 23284 - RNA, 21 nt, Artificial Sequence
  ELANE RNA Guide
gcugccggagucccccucugg

SEQ ID NO: 23285 - RNA, 21 nt, Artificial Sequence
  ELANE RNA Guide
gcuuccccaccuugucugccu

SEQ ID NO: 23286 - RNA, 21 nt, Artificial Sequence
  ELANE RNA Guide
ggagucccccucuggaggcag

SEQ ID NO: 23287 - RNA, 21 nt, Artificial Sequence
  ELANE RNA Guide
ggcugccggagucccccucug

SEQ ID NO: 23288 - RNA, 21 nt, Artificial Sequence
  ELANE RNA Guide
gggcugccggagucccccucu

SEQ ID NO: 23289 - RNA, 21 nt, Artificial Sequence
  ELANE RNA Guide
gucccccucuggaggcagaca

SEQ ID NO: 23290 - RNA, 21 nt, Artificial Sequence
  ELANE RNA Guide
gucugccuccagagggggacu

SEQ ID NO: 23291 - RNA, 21 nt, Artificial Sequence
  ELANE RNA Guide
uccagagggggacuccggcag

SEQ ID NO: 23292 - RNA, 21 nt, Artificial Sequence
  ELANE RNA Guide
ucccccucuggaggcagacaa

SEQ ID NO: 23293 - RNA, 21 nt, Artificial Sequence
  ELANE RNA Guide
ucugccuccagagggggacuc

SEQ ID NO: 23294 - RNA, 21 nt, Artificial Sequence
  ELANE RNA Guide
ucuggaggcagacaagguggg

SEQ ID NO: 23295 - RNA, 21 nt, Artificial Sequence
  ELANE RNA Guide
ugccggagucccccucuggag

SEQ ID NO: 23296 - RNA, 21 nt, Artificial Sequence
  ELANE RNA Guide
ugccuccagagggggacuccg

SEQ ID NO: 23297 - RNA, 21 nt, Artificial Sequence
  ELANE RNA Guide
ugucugccuccagagggggac

SEQ ID NO: 23298 - RNA, 21 nt, Artificial Sequence
  ELANE RNA Guide
uugucugccuccagaggggga

SEQ ID NO: 23299 - RNA, 22 nt, Artificial Sequence
  ELANE RNA Guide
aaggggcugccggagucccccu

SEQ ID NO: 23300 - RNA, 22 nt, Artificial Sequence
  ELANE RNA Guide
accuugucugccuccagagggg

SEQ ID NO: 23301 - RNA, 22 nt, Artificial Sequence
  ELANE RNA Guide
agagggggacuccggcagcccc

SEQ ID NO: 23302 - RNA, 22 nt, Artificial Sequence
  ELANE RNA Guide
agcuuccccaccuugucugccu

SEQ ID NO: 23303 - RNA, 22 nt, Artificial Sequence
  ELANE RNA Guide
aggggcugccggagucccccuc

SEQ ID NO: 23304 - RNA, 22 nt, Artificial Sequence
  ELANE RNA Guide
agucccccucuggaggcagaca

SEQ ID NO: 23305 - RNA, 22 nt, Artificial Sequence
  ELANE RNA Guide
caaggggcugccggaguccccc

SEQ ID NO: 23306 - RNA, 22 nt, Artificial Sequence
  ELANE RNA Guide
caccuugucugccuccagaggg

SEQ ID NO: 23307 - RNA, 22 nt, Artificial Sequence
  ELANE RNA Guide
cagagggggacuccggcagccc

SEQ ID NO: 23308 - RNA, 22 nt, Artificial Sequence
  ELANE RNA Guide
ccaccuugucugccuccagagg

SEQ ID NO: 23309 - RNA, 22 nt, Artificial Sequence
  ELANE RNA Guide
ccagagggggacuccggcagcc

SEQ ID NO: 23310 - RNA, 22 nt, Artificial Sequence
  ELANE RNA Guide
cccaccuugucugccuccagag

SEQ ID NO: 23311 - RNA, 22 nt, Artificial Sequence
  ELANE RNA Guide
ccccaccuugucugccuccaga

SEQ ID NO: 23312 - RNA, 22 nt, Artificial Sequence
  ELANE RNA Guide
cccccucuggaggcagacaagg

SEQ ID NO: 23313 - RNA, 22 nt, Artificial Sequence
  ELANE RNA Guide
ccccucuggaggcagacaaggu

SEQ ID NO: 23314 - RNA, 22 nt, Artificial Sequence
  ELANE RNA Guide
cccucuggaggcagacaaggug

SEQ ID NO: 23315 - RNA, 22 nt, Artificial Sequence
  ELANE RNA Guide
ccggagucccccucuggaggca

SEQ ID NO: 23316 - RNA, 22 nt, Artificial Sequence
  ELANE RNA Guide
ccuccagagggggacuccggca

SEQ ID NO: 23317 - RNA, 22 nt, Artificial Sequence
  ELANE RNA Guide
ccucuggaggcagacaaggugg

SEQ ID NO: 23318 - RNA, 22 nt, Artificial Sequence
  ELANE RNA Guide
ccuugucugccuccagaggggg

SEQ ID NO: 23319 - RNA, 22 nt, Artificial Sequence
  ELANE RNA Guide
cggagucccccucuggaggcag

SEQ ID NO: 23320 - RNA, 22 nt, Artificial Sequence
  ELANE RNA Guide
cuccagagggggacuccggcag

SEQ ID NO: 23321 - RNA, 22 nt, Artificial Sequence
  ELANE RNA Guide
cucuggaggcagacaagguggg

SEQ ID NO: 23322 - RNA, 22 nt, Artificial Sequence
  ELANE RNA Guide
cugccggagucccccucuggag

SEQ ID NO: 23323 - RNA, 22 nt, Artificial Sequence
  ELANE RNA Guide
cugccuccagagggggacuccg

SEQ ID NO: 23324 - RNA, 22 nt, Artificial Sequence
  ELANE RNA Guide
cuugucugccuccagaggggga

SEQ ID NO: 23325 - RNA, 22 nt, Artificial Sequence
  ELANE RNA Guide
gagucccccucuggaggcagac

SEQ ID NO: 23326 - RNA, 22 nt, Artificial Sequence
  ELANE RNA Guide
gccggagucccccucuggaggc

SEQ ID NO: 23327 - RNA, 22 nt, Artificial Sequence
  ELANE RNA Guide
gccuccagagggggacuccggc

SEQ ID NO: 23328 - RNA, 22 nt, Artificial Sequence
  ELANE RNA Guide
gcugccggagucccccucugga

SEQ ID NO: 23329 - RNA, 22 nt, Artificial Sequence
  ELANE RNA Guide
ggagucccccucuggaggcaga

SEQ ID NO: 23330 - RNA, 22 nt, Artificial Sequence
  ELANE RNA Guide
ggcugccggagucccccucugg

SEQ ID NO: 23331 - RNA, 22 nt, Artificial Sequence
  ELANE RNA Guide
gggcugccggagucccccucug

SEQ ID NO: 23332 - RNA, 22 nt, Artificial Sequence
  ELANE RNA Guide
ggggcugccggagucccccucu

SEQ ID NO: 23333 - RNA, 22 nt, Artificial Sequence
  ELANE RNA Guide
gucccccucuggaggcagacaa

SEQ ID NO: 23334 - RNA, 22 nt, Artificial Sequence
  ELANE RNA Guide
gucugccuccagagggggacuc

SEQ ID NO: 23335 - RNA, 22 nt, Artificial Sequence
  ELANE RNA Guide
uccagagggggacuccggcagc

SEQ ID NO: 23336 - RNA, 22 nt, Artificial Sequence
  ELANE RNA Guide
uccccaccuugucugccuccag

SEQ ID NO: 23337 - RNA, 22 nt, Artificial Sequence
  ELANE RNA Guide
ucccccucuggaggcagacaag

SEQ ID NO: 23338 - RNA, 22 nt, Artificial Sequence
  ELANE RNA Guide
ucugccuccagagggggacucc

SEQ ID NO: 23339 - RNA, 22 nt, Artificial Sequence
  ELANE RNA Guide
ucuggaggcagacaaggugggg

SEQ ID NO: 23340 - RNA, 22 nt, Artificial Sequence
  ELANE RNA Guide
ugccggagucccccucuggagg

SEQ ID NO: 23341 - RNA, 22 nt, Artificial Sequence
  ELANE RNA Guide
ugccuccagagggggacuccgg

SEQ ID NO: 23342 - RNA, 22 nt, Artificial Sequence
  ELANE RNA Guide
ugucugccuccagagggggacu

SEQ ID NO: 23343 - RNA, 22 nt, Artificial Sequence
  ELANE RNA Guide
uugucugccuccagagggggac

SEQ ID NO: 23344 - RNA, 20 nt, Artificial Sequence
  ELANE RNA Guide
acaggggacuccggcagccc

SEQ ID NO: 23345 - RNA, 20 nt, Artificial Sequence
  ELANE RNA Guide
accuugucugccuccacagg

SEQ ID NO: 23346 - RNA, 20 nt, Artificial Sequence
  ELANE RNA Guide
aggggcugccggaguccccu

SEQ ID NO: 23347 - RNA, 20 nt, Artificial Sequence
  ELANE RNA Guide
aguccccuguggaggcagac

SEQ ID NO: 23348 - RNA, 20 nt, Artificial Sequence
  ELANE RNA Guide
cacaggggacuccggcagcc

SEQ ID NO: 23349 - RNA, 20 nt, Artificial Sequence
  ELANE RNA Guide
caccuugucugccuccacag

SEQ ID NO: 23350 - RNA, 20 nt, Artificial Sequence
  ELANE RNA Guide
caggggacuccggcagcccc

SEQ ID NO: 23351 - RNA, 20 nt, Artificial Sequence
  ELANE RNA Guide
ccacaggggacuccggcagc

SEQ ID NO: 23352 - RNA, 20 nt, Artificial Sequence
  ELANE RNA Guide
ccggaguccccuguggaggc

SEQ ID NO: 23353 - RNA, 20 nt, Artificial Sequence
  ELANE RNA Guide
ccuccacaggggacuccggc

SEQ ID NO: 23354 - RNA, 20 nt, Artificial Sequence
  ELANE RNA Guide
ccuugucugccuccacaggg

SEQ ID NO: 23355 - RNA, 20 nt, Artificial Sequence
  ELANE RNA Guide
cggaguccccuguggaggca

SEQ ID NO: 23356 - RNA, 20 nt, Artificial Sequence
  ELANE RNA Guide
cuccacaggggacuccggca

SEQ ID NO: 23357 - RNA, 20 nt, Artificial Sequence
  ELANE RNA Guide
cugccggaguccccugugga

SEQ ID NO: 23358 - RNA, 20 nt, Artificial Sequence
  ELANE RNA Guide
cugccuccacaggggacucc

SEQ ID NO: 23359 - RNA, 20 nt, Artificial Sequence
  ELANE RNA Guide
cuugucugccuccacagggg

SEQ ID NO: 23360 - RNA, 20 nt, Artificial Sequence
  ELANE RNA Guide
gaguccccuguggaggcaga

SEQ ID NO: 23361 - RNA, 20 nt, Artificial Sequence
  ELANE RNA Guide
gccggaguccccuguggagg

SEQ ID NO: 23362 - RNA, 20 nt, Artificial Sequence
  ELANE RNA Guide
gccuccacaggggacuccgg

SEQ ID NO: 23363 - RNA, 20 nt, Artificial Sequence
  ELANE RNA Guide
gcugccggaguccccugugg

SEQ ID NO: 23364 - RNA, 20 nt, Artificial Sequence
  ELANE RNA Guide
ggaguccccuguggaggcag

SEQ ID NO: 23365 - RNA, 20 nt, Artificial Sequence
  ELANE RNA Guide
ggcugccggaguccccugug

SEQ ID NO: 23366 - RNA, 20 nt, Artificial Sequence
  ELANE RNA Guide
gggcugccggaguccccugu

SEQ ID NO: 23367 - RNA, 20 nt, Artificial Sequence
  ELANE RNA Guide
ggggcugccggaguccccug

SEQ ID NO: 23368 - RNA, 20 nt, Artificial Sequence
  ELANE RNA Guide
guccccuguggaggcagaca

SEQ ID NO: 23369 - RNA, 20 nt, Artificial Sequence
  ELANE RNA Guide
gucugccuccacaggggacu

SEQ ID NO: 23370 - RNA, 20 nt, Artificial Sequence
  ELANE RNA Guide
uccacaggggacuccggcag

SEQ ID NO: 23371 - RNA, 20 nt, Artificial Sequence
  ELANE RNA Guide
uccccuguggaggcagacaa

SEQ ID NO: 23372 - RNA, 20 nt, Artificial Sequence
  ELANE RNA Guide
ucugccuccacaggggacuc

SEQ ID NO: 23373 - RNA, 20 nt, Artificial Sequence
  ELANE RNA Guide
ugccggaguccccuguggag

SEQ ID NO: 23374 - RNA, 20 nt, Artificial Sequence
  ELANE RNA Guide
ugccuccacaggggacuccg

SEQ ID NO: 23375 - RNA, 20 nt, Artificial Sequence
  ELANE RNA Guide
ugucugccuccacaggggac

SEQ ID NO: 23376 - RNA, 20 nt, Artificial Sequence
  ELANE RNA Guide
uugucugccuccacagggga

SEQ ID NO: 23377 - RNA, 21 nt, Artificial Sequence
  ELANE RNA Guide
aaggggcugccggaguccccu

SEQ ID NO: 23378 - RNA, 21 nt, Artificial Sequence
  ELANE RNA Guide
acaggggacuccggcagcccc

SEQ ID NO: 23379 - RNA, 21 nt, Artificial Sequence
  ELANE RNA Guide
accuugucugccuccacaggg

SEQ ID NO: 23380 - RNA, 21 nt, Artificial Sequence
  ELANE RNA Guide
aggggcugccggaguccccug

SEQ ID NO: 23381 - RNA, 21 nt, Artificial Sequence
  ELANE RNA Guide
aguccccuguggaggcagaca

SEQ ID NO: 23382 - RNA, 21 nt, Artificial Sequence
  ELANE RNA Guide
cacaggggacuccggcagccc

SEQ ID NO: 23383 - RNA, 21 nt, Artificial Sequence
  ELANE RNA Guide
caccuugucugccuccacagg

SEQ ID NO: 23384 - RNA, 21 nt, Artificial Sequence
  ELANE RNA Guide
caggggacuccggcagccccu

SEQ ID NO: 23385 - RNA, 21 nt, Artificial Sequence
  ELANE RNA Guide
ccacaggggacuccggcagcc

SEQ ID NO: 23386 - RNA, 21 nt, Artificial Sequence
  ELANE RNA Guide
ccaccuugucugccuccacag

SEQ ID NO: 23387 - RNA, 21 nt, Artificial Sequence
  ELANE RNA Guide
ccggaguccccuguggaggca

SEQ ID NO: 23388 - RNA, 21 nt, Artificial Sequence
  ELANE RNA Guide
ccuccacaggggacuccggca

SEQ ID NO: 23389 - RNA, 21 nt, Artificial Sequence
  ELANE RNA Guide
ccuugucugccuccacagggg

SEQ ID NO: 23390 - RNA, 21 nt, Artificial Sequence
  ELANE RNA Guide
cggaguccccuguggaggcag

SEQ ID NO: 23391 - RNA, 21 nt, Artificial Sequence
  ELANE RNA Guide
cuccacaggggacuccggcag

SEQ ID NO: 23392 - RNA, 21 nt, Artificial Sequence
  ELANE RNA Guide
cugccggaguccccuguggag

SEQ ID NO: 23393 - RNA, 21 nt, Artificial Sequence
  ELANE RNA Guide
cugccuccacaggggacuccg

SEQ ID NO: 23394 - RNA, 21 nt, Artificial Sequence
  ELANE RNA Guide
cuugucugccuccacagggga

SEQ ID NO: 23395 - RNA, 21 nt, Artificial Sequence
  ELANE RNA Guide
gaguccccuguggaggcagac

SEQ ID NO: 23396 - RNA, 21 nt, Artificial Sequence
  ELANE RNA Guide
gccggaguccccuguggaggc

SEQ ID NO: 23397 - RNA, 21 nt, Artificial Sequence
  ELANE RNA Guide
gccuccacaggggacuccggc

SEQ ID NO: 23398 - RNA, 21 nt, Artificial Sequence
  ELANE RNA Guide
gcugccggaguccccugugga

SEQ ID NO: 23399 - RNA, 21 nt, Artificial Sequence
  ELANE RNA Guide
ggaguccccuguggaggcaga

SEQ ID NO: 23400 - RNA, 21 nt, Artificial Sequence
  ELANE RNA Guide
ggcugccggaguccccugugg

SEQ ID NO: 23401 - RNA, 21 nt, Artificial Sequence
  ELANE RNA Guide
gggcugccggaguccccugug

SEQ ID NO: 23402 - RNA, 21 nt, Artificial Sequence
  ELANE RNA Guide
ggggcugccggaguccccugu

SEQ ID NO: 23403 - RNA, 21 nt, Artificial Sequence
  ELANE RNA Guide
guccccuguggaggcagacaa

SEQ ID NO: 23404 - RNA, 21 nt, Artificial Sequence
  ELANE RNA Guide
gucugccuccacaggggacuc

SEQ ID NO: 23405 - RNA, 21 nt, Artificial Sequence
  ELANE RNA Guide
uccacaggggacuccggcagc

SEQ ID NO: 23406 - RNA, 21 nt, Artificial Sequence
  ELANE RNA Guide
uccccuguggaggcagacaag

SEQ ID NO: 23407 - RNA, 21 nt, Artificial Sequence
  ELANE RNA Guide
ucugccuccacaggggacucc

SEQ ID NO: 23408 - RNA, 21 nt, Artificial Sequence
  ELANE RNA Guide
ugccggaguccccuguggagg

SEQ ID NO: 23409 - RNA, 21 nt, Artificial Sequence
  ELANE RNA Guide
ugccuccacaggggacuccgg

SEQ ID NO: 23410 - RNA, 21 nt, Artificial Sequence
  ELANE RNA Guide
ugucugccuccacaggggacu

SEQ ID NO: 23411 - RNA, 21 nt, Artificial Sequence
  ELANE RNA Guide
uugucugccuccacaggggac

SEQ ID NO: 23412 - RNA, 22 nt, Artificial Sequence
  ELANE RNA Guide
aaggggcugccggaguccccug

SEQ ID NO: 23413 - RNA, 22 nt, Artificial Sequence
  ELANE RNA Guide
acaggggacuccggcagccccu

SEQ ID NO: 23414 - RNA, 22 nt, Artificial Sequence
  ELANE RNA Guide
accuugucugccuccacagggg

SEQ ID NO: 23415 - RNA, 22 nt, Artificial Sequence
  ELANE RNA Guide
aggggcugccggaguccccugu

SEQ ID NO: 23416 - RNA, 22 nt, Artificial Sequence
  ELANE RNA Guide
aguccccuguggaggcagacaa

SEQ ID NO: 23417 - RNA, 22 nt, Artificial Sequence
  ELANE RNA Guide
caaggggcugccggaguccccu

SEQ ID NO: 23418 - RNA, 22 nt, Artificial Sequence
  ELANE RNA Guide
cacaggggacuccggcagcccc

SEQ ID NO: 23419 - RNA, 22 nt, Artificial Sequence
  ELANE RNA Guide
caccuugucugccuccacaggg

SEQ ID NO: 23420 - RNA, 22 nt, Artificial Sequence
  ELANE RNA Guide
caggggacuccggcagccccuu

SEQ ID NO: 23421 - RNA, 22 nt, Artificial Sequence
  ELANE RNA Guide
ccacaggggacuccggcagccc

SEQ ID NO: 23422 - RNA, 22 nt, Artificial Sequence
  ELANE RNA Guide
ccaccuugucugccuccacagg

SEQ ID NO: 23423 - RNA, 22 nt, Artificial Sequence
  ELANE RNA Guide
cccaccuugucugccuccacag

SEQ ID NO: 23424 - RNA, 22 nt, Artificial Sequence
  ELANE RNA Guide
ccggaguccccuguggaggcag

SEQ ID NO: 23425 - RNA, 22 nt, Artificial Sequence
  ELANE RNA Guide
ccuccacaggggacuccggcag

SEQ ID NO: 23426 - RNA, 22 nt, Artificial Sequence
  ELANE RNA Guide
ccuugucugccuccacagggga

SEQ ID NO: 23427 - RNA, 22 nt, Artificial Sequence
  ELANE RNA Guide
cggaguccccuguggaggcaga

SEQ ID NO: 23428 - RNA, 22 nt, Artificial Sequence
  ELANE RNA Guide
cuccacaggggacuccggcagc

SEQ ID NO: 23429 - RNA, 22 nt, Artificial Sequence
  ELANE RNA Guide
cugccggaguccccuguggagg

SEQ ID NO: 23430 - RNA, 22 nt, Artificial Sequence
  ELANE RNA Guide
cugccuccacaggggacuccgg

SEQ ID NO: 23431 - RNA, 22 nt, Artificial Sequence
  ELANE RNA Guide
cuugucugccuccacaggggac

SEQ ID NO: 23432 - RNA, 22 nt, Artificial Sequence
  ELANE RNA Guide
gaguccccuguggaggcagaca

SEQ ID NO: 23433 - RNA, 22 nt, Artificial Sequence
  ELANE RNA Guide
gccggaguccccuguggaggca

SEQ ID NO: 23434 - RNA, 22 nt, Artificial Sequence
  ELANE RNA Guide
gccuccacaggggacuccggca

SEQ ID NO: 23435 - RNA, 22 nt, Artificial Sequence
  ELANE RNA Guide
gcugccggaguccccuguggag

SEQ ID NO: 23436 - RNA, 22 nt, Artificial Sequence
  ELANE RNA Guide
ggaguccccuguggaggcagac

SEQ ID NO: 23437 - RNA, 22 nt, Artificial Sequence
  ELANE RNA Guide
ggcugccggaguccccugugga

SEQ ID NO: 23438 - RNA, 22 nt, Artificial Sequence
  ELANE RNA Guide
gggcugccggaguccccugugg

SEQ ID NO: 23439 - RNA, 22 nt, Artificial Sequence
  ELANE RNA Guide
ggggcugccggaguccccugug

SEQ ID NO: 23440 - RNA, 22 nt, Artificial Sequence
  ELANE RNA Guide
guccccuguggaggcagacaag

SEQ ID NO: 23441 - RNA, 22 nt, Artificial Sequence
  ELANE RNA Guide
gucugccuccacaggggacucc

SEQ ID NO: 23442 - RNA, 22 nt, Artificial Sequence
  ELANE RNA Guide
uccacaggggacuccggcagcc

SEQ ID NO: 23443 - RNA, 22 nt, Artificial Sequence
  ELANE RNA Guide
uccccuguggaggcagacaagg

SEQ ID NO: 23444 - RNA, 22 nt, Artificial Sequence
  ELANE RNA Guide
ucugccuccacaggggacuccg

SEQ ID NO: 23445 - RNA, 22 nt, Artificial Sequence
  ELANE RNA Guide
ugccggaguccccuguggaggc

SEQ ID NO: 23446 - RNA, 22 nt, Artificial Sequence
  ELANE RNA Guide
ugccuccacaggggacuccggc

SEQ ID NO: 23447 - RNA, 22 nt, Artificial Sequence
  ELANE RNA Guide
ugucugccuccacaggggacuc

SEQ ID NO: 23448 - RNA, 22 nt, Artificial Sequence
  ELANE RNA Guide
uugucugccuccacaggggacu

SEQ ID NO: 23449 - RNA, 20 nt, Artificial Sequence
  ELANE RNA Guide
aaggggacuccggcagcccc

SEQ ID NO: 23450 - RNA, 20 nt, Artificial Sequence
  ELANE RNA Guide
acaaggggacuccggcagcc

SEQ ID NO: 23451 - RNA, 20 nt, Artificial Sequence
  ELANE RNA Guide
accuugucugccuccacaag

SEQ ID NO: 23452 - RNA, 20 nt, Artificial Sequence
  ELANE RNA Guide
aguccccuuguggaggcaga

SEQ ID NO: 23453 - RNA, 20 nt, Artificial Sequence
  ELANE RNA Guide
caaggggacuccggcagccc

SEQ ID NO: 23454 - RNA, 20 nt, Artificial Sequence
  ELANE RNA Guide
cacaaggggacuccggcagc

SEQ ID NO: 23455 - RNA, 20 nt, Artificial Sequence
  ELANE RNA Guide
caccuugucugccuccacaa

SEQ ID NO: 23456 - RNA, 20 nt, Artificial Sequence
  ELANE RNA Guide
ccacaaggggacuccggcag

SEQ ID NO: 23457 - RNA, 20 nt, Artificial Sequence
  ELANE RNA Guide
ccaccuugucugccuccaca

SEQ ID NO: 23458 - RNA, 20 nt, Artificial Sequence
  ELANE RNA Guide
ccccuuguggaggcagacaa

SEQ ID NO: 23459 - RNA, 20 nt, Artificial Sequence
  ELANE RNA Guide
cccuuguggaggcagacaag

SEQ ID NO: 23460 - RNA, 20 nt, Artificial Sequence
  ELANE RNA Guide
ccggaguccccuuguggagg

SEQ ID NO: 23461 - RNA, 20 nt, Artificial Sequence
  ELANE RNA Guide
ccuccacaaggggacuccgg

SEQ ID NO: 23462 - RNA, 20 nt, Artificial Sequence
  ELANE RNA Guide
ccuugucugccuccacaagg

SEQ ID NO: 23463 - RNA, 20 nt, Artificial Sequence
  ELANE RNA Guide
ccuuguggaggcagacaagg

SEQ ID NO: 23464 - RNA, 20 nt, Artificial Sequence
  ELANE RNA Guide
cggaguccccuuguggaggc

SEQ ID NO: 23465 - RNA, 20 nt, Artificial Sequence
  ELANE RNA Guide
cuccacaaggggacuccggc

SEQ ID NO: 23466 - RNA, 20 nt, Artificial Sequence
  ELANE RNA Guide
cugccggaguccccuugugg

SEQ ID NO: 23467 - RNA, 20 nt, Artificial Sequence
  ELANE RNA Guide
cugccuccacaaggggacuc

SEQ ID NO: 23468 - RNA, 20 nt, Artificial Sequence
  ELANE RNA Guide
cuugucugccuccacaaggg

SEQ ID NO: 23469 - RNA, 20 nt, Artificial Sequence
  ELANE RNA Guide
cuuguggaggcagacaaggu

SEQ ID NO: 23470 - RNA, 20 nt, Artificial Sequence
  ELANE RNA Guide
gaguccccuuguggaggcag

SEQ ID NO: 23471 - RNA, 20 nt, Artificial Sequence
  ELANE RNA Guide
gccggaguccccuuguggag

SEQ ID NO: 23472 - RNA, 20 nt, Artificial Sequence
  ELANE RNA Guide
gccuccacaaggggacuccg

SEQ ID NO: 23473 - RNA, 20 nt, Artificial Sequence
  ELANE RNA Guide
gcugccggaguccccuugug

SEQ ID NO: 23474 - RNA, 20 nt, Artificial Sequence
  ELANE RNA Guide
ggaguccccuuguggaggca

SEQ ID NO: 23475 - RNA, 20 nt, Artificial Sequence
  ELANE RNA Guide
ggcugccggaguccccuugu

SEQ ID NO: 23476 - RNA, 20 nt, Artificial Sequence
  ELANE RNA Guide
gggcugccggaguccccuug

SEQ ID NO: 23477 - RNA, 20 nt, Artificial Sequence
  ELANE RNA Guide
ggggcugccggaguccccuu

SEQ ID NO: 23478 - RNA, 20 nt, Artificial Sequence
  ELANE RNA Guide
guccccuuguggaggcagac

SEQ ID NO: 23479 - RNA, 20 nt, Artificial Sequence
  ELANE RNA Guide
gucugccuccacaaggggac

SEQ ID NO: 23480 - RNA, 20 nt, Artificial Sequence
  ELANE RNA Guide
uccacaaggggacuccggca

SEQ ID NO: 23481 - RNA, 20 nt, Artificial Sequence
  ELANE RNA Guide
uccccuuguggaggcagaca

SEQ ID NO: 23482 - RNA, 20 nt, Artificial Sequence
  ELANE RNA Guide
ucugccuccacaaggggacu

SEQ ID NO: 23483 - RNA, 20 nt, Artificial Sequence
  ELANE RNA Guide
ugccggaguccccuugugga

SEQ ID NO: 23484 - RNA, 20 nt, Artificial Sequence
  ELANE RNA Guide
ugccuccacaaggggacucc

SEQ ID NO: 23485 - RNA, 20 nt, Artificial Sequence
  ELANE RNA Guide
ugucugccuccacaagggga

SEQ ID NO: 23486 - RNA, 20 nt, Artificial Sequence
  ELANE RNA Guide
uugucugccuccacaagggg

SEQ ID NO: 23487 - RNA, 21 nt, Artificial Sequence
  ELANE RNA Guide
aaggggacuccggcagccccu

SEQ ID NO: 23488 - RNA, 21 nt, Artificial Sequence
  ELANE RNA Guide
acaaggggacuccggcagccc

SEQ ID NO: 23489 - RNA, 21 nt, Artificial Sequence
  ELANE RNA Guide
accuugucugccuccacaagg

SEQ ID NO: 23490 - RNA, 21 nt, Artificial Sequence
  ELANE RNA Guide
aggggcugccggaguccccuu

SEQ ID NO: 23491 - RNA, 21 nt, Artificial Sequence
  ELANE RNA Guide
aguccccuuguggaggcagac

SEQ ID NO: 23492 - RNA, 21 nt, Artificial Sequence
  ELANE RNA Guide
caaggggacuccggcagcccc

SEQ ID NO: 23493 - RNA, 21 nt, Artificial Sequence
  ELANE RNA Guide
cacaaggggacuccggcagcc

SEQ ID NO: 23494 - RNA, 21 nt, Artificial Sequence
  ELANE RNA Guide
caccuugucugccuccacaag

SEQ ID NO: 23495 - RNA, 21 nt, Artificial Sequence
  ELANE RNA Guide
ccacaaggggacuccggcagc

SEQ ID NO: 23496 - RNA, 21 nt, Artificial Sequence
  ELANE RNA Guide
ccaccuugucugccuccacaa

SEQ ID NO: 23497 - RNA, 21 nt, Artificial Sequence
  ELANE RNA Guide
cccaccuugucugccuccaca

SEQ ID NO: 23498 - RNA, 21 nt, Artificial Sequence
  ELANE RNA Guide
ccccuuguggaggcagacaag

SEQ ID NO: 23499 - RNA, 21 nt, Artificial Sequence
  ELANE RNA Guide
cccuuguggaggcagacaagg

SEQ ID NO: 23500 - RNA, 21 nt, Artificial Sequence
  ELANE RNA Guide
ccggaguccccuuguggaggc

SEQ ID NO: 23501 - RNA, 21 nt, Artificial Sequence
  ELANE RNA Guide
ccuccacaaggggacuccggc

SEQ ID NO: 23502 - RNA, 21 nt, Artificial Sequence
  ELANE RNA Guide
ccuugucugccuccacaaggg

SEQ ID NO: 23503 - RNA, 21 nt, Artificial Sequence
  ELANE RNA Guide
ccuuguggaggcagacaaggu

SEQ ID NO: 23504 - RNA, 21 nt, Artificial Sequence
  ELANE RNA Guide
cggaguccccuuguggaggca

SEQ ID NO: 23505 - RNA, 21 nt, Artificial Sequence
  ELANE RNA Guide
cuccacaaggggacuccggca

SEQ ID NO: 23506 - RNA, 21 nt, Artificial Sequence
  ELANE RNA Guide
cugccggaguccccuugugga

SEQ ID NO: 23507 - RNA, 21 nt, Artificial Sequence
  ELANE RNA Guide
cugccuccacaaggggacucc

SEQ ID NO: 23508 - RNA, 21 nt, Artificial Sequence
  ELANE RNA Guide
cuugucugccuccacaagggg

SEQ ID NO: 23509 - RNA, 21 nt, Artificial Sequence
  ELANE RNA Guide
cuuguggaggcagacaaggug

SEQ ID NO: 23510 - RNA, 21 nt, Artificial Sequence
  ELANE RNA Guide
gaguccccuuguggaggcaga

SEQ ID NO: 23511 - RNA, 21 nt, Artificial Sequence
  ELANE RNA Guide
gccggaguccccuuguggagg

SEQ ID NO: 23512 - RNA, 21 nt, Artificial Sequence
  ELANE RNA Guide
gccuccacaaggggacuccgg

SEQ ID NO: 23513 - RNA, 21 nt, Artificial Sequence
  ELANE RNA Guide
gcugccggaguccccuugugg

SEQ ID NO: 23514 - RNA, 21 nt, Artificial Sequence
  ELANE RNA Guide
ggaguccccuuguggaggcag

SEQ ID NO: 23515 - RNA, 21 nt, Artificial Sequence
  ELANE RNA Guide
ggcugccggaguccccuugug

SEQ ID NO: 23516 - RNA, 21 nt, Artificial Sequence
  ELANE RNA Guide
gggcugccggaguccccuugu

SEQ ID NO: 23517 - RNA, 21 nt, Artificial Sequence
  ELANE RNA Guide
ggggcugccggaguccccuug

SEQ ID NO: 23518 - RNA, 21 nt, Artificial Sequence
  ELANE RNA Guide
guccccuuguggaggcagaca

SEQ ID NO: 23519 - RNA, 21 nt, Artificial Sequence
  ELANE RNA Guide
gucugccuccacaaggggacu

SEQ ID NO: 23520 - RNA, 21 nt, Artificial Sequence
  ELANE RNA Guide
uccacaaggggacuccggcag

SEQ ID NO: 23521 - RNA, 21 nt, Artificial Sequence
  ELANE RNA Guide
uccccuuguggaggcagacaa

SEQ ID NO: 23522 - RNA, 21 nt, Artificial Sequence
  ELANE RNA Guide
ucugccuccacaaggggacuc

SEQ ID NO: 23523 - RNA, 21 nt, Artificial Sequence
  ELANE RNA Guide
ugccggaguccccuuguggag

SEQ ID NO: 23524 - RNA, 21 nt, Artificial Sequence
  ELANE RNA Guide
ugccuccacaaggggacuccg

SEQ ID NO: 23525 - RNA, 21 nt, Artificial Sequence
  ELANE RNA Guide
ugucugccuccacaaggggac

SEQ ID NO: 23526 - RNA, 21 nt, Artificial Sequence
  ELANE RNA Guide
uugucugccuccacaagggga

SEQ ID NO: 23527 - RNA, 22 nt, Artificial Sequence
  ELANE RNA Guide
aaggggacuccggcagccccuu

SEQ ID NO: 23528 - RNA, 22 nt, Artificial Sequence
  ELANE RNA Guide
aaggggcugccggaguccccuu

SEQ ID NO: 23529 - RNA, 22 nt, Artificial Sequence
  ELANE RNA Guide
acaaggggacuccggcagcccc

SEQ ID NO: 23530 - RNA, 22 nt, Artificial Sequence
  ELANE RNA Guide
accuugucugccuccacaaggg

SEQ ID NO: 23531 - RNA, 22 nt, Artificial Sequence
  ELANE RNA Guide
aggggcugccggaguccccuug

SEQ ID NO: 23532 - RNA, 22 nt, Artificial Sequence
  ELANE RNA Guide
aguccccuuguggaggcagaca

SEQ ID NO: 23533 - RNA, 22 nt, Artificial Sequence
  ELANE RNA Guide
caaggggacuccggcagccccu

SEQ ID NO: 23534 - RNA, 22 nt, Artificial Sequence
  ELANE RNA Guide
cacaaggggacuccggcagccc

SEQ ID NO: 23535 - RNA, 22 nt, Artificial Sequence
  ELANE RNA Guide
caccuugucugccuccacaagg

SEQ ID NO: 23536 - RNA, 22 nt, Artificial Sequence
  ELANE RNA Guide
ccacaaggggacuccggcagcc

SEQ ID NO: 23537 - RNA, 22 nt, Artificial Sequence
  ELANE RNA Guide
ccaccuugucugccuccacaag

SEQ ID NO: 23538 - RNA, 22 nt, Artificial Sequence
  ELANE RNA Guide
cccaccuugucugccuccacaa

SEQ ID NO: 23539 - RNA, 22 nt, Artificial Sequence
  ELANE RNA Guide
ccccaccuugucugccuccaca

SEQ ID NO: 23540 - RNA, 22 nt, Artificial Sequence
  ELANE RNA Guide
ccccuuguggaggcagacaagg

SEQ ID NO: 23541 - RNA, 22 nt, Artificial Sequence
  ELANE RNA Guide
cccuuguggaggcagacaaggu

SEQ ID NO: 23542 - RNA, 22 nt, Artificial Sequence
  ELANE RNA Guide
ccggaguccccuuguggaggca

SEQ ID NO: 23543 - RNA, 22 nt, Artificial Sequence
  ELANE RNA Guide
ccuccacaaggggacuccggca

SEQ ID NO: 23544 - RNA, 22 nt, Artificial Sequence
  ELANE RNA Guide
ccuugucugccuccacaagggg

SEQ ID NO: 23545 - RNA, 22 nt, Artificial Sequence
  ELANE RNA Guide
ccuuguggaggcagacaaggug

SEQ ID NO: 23546 - RNA, 22 nt, Artificial Sequence
  ELANE RNA Guide
cggaguccccuuguggaggcag

SEQ ID NO: 23547 - RNA, 22 nt, Artificial Sequence
  ELANE RNA Guide
cuccacaaggggacuccggcag

SEQ ID NO: 23548 - RNA, 22 nt, Artificial Sequence
  ELANE RNA Guide
cugccggaguccccuuguggag

SEQ ID NO: 23549 - RNA, 22 nt, Artificial Sequence
  ELANE RNA Guide
cugccuccacaaggggacuccg

SEQ ID NO: 23550 - RNA, 22 nt, Artificial Sequence
  ELANE RNA Guide
cuugucugccuccacaagggga

SEQ ID NO: 23551 - RNA, 22 nt, Artificial Sequence
  ELANE RNA Guide
cuuguggaggcagacaaggugg

SEQ ID NO: 23552 - RNA, 22 nt, Artificial Sequence
  ELANE RNA Guide
gaguccccuuguggaggcagac

SEQ ID NO: 23553 - RNA, 22 nt, Artificial Sequence
  ELANE RNA Guide
gccggaguccccuuguggaggc

SEQ ID NO: 23554 - RNA, 22 nt, Artificial Sequence
  ELANE RNA Guide
gccuccacaaggggacuccggc

SEQ ID NO: 23555 - RNA, 22 nt, Artificial Sequence
  ELANE RNA Guide
gcugccggaguccccuugugga

SEQ ID NO: 23556 - RNA, 22 nt, Artificial Sequence
  ELANE RNA Guide
ggaguccccuuguggaggcaga

SEQ ID NO: 23557 - RNA, 22 nt, Artificial Sequence
  ELANE RNA Guide
ggcugccggaguccccuugugg

SEQ ID NO: 23558 - RNA, 22 nt, Artificial Sequence
  ELANE RNA Guide
gggcugccggaguccccuugug

SEQ ID NO: 23559 - RNA, 22 nt, Artificial Sequence
  ELANE RNA Guide
ggggcugccggaguccccuugu

SEQ ID NO: 23560 - RNA, 22 nt, Artificial Sequence
  ELANE RNA Guide
guccccuuguggaggcagacaa

SEQ ID NO: 23561 - RNA, 22 nt, Artificial Sequence
  ELANE RNA Guide
gucugccuccacaaggggacuc

SEQ ID NO: 23562 - RNA, 22 nt, Artificial Sequence
  ELANE RNA Guide
uccacaaggggacuccggcagc

SEQ ID NO: 23563 - RNA, 22 nt, Artificial Sequence
  ELANE RNA Guide
uccccuuguggaggcagacaag

SEQ ID NO: 23564 - RNA, 22 nt, Artificial Sequence
  ELANE RNA Guide
ucugccuccacaaggggacucc

SEQ ID NO: 23565 - RNA, 22 nt, Artificial Sequence
  ELANE RNA Guide
ugccggaguccccuuguggagg

SEQ ID NO: 23566 - RNA, 22 nt, Artificial Sequence
  ELANE RNA Guide
ugccuccacaaggggacuccgg

SEQ ID NO: 23567 - RNA, 22 nt, Artificial Sequence
  ELANE RNA Guide
ugucugccuccacaaggggacu

SEQ ID NO: 23568 - RNA, 22 nt, Artificial Sequence
  ELANE RNA Guide
uugucugccuccacaaggggac

SEQ ID NO: 23569 - RNA, 20 nt, Artificial Sequence
  ELANE RNA Guide
acagggggacuccgggacuc

SEQ ID NO: 23570 - RNA, 20 nt, Artificial Sequence
  ELANE RNA Guide
agggggacuccgggacuccg

SEQ ID NO: 23571 - RNA, 20 nt, Artificial Sequence
  ELANE RNA Guide
agucccggagucccccugug

SEQ ID NO: 23572 - RNA, 20 nt, Artificial Sequence
  ELANE RNA Guide
cacagggggacuccgggacu

SEQ ID NO: 23573 - RNA, 20 nt, Artificial Sequence
  ELANE RNA Guide
cagggggacuccgggacucc

SEQ ID NO: 23574 - RNA, 20 nt, Artificial Sequence
  ELANE RNA Guide
ccacagggggacuccgggac

SEQ ID NO: 23575 - RNA, 20 nt, Artificial Sequence
  ELANE RNA Guide
cccggagucccccuguggag

SEQ ID NO: 23576 - RNA, 20 nt, Artificial Sequence
  ELANE RNA Guide
ccggagucccggaguccccc

SEQ ID NO: 23577 - RNA, 20 nt, Artificial Sequence
  ELANE RNA Guide
ccuccacagggggacuccgg

SEQ ID NO: 23578 - RNA, 20 nt, Artificial Sequence
  ELANE RNA Guide
cggagucccggagucccccu

SEQ ID NO: 23579 - RNA, 20 nt, Artificial Sequence
  ELANE RNA Guide
cuccacagggggacuccggg

SEQ ID NO: 23580 - RNA, 20 nt, Artificial Sequence
  ELANE RNA Guide
cugccggagucccggagucc

SEQ ID NO: 23581 - RNA, 20 nt, Artificial Sequence
  ELANE RNA Guide
cugccuccacagggggacuc

SEQ ID NO: 23582 - RNA, 20 nt, Artificial Sequence
  ELANE RNA Guide
gagucccggagucccccugu

SEQ ID NO: 23583 - RNA, 20 nt, Artificial Sequence
  ELANE RNA Guide
gccggagucccggagucccc

SEQ ID NO: 23584 - RNA, 20 nt, Artificial Sequence
  ELANE RNA Guide
gccuccacagggggacuccg

SEQ ID NO: 23585 - RNA, 20 nt, Artificial Sequence
  ELANE RNA Guide
gcugccggagucccggaguc

SEQ ID NO: 23586 - RNA, 20 nt, Artificial Sequence
  ELANE RNA Guide
ggagucccggagucccccug

SEQ ID NO: 23587 - RNA, 20 nt, Artificial Sequence
  ELANE RNA Guide
ggcugccggagucccggagu

SEQ ID NO: 23588 - RNA, 20 nt, Artificial Sequence
  ELANE RNA Guide
gggggacuccgggacuccgg

SEQ ID NO: 23589 - RNA, 20 nt, Artificial Sequence
  ELANE RNA Guide
gucccggagucccccugugg

SEQ ID NO: 23590 - RNA, 20 nt, Artificial Sequence
  ELANE RNA Guide
uccacagggggacuccggga

SEQ ID NO: 23591 - RNA, 20 nt, Artificial Sequence
  ELANE RNA Guide
ucccggagucccccugugga

SEQ ID NO: 23592 - RNA, 20 nt, Artificial Sequence
  ELANE RNA Guide
ugccggagucccggaguccc

SEQ ID NO: 23593 - RNA, 20 nt, Artificial Sequence
  ELANE RNA Guide
ugccuccacagggggacucc

SEQ ID NO: 23594 - RNA, 21 nt, Artificial Sequence
  ELANE RNA Guide
acagggggacuccgggacucc

SEQ ID NO: 23595 - RNA, 21 nt, Artificial Sequence
  ELANE RNA Guide
agggggacuccgggacuccgg

SEQ ID NO: 23596 - RNA, 21 nt, Artificial Sequence
  ELANE RNA Guide
agucccggagucccccugugg

SEQ ID NO: 23597 - RNA, 21 nt, Artificial Sequence
  ELANE RNA Guide
cacagggggacuccgggacuc

SEQ ID NO: 23598 - RNA, 21 nt, Artificial Sequence
  ELANE RNA Guide
cagggggacuccgggacuccg

SEQ ID NO: 23599 - RNA, 21 nt, Artificial Sequence
  ELANE RNA Guide
ccacagggggacuccgggacu

SEQ ID NO: 23600 - RNA, 21 nt, Artificial Sequence
  ELANE RNA Guide
cccggagucccccuguggagg

SEQ ID NO: 23601 - RNA, 21 nt, Artificial Sequence
  ELANE RNA Guide
ccggagucccggagucccccu

SEQ ID NO: 23602 - RNA, 21 nt, Artificial Sequence
  ELANE RNA Guide
ccuccacagggggacuccggg

SEQ ID NO: 23603 - RNA, 21 nt, Artificial Sequence
  ELANE RNA Guide
cggagucccggagucccccug

SEQ ID NO: 23604 - RNA, 21 nt, Artificial Sequence
  ELANE RNA Guide
cuccacagggggacuccggga

SEQ ID NO: 23605 - RNA, 21 nt, Artificial Sequence
  ELANE RNA Guide
cugccggagucccggaguccc

SEQ ID NO: 23606 - RNA, 21 nt, Artificial Sequence
  ELANE RNA Guide
cugccuccacagggggacucc

SEQ ID NO: 23607 - RNA, 21 nt, Artificial Sequence
  ELANE RNA Guide
gagucccggagucccccugug

SEQ ID NO: 23608 - RNA, 21 nt, Artificial Sequence
  ELANE RNA Guide
gccuccacagggggacuccgg

SEQ ID NO: 23609 - RNA, 21 nt, Artificial Sequence
  ELANE RNA Guide
gcugccggagucccggagucc

SEQ ID NO: 23610 - RNA, 21 nt, Artificial Sequence
  ELANE RNA Guide
ggagucccggagucccccugu

SEQ ID NO: 23611 - RNA, 21 nt, Artificial Sequence
  ELANE RNA Guide
ggcugccggagucccggaguc

SEQ ID NO: 23612 - RNA, 21 nt, Artificial Sequence
  ELANE RNA Guide
gggcugccggagucccggagu

SEQ ID NO: 23613 - RNA, 21 nt, Artificial Sequence
  ELANE RNA Guide
gucccggagucccccugugga

SEQ ID NO: 23614 - RNA, 21 nt, Artificial Sequence
  ELANE RNA Guide
uccacagggggacuccgggac

SEQ ID NO: 23615 - RNA, 21 nt, Artificial Sequence
  ELANE RNA Guide
ucccggagucccccuguggag

SEQ ID NO: 23616 - RNA, 21 nt, Artificial Sequence
  ELANE RNA Guide
ucugccuccacagggggacuc

SEQ ID NO: 23617 - RNA, 21 nt, Artificial Sequence
  ELANE RNA Guide
ugccggagucccggagucccc

SEQ ID NO: 23618 - RNA, 21 nt, Artificial Sequence
  ELANE RNA Guide
ugccuccacagggggacuccg

SEQ ID NO: 23619 - RNA, 22 nt, Artificial Sequence
  ELANE RNA Guide
acagggggacuccgggacuccg

SEQ ID NO: 23620 - RNA, 22 nt, Artificial Sequence
  ELANE RNA Guide
agggggacuccgggacuccggc

SEQ ID NO: 23621 - RNA, 22 nt, Artificial Sequence
  ELANE RNA Guide
agucccggagucccccugugga

SEQ ID NO: 23622 - RNA, 22 nt, Artificial Sequence
  ELANE RNA Guide
cacagggggacuccgggacucc

SEQ ID NO: 23623 - RNA, 22 nt, Artificial Sequence
  ELANE RNA Guide
cagggggacuccgggacuccgg

SEQ ID NO: 23624 - RNA, 22 nt, Artificial Sequence
  ELANE RNA Guide
ccacagggggacuccgggacuc

SEQ ID NO: 23625 - RNA, 22 nt, Artificial Sequence
  ELANE RNA Guide
cccggagucccccuguggaggc

SEQ ID NO: 23626 - RNA, 22 nt, Artificial Sequence
  ELANE RNA Guide
ccggagucccggagucccccug

SEQ ID NO: 23627 - RNA, 22 nt, Artificial Sequence
  ELANE RNA Guide
ccuccacagggggacuccggga

SEQ ID NO: 23628 - RNA, 22 nt, Artificial Sequence
  ELANE RNA Guide
cggagucccggagucccccugu

SEQ ID NO: 23629 - RNA, 22 nt, Artificial Sequence
  ELANE RNA Guide
cuccacagggggacuccgggac

SEQ ID NO: 23630 - RNA, 22 nt, Artificial Sequence
  ELANE RNA Guide
cugccggagucccggagucccc

SEQ ID NO: 23631 - RNA, 22 nt, Artificial Sequence
  ELANE RNA Guide
cugccuccacagggggacuccg

SEQ ID NO: 23632 - RNA, 22 nt, Artificial Sequence
  ELANE RNA Guide
gagucccggagucccccugugg

SEQ ID NO: 23633 - RNA, 22 nt, Artificial Sequence
  ELANE RNA Guide
gccggagucccggagucccccu

SEQ ID NO: 23634 - RNA, 22 nt, Artificial Sequence
  ELANE RNA Guide
gccuccacagggggacuccggg

SEQ ID NO: 23635 - RNA, 22 nt, Artificial Sequence
  ELANE RNA Guide
gcugccggagucccggaguccc

SEQ ID NO: 23636 - RNA, 22 nt, Artificial Sequence
  ELANE RNA Guide
ggagucccggagucccccugug

SEQ ID NO: 23637 - RNA, 22 nt, Artificial Sequence
  ELANE RNA Guide
ggcugccggagucccggagucc

SEQ ID NO: 23638 - RNA, 22 nt, Artificial Sequence
  ELANE RNA Guide
gggcugccggagucccggaguc

SEQ ID NO: 23639 - RNA, 22 nt, Artificial Sequence
  ELANE RNA Guide
ggggcugccggagucccggagu

SEQ ID NO: 23640 - RNA, 22 nt, Artificial Sequence
  ELANE RNA Guide
gggggacuccgggacuccggca

SEQ ID NO: 23641 - RNA, 22 nt, Artificial Sequence
  ELANE RNA Guide
gucccggagucccccuguggag

SEQ ID NO: 23642 - RNA, 22 nt, Artificial Sequence
  ELANE RNA Guide
gucugccuccacagggggacuc

SEQ ID NO: 23643 - RNA, 22 nt, Artificial Sequence
  ELANE RNA Guide
uccacagggggacuccgggacu

SEQ ID NO: 23644 - RNA, 22 nt, Artificial Sequence
  ELANE RNA Guide
ucccggagucccccuguggagg

SEQ ID NO: 23645 - RNA, 22 nt, Artificial Sequence
  ELANE RNA Guide
ucugccuccacagggggacucc

SEQ ID NO: 23646 - RNA, 22 nt, Artificial Sequence
  ELANE RNA Guide
ugccggagucccggaguccccc

SEQ ID NO: 23647 - RNA, 22 nt, Artificial Sequence
  ELANE RNA Guide
ugccuccacagggggacuccgg

SEQ ID NO: 23648 - RNA, 20 nt, Artificial Sequence
  ELANE RNA Guide
aaggggcugcccccugugga

SEQ ID NO: 23649 - RNA, 20 nt, Artificial Sequence
  ELANE RNA Guide
acagggggcagccccuuggu

SEQ ID NO: 23650 - RNA, 20 nt, Artificial Sequence
  ELANE RNA Guide
accaaggggcugcccccugu

SEQ ID NO: 23651 - RNA, 20 nt, Artificial Sequence
  ELANE RNA Guide
agaccaaggggcugcccccu

SEQ ID NO: 23652 - RNA, 20 nt, Artificial Sequence
  ELANE RNA Guide
aggggcugcccccuguggag

SEQ ID NO: 23653 - RNA, 20 nt, Artificial Sequence
  ELANE RNA Guide
agggggcagccccuuggucu

SEQ ID NO: 23654 - RNA, 20 nt, Artificial Sequence
  ELANE RNA Guide
caaggggcugcccccugugg

SEQ ID NO: 23655 - RNA, 20 nt, Artificial Sequence
  ELANE RNA Guide
cacagggggcagccccuugg

SEQ ID NO: 23656 - RNA, 20 nt, Artificial Sequence
  ELANE RNA Guide
cagaccaaggggcugccccc

SEQ ID NO: 23657 - RNA, 20 nt, Artificial Sequence
  ELANE RNA Guide
cagggggcagccccuugguc

SEQ ID NO: 23658 - RNA, 20 nt, Artificial Sequence
  ELANE RNA Guide
ccaaggggcugcccccugug

SEQ ID NO: 23659 - RNA, 20 nt, Artificial Sequence
  ELANE RNA Guide
ccacagggggcagccccuug

SEQ ID NO: 23660 - RNA, 20 nt, Artificial Sequence
  ELANE RNA Guide
ccguugcagaccaaggggcu

SEQ ID NO: 23661 - RNA, 20 nt, Artificial Sequence
  ELANE RNA Guide
ccuccacagggggcagcccc

SEQ ID NO: 23662 - RNA, 20 nt, Artificial Sequence
  ELANE RNA Guide
cguugcagaccaaggggcug

SEQ ID NO: 23663 - RNA, 20 nt, Artificial Sequence
  ELANE RNA Guide
cuccacagggggcagccccu

SEQ ID NO: 23664 - RNA, 20 nt, Artificial Sequence
  ELANE RNA Guide
cugcccccuguggaggcaga

SEQ ID NO: 23665 - RNA, 20 nt, Artificial Sequence
  ELANE RNA Guide
cugccuccacagggggcagc

SEQ ID NO: 23666 - RNA, 20 nt, Artificial Sequence
  ELANE RNA Guide
gaccaaggggcugcccccug

SEQ ID NO: 23667 - RNA, 20 nt, Artificial Sequence
  ELANE RNA Guide
gcagaccaaggggcugcccc

SEQ ID NO: 23668 - RNA, 20 nt, Artificial Sequence
  ELANE RNA Guide
gcccccuguggaggcagaca

SEQ ID NO: 23669 - RNA, 20 nt, Artificial Sequence
  ELANE RNA Guide
gccuccacagggggcagccc

SEQ ID NO: 23670 - RNA, 20 nt, Artificial Sequence
  ELANE RNA Guide
gcugcccccuguggaggcag

SEQ ID NO: 23671 - RNA, 20 nt, Artificial Sequence
  ELANE RNA Guide
ggcugcccccuguggaggca

SEQ ID NO: 23672 - RNA, 20 nt, Artificial Sequence
  ELANE RNA Guide
gggcugcccccuguggaggc

SEQ ID NO: 23673 - RNA, 20 nt, Artificial Sequence
  ELANE RNA Guide
ggggcagccccuuggucugc

SEQ ID NO: 23674 - RNA, 20 nt, Artificial Sequence
  ELANE RNA Guide
ggggcugcccccuguggagg

SEQ ID NO: 23675 - RNA, 20 nt, Artificial Sequence
  ELANE RNA Guide
gggggcagccccuuggucug

SEQ ID NO: 23676 - RNA, 20 nt, Artificial Sequence
  ELANE RNA Guide
gucugccuccacagggggca

SEQ ID NO: 23677 - RNA, 20 nt, Artificial Sequence
  ELANE RNA Guide
guugcagaccaaggggcugc

SEQ ID NO: 23678 - RNA, 20 nt, Artificial Sequence
  ELANE RNA Guide
uccacagggggcagccccuu

SEQ ID NO: 23679 - RNA, 20 nt, Artificial Sequence
  ELANE RNA Guide
ucugccuccacagggggcag

SEQ ID NO: 23680 - RNA, 20 nt, Artificial Sequence
  ELANE RNA Guide
ugcagaccaaggggcugccc

SEQ ID NO: 23681 - RNA, 20 nt, Artificial Sequence
  ELANE RNA Guide
ugcccccuguggaggcagac

SEQ ID NO: 23682 - RNA, 20 nt, Artificial Sequence
  ELANE RNA Guide
ugccuccacagggggcagcc

SEQ ID NO: 23683 - RNA, 20 nt, Artificial Sequence
  ELANE RNA Guide
ugucugccuccacagggggc

SEQ ID NO: 23684 - RNA, 20 nt, Artificial Sequence
  ELANE RNA Guide
uugcagaccaaggggcugcc

SEQ ID NO: 23685 - RNA, 20 nt, Artificial Sequence
  ELANE RNA Guide
uugucugccuccacaggggg

SEQ ID NO: 23686 - RNA, 21 nt, Artificial Sequence
  ELANE RNA Guide
aaggggcugcccccuguggag

SEQ ID NO: 23687 - RNA, 21 nt, Artificial Sequence
  ELANE RNA Guide
acagggggcagccccuugguc

SEQ ID NO: 23688 - RNA, 21 nt, Artificial Sequence
  ELANE RNA Guide
accaaggggcugcccccugug

SEQ ID NO: 23689 - RNA, 21 nt, Artificial Sequence
  ELANE RNA Guide
agaccaaggggcugcccccug

SEQ ID NO: 23690 - RNA, 21 nt, Artificial Sequence
  ELANE RNA Guide
aggggcugcccccuguggagg

SEQ ID NO: 23691 - RNA, 21 nt, Artificial Sequence
  ELANE RNA Guide
agggggcagccccuuggucug

SEQ ID NO: 23692 - RNA, 21 nt, Artificial Sequence
  ELANE RNA Guide
caaggggcugcccccugugga

SEQ ID NO: 23693 - RNA, 21 nt, Artificial Sequence
  ELANE RNA Guide
cacagggggcagccccuuggu

SEQ ID NO: 23694 - RNA, 21 nt, Artificial Sequence
  ELANE RNA Guide
cagaccaaggggcugcccccu

SEQ ID NO: 23695 - RNA, 21 nt, Artificial Sequence
  ELANE RNA Guide
cagggggcagccccuuggucu

SEQ ID NO: 23696 - RNA, 21 nt, Artificial Sequence
  ELANE RNA Guide
ccaaggggcugcccccugugg

SEQ ID NO: 23697 - RNA, 21 nt, Artificial Sequence
  ELANE RNA Guide
ccacagggggcagccccuugg

SEQ ID NO: 23698 - RNA, 21 nt, Artificial Sequence
  ELANE RNA Guide
cccguugcagaccaaggggcu

SEQ ID NO: 23699 - RNA, 21 nt, Artificial Sequence
  ELANE RNA Guide
ccguugcagaccaaggggcug

SEQ ID NO: 23700 - RNA, 21 nt, Artificial Sequence
  ELANE RNA Guide
ccuccacagggggcagccccu

SEQ ID NO: 23701 - RNA, 21 nt, Artificial Sequence
  ELANE RNA Guide
cguugcagaccaaggggcugc

SEQ ID NO: 23702 - RNA, 21 nt, Artificial Sequence
  ELANE RNA Guide
cuccacagggggcagccccuu

SEQ ID NO: 23703 - RNA, 21 nt, Artificial Sequence
  ELANE RNA Guide
cugcccccuguggaggcagac

SEQ ID NO: 23704 - RNA, 21 nt, Artificial Sequence
  ELANE RNA Guide
cugccuccacagggggcagcc

SEQ ID NO: 23705 - RNA, 21 nt, Artificial Sequence
  ELANE RNA Guide
cuugucugccuccacaggggg

SEQ ID NO: 23706 - RNA, 21 nt, Artificial Sequence
  ELANE RNA Guide
gaccaaggggcugcccccugu

SEQ ID NO: 23707 - RNA, 21 nt, Artificial Sequence
  ELANE RNA Guide
gcagaccaaggggcugccccc

SEQ ID NO: 23708 - RNA, 21 nt, Artificial Sequence
  ELANE RNA Guide
gcccccuguggaggcagacaa

SEQ ID NO: 23709 - RNA, 21 nt, Artificial Sequence
  ELANE RNA Guide
gcugcccccuguggaggcaga

SEQ ID NO: 23710 - RNA, 21 nt, Artificial Sequence
  ELANE RNA Guide
ggcugcccccuguggaggcag

SEQ ID NO: 23711 - RNA, 21 nt, Artificial Sequence
  ELANE RNA Guide
gggcugcccccuguggaggca

SEQ ID NO: 23712 - RNA, 21 nt, Artificial Sequence
  ELANE RNA Guide
ggggcagccccuuggucugca

SEQ ID NO: 23713 - RNA, 21 nt, Artificial Sequence
  ELANE RNA Guide
gggggcagccccuuggucugc

SEQ ID NO: 23714 - RNA, 21 nt, Artificial Sequence
  ELANE RNA Guide
gucugccuccacagggggcag

SEQ ID NO: 23715 - RNA, 21 nt, Artificial Sequence
  ELANE RNA Guide
guugcagaccaaggggcugcc

SEQ ID NO: 23716 - RNA, 21 nt, Artificial Sequence
  ELANE RNA Guide
uccacagggggcagccccuug

SEQ ID NO: 23717 - RNA, 21 nt, Artificial Sequence
  ELANE RNA Guide
ucugccuccacagggggcagc

SEQ ID NO: 23718 - RNA, 21 nt, Artificial Sequence
  ELANE RNA Guide
ugcagaccaaggggcugcccc

SEQ ID NO: 23719 - RNA, 21 nt, Artificial Sequence
  ELANE RNA Guide
ugcccccuguggaggcagaca

SEQ ID NO: 23720 - RNA, 21 nt, Artificial Sequence
  ELANE RNA Guide
ugccuccacagggggcagccc

SEQ ID NO: 23721 - RNA, 21 nt, Artificial Sequence
  ELANE RNA Guide
ugucugccuccacagggggca

SEQ ID NO: 23722 - RNA, 21 nt, Artificial Sequence
  ELANE RNA Guide
uugcagaccaaggggcugccc

SEQ ID NO: 23723 - RNA, 21 nt, Artificial Sequence
  ELANE RNA Guide
uugucugccuccacagggggc

SEQ ID NO: 23724 - RNA, 22 nt, Artificial Sequence
  ELANE RNA Guide
aaggggcugcccccuguggagg

SEQ ID NO: 23725 - RNA, 22 nt, Artificial Sequence
  ELANE RNA Guide
acagggggcagccccuuggucu

SEQ ID NO: 23726 - RNA, 22 nt, Artificial Sequence
  ELANE RNA Guide
accaaggggcugcccccugugg

SEQ ID NO: 23727 - RNA, 22 nt, Artificial Sequence
  ELANE RNA Guide
agaccaaggggcugcccccugu

SEQ ID NO: 23728 - RNA, 22 nt, Artificial Sequence
  ELANE RNA Guide
aggggcugcccccuguggaggc

SEQ ID NO: 23729 - RNA, 22 nt, Artificial Sequence
  ELANE RNA Guide
agggggcagccccuuggucugc

SEQ ID NO: 23730 - RNA, 22 nt, Artificial Sequence
  ELANE RNA Guide
caaggggcugcccccuguggag

SEQ ID NO: 23731 - RNA, 22 nt, Artificial Sequence
  ELANE RNA Guide
cacagggggcagccccuugguc

SEQ ID NO: 23732 - RNA, 22 nt, Artificial Sequence
  ELANE RNA Guide
cagaccaaggggcugcccccug

SEQ ID NO: 23733 - RNA, 22 nt, Artificial Sequence
  ELANE RNA Guide
cagggggcagccccuuggucug

SEQ ID NO: 23734 - RNA, 22 nt, Artificial Sequence
  ELANE RNA Guide
ccaaggggcugcccccugugga

SEQ ID NO: 23735 - RNA, 22 nt, Artificial Sequence
  ELANE RNA Guide
ccacagggggcagccccuuggu

SEQ ID NO: 23736 - RNA, 22 nt, Artificial Sequence
  ELANE RNA Guide
cccguugcagaccaaggggcug

SEQ ID NO: 23737 - RNA, 22 nt, Artificial Sequence
  ELANE RNA Guide
ccguugcagaccaaggggcugc

SEQ ID NO: 23738 - RNA, 22 nt, Artificial Sequence
  ELANE RNA Guide
ccuccacagggggcagccccuu

SEQ ID NO: 23739 - RNA, 22 nt, Artificial Sequence
  ELANE RNA Guide
ccuugucugccuccacaggggg

SEQ ID NO: 23740 - RNA, 22 nt, Artificial Sequence
  ELANE RNA Guide
cguugcagaccaaggggcugcc

SEQ ID NO: 23741 - RNA, 22 nt, Artificial Sequence
  ELANE RNA Guide
cuccacagggggcagccccuug

SEQ ID NO: 23742 - RNA, 22 nt, Artificial Sequence
  ELANE RNA Guide
cugcccccuguggaggcagaca

SEQ ID NO: 23743 - RNA, 22 nt, Artificial Sequence
  ELANE RNA Guide
cugccuccacagggggcagccc

SEQ ID NO: 23744 - RNA, 22 nt, Artificial Sequence
  ELANE RNA Guide
cuugucugccuccacagggggc

SEQ ID NO: 23745 - RNA, 22 nt, Artificial Sequence
  ELANE RNA Guide
gaccaaggggcugcccccugug

SEQ ID NO: 23746 - RNA, 22 nt, Artificial Sequence
  ELANE RNA Guide
gcagaccaaggggcugcccccu

SEQ ID NO: 23747 - RNA, 22 nt, Artificial Sequence
  ELANE RNA Guide
gcccccuguggaggcagacaag

SEQ ID NO: 23748 - RNA, 22 nt, Artificial Sequence
  ELANE RNA Guide
gcccguugcagaccaaggggcu

SEQ ID NO: 23749 - RNA, 22 nt, Artificial Sequence
  ELANE RNA Guide
gccuccacagggggcagccccu

SEQ ID NO: 23750 - RNA, 22 nt, Artificial Sequence
  ELANE RNA Guide
gcugcccccuguggaggcagac

SEQ ID NO: 23751 - RNA, 22 nt, Artificial Sequence
  ELANE RNA Guide
ggcugcccccuguggaggcaga

SEQ ID NO: 23752 - RNA, 22 nt, Artificial Sequence
  ELANE RNA Guide
gggcugcccccuguggaggcag

SEQ ID NO: 23753 - RNA, 22 nt, Artificial Sequence
  ELANE RNA Guide
ggggcagccccuuggucugcaa

SEQ ID NO: 23754 - RNA, 22 nt, Artificial Sequence
  ELANE RNA Guide
ggggcugcccccuguggaggca

SEQ ID NO: 23755 - RNA, 22 nt, Artificial Sequence
  ELANE RNA Guide
gggggcagccccuuggucugca

SEQ ID NO: 23756 - RNA, 22 nt, Artificial Sequence
  ELANE RNA Guide
gucugccuccacagggggcagc

SEQ ID NO: 23757 - RNA, 22 nt, Artificial Sequence
  ELANE RNA Guide
guugcagaccaaggggcugccc

SEQ ID NO: 23758 - RNA, 22 nt, Artificial Sequence
  ELANE RNA Guide
uccacagggggcagccccuugg

SEQ ID NO: 23759 - RNA, 22 nt, Artificial Sequence
  ELANE RNA Guide
ucugccuccacagggggcagcc

SEQ ID NO: 23760 - RNA, 22 nt, Artificial Sequence
  ELANE RNA Guide
ugcagaccaaggggcugccccc

SEQ ID NO: 23761 - RNA, 22 nt, Artificial Sequence
  ELANE RNA Guide
ugcccccuguggaggcagacaa

SEQ ID NO: 23762 - RNA, 22 nt, Artificial Sequence
  ELANE RNA Guide
ugccuccacagggggcagcccc

SEQ ID NO: 23763 - RNA, 22 nt, Artificial Sequence
  ELANE RNA Guide
ugucugccuccacagggggcag

SEQ ID NO: 23764 - RNA, 22 nt, Artificial Sequence
  ELANE RNA Guide
uugcagaccaaggggcugcccc

SEQ ID NO: 23765 - RNA, 22 nt, Artificial Sequence
  ELANE RNA Guide
uugucugccuccacagggggca

SEQ ID NO: 23766 - RNA, 20 nt, Artificial Sequence
  ELANE RNA Guide
ccccccuguggaggcagaca

SEQ ID NO: 23767 - RNA, 20 nt, Artificial Sequence
  ELANE RNA Guide
ugucugccuccacagggggg

SEQ ID NO: 23768 - RNA, 21 nt, Artificial Sequence
  ELANE RNA Guide
ccccccuguggaggcagacaa

SEQ ID NO: 23769 - RNA, 21 nt, Artificial Sequence
  ELANE RNA Guide
uugucugccuccacagggggg

SEQ ID NO: 23770 - RNA, 22 nt, Artificial Sequence
  ELANE RNA Guide
aaggggcugccggagucccccc

SEQ ID NO: 23771 - RNA, 22 nt, Artificial Sequence
  ELANE RNA Guide
ccccccuguggaggcagacaag

SEQ ID NO: 23772 - RNA, 22 nt, Artificial Sequence
  ELANE RNA Guide
cuugucugccuccacagggggg

SEQ ID NO: 23773 - RNA, 22 nt, Artificial Sequence
  ELANE RNA Guide
ggggggacuccggcagccccuu

SEQ ID NO: 23774 - RNA, 20 nt, Artificial Sequence
  ELANE RNA Guide
aaggggcugccgaagucccc

SEQ ID NO: 23775 - RNA, 20 nt, Artificial Sequence
  ELANE RNA Guide
acagggggacuucggcagcc

SEQ ID NO: 23776 - RNA, 20 nt, Artificial Sequence
  ELANE RNA Guide
accaaggggcugccgaaguc

SEQ ID NO: 23777 - RNA, 20 nt, Artificial Sequence
  ELANE RNA Guide
acuucggcagccccuugguc

SEQ ID NO: 23778 - RNA, 20 nt, Artificial Sequence
  ELANE RNA Guide
agaccaaggggcugccgaag

SEQ ID NO: 23779 - RNA, 20 nt, Artificial Sequence
  ELANE RNA Guide
aggggcugccgaaguccccc

SEQ ID NO: 23780 - RNA, 20 nt, Artificial Sequence
  ELANE RNA Guide
agggggacuucggcagcccc

SEQ ID NO: 23781 - RNA, 20 nt, Artificial Sequence
  ELANE RNA Guide
caaggggcugccgaaguccc

SEQ ID NO: 23782 - RNA, 20 nt, Artificial Sequence
  ELANE RNA Guide
cacagggggacuucggcagc

SEQ ID NO: 23783 - RNA, 20 nt, Artificial Sequence
  ELANE RNA Guide
cagaccaaggggcugccgaa

SEQ ID NO: 23784 - RNA, 20 nt, Artificial Sequence
  ELANE RNA Guide
cagggggacuucggcagccc

SEQ ID NO: 23785 - RNA, 20 nt, Artificial Sequence
  ELANE RNA Guide
ccaaggggcugccgaagucc

SEQ ID NO: 23786 - RNA, 20 nt, Artificial Sequence
  ELANE RNA Guide
ccacagggggacuucggcag

SEQ ID NO: 23787 - RNA, 20 nt, Artificial Sequence
  ELANE RNA Guide
ccgaagucccccuguggagg

SEQ ID NO: 23788 - RNA, 20 nt, Artificial Sequence
  ELANE RNA Guide
ccuccacagggggacuucgg

SEQ ID NO: 23789 - RNA, 20 nt, Artificial Sequence
  ELANE RNA Guide
cgaagucccccuguggaggc

SEQ ID NO: 23790 - RNA, 20 nt, Artificial Sequence
  ELANE RNA Guide
cuccacagggggacuucggc

SEQ ID NO: 23791 - RNA, 20 nt, Artificial Sequence
  ELANE RNA Guide
cugccgaagucccccugugg

SEQ ID NO: 23792 - RNA, 20 nt, Artificial Sequence
  ELANE RNA Guide
cugccuccacagggggacuu

SEQ ID NO: 23793 - RNA, 20 nt, Artificial Sequence
  ELANE RNA Guide
cuucggcagccccuuggucu

SEQ ID NO: 23794 - RNA, 20 nt, Artificial Sequence
  ELANE RNA Guide
gaagucccccuguggaggca

SEQ ID NO: 23795 - RNA, 20 nt, Artificial Sequence
  ELANE RNA Guide
gaccaaggggcugccgaagu

SEQ ID NO: 23796 - RNA, 20 nt, Artificial Sequence
  ELANE RNA Guide
gacuucggcagccccuuggu

SEQ ID NO: 23797 - RNA, 20 nt, Artificial Sequence
  ELANE RNA Guide
gcagaccaaggggcugccga

SEQ ID NO: 23798 - RNA, 20 nt, Artificial Sequence
  ELANE RNA Guide
gccgaagucccccuguggag

SEQ ID NO: 23799 - RNA, 20 nt, Artificial Sequence
  ELANE RNA Guide
gccuccacagggggacuucg

SEQ ID NO: 23800 - RNA, 20 nt, Artificial Sequence
  ELANE RNA Guide
gcugccgaagucccccugug

SEQ ID NO: 23801 - RNA, 20 nt, Artificial Sequence
  ELANE RNA Guide
ggacuucggcagccccuugg

SEQ ID NO: 23802 - RNA, 20 nt, Artificial Sequence
  ELANE RNA Guide
ggcugccgaagucccccugu

SEQ ID NO: 23803 - RNA, 20 nt, Artificial Sequence
  ELANE RNA Guide
gggacuucggcagccccuug

SEQ ID NO: 23804 - RNA, 20 nt, Artificial Sequence
  ELANE RNA Guide
gggcugccgaagucccccug

SEQ ID NO: 23805 - RNA, 20 nt, Artificial Sequence
  ELANE RNA Guide
ggggacuucggcagccccuu

SEQ ID NO: 23806 - RNA, 20 nt, Artificial Sequence
  ELANE RNA Guide
ggggcugccgaagucccccu

SEQ ID NO: 23807 - RNA, 20 nt, Artificial Sequence
  ELANE RNA Guide
gggggacuucggcagccccu

SEQ ID NO: 23808 - RNA, 20 nt, Artificial Sequence
  ELANE RNA Guide
gucugccuccacagggggac

SEQ ID NO: 23809 - RNA, 20 nt, Artificial Sequence
  ELANE RNA Guide
uccacagggggacuucggca

SEQ ID NO: 23810 - RNA, 20 nt, Artificial Sequence
  ELANE RNA Guide
ucugccuccacagggggacu

SEQ ID NO: 23811 - RNA, 20 nt, Artificial Sequence
  ELANE RNA Guide
ugcagaccaaggggcugccg

SEQ ID NO: 23812 - RNA, 20 nt, Artificial Sequence
  ELANE RNA Guide
ugccgaagucccccugugga

SEQ ID NO: 23813 - RNA, 20 nt, Artificial Sequence
  ELANE RNA Guide
ugccuccacagggggacuuc

SEQ ID NO: 23814 - RNA, 20 nt, Artificial Sequence
  ELANE RNA Guide
ugucugccuccacaggggga

SEQ ID NO: 23815 - RNA, 20 nt, Artificial Sequence
  ELANE RNA Guide
uucggcagccccuuggucug

SEQ ID NO: 23816 - RNA, 21 nt, Artificial Sequence
  ELANE RNA Guide
aaggggcugccgaaguccccc

SEQ ID NO: 23817 - RNA, 21 nt, Artificial Sequence
  ELANE RNA Guide
acagggggacuucggcagccc

SEQ ID NO: 23818 - RNA, 21 nt, Artificial Sequence
  ELANE RNA Guide
accaaggggcugccgaagucc

SEQ ID NO: 23819 - RNA, 21 nt, Artificial Sequence
  ELANE RNA Guide
acuucggcagccccuuggucu

SEQ ID NO: 23820 - RNA, 21 nt, Artificial Sequence
  ELANE RNA Guide
agaccaaggggcugccgaagu

SEQ ID NO: 23821 - RNA, 21 nt, Artificial Sequence
  ELANE RNA Guide
aggggcugccgaagucccccu

SEQ ID NO: 23822 - RNA, 21 nt, Artificial Sequence
  ELANE RNA Guide
agggggacuucggcagccccu

SEQ ID NO: 23823 - RNA, 21 nt, Artificial Sequence
  ELANE RNA Guide
caaggggcugccgaagucccc

SEQ ID NO: 23824 - RNA, 21 nt, Artificial Sequence
  ELANE RNA Guide
cacagggggacuucggcagcc

SEQ ID NO: 23825 - RNA, 21 nt, Artificial Sequence
  ELANE RNA Guide
cagaccaaggggcugccgaag

SEQ ID NO: 23826 - RNA, 21 nt, Artificial Sequence
  ELANE RNA Guide
cagggggacuucggcagcccc

SEQ ID NO: 23827 - RNA, 21 nt, Artificial Sequence
  ELANE RNA Guide
ccaaggggcugccgaaguccc

SEQ ID NO: 23828 - RNA, 21 nt, Artificial Sequence
  ELANE RNA Guide
ccacagggggacuucggcagc

SEQ ID NO: 23829 - RNA, 21 nt, Artificial Sequence
  ELANE RNA Guide
ccgaagucccccuguggaggc

SEQ ID NO: 23830 - RNA, 21 nt, Artificial Sequence
  ELANE RNA Guide
ccuccacagggggacuucggc

SEQ ID NO: 23831 - RNA, 21 nt, Artificial Sequence
  ELANE RNA Guide
cgaagucccccuguggaggca

SEQ ID NO: 23832 - RNA, 21 nt, Artificial Sequence
  ELANE RNA Guide
cuccacagggggacuucggca

SEQ ID NO: 23833 - RNA, 21 nt, Artificial Sequence
  ELANE RNA Guide
cugccgaagucccccugugga

SEQ ID NO: 23834 - RNA, 21 nt, Artificial Sequence
  ELANE RNA Guide
cugccuccacagggggacuuc

SEQ ID NO: 23835 - RNA, 21 nt, Artificial Sequence
  ELANE RNA Guide
cuucggcagccccuuggucug

SEQ ID NO: 23836 - RNA, 21 nt, Artificial Sequence
  ELANE RNA Guide
gaagucccccuguggaggcag

SEQ ID NO: 23837 - RNA, 21 nt, Artificial Sequence
  ELANE RNA Guide
gaccaaggggcugccgaaguc

SEQ ID NO: 23838 - RNA, 21 nt, Artificial Sequence
  ELANE RNA Guide
gacuucggcagccccuugguc

SEQ ID NO: 23839 - RNA, 21 nt, Artificial Sequence
  ELANE RNA Guide
gcagaccaaggggcugccgaa

SEQ ID NO: 23840 - RNA, 21 nt, Artificial Sequence
  ELANE RNA Guide
gccgaagucccccuguggagg

SEQ ID NO: 23841 - RNA, 21 nt, Artificial Sequence
  ELANE RNA Guide
gccuccacagggggacuucgg

SEQ ID NO: 23842 - RNA, 21 nt, Artificial Sequence
  ELANE RNA Guide
gcugccgaagucccccugugg

SEQ ID NO: 23843 - RNA, 21 nt, Artificial Sequence
  ELANE RNA Guide
ggacuucggcagccccuuggu

SEQ ID NO: 23844 - RNA, 21 nt, Artificial Sequence
  ELANE RNA Guide
ggcugccgaagucccccugug

SEQ ID NO: 23845 - RNA, 21 nt, Artificial Sequence
  ELANE RNA Guide
gggacuucggcagccccuugg

SEQ ID NO: 23846 - RNA, 21 nt, Artificial Sequence
  ELANE RNA Guide
gggcugccgaagucccccugu

SEQ ID NO: 23847 - RNA, 21 nt, Artificial Sequence
  ELANE RNA Guide
ggggacuucggcagccccuug

SEQ ID NO: 23848 - RNA, 21 nt, Artificial Sequence
  ELANE RNA Guide
ggggcugccgaagucccccug

SEQ ID NO: 23849 - RNA, 21 nt, Artificial Sequence
  ELANE RNA Guide
gggggacuucggcagccccuu

SEQ ID NO: 23850 - RNA, 21 nt, Artificial Sequence
  ELANE RNA Guide
gucugccuccacagggggacu

SEQ ID NO: 23851 - RNA, 21 nt, Artificial Sequence
  ELANE RNA Guide
uccacagggggacuucggcag

SEQ ID NO: 23852 - RNA, 21 nt, Artificial Sequence
  ELANE RNA Guide
ucugccuccacagggggacuu

SEQ ID NO: 23853 - RNA, 21 nt, Artificial Sequence
  ELANE RNA Guide
ugcagaccaaggggcugccga

SEQ ID NO: 23854 - RNA, 21 nt, Artificial Sequence
  ELANE RNA Guide
ugccgaagucccccuguggag

SEQ ID NO: 23855 - RNA, 21 nt, Artificial Sequence
  ELANE RNA Guide
ugccuccacagggggacuucg

SEQ ID NO: 23856 - RNA, 21 nt, Artificial Sequence
  ELANE RNA Guide
ugucugccuccacagggggac

SEQ ID NO: 23857 - RNA, 21 nt, Artificial Sequence
  ELANE RNA Guide
uucggcagccccuuggucugc

SEQ ID NO: 23858 - RNA, 21 nt, Artificial Sequence
  ELANE RNA Guide
uugcagaccaaggggcugccg

SEQ ID NO: 23859 - RNA, 21 nt, Artificial Sequence
  ELANE RNA Guide
uugucugccuccacaggggga

SEQ ID NO: 23860 - RNA, 22 nt, Artificial Sequence
  ELANE RNA Guide
aaggggcugccgaagucccccu

SEQ ID NO: 23861 - RNA, 22 nt, Artificial Sequence
  ELANE RNA Guide
acagggggacuucggcagcccc

SEQ ID NO: 23862 - RNA, 22 nt, Artificial Sequence
  ELANE RNA Guide
accaaggggcugccgaaguccc

SEQ ID NO: 23863 - RNA, 22 nt, Artificial Sequence
  ELANE RNA Guide
acuucggcagccccuuggucug

SEQ ID NO: 23864 - RNA, 22 nt, Artificial Sequence
  ELANE RNA Guide
agaccaaggggcugccgaaguc

SEQ ID NO: 23865 - RNA, 22 nt, Artificial Sequence
  ELANE RNA Guide
aggggcugccgaagucccccug

SEQ ID NO: 23866 - RNA, 22 nt, Artificial Sequence
  ELANE RNA Guide
agggggacuucggcagccccuu

SEQ ID NO: 23867 - RNA, 22 nt, Artificial Sequence
  ELANE RNA Guide
caaggggcugccgaaguccccc

SEQ ID NO: 23868 - RNA, 22 nt, Artificial Sequence
  ELANE RNA Guide
cacagggggacuucggcagccc

SEQ ID NO: 23869 - RNA, 22 nt, Artificial Sequence
  ELANE RNA Guide
cagaccaaggggcugccgaagu

SEQ ID NO: 23870 - RNA, 22 nt, Artificial Sequence
  ELANE RNA Guide
cagggggacuucggcagccccu

SEQ ID NO: 23871 - RNA, 22 nt, Artificial Sequence
  ELANE RNA Guide
ccaaggggcugccgaagucccc

SEQ ID NO: 23872 - RNA, 22 nt, Artificial Sequence
  ELANE RNA Guide
ccacagggggacuucggcagcc

SEQ ID NO: 23873 - RNA, 22 nt, Artificial Sequence
  ELANE RNA Guide
ccgaagucccccuguggaggca

SEQ ID NO: 23874 - RNA, 22 nt, Artificial Sequence
  ELANE RNA Guide
ccuccacagggggacuucggca

SEQ ID NO: 23875 - RNA, 22 nt, Artificial Sequence
  ELANE RNA Guide
cgaagucccccuguggaggcag

SEQ ID NO: 23876 - RNA, 22 nt, Artificial Sequence
  ELANE RNA Guide
cuccacagggggacuucggcag

SEQ ID NO: 23877 - RNA, 22 nt, Artificial Sequence
  ELANE RNA Guide
cugccgaagucccccuguggag

SEQ ID NO: 23878 - RNA, 22 nt, Artificial Sequence
  ELANE RNA Guide
cugccuccacagggggacuucg

SEQ ID NO: 23879 - RNA, 22 nt, Artificial Sequence
  ELANE RNA Guide
cuucggcagccccuuggucugc

SEQ ID NO: 23880 - RNA, 22 nt, Artificial Sequence
  ELANE RNA Guide
cuugucugccuccacaggggga

SEQ ID NO: 23881 - RNA, 22 nt, Artificial Sequence
  ELANE RNA Guide
gaagucccccuguggaggcaga

SEQ ID NO: 23882 - RNA, 22 nt, Artificial Sequence
  ELANE RNA Guide
gaccaaggggcugccgaagucc

SEQ ID NO: 23883 - RNA, 22 nt, Artificial Sequence
  ELANE RNA Guide
gacuucggcagccccuuggucu

SEQ ID NO: 23884 - RNA, 22 nt, Artificial Sequence
  ELANE RNA Guide
gcagaccaaggggcugccgaag

SEQ ID NO: 23885 - RNA, 22 nt, Artificial Sequence
  ELANE RNA Guide
gccgaagucccccuguggaggc

SEQ ID NO: 23886 - RNA, 22 nt, Artificial Sequence
  ELANE RNA Guide
gccuccacagggggacuucggc

SEQ ID NO: 23887 - RNA, 22 nt, Artificial Sequence
  ELANE RNA Guide
gcugccgaagucccccugugga

SEQ ID NO: 23888 - RNA, 22 nt, Artificial Sequence
  ELANE RNA Guide
ggacuucggcagccccuugguc

SEQ ID NO: 23889 - RNA, 22 nt, Artificial Sequence
  ELANE RNA Guide
ggcugccgaagucccccugugg

SEQ ID NO: 23890 - RNA, 22 nt, Artificial Sequence
  ELANE RNA Guide
gggacuucggcagccccuuggu

SEQ ID NO: 23891 - RNA, 22 nt, Artificial Sequence
  ELANE RNA Guide
gggcugccgaagucccccugug

SEQ ID NO: 23892 - RNA, 22 nt, Artificial Sequence
  ELANE RNA Guide
ggggacuucggcagccccuugg

SEQ ID NO: 23893 - RNA, 22 nt, Artificial Sequence
  ELANE RNA Guide
ggggcugccgaagucccccugu

SEQ ID NO: 23894 - RNA, 22 nt, Artificial Sequence
  ELANE RNA Guide
gggggacuucggcagccccuug

SEQ ID NO: 23895 - RNA, 22 nt, Artificial Sequence
  ELANE RNA Guide
gucugccuccacagggggacuu

SEQ ID NO: 23896 - RNA, 22 nt, Artificial Sequence
  ELANE RNA Guide
guugcagaccaaggggcugccg

SEQ ID NO: 23897 - RNA, 22 nt, Artificial Sequence
  ELANE RNA Guide
uccacagggggacuucggcagc

SEQ ID NO: 23898 - RNA, 22 nt, Artificial Sequence
  ELANE RNA Guide
ucugccuccacagggggacuuc

SEQ ID NO: 23899 - RNA, 22 nt, Artificial Sequence
  ELANE RNA Guide
ugcagaccaaggggcugccgaa

SEQ ID NO: 23900 - RNA, 22 nt, Artificial Sequence
  ELANE RNA Guide
ugccgaagucccccuguggagg

SEQ ID NO: 23901 - RNA, 22 nt, Artificial Sequence
  ELANE RNA Guide
ugccuccacagggggacuucgg

SEQ ID NO: 23902 - RNA, 22 nt, Artificial Sequence
  ELANE RNA Guide
ugucugccuccacagggggacu

SEQ ID NO: 23903 - RNA, 22 nt, Artificial Sequence
  ELANE RNA Guide
uucggcagccccuuggucugca

SEQ ID NO: 23904 - RNA, 22 nt, Artificial Sequence
  ELANE RNA Guide
uugcagaccaaggggcugccga

SEQ ID NO: 23905 - RNA, 22 nt, Artificial Sequence
  ELANE RNA Guide
uugucugccuccacagggggac

SEQ ID NO: 23906 - RNA, 20 nt, Artificial Sequence
  ELANE RNA Guide
aaggggcugcgggagucccc

SEQ ID NO: 23907 - RNA, 20 nt, Artificial Sequence
  ELANE RNA Guide
acagggggacucccgcagcc

SEQ ID NO: 23908 - RNA, 20 nt, Artificial Sequence
  ELANE RNA Guide
accaaggggcugcgggaguc

SEQ ID NO: 23909 - RNA, 20 nt, Artificial Sequence
  ELANE RNA Guide
acucccgcagccccuugguc

SEQ ID NO: 23910 - RNA, 20 nt, Artificial Sequence
  ELANE RNA Guide
agaccaaggggcugcgggag

SEQ ID NO: 23911 - RNA, 20 nt, Artificial Sequence
  ELANE RNA Guide
aggggcugcgggaguccccc

SEQ ID NO: 23912 - RNA, 20 nt, Artificial Sequence
  ELANE RNA Guide
agggggacucccgcagcccc

SEQ ID NO: 23913 - RNA, 20 nt, Artificial Sequence
  ELANE RNA Guide
caaggggcugcgggaguccc

SEQ ID NO: 23914 - RNA, 20 nt, Artificial Sequence
  ELANE RNA Guide
cacagggggacucccgcagc

SEQ ID NO: 23915 - RNA, 20 nt, Artificial Sequence
  ELANE RNA Guide
cagaccaaggggcugcggga

SEQ ID NO: 23916 - RNA, 20 nt, Artificial Sequence
  ELANE RNA Guide
cagggggacucccgcagccc

SEQ ID NO: 23917 - RNA, 20 nt, Artificial Sequence
  ELANE RNA Guide
ccaaggggcugcgggagucc

SEQ ID NO: 23918 - RNA, 20 nt, Artificial Sequence
  ELANE RNA Guide
ccacagggggacucccgcag

SEQ ID NO: 23919 - RNA, 20 nt, Artificial Sequence
  ELANE RNA Guide
cccgcagccccuuggucugc

SEQ ID NO: 23920 - RNA, 20 nt, Artificial Sequence
  ELANE RNA Guide
cccguugcagaccaaggggc

SEQ ID NO: 23921 - RNA, 20 nt, Artificial Sequence
  ELANE RNA Guide
ccgcagccccuuggucugca

SEQ ID NO: 23922 - RNA, 20 nt, Artificial Sequence
  ELANE RNA Guide
ccuccacagggggacucccg

SEQ ID NO: 23923 - RNA, 20 nt, Artificial Sequence
  ELANE RNA Guide
cgggagucccccuguggagg

SEQ ID NO: 23924 - RNA, 20 nt, Artificial Sequence
  ELANE RNA Guide
cuccacagggggacucccgc

SEQ ID NO: 23925 - RNA, 20 nt, Artificial Sequence
  ELANE RNA Guide
cucccgcagccccuuggucu

SEQ ID NO: 23926 - RNA, 20 nt, Artificial Sequence
  ELANE RNA Guide
cugcgggagucccccugugg

SEQ ID NO: 23927 - RNA, 20 nt, Artificial Sequence
  ELANE RNA Guide
gaccaaggggcugcgggagu

SEQ ID NO: 23928 - RNA, 20 nt, Artificial Sequence
  ELANE RNA Guide
gacucccgcagccccuuggu

SEQ ID NO: 23929 - RNA, 20 nt, Artificial Sequence
  ELANE RNA Guide
gcagaccaaggggcugcggg

SEQ ID NO: 23930 - RNA, 20 nt, Artificial Sequence
  ELANE RNA Guide
gccuccacagggggacuccc

SEQ ID NO: 23931 - RNA, 20 nt, Artificial Sequence
  ELANE RNA Guide
gcgggagucccccuguggag

SEQ ID NO: 23932 - RNA, 20 nt, Artificial Sequence
  ELANE RNA Guide
gcugcgggagucccccugug

SEQ ID NO: 23933 - RNA, 20 nt, Artificial Sequence
  ELANE RNA Guide
ggacucccgcagccccuugg

SEQ ID NO: 23934 - RNA, 20 nt, Artificial Sequence
  ELANE RNA Guide
ggcugcgggagucccccugu

SEQ ID NO: 23935 - RNA, 20 nt, Artificial Sequence
  ELANE RNA Guide
gggacucccgcagccccuug

SEQ ID NO: 23936 - RNA, 20 nt, Artificial Sequence
  ELANE RNA Guide
gggcugcgggagucccccug

SEQ ID NO: 23937 - RNA, 20 nt, Artificial Sequence
  ELANE RNA Guide
ggggacucccgcagccccuu

SEQ ID NO: 23938 - RNA, 20 nt, Artificial Sequence
  ELANE RNA Guide
ggggcugcgggagucccccu

SEQ ID NO: 23939 - RNA, 20 nt, Artificial Sequence
  ELANE RNA Guide
gggggacucccgcagccccu

SEQ ID NO: 23940 - RNA, 20 nt, Artificial Sequence
  ELANE RNA Guide
uccacagggggacucccgca

SEQ ID NO: 23941 - RNA, 20 nt, Artificial Sequence
  ELANE RNA Guide
ucccgcagccccuuggucug

SEQ ID NO: 23942 - RNA, 20 nt, Artificial Sequence
  ELANE RNA Guide
ugcagaccaaggggcugcgg

SEQ ID NO: 23943 - RNA, 20 nt, Artificial Sequence
  ELANE RNA Guide
ugcgggagucccccugugga

SEQ ID NO: 23944 - RNA, 20 nt, Artificial Sequence
  ELANE RNA Guide
uugcagaccaaggggcugcg

SEQ ID NO: 23945 - RNA, 21 nt, Artificial Sequence
  ELANE RNA Guide
aaggggcugcgggaguccccc

SEQ ID NO: 23946 - RNA, 21 nt, Artificial Sequence
  ELANE RNA Guide
acagggggacucccgcagccc

SEQ ID NO: 23947 - RNA, 21 nt, Artificial Sequence
  ELANE RNA Guide
accaaggggcugcgggagucc

SEQ ID NO: 23948 - RNA, 21 nt, Artificial Sequence
  ELANE RNA Guide
acucccgcagccccuuggucu

SEQ ID NO: 23949 - RNA, 21 nt, Artificial Sequence
  ELANE RNA Guide
agaccaaggggcugcgggagu

SEQ ID NO: 23950 - RNA, 21 nt, Artificial Sequence
  ELANE RNA Guide
aggggcugcgggagucccccu

SEQ ID NO: 23951 - RNA, 21 nt, Artificial Sequence
  ELANE RNA Guide
agggggacucccgcagccccu

SEQ ID NO: 23952 - RNA, 21 nt, Artificial Sequence
  ELANE RNA Guide
caaggggcugcgggagucccc

SEQ ID NO: 23953 - RNA, 21 nt, Artificial Sequence
  ELANE RNA Guide
cacagggggacucccgcagcc

SEQ ID NO: 23954 - RNA, 21 nt, Artificial Sequence
  ELANE RNA Guide
cagaccaaggggcugcgggag

SEQ ID NO: 23955 - RNA, 21 nt, Artificial Sequence
  ELANE RNA Guide
ccaaggggcugcgggaguccc

SEQ ID NO: 23956 - RNA, 21 nt, Artificial Sequence
  ELANE RNA Guide
ccacagggggacucccgcagc

SEQ ID NO: 23957 - RNA, 21 nt, Artificial Sequence
  ELANE RNA Guide
cccgcagccccuuggucugca

SEQ ID NO: 23958 - RNA, 21 nt, Artificial Sequence
  ELANE RNA Guide
ccgcagccccuuggucugcaa

SEQ ID NO: 23959 - RNA, 21 nt, Artificial Sequence
  ELANE RNA Guide
ccuccacagggggacucccgc

SEQ ID NO: 23960 - RNA, 21 nt, Artificial Sequence
  ELANE RNA Guide
cgggagucccccuguggaggc

SEQ ID NO: 23961 - RNA, 21 nt, Artificial Sequence
  ELANE RNA Guide
cuccacagggggacucccgca

SEQ ID NO: 23962 - RNA, 21 nt, Artificial Sequence
  ELANE RNA Guide
cucccgcagccccuuggucug

SEQ ID NO: 23963 - RNA, 21 nt, Artificial Sequence
  ELANE RNA Guide
cugcgggagucccccugugga

SEQ ID NO: 23964 - RNA, 21 nt, Artificial Sequence
  ELANE RNA Guide
gaccaaggggcugcgggaguc

SEQ ID NO: 23965 - RNA, 21 nt, Artificial Sequence
  ELANE RNA Guide
gacucccgcagccccuugguc

SEQ ID NO: 23966 - RNA, 21 nt, Artificial Sequence
  ELANE RNA Guide
gcagaccaaggggcugcggga

SEQ ID NO: 23967 - RNA, 21 nt, Artificial Sequence
  ELANE RNA Guide
gcccguugcagaccaaggggc

SEQ ID NO: 23968 - RNA, 21 nt, Artificial Sequence
  ELANE RNA Guide
gccuccacagggggacucccg

SEQ ID NO: 23969 - RNA, 21 nt, Artificial Sequence
  ELANE RNA Guide
gcgggagucccccuguggagg

SEQ ID NO: 23970 - RNA, 21 nt, Artificial Sequence
  ELANE RNA Guide
gcugcgggagucccccugugg

SEQ ID NO: 23971 - RNA, 21 nt, Artificial Sequence
  ELANE RNA Guide
ggacucccgcagccccuuggu

SEQ ID NO: 23972 - RNA, 21 nt, Artificial Sequence
  ELANE RNA Guide
ggcugcgggagucccccugug

SEQ ID NO: 23973 - RNA, 21 nt, Artificial Sequence
  ELANE RNA Guide
gggacucccgcagccccuugg

SEQ ID NO: 23974 - RNA, 21 nt, Artificial Sequence
  ELANE RNA Guide
gggcugcgggagucccccugu

SEQ ID NO: 23975 - RNA, 21 nt, Artificial Sequence
  ELANE RNA Guide
ggggacucccgcagccccuug

SEQ ID NO: 23976 - RNA, 21 nt, Artificial Sequence
  ELANE RNA Guide
gggggacucccgcagccccuu

SEQ ID NO: 23977 - RNA, 21 nt, Artificial Sequence
  ELANE RNA Guide
guugcagaccaaggggcugcg

SEQ ID NO: 23978 - RNA, 21 nt, Artificial Sequence
  ELANE RNA Guide
uccacagggggacucccgcag

SEQ ID NO: 23979 - RNA, 21 nt, Artificial Sequence
  ELANE RNA Guide
ucccgcagccccuuggucugc

SEQ ID NO: 23980 - RNA, 21 nt, Artificial Sequence
  ELANE RNA Guide
ugcagaccaaggggcugcggg

SEQ ID NO: 23981 - RNA, 21 nt, Artificial Sequence
  ELANE RNA Guide
ugccuccacagggggacuccc

SEQ ID NO: 23982 - RNA, 21 nt, Artificial Sequence
  ELANE RNA Guide
ugcgggagucccccuguggag

SEQ ID NO: 23983 - RNA, 21 nt, Artificial Sequence
  ELANE RNA Guide
uugcagaccaaggggcugcgg

SEQ ID NO: 23984 - RNA, 22 nt, Artificial Sequence
  ELANE RNA Guide
aaggggcugcgggagucccccu

SEQ ID NO: 23985 - RNA, 22 nt, Artificial Sequence
  ELANE RNA Guide
acagggggacucccgcagcccc

SEQ ID NO: 23986 - RNA, 22 nt, Artificial Sequence
  ELANE RNA Guide
accaaggggcugcgggaguccc

SEQ ID NO: 23987 - RNA, 22 nt, Artificial Sequence
  ELANE RNA Guide
acucccgcagccccuuggucug

SEQ ID NO: 23988 - RNA, 22 nt, Artificial Sequence
  ELANE RNA Guide
agaccaaggggcugcgggaguc

SEQ ID NO: 23989 - RNA, 22 nt, Artificial Sequence
  ELANE RNA Guide
agcccguugcagaccaaggggc

SEQ ID NO: 23990 - RNA, 22 nt, Artificial Sequence
  ELANE RNA Guide
aggggcugcgggagucccccug

SEQ ID NO: 23991 - RNA, 22 nt, Artificial Sequence
  ELANE RNA Guide
agggggacucccgcagccccuu

SEQ ID NO: 23992 - RNA, 22 nt, Artificial Sequence
  ELANE RNA Guide
caaggggcugcgggaguccccc

SEQ ID NO: 23993 - RNA, 22 nt, Artificial Sequence
  ELANE RNA Guide
cacagggggacucccgcagccc

SEQ ID NO: 23994 - RNA, 22 nt, Artificial Sequence
  ELANE RNA Guide
cagaccaaggggcugcgggagu

SEQ ID NO: 23995 - RNA, 22 nt, Artificial Sequence
  ELANE RNA Guide
cagggggacucccgcagccccu

SEQ ID NO: 23996 - RNA, 22 nt, Artificial Sequence
  ELANE RNA Guide
ccaaggggcugcgggagucccc

SEQ ID NO: 23997 - RNA, 22 nt, Artificial Sequence
  ELANE RNA Guide
ccacagggggacucccgcagcc

SEQ ID NO: 23998 - RNA, 22 nt, Artificial Sequence
  ELANE RNA Guide
cccgcagccccuuggucugcaa

SEQ ID NO: 23999 - RNA, 22 nt, Artificial Sequence
  ELANE RNA Guide
ccgcagccccuuggucugcaac

SEQ ID NO: 24000 - RNA, 22 nt, Artificial Sequence
  ELANE RNA Guide
ccuccacagggggacucccgca

SEQ ID NO: 24001 - RNA, 22 nt, Artificial Sequence
  ELANE RNA Guide
cgggagucccccuguggaggca

SEQ ID NO: 24002 - RNA, 22 nt, Artificial Sequence
  ELANE RNA Guide
cguugcagaccaaggggcugcg

SEQ ID NO: 24003 - RNA, 22 nt, Artificial Sequence
  ELANE RNA Guide
cuccacagggggacucccgcag

SEQ ID NO: 24004 - RNA, 22 nt, Artificial Sequence
  ELANE RNA Guide
cucccgcagccccuuggucugc

SEQ ID NO: 24005 - RNA, 22 nt, Artificial Sequence
  ELANE RNA Guide
cugccuccacagggggacuccc

SEQ ID NO: 24006 - RNA, 22 nt, Artificial Sequence
  ELANE RNA Guide
cugcgggagucccccuguggag

SEQ ID NO: 24007 - RNA, 22 nt, Artificial Sequence
  ELANE RNA Guide
gaccaaggggcugcgggagucc

SEQ ID NO: 24008 - RNA, 22 nt, Artificial Sequence
  ELANE RNA Guide
gacucccgcagccccuuggucu

SEQ ID NO: 24009 - RNA, 22 nt, Artificial Sequence
  ELANE RNA Guide
gcagaccaaggggcugcgggag

SEQ ID NO: 24010 - RNA, 22 nt, Artificial Sequence
  ELANE RNA Guide
gccuccacagggggacucccgc

SEQ ID NO: 24011 - RNA, 22 nt, Artificial Sequence
  ELANE RNA Guide
gcgggagucccccuguggaggc

SEQ ID NO: 24012 - RNA, 22 nt, Artificial Sequence
  ELANE RNA Guide
gcugcgggagucccccugugga

SEQ ID NO: 24013 - RNA, 22 nt, Artificial Sequence
  ELANE RNA Guide
ggacucccgcagccccuugguc

SEQ ID NO: 24014 - RNA, 22 nt, Artificial Sequence
  ELANE RNA Guide
ggcugcgggagucccccugugg

SEQ ID NO: 24015 - RNA, 22 nt, Artificial Sequence
  ELANE RNA Guide
gggacucccgcagccccuuggu

SEQ ID NO: 24016 - RNA, 22 nt, Artificial Sequence
  ELANE RNA Guide
gggcugcgggagucccccugug

SEQ ID NO: 24017 - RNA, 22 nt, Artificial Sequence
  ELANE RNA Guide
ggggacucccgcagccccuugg

SEQ ID NO: 24018 - RNA, 22 nt, Artificial Sequence
  ELANE RNA Guide
ggggcugcgggagucccccugu

SEQ ID NO: 24019 - RNA, 22 nt, Artificial Sequence
  ELANE RNA Guide
gggggacucccgcagccccuug

SEQ ID NO: 24020 - RNA, 22 nt, Artificial Sequence
  ELANE RNA Guide
guugcagaccaaggggcugcgg

SEQ ID NO: 24021 - RNA, 22 nt, Artificial Sequence
  ELANE RNA Guide
uccacagggggacucccgcagc

SEQ ID NO: 24022 - RNA, 22 nt, Artificial Sequence
  ELANE RNA Guide
ucccgcagccccuuggucugca

SEQ ID NO: 24023 - RNA, 22 nt, Artificial Sequence
  ELANE RNA Guide
ugcagaccaaggggcugcggga

SEQ ID NO: 24024 - RNA, 22 nt, Artificial Sequence
  ELANE RNA Guide
ugccuccacagggggacucccg

SEQ ID NO: 24025 - RNA, 22 nt, Artificial Sequence
  ELANE RNA Guide
ugcgggagucccccuguggagg

SEQ ID NO: 24026 - RNA, 22 nt, Artificial Sequence
  ELANE RNA Guide
uugcagaccaaggggcugcggg

SEQ ID NO: 24027 - RNA, 20 nt, Artificial Sequence
  ELANE RNA Guide
aaggggcugcaggagucccc

SEQ ID NO: 24028 - RNA, 20 nt, Artificial Sequence
  ELANE RNA Guide
acagggggacuccugcagcc

SEQ ID NO: 24029 - RNA, 20 nt, Artificial Sequence
  ELANE RNA Guide
accaaggggcugcaggaguc

SEQ ID NO: 24030 - RNA, 20 nt, Artificial Sequence
  ELANE RNA Guide
acuccugcagccccuugguc

SEQ ID NO: 24031 - RNA, 20 nt, Artificial Sequence
  ELANE RNA Guide
agaccaaggggcugcaggag

SEQ ID NO: 24032 - RNA, 20 nt, Artificial Sequence
  ELANE RNA Guide
aggggcugcaggaguccccc

SEQ ID NO: 24033 - RNA, 20 nt, Artificial Sequence
  ELANE RNA Guide
agggggacuccugcagcccc

SEQ ID NO: 24034 - RNA, 20 nt, Artificial Sequence
  ELANE RNA Guide
caaggggcugcaggaguccc

SEQ ID NO: 24035 - RNA, 20 nt, Artificial Sequence
  ELANE RNA Guide
cacagggggacuccugcagc

SEQ ID NO: 24036 - RNA, 20 nt, Artificial Sequence
  ELANE RNA Guide
cagaccaaggggcugcagga

SEQ ID NO: 24037 - RNA, 20 nt, Artificial Sequence
  ELANE RNA Guide
caggagucccccuguggagg

SEQ ID NO: 24038 - RNA, 20 nt, Artificial Sequence
  ELANE RNA Guide
cagggggacuccugcagccc

SEQ ID NO: 24039 - RNA, 20 nt, Artificial Sequence
  ELANE RNA Guide
ccaaggggcugcaggagucc

SEQ ID NO: 24040 - RNA, 20 nt, Artificial Sequence
  ELANE RNA Guide
ccacagggggacuccugcag

SEQ ID NO: 24041 - RNA, 20 nt, Artificial Sequence
  ELANE RNA Guide
ccuccacagggggacuccug

SEQ ID NO: 24042 - RNA, 20 nt, Artificial Sequence
  ELANE RNA Guide
ccugcagccccuuggucugc

SEQ ID NO: 24043 - RNA, 20 nt, Artificial Sequence
  ELANE RNA Guide
cuccacagggggacuccugc

SEQ ID NO: 24044 - RNA, 20 nt, Artificial Sequence
  ELANE RNA Guide
cuccugcagccccuuggucu

SEQ ID NO: 24045 - RNA, 20 nt, Artificial Sequence
  ELANE RNA Guide
cugcagccccuuggucugca

SEQ ID NO: 24046 - RNA, 20 nt, Artificial Sequence
  ELANE RNA Guide
cugcaggagucccccugugg

SEQ ID NO: 24047 - RNA, 20 nt, Artificial Sequence
  ELANE RNA Guide
gaccaaggggcugcaggagu

SEQ ID NO: 24048 - RNA, 20 nt, Artificial Sequence
  ELANE RNA Guide
gacuccugcagccccuuggu

SEQ ID NO: 24049 - RNA, 20 nt, Artificial Sequence
  ELANE RNA Guide
gcagaccaaggggcugcagg

SEQ ID NO: 24050 - RNA, 20 nt, Artificial Sequence
  ELANE RNA Guide
gcaggagucccccuguggag

SEQ ID NO: 24051 - RNA, 20 nt, Artificial Sequence
  ELANE RNA Guide
gccuccacagggggacuccu

SEQ ID NO: 24052 - RNA, 20 nt, Artificial Sequence
  ELANE RNA Guide
gcugcaggagucccccugug

SEQ ID NO: 24053 - RNA, 20 nt, Artificial Sequence
  ELANE RNA Guide
ggacuccugcagccccuugg

SEQ ID NO: 24054 - RNA, 20 nt, Artificial Sequence
  ELANE RNA Guide
ggcugcaggagucccccugu

SEQ ID NO: 24055 - RNA, 20 nt, Artificial Sequence
  ELANE RNA Guide
gggacuccugcagccccuug

SEQ ID NO: 24056 - RNA, 20 nt, Artificial Sequence
  ELANE RNA Guide
gggcugcaggagucccccug

SEQ ID NO: 24057 - RNA, 20 nt, Artificial Sequence
  ELANE RNA Guide
ggggacuccugcagccccuu

SEQ ID NO: 24058 - RNA, 20 nt, Artificial Sequence
  ELANE RNA Guide
ggggcugcaggagucccccu

SEQ ID NO: 24059 - RNA, 20 nt, Artificial Sequence
  ELANE RNA Guide
gggggacuccugcagccccu

SEQ ID NO: 24060 - RNA, 20 nt, Artificial Sequence
  ELANE RNA Guide
uccacagggggacuccugca

SEQ ID NO: 24061 - RNA, 20 nt, Artificial Sequence
  ELANE RNA Guide
uccugcagccccuuggucug

SEQ ID NO: 24062 - RNA, 20 nt, Artificial Sequence
  ELANE RNA Guide
ugcagaccaaggggcugcag

SEQ ID NO: 24063 - RNA, 20 nt, Artificial Sequence
  ELANE RNA Guide
ugcaggagucccccugugga

SEQ ID NO: 24064 - RNA, 20 nt, Artificial Sequence
  ELANE RNA Guide
uugcagaccaaggggcugca

SEQ ID NO: 24065 - RNA, 21 nt, Artificial Sequence
  ELANE RNA Guide
aaggggcugcaggaguccccc

SEQ ID NO: 24066 - RNA, 21 nt, Artificial Sequence
  ELANE RNA Guide
acagggggacuccugcagccc

SEQ ID NO: 24067 - RNA, 21 nt, Artificial Sequence
  ELANE RNA Guide
accaaggggcugcaggagucc

SEQ ID NO: 24068 - RNA, 21 nt, Artificial Sequence
  ELANE RNA Guide
acuccugcagccccuuggucu

SEQ ID NO: 24069 - RNA, 21 nt, Artificial Sequence
  ELANE RNA Guide
agaccaaggggcugcaggagu

SEQ ID NO: 24070 - RNA, 21 nt, Artificial Sequence
  ELANE RNA Guide
aggggcugcaggagucccccu

SEQ ID NO: 24071 - RNA, 21 nt, Artificial Sequence
  ELANE RNA Guide
agggggacuccugcagccccu

SEQ ID NO: 24072 - RNA, 21 nt, Artificial Sequence
  ELANE RNA Guide
caaggggcugcaggagucccc

SEQ ID NO: 24073 - RNA, 21 nt, Artificial Sequence
  ELANE RNA Guide
cacagggggacuccugcagcc

SEQ ID NO: 24074 - RNA, 21 nt, Artificial Sequence
  ELANE RNA Guide
cagaccaaggggcugcaggag

SEQ ID NO: 24075 - RNA, 21 nt, Artificial Sequence
  ELANE RNA Guide
caggagucccccuguggaggc

SEQ ID NO: 24076 - RNA, 21 nt, Artificial Sequence
  ELANE RNA Guide
cagggggacuccugcagcccc

SEQ ID NO: 24077 - RNA, 21 nt, Artificial Sequence
  ELANE RNA Guide
ccaaggggcugcaggaguccc

SEQ ID NO: 24078 - RNA, 21 nt, Artificial Sequence
  ELANE RNA Guide
ccacagggggacuccugcagc

SEQ ID NO: 24079 - RNA, 21 nt, Artificial Sequence
  ELANE RNA Guide
ccuccacagggggacuccugc

SEQ ID NO: 24080 - RNA, 21 nt, Artificial Sequence
  ELANE RNA Guide
ccugcagccccuuggucugca

SEQ ID NO: 24081 - RNA, 21 nt, Artificial Sequence
  ELANE RNA Guide
cuccacagggggacuccugca

SEQ ID NO: 24082 - RNA, 21 nt, Artificial Sequence
  ELANE RNA Guide
cuccugcagccccuuggucug

SEQ ID NO: 24083 - RNA, 21 nt, Artificial Sequence
  ELANE RNA Guide
cugcagccccuuggucugcaa

SEQ ID NO: 24084 - RNA, 21 nt, Artificial Sequence
  ELANE RNA Guide
cugcaggagucccccugugga

SEQ ID NO: 24085 - RNA, 21 nt, Artificial Sequence
  ELANE RNA Guide
gaccaaggggcugcaggaguc

SEQ ID NO: 24086 - RNA, 21 nt, Artificial Sequence
  ELANE RNA Guide
gacuccugcagccccuugguc

SEQ ID NO: 24087 - RNA, 21 nt, Artificial Sequence
  ELANE RNA Guide
gcagaccaaggggcugcagga

SEQ ID NO: 24088 - RNA, 21 nt, Artificial Sequence
  ELANE RNA Guide
gcaggagucccccuguggagg

SEQ ID NO: 24089 - RNA, 21 nt, Artificial Sequence
  ELANE RNA Guide
gccuccacagggggacuccug

SEQ ID NO: 24090 - RNA, 21 nt, Artificial Sequence
  ELANE RNA Guide
gcugcaggagucccccugugg

SEQ ID NO: 24091 - RNA, 21 nt, Artificial Sequence
  ELANE RNA Guide
ggacuccugcagccccuuggu

SEQ ID NO: 24092 - RNA, 21 nt, Artificial Sequence
  ELANE RNA Guide
ggcugcaggagucccccugug

SEQ ID NO: 24093 - RNA, 21 nt, Artificial Sequence
  ELANE RNA Guide
gggacuccugcagccccuugg

SEQ ID NO: 24094 - RNA, 21 nt, Artificial Sequence
  ELANE RNA Guide
gggcugcaggagucccccugu

SEQ ID NO: 24095 - RNA, 21 nt, Artificial Sequence
  ELANE RNA Guide
ggggacuccugcagccccuug

SEQ ID NO: 24096 - RNA, 21 nt, Artificial Sequence
  ELANE RNA Guide
ggggcugcaggagucccccug

SEQ ID NO: 24097 - RNA, 21 nt, Artificial Sequence
  ELANE RNA Guide
gggggacuccugcagccccuu

SEQ ID NO: 24098 - RNA, 21 nt, Artificial Sequence
  ELANE RNA Guide
guugcagaccaaggggcugca

SEQ ID NO: 24099 - RNA, 21 nt, Artificial Sequence
  ELANE RNA Guide
uccacagggggacuccugcag

SEQ ID NO: 24100 - RNA, 21 nt, Artificial Sequence
  ELANE RNA Guide
uccugcagccccuuggucugc

SEQ ID NO: 24101 - RNA, 21 nt, Artificial Sequence
  ELANE RNA Guide
ugcagaccaaggggcugcagg

SEQ ID NO: 24102 - RNA, 21 nt, Artificial Sequence
  ELANE RNA Guide
ugcaggagucccccuguggag

SEQ ID NO: 24103 - RNA, 21 nt, Artificial Sequence
  ELANE RNA Guide
ugccuccacagggggacuccu

SEQ ID NO: 24104 - RNA, 21 nt, Artificial Sequence
  ELANE RNA Guide
uugcagaccaaggggcugcag

SEQ ID NO: 24105 - RNA, 22 nt, Artificial Sequence
  ELANE RNA Guide
aaggggcugcaggagucccccu

SEQ ID NO: 24106 - RNA, 22 nt, Artificial Sequence
  ELANE RNA Guide
acagggggacuccugcagcccc

SEQ ID NO: 24107 - RNA, 22 nt, Artificial Sequence
  ELANE RNA Guide
accaaggggcugcaggaguccc

SEQ ID NO: 24108 - RNA, 22 nt, Artificial Sequence
  ELANE RNA Guide
acuccugcagccccuuggucug

SEQ ID NO: 24109 - RNA, 22 nt, Artificial Sequence
  ELANE RNA Guide
agaccaaggggcugcaggaguc

SEQ ID NO: 24110 - RNA, 22 nt, Artificial Sequence
  ELANE RNA Guide
aggggcugcaggagucccccug

SEQ ID NO: 24111 - RNA, 22 nt, Artificial Sequence
  ELANE RNA Guide
agggggacuccugcagccccuu

SEQ ID NO: 24112 - RNA, 22 nt, Artificial Sequence
  ELANE RNA Guide
caaggggcugcaggaguccccc

SEQ ID NO: 24113 - RNA, 22 nt, Artificial Sequence
  ELANE RNA Guide
cacagggggacuccugcagccc

SEQ ID NO: 24114 - RNA, 22 nt, Artificial Sequence
  ELANE RNA Guide
cagaccaaggggcugcaggagu

SEQ ID NO: 24115 - RNA, 22 nt, Artificial Sequence
  ELANE RNA Guide
caggagucccccuguggaggca

SEQ ID NO: 24116 - RNA, 22 nt, Artificial Sequence
  ELANE RNA Guide
cagggggacuccugcagccccu

SEQ ID NO: 24117 - RNA, 22 nt, Artificial Sequence
  ELANE RNA Guide
ccaaggggcugcaggagucccc

SEQ ID NO: 24118 - RNA, 22 nt, Artificial Sequence
  ELANE RNA Guide
ccacagggggacuccugcagcc

SEQ ID NO: 24119 - RNA, 22 nt, Artificial Sequence
  ELANE RNA Guide
ccuccacagggggacuccugca

SEQ ID NO: 24120 - RNA, 22 nt, Artificial Sequence
  ELANE RNA Guide
ccugcagccccuuggucugcaa

SEQ ID NO: 24121 - RNA, 22 nt, Artificial Sequence
  ELANE RNA Guide
cguugcagaccaaggggcugca

SEQ ID NO: 24122 - RNA, 22 nt, Artificial Sequence
  ELANE RNA Guide
cuccacagggggacuccugcag

SEQ ID NO: 24123 - RNA, 22 nt, Artificial Sequence
  ELANE RNA Guide
cuccugcagccccuuggucugc

SEQ ID NO: 24124 - RNA, 22 nt, Artificial Sequence
  ELANE RNA Guide
cugcagccccuuggucugcaac

SEQ ID NO: 24125 - RNA, 22 nt, Artificial Sequence
  ELANE RNA Guide
cugcaggagucccccuguggag

SEQ ID NO: 24126 - RNA, 22 nt, Artificial Sequence
  ELANE RNA Guide
cugccuccacagggggacuccu

SEQ ID NO: 24127 - RNA, 22 nt, Artificial Sequence
  ELANE RNA Guide
gaccaaggggcugcaggagucc

SEQ ID NO: 24128 - RNA, 22 nt, Artificial Sequence
  ELANE RNA Guide
gacuccugcagccccuuggucu

SEQ ID NO: 24129 - RNA, 22 nt, Artificial Sequence
  ELANE RNA Guide
gcagaccaaggggcugcaggag

SEQ ID NO: 24130 - RNA, 22 nt, Artificial Sequence
  ELANE RNA Guide
gcaggagucccccuguggaggc

SEQ ID NO: 24131 - RNA, 22 nt, Artificial Sequence
  ELANE RNA Guide
gccuccacagggggacuccugc

SEQ ID NO: 24132 - RNA, 22 nt, Artificial Sequence
  ELANE RNA Guide
gcugcaggagucccccugugga

SEQ ID NO: 24133 - RNA, 22 nt, Artificial Sequence
  ELANE RNA Guide
ggacuccugcagccccuugguc

SEQ ID NO: 24134 - RNA, 22 nt, Artificial Sequence
  ELANE RNA Guide
ggcugcaggagucccccugugg

SEQ ID NO: 24135 - RNA, 22 nt, Artificial Sequence
  ELANE RNA Guide
gggacuccugcagccccuuggu

SEQ ID NO: 24136 - RNA, 22 nt, Artificial Sequence
  ELANE RNA Guide
gggcugcaggagucccccugug

SEQ ID NO: 24137 - RNA, 22 nt, Artificial Sequence
  ELANE RNA Guide
ggggacuccugcagccccuugg

SEQ ID NO: 24138 - RNA, 22 nt, Artificial Sequence
  ELANE RNA Guide
ggggcugcaggagucccccugu

SEQ ID NO: 24139 - RNA, 22 nt, Artificial Sequence
  ELANE RNA Guide
gggggacuccugcagccccuug

SEQ ID NO: 24140 - RNA, 22 nt, Artificial Sequence
  ELANE RNA Guide
guugcagaccaaggggcugcag

SEQ ID NO: 24141 - RNA, 22 nt, Artificial Sequence
  ELANE RNA Guide
uccacagggggacuccugcagc

SEQ ID NO: 24142 - RNA, 22 nt, Artificial Sequence
  ELANE RNA Guide
uccugcagccccuuggucugca

SEQ ID NO: 24143 - RNA, 22 nt, Artificial Sequence
  ELANE RNA Guide
ugcagaccaaggggcugcagga

SEQ ID NO: 24144 - RNA, 22 nt, Artificial Sequence
  ELANE RNA Guide
ugcaggagucccccuguggagg

SEQ ID NO: 24145 - RNA, 22 nt, Artificial Sequence
  ELANE RNA Guide
ugccuccacagggggacuccug

SEQ ID NO: 24146 - RNA, 22 nt, Artificial Sequence
  ELANE RNA Guide
uugcagaccaaggggcugcagg

SEQ ID NO: 24147 - RNA, 20 nt, Artificial Sequence
  ELANE RNA Guide
aaggggcugucggagucccc

SEQ ID NO: 24148 - RNA, 20 nt, Artificial Sequence
  ELANE RNA Guide
acagggggacuccgacagcc

SEQ ID NO: 24149 - RNA, 20 nt, Artificial Sequence
  ELANE RNA Guide
accaaggggcugucggaguc

SEQ ID NO: 24150 - RNA, 20 nt, Artificial Sequence
  ELANE RNA Guide
acuccgacagccccuugguc

SEQ ID NO: 24151 - RNA, 20 nt, Artificial Sequence
  ELANE RNA Guide
agaccaaggggcugucggag

SEQ ID NO: 24152 - RNA, 20 nt, Artificial Sequence
  ELANE RNA Guide
aggggcugucggaguccccc

SEQ ID NO: 24153 - RNA, 20 nt, Artificial Sequence
  ELANE RNA Guide
agggggacuccgacagcccc

SEQ ID NO: 24154 - RNA, 20 nt, Artificial Sequence
  ELANE RNA Guide
caaggggcugucggaguccc

SEQ ID NO: 24155 - RNA, 20 nt, Artificial Sequence
  ELANE RNA Guide
cacagggggacuccgacagc

SEQ ID NO: 24156 - RNA, 20 nt, Artificial Sequence
  ELANE RNA Guide
cagaccaaggggcugucgga

SEQ ID NO: 24157 - RNA, 20 nt, Artificial Sequence
  ELANE RNA Guide
cagggggacuccgacagccc

SEQ ID NO: 24158 - RNA, 20 nt, Artificial Sequence
  ELANE RNA Guide
ccaaggggcugucggagucc

SEQ ID NO: 24159 - RNA, 20 nt, Artificial Sequence
  ELANE RNA Guide
ccacagggggacuccgacag

SEQ ID NO: 24160 - RNA, 20 nt, Artificial Sequence
  ELANE RNA Guide
ccgacagccccuuggucugc

SEQ ID NO: 24161 - RNA, 20 nt, Artificial Sequence
  ELANE RNA Guide
ccuccacagggggacuccga

SEQ ID NO: 24162 - RNA, 20 nt, Artificial Sequence
  ELANE RNA Guide
cgacagccccuuggucugca

SEQ ID NO: 24163 - RNA, 20 nt, Artificial Sequence
  ELANE RNA Guide
cuccacagggggacuccgac

SEQ ID NO: 24164 - RNA, 20 nt, Artificial Sequence
  ELANE RNA Guide
cuccgacagccccuuggucu

SEQ ID NO: 24165 - RNA, 20 nt, Artificial Sequence
  ELANE RNA Guide
cugucggagucccccugugg

SEQ ID NO: 24166 - RNA, 20 nt, Artificial Sequence
  ELANE RNA Guide
gacagccccuuggucugcaa

SEQ ID NO: 24167 - RNA, 20 nt, Artificial Sequence
  ELANE RNA Guide
gaccaaggggcugucggagu

SEQ ID NO: 24168 - RNA, 20 nt, Artificial Sequence
  ELANE RNA Guide
gacuccgacagccccuuggu

SEQ ID NO: 24169 - RNA, 20 nt, Artificial Sequence
  ELANE RNA Guide
gcagaccaaggggcugucgg

SEQ ID NO: 24170 - RNA, 20 nt, Artificial Sequence
  ELANE RNA Guide
gcccguugcagaccaagggg

SEQ ID NO: 24171 - RNA, 20 nt, Artificial Sequence
  ELANE RNA Guide
gcugucggagucccccugug

SEQ ID NO: 24172 - RNA, 20 nt, Artificial Sequence
  ELANE RNA Guide
ggacuccgacagccccuugg

SEQ ID NO: 24173 - RNA, 20 nt, Artificial Sequence
  ELANE RNA Guide
ggcugucggagucccccugu

SEQ ID NO: 24174 - RNA, 20 nt, Artificial Sequence
  ELANE RNA Guide
gggacuccgacagccccuug

SEQ ID NO: 24175 - RNA, 20 nt, Artificial Sequence
  ELANE RNA Guide
gggcugucggagucccccug

SEQ ID NO: 24176 - RNA, 20 nt, Artificial Sequence
  ELANE RNA Guide
ggggacuccgacagccccuu

SEQ ID NO: 24177 - RNA, 20 nt, Artificial Sequence
  ELANE RNA Guide
ggggcugucggagucccccu

SEQ ID NO: 24178 - RNA, 20 nt, Artificial Sequence
  ELANE RNA Guide
gggggacuccgacagccccu

SEQ ID NO: 24179 - RNA, 20 nt, Artificial Sequence
  ELANE RNA Guide
gucggagucccccuguggag

SEQ ID NO: 24180 - RNA, 20 nt, Artificial Sequence
  ELANE RNA Guide
guugcagaccaaggggcugu

SEQ ID NO: 24181 - RNA, 20 nt, Artificial Sequence
  ELANE RNA Guide
uccacagggggacuccgaca

SEQ ID NO: 24182 - RNA, 20 nt, Artificial Sequence
  ELANE RNA Guide
uccgacagccccuuggucug

SEQ ID NO: 24183 - RNA, 20 nt, Artificial Sequence
  ELANE RNA Guide
ugcagaccaaggggcugucg

SEQ ID NO: 24184 - RNA, 20 nt, Artificial Sequence
  ELANE RNA Guide
ugucggagucccccugugga

SEQ ID NO: 24185 - RNA, 20 nt, Artificial Sequence
  ELANE RNA Guide
uugcagaccaaggggcuguc

SEQ ID NO: 24186 - RNA, 21 nt, Artificial Sequence
  ELANE RNA Guide
aaggggcugucggaguccccc

SEQ ID NO: 24187 - RNA, 21 nt, Artificial Sequence
  ELANE RNA Guide
acagggggacuccgacagccc

SEQ ID NO: 24188 - RNA, 21 nt, Artificial Sequence
  ELANE RNA Guide
accaaggggcugucggagucc

SEQ ID NO: 24189 - RNA, 21 nt, Artificial Sequence
  ELANE RNA Guide
acuccgacagccccuuggucu

SEQ ID NO: 24190 - RNA, 21 nt, Artificial Sequence
  ELANE RNA Guide
agaccaaggggcugucggagu

SEQ ID NO: 24191 - RNA, 21 nt, Artificial Sequence
  ELANE RNA Guide
agcccguugcagaccaagggg

SEQ ID NO: 24192 - RNA, 21 nt, Artificial Sequence
  ELANE RNA Guide
aggggcugucggagucccccu

SEQ ID NO: 24193 - RNA, 21 nt, Artificial Sequence
  ELANE RNA Guide
agggggacuccgacagccccu

SEQ ID NO: 24194 - RNA, 21 nt, Artificial Sequence
  ELANE RNA Guide
caaggggcugucggagucccc

SEQ ID NO: 24195 - RNA, 21 nt, Artificial Sequence
  ELANE RNA Guide
cacagggggacuccgacagcc

SEQ ID NO: 24196 - RNA, 21 nt, Artificial Sequence
  ELANE RNA Guide
cagaccaaggggcugucggag

SEQ ID NO: 24197 - RNA, 21 nt, Artificial Sequence
  ELANE RNA Guide
cagggggacuccgacagcccc

SEQ ID NO: 24198 - RNA, 21 nt, Artificial Sequence
  ELANE RNA Guide
ccaaggggcugucggaguccc

SEQ ID NO: 24199 - RNA, 21 nt, Artificial Sequence
  ELANE RNA Guide
ccacagggggacuccgacagc

SEQ ID NO: 24200 - RNA, 21 nt, Artificial Sequence
  ELANE RNA Guide
ccgacagccccuuggucugca

SEQ ID NO: 24201 - RNA, 21 nt, Artificial Sequence
  ELANE RNA Guide
ccuccacagggggacuccgac

SEQ ID NO: 24202 - RNA, 21 nt, Artificial Sequence
  ELANE RNA Guide
cgacagccccuuggucugcaa

SEQ ID NO: 24203 - RNA, 21 nt, Artificial Sequence
  ELANE RNA Guide
cguugcagaccaaggggcugu

SEQ ID NO: 24204 - RNA, 21 nt, Artificial Sequence
  ELANE RNA Guide
cuccacagggggacuccgaca

SEQ ID NO: 24205 - RNA, 21 nt, Artificial Sequence
  ELANE RNA Guide
cuccgacagccccuuggucug

SEQ ID NO: 24206 - RNA, 21 nt, Artificial Sequence
  ELANE RNA Guide
cugucggagucccccugugga

SEQ ID NO: 24207 - RNA, 21 nt, Artificial Sequence
  ELANE RNA Guide
gacagccccuuggucugcaac

SEQ ID NO: 24208 - RNA, 21 nt, Artificial Sequence
  ELANE RNA Guide
gaccaaggggcugucggaguc

SEQ ID NO: 24209 - RNA, 21 nt, Artificial Sequence
  ELANE RNA Guide
gacuccgacagccccuugguc

SEQ ID NO: 24210 - RNA, 21 nt, Artificial Sequence
  ELANE RNA Guide
gcagaccaaggggcugucgga

SEQ ID NO: 24211 - RNA, 21 nt, Artificial Sequence
  ELANE RNA Guide
gccuccacagggggacuccga

SEQ ID NO: 24212 - RNA, 21 nt, Artificial Sequence
  ELANE RNA Guide
gcugucggagucccccugugg

SEQ ID NO: 24213 - RNA, 21 nt, Artificial Sequence
  ELANE RNA Guide
ggacuccgacagccccuuggu

SEQ ID NO: 24214 - RNA, 21 nt, Artificial Sequence
  ELANE RNA Guide
ggcugucggagucccccugug

SEQ ID NO: 24215 - RNA, 21 nt, Artificial Sequence
  ELANE RNA Guide
gggacuccgacagccccuugg

SEQ ID NO: 24216 - RNA, 21 nt, Artificial Sequence
  ELANE RNA Guide
gggcugucggagucccccugu

SEQ ID NO: 24217 - RNA, 21 nt, Artificial Sequence
  ELANE RNA Guide
ggggacuccgacagccccuug

SEQ ID NO: 24218 - RNA, 21 nt, Artificial Sequence
  ELANE RNA Guide
ggggcugucggagucccccug

SEQ ID NO: 24219 - RNA, 21 nt, Artificial Sequence
  ELANE RNA Guide
gggggacuccgacagccccuu

SEQ ID NO: 24220 - RNA, 21 nt, Artificial Sequence
  ELANE RNA Guide
gucggagucccccuguggagg

SEQ ID NO: 24221 - RNA, 21 nt, Artificial Sequence
  ELANE RNA Guide
guugcagaccaaggggcuguc

SEQ ID NO: 24222 - RNA, 21 nt, Artificial Sequence
  ELANE RNA Guide
uccacagggggacuccgacag

SEQ ID NO: 24223 - RNA, 21 nt, Artificial Sequence
  ELANE RNA Guide
uccgacagccccuuggucugc

SEQ ID NO: 24224 - RNA, 21 nt, Artificial Sequence
  ELANE RNA Guide
ugcagaccaaggggcugucgg

SEQ ID NO: 24225 - RNA, 21 nt, Artificial Sequence
  ELANE RNA Guide
ugucggagucccccuguggag

SEQ ID NO: 24226 - RNA, 21 nt, Artificial Sequence
  ELANE RNA Guide
uugcagaccaaggggcugucg

SEQ ID NO: 24227 - RNA, 22 nt, Artificial Sequence
  ELANE RNA Guide
aaggggcugucggagucccccu

SEQ ID NO: 24228 - RNA, 22 nt, Artificial Sequence
  ELANE RNA Guide
acagggggacuccgacagcccc

SEQ ID NO: 24229 - RNA, 22 nt, Artificial Sequence
  ELANE RNA Guide
accaaggggcugucggaguccc

SEQ ID NO: 24230 - RNA, 22 nt, Artificial Sequence
  ELANE RNA Guide
acuccgacagccccuuggucug

SEQ ID NO: 24231 - RNA, 22 nt, Artificial Sequence
  ELANE RNA Guide
agaccaaggggcugucggaguc

SEQ ID NO: 24232 - RNA, 22 nt, Artificial Sequence
  ELANE RNA Guide
aggggcugucggagucccccug

SEQ ID NO: 24233 - RNA, 22 nt, Artificial Sequence
  ELANE RNA Guide
agggggacuccgacagccccuu

SEQ ID NO: 24234 - RNA, 22 nt, Artificial Sequence
  ELANE RNA Guide
caaggggcugucggaguccccc

SEQ ID NO: 24235 - RNA, 22 nt, Artificial Sequence
  ELANE RNA Guide
cacagggggacuccgacagccc

SEQ ID NO: 24236 - RNA, 22 nt, Artificial Sequence
  ELANE RNA Guide
cagaccaaggggcugucggagu

SEQ ID NO: 24237 - RNA, 22 nt, Artificial Sequence
  ELANE RNA Guide
cagggggacuccgacagccccu

SEQ ID NO: 24238 - RNA, 22 nt, Artificial Sequence
  ELANE RNA Guide
ccaaggggcugucggagucccc

SEQ ID NO: 24239 - RNA, 22 nt, Artificial Sequence
  ELANE RNA Guide
ccacagggggacuccgacagcc

SEQ ID NO: 24240 - RNA, 22 nt, Artificial Sequence
  ELANE RNA Guide
ccgacagccccuuggucugcaa

SEQ ID NO: 24241 - RNA, 22 nt, Artificial Sequence
  ELANE RNA Guide
ccguugcagaccaaggggcugu

SEQ ID NO: 24242 - RNA, 22 nt, Artificial Sequence
  ELANE RNA Guide
ccuccacagggggacuccgaca

SEQ ID NO: 24243 - RNA, 22 nt, Artificial Sequence
  ELANE RNA Guide
cgacagccccuuggucugcaac

SEQ ID NO: 24244 - RNA, 22 nt, Artificial Sequence
  ELANE RNA Guide
cguugcagaccaaggggcuguc

SEQ ID NO: 24245 - RNA, 22 nt, Artificial Sequence
  ELANE RNA Guide
cuccacagggggacuccgacag

SEQ ID NO: 24246 - RNA, 22 nt, Artificial Sequence
  ELANE RNA Guide
cuccgacagccccuuggucugc

SEQ ID NO: 24247 - RNA, 22 nt, Artificial Sequence
  ELANE RNA Guide
cugucggagucccccuguggag

SEQ ID NO: 24248 - RNA, 22 nt, Artificial Sequence
  ELANE RNA Guide
gacagccccuuggucugcaacg

SEQ ID NO: 24249 - RNA, 22 nt, Artificial Sequence
  ELANE RNA Guide
gaccaaggggcugucggagucc

SEQ ID NO: 24250 - RNA, 22 nt, Artificial Sequence
  ELANE RNA Guide
gacuccgacagccccuuggucu

SEQ ID NO: 24251 - RNA, 22 nt, Artificial Sequence
  ELANE RNA Guide
gcagaccaaggggcugucggag

SEQ ID NO: 24252 - RNA, 22 nt, Artificial Sequence
  ELANE RNA Guide
gccuccacagggggacuccgac

SEQ ID NO: 24253 - RNA, 22 nt, Artificial Sequence
  ELANE RNA Guide
gcugucggagucccccugugga

SEQ ID NO: 24254 - RNA, 22 nt, Artificial Sequence
  ELANE RNA Guide
ggacuccgacagccccuugguc

SEQ ID NO: 24255 - RNA, 22 nt, Artificial Sequence
  ELANE RNA Guide
ggcugucggagucccccugugg

SEQ ID NO: 24256 - RNA, 22 nt, Artificial Sequence
  ELANE RNA Guide
gggacuccgacagccccuuggu

SEQ ID NO: 24257 - RNA, 22 nt, Artificial Sequence
  ELANE RNA Guide
gggcugucggagucccccugug

SEQ ID NO: 24258 - RNA, 22 nt, Artificial Sequence
  ELANE RNA Guide
ggggacuccgacagccccuugg

SEQ ID NO: 24259 - RNA, 22 nt, Artificial Sequence
  ELANE RNA Guide
ggggcugucggagucccccugu

SEQ ID NO: 24260 - RNA, 22 nt, Artificial Sequence
  ELANE RNA Guide
gggggacuccgacagccccuug

SEQ ID NO: 24261 - RNA, 22 nt, Artificial Sequence
  ELANE RNA Guide
gucggagucccccuguggaggc

SEQ ID NO: 24262 - RNA, 22 nt, Artificial Sequence
  ELANE RNA Guide
guugcagaccaaggggcugucg

SEQ ID NO: 24263 - RNA, 22 nt, Artificial Sequence
  ELANE RNA Guide
uagcccguugcagaccaagggg

SEQ ID NO: 24264 - RNA, 22 nt, Artificial Sequence
  ELANE RNA Guide
uccacagggggacuccgacagc

SEQ ID NO: 24265 - RNA, 22 nt, Artificial Sequence
  ELANE RNA Guide
uccgacagccccuuggucugca

SEQ ID NO: 24266 - RNA, 22 nt, Artificial Sequence
  ELANE RNA Guide
ugcagaccaaggggcugucgga

SEQ ID NO: 24267 - RNA, 22 nt, Artificial Sequence
  ELANE RNA Guide
ugccuccacagggggacuccga

SEQ ID NO: 24268 - RNA, 22 nt, Artificial Sequence
  ELANE RNA Guide
ugucggagucccccuguggagg

SEQ ID NO: 24269 - RNA, 22 nt, Artificial Sequence
  ELANE RNA Guide
uugcagaccaaggggcugucgg

SEQ ID NO: 24270 - RNA, 20 nt, Artificial Sequence
  ELANE RNA Guide
aagggcugccggaguccccc

SEQ ID NO: 24271 - RNA, 20 nt, Artificial Sequence
  ELANE RNA Guide
acagggggacuccggcagcc

SEQ ID NO: 24272 - RNA, 20 nt, Artificial Sequence
  ELANE RNA Guide
accaagggcugccggagucc

SEQ ID NO: 24273 - RNA, 20 nt, Artificial Sequence
  ELANE RNA Guide
acuccggcagcccuuggucu

SEQ ID NO: 24274 - RNA, 20 nt, Artificial Sequence
  ELANE RNA Guide
agaccaagggcugccggagu

SEQ ID NO: 24275 - RNA, 20 nt, Artificial Sequence
  ELANE RNA Guide
agcccguugcagaccaaggg

SEQ ID NO: 24276 - RNA, 20 nt, Artificial Sequence
  ELANE RNA Guide
agcccuuggucugcaacggg

SEQ ID NO: 24277 - RNA, 20 nt, Artificial Sequence
  ELANE RNA Guide
agggcugccggagucccccu

SEQ ID NO: 24278 - RNA, 20 nt, Artificial Sequence
  ELANE RNA Guide
agggggacuccggcagcccu

SEQ ID NO: 24279 - RNA, 20 nt, Artificial Sequence
  ELANE RNA Guide
auuagcccguugcagaccaa

SEQ ID NO: 24280 - RNA, 20 nt, Artificial Sequence
  ELANE RNA Guide
caagggcugccggagucccc

SEQ ID NO: 24281 - RNA, 20 nt, Artificial Sequence
  ELANE RNA Guide
cacagggggacuccggcagc

SEQ ID NO: 24282 - RNA, 20 nt, Artificial Sequence
  ELANE RNA Guide
cagaccaagggcugccggag

SEQ ID NO: 24283 - RNA, 20 nt, Artificial Sequence
  ELANE RNA Guide
cagcccuuggucugcaacgg

SEQ ID NO: 24284 - RNA, 20 nt, Artificial Sequence
  ELANE RNA Guide
cagggggacuccggcagccc

SEQ ID NO: 24285 - RNA, 20 nt, Artificial Sequence
  ELANE RNA Guide
ccaagggcugccggaguccc

SEQ ID NO: 24286 - RNA, 20 nt, Artificial Sequence
  ELANE RNA Guide
ccacagggggacuccggcag

SEQ ID NO: 24287 - RNA, 20 nt, Artificial Sequence
  ELANE RNA Guide
cccguugcagaccaagggcu

SEQ ID NO: 24288 - RNA, 20 nt, Artificial Sequence
  ELANE RNA Guide
ccggcagcccuuggucugca

SEQ ID NO: 24289 - RNA, 20 nt, Artificial Sequence
  ELANE RNA Guide
ccguugcagaccaagggcug

SEQ ID NO: 24290 - RNA, 20 nt, Artificial Sequence
  ELANE RNA Guide
cggcagcccuuggucugcaa

SEQ ID NO: 24291 - RNA, 20 nt, Artificial Sequence
  ELANE RNA Guide
cguugcagaccaagggcugc

SEQ ID NO: 24292 - RNA, 20 nt, Artificial Sequence
  ELANE RNA Guide
cuccggcagcccuuggucug

SEQ ID NO: 24293 - RNA, 20 nt, Artificial Sequence
  ELANE RNA Guide
gaccaagggcugccggaguc

SEQ ID NO: 24294 - RNA, 20 nt, Artificial Sequence
  ELANE RNA Guide
gacuccggcagcccuugguc

SEQ ID NO: 24295 - RNA, 20 nt, Artificial Sequence
  ELANE RNA Guide
gcagaccaagggcugccgga

SEQ ID NO: 24296 - RNA, 20 nt, Artificial Sequence
  ELANE RNA Guide
gcagcccuuggucugcaacg

SEQ ID NO: 24297 - RNA, 20 nt, Artificial Sequence
  ELANE RNA Guide
gcccguugcagaccaagggc

SEQ ID NO: 24298 - RNA, 20 nt, Artificial Sequence
  ELANE RNA Guide
ggacuccggcagcccuuggu

SEQ ID NO: 24299 - RNA, 20 nt, Artificial Sequence
  ELANE RNA Guide
ggcagcccuuggucugcaac

SEQ ID NO: 24300 - RNA, 20 nt, Artificial Sequence
  ELANE RNA Guide
gggacuccggcagcccuugg

SEQ ID NO: 24301 - RNA, 20 nt, Artificial Sequence
  ELANE RNA Guide
ggggacuccggcagcccuug

SEQ ID NO: 24302 - RNA, 20 nt, Artificial Sequence
  ELANE RNA Guide
gggggacuccggcagcccuu

SEQ ID NO: 24303 - RNA, 20 nt, Artificial Sequence
  ELANE RNA Guide
guugcagaccaagggcugcc

SEQ ID NO: 24304 - RNA, 20 nt, Artificial Sequence
  ELANE RNA Guide
uagcccguugcagaccaagg

SEQ ID NO: 24305 - RNA, 20 nt, Artificial Sequence
  ELANE RNA Guide
uccggcagcccuuggucugc

SEQ ID NO: 24306 - RNA, 20 nt, Artificial Sequence
  ELANE RNA Guide
ugcagaccaagggcugccgg

SEQ ID NO: 24307 - RNA, 20 nt, Artificial Sequence
  ELANE RNA Guide
uuagcccguugcagaccaag

SEQ ID NO: 24308 - RNA, 20 nt, Artificial Sequence
  ELANE RNA Guide
uugcagaccaagggcugccg

SEQ ID NO: 24309 - RNA, 21 nt, Artificial Sequence
  ELANE RNA Guide
aagggcugccggagucccccu

SEQ ID NO: 24310 - RNA, 21 nt, Artificial Sequence
  ELANE RNA Guide
acagggggacuccggcagccc

SEQ ID NO: 24311 - RNA, 21 nt, Artificial Sequence
  ELANE RNA Guide
accaagggcugccggaguccc

SEQ ID NO: 24312 - RNA, 21 nt, Artificial Sequence
  ELANE RNA Guide
acuccggcagcccuuggucug

SEQ ID NO: 24313 - RNA, 21 nt, Artificial Sequence
  ELANE RNA Guide
agaccaagggcugccggaguc

SEQ ID NO: 24314 - RNA, 21 nt, Artificial Sequence
  ELANE RNA Guide
agcccguugcagaccaagggc

SEQ ID NO: 24315 - RNA, 21 nt, Artificial Sequence
  ELANE RNA Guide
agcccuuggucugcaacgggc

SEQ ID NO: 24316 - RNA, 21 nt, Artificial Sequence
  ELANE RNA Guide
agggcugccggagucccccug

SEQ ID NO: 24317 - RNA, 21 nt, Artificial Sequence
  ELANE RNA Guide
agggggacuccggcagcccuu

SEQ ID NO: 24318 - RNA, 21 nt, Artificial Sequence
  ELANE RNA Guide
auuagcccguugcagaccaag

SEQ ID NO: 24319 - RNA, 21 nt, Artificial Sequence
  ELANE RNA Guide
caagggcugccggaguccccc

SEQ ID NO: 24320 - RNA, 21 nt, Artificial Sequence
  ELANE RNA Guide
cacagggggacuccggcagcc

SEQ ID NO: 24321 - RNA, 21 nt, Artificial Sequence
  ELANE RNA Guide
cagaccaagggcugccggagu

SEQ ID NO: 24322 - RNA, 21 nt, Artificial Sequence
  ELANE RNA Guide
cagcccuuggucugcaacggg

SEQ ID NO: 24323 - RNA, 21 nt, Artificial Sequence
  ELANE RNA Guide
cagggggacuccggcagcccu

SEQ ID NO: 24324 - RNA, 21 nt, Artificial Sequence
  ELANE RNA Guide
ccaagggcugccggagucccc

SEQ ID NO: 24325 - RNA, 21 nt, Artificial Sequence
  ELANE RNA Guide
ccacagggggacuccggcagc

SEQ ID NO: 24326 - RNA, 21 nt, Artificial Sequence
  ELANE RNA Guide
cccguugcagaccaagggcug

SEQ ID NO: 24327 - RNA, 21 nt, Artificial Sequence
  ELANE RNA Guide
ccggcagcccuuggucugcaa

SEQ ID NO: 24328 - RNA, 21 nt, Artificial Sequence
  ELANE RNA Guide
ccguugcagaccaagggcugc

SEQ ID NO: 24329 - RNA, 21 nt, Artificial Sequence
  ELANE RNA Guide
cggcagcccuuggucugcaac

SEQ ID NO: 24330 - RNA, 21 nt, Artificial Sequence
  ELANE RNA Guide
cguugcagaccaagggcugcc

SEQ ID NO: 24331 - RNA, 21 nt, Artificial Sequence
  ELANE RNA Guide
cuccggcagcccuuggucugc

SEQ ID NO: 24332 - RNA, 21 nt, Artificial Sequence
  ELANE RNA Guide
gaccaagggcugccggagucc

SEQ ID NO: 24333 - RNA, 21 nt, Artificial Sequence
  ELANE RNA Guide
gacuccggcagcccuuggucu

SEQ ID NO: 24334 - RNA, 21 nt, Artificial Sequence
  ELANE RNA Guide
gauuagcccguugcagaccaa

SEQ ID NO: 24335 - RNA, 21 nt, Artificial Sequence
  ELANE RNA Guide
gcagaccaagggcugccggag

SEQ ID NO: 24336 - RNA, 21 nt, Artificial Sequence
  ELANE RNA Guide
gcagcccuuggucugcaacgg

SEQ ID NO: 24337 - RNA, 21 nt, Artificial Sequence
  ELANE RNA Guide
gcccguugcagaccaagggcu

SEQ ID NO: 24338 - RNA, 21 nt, Artificial Sequence
  ELANE RNA Guide
ggacuccggcagcccuugguc

SEQ ID NO: 24339 - RNA, 21 nt, Artificial Sequence
  ELANE RNA Guide
ggcagcccuuggucugcaacg

SEQ ID NO: 24340 - RNA, 21 nt, Artificial Sequence
  ELANE RNA Guide
gggacuccggcagcccuuggu

SEQ ID NO: 24341 - RNA, 21 nt, Artificial Sequence
  ELANE RNA Guide
ggggacuccggcagcccuugg

SEQ ID NO: 24342 - RNA, 21 nt, Artificial Sequence
  ELANE RNA Guide
gggggacuccggcagcccuug

SEQ ID NO: 24343 - RNA, 21 nt, Artificial Sequence
  ELANE RNA Guide
guugcagaccaagggcugccg

SEQ ID NO: 24344 - RNA, 21 nt, Artificial Sequence
  ELANE RNA Guide
uagcccguugcagaccaaggg

SEQ ID NO: 24345 - RNA, 21 nt, Artificial Sequence
  ELANE RNA Guide
uccacagggggacuccggcag

SEQ ID NO: 24346 - RNA, 21 nt, Artificial Sequence
  ELANE RNA Guide
uccggcagcccuuggucugca

SEQ ID NO: 24347 - RNA, 21 nt, Artificial Sequence
  ELANE RNA Guide
ugcagaccaagggcugccgga

SEQ ID NO: 24348 - RNA, 21 nt, Artificial Sequence
  ELANE RNA Guide
uuagcccguugcagaccaagg

SEQ ID NO: 24349 - RNA, 21 nt, Artificial Sequence
  ELANE RNA Guide
uugcagaccaagggcugccgg

SEQ ID NO: 24350 - RNA, 22 nt, Artificial Sequence
  ELANE RNA Guide
aagggcugccggagucccccug

SEQ ID NO: 24351 - RNA, 22 nt, Artificial Sequence
  ELANE RNA Guide
acagggggacuccggcagcccu

SEQ ID NO: 24352 - RNA, 22 nt, Artificial Sequence
  ELANE RNA Guide
accaagggcugccggagucccc

SEQ ID NO: 24353 - RNA, 22 nt, Artificial Sequence
  ELANE RNA Guide
acuccggcagcccuuggucugc

SEQ ID NO: 24354 - RNA, 22 nt, Artificial Sequence
  ELANE RNA Guide
agaccaagggcugccggagucc

SEQ ID NO: 24355 - RNA, 22 nt, Artificial Sequence
  ELANE RNA Guide
agcccguugcagaccaagggcu

SEQ ID NO: 24356 - RNA, 22 nt, Artificial Sequence
  ELANE RNA Guide
agcccuuggucugcaacgggcu

SEQ ID NO: 24357 - RNA, 22 nt, Artificial Sequence
  ELANE RNA Guide
agggcugccggagucccccugu

SEQ ID NO: 24358 - RNA, 22 nt, Artificial Sequence
  ELANE RNA Guide
agggggacuccggcagcccuug

SEQ ID NO: 24359 - RNA, 22 nt, Artificial Sequence
  ELANE RNA Guide
auuagcccguugcagaccaagg

SEQ ID NO: 24360 - RNA, 22 nt, Artificial Sequence
  ELANE RNA Guide
caagggcugccggagucccccu

SEQ ID NO: 24361 - RNA, 22 nt, Artificial Sequence
  ELANE RNA Guide
cacagggggacuccggcagccc

SEQ ID NO: 24362 - RNA, 22 nt, Artificial Sequence
  ELANE RNA Guide
cagaccaagggcugccggaguc

SEQ ID NO: 24363 - RNA, 22 nt, Artificial Sequence
  ELANE RNA Guide
cagcccuuggucugcaacgggc

SEQ ID NO: 24364 - RNA, 22 nt, Artificial Sequence
  ELANE RNA Guide
cagggggacuccggcagcccuu

SEQ ID NO: 24365 - RNA, 22 nt, Artificial Sequence
  ELANE RNA Guide
ccaagggcugccggaguccccc

SEQ ID NO: 24366 - RNA, 22 nt, Artificial Sequence
  ELANE RNA Guide
ccacagggggacuccggcagcc

SEQ ID NO: 24367 - RNA, 22 nt, Artificial Sequence
  ELANE RNA Guide
cccguugcagaccaagggcugc

SEQ ID NO: 24368 - RNA, 22 nt, Artificial Sequence
  ELANE RNA Guide
ccggcagcccuuggucugcaac

SEQ ID NO: 24369 - RNA, 22 nt, Artificial Sequence
  ELANE RNA Guide
ccguugcagaccaagggcugcc

SEQ ID NO: 24370 - RNA, 22 nt, Artificial Sequence
  ELANE RNA Guide
cggcagcccuuggucugcaacg

SEQ ID NO: 24371 - RNA, 22 nt, Artificial Sequence
  ELANE RNA Guide
cguugcagaccaagggcugccg

SEQ ID NO: 24372 - RNA, 22 nt, Artificial Sequence
  ELANE RNA Guide
cuccacagggggacuccggcag

SEQ ID NO: 24373 - RNA, 22 nt, Artificial Sequence
  ELANE RNA Guide
cuccggcagcccuuggucugca

SEQ ID NO: 24374 - RNA, 22 nt, Artificial Sequence
  ELANE RNA Guide
gaccaagggcugccggaguccc

SEQ ID NO: 24375 - RNA, 22 nt, Artificial Sequence
  ELANE RNA Guide
gacuccggcagcccuuggucug

SEQ ID NO: 24376 - RNA, 22 nt, Artificial Sequence
  ELANE RNA Guide
gauuagcccguugcagaccaag

SEQ ID NO: 24377 - RNA, 22 nt, Artificial Sequence
  ELANE RNA Guide
gcagaccaagggcugccggagu

SEQ ID NO: 24378 - RNA, 22 nt, Artificial Sequence
  ELANE RNA Guide
gcagcccuuggucugcaacggg

SEQ ID NO: 24379 - RNA, 22 nt, Artificial Sequence
  ELANE RNA Guide
gcccguugcagaccaagggcug

SEQ ID NO: 24380 - RNA, 22 nt, Artificial Sequence
  ELANE RNA Guide
ggacuccggcagcccuuggucu

SEQ ID NO: 24381 - RNA, 22 nt, Artificial Sequence
  ELANE RNA Guide
ggauuagcccguugcagaccaa

SEQ ID NO: 24382 - RNA, 22 nt, Artificial Sequence
  ELANE RNA Guide
ggcagcccuuggucugcaacgg

SEQ ID NO: 24383 - RNA, 22 nt, Artificial Sequence
  ELANE RNA Guide
gggacuccggcagcccuugguc

SEQ ID NO: 24384 - RNA, 22 nt, Artificial Sequence
  ELANE RNA Guide
ggggacuccggcagcccuuggu

SEQ ID NO: 24385 - RNA, 22 nt, Artificial Sequence
  ELANE RNA Guide
gggggacuccggcagcccuugg

SEQ ID NO: 24386 - RNA, 22 nt, Artificial Sequence
  ELANE RNA Guide
guugcagaccaagggcugccgg

SEQ ID NO: 24387 - RNA, 22 nt, Artificial Sequence
  ELANE RNA Guide
uagcccguugcagaccaagggc

SEQ ID NO: 24388 - RNA, 22 nt, Artificial Sequence
  ELANE RNA Guide
uccacagggggacuccggcagc

SEQ ID NO: 24389 - RNA, 22 nt, Artificial Sequence
  ELANE RNA Guide
uccggcagcccuuggucugcaa

SEQ ID NO: 24390 - RNA, 22 nt, Artificial Sequence
  ELANE RNA Guide
ugcagaccaagggcugccggag

SEQ ID NO: 24391 - RNA, 22 nt, Artificial Sequence
  ELANE RNA Guide
uuagcccguugcagaccaaggg

SEQ ID NO: 24392 - RNA, 22 nt, Artificial Sequence
  ELANE RNA Guide
uugcagaccaagggcugccgga

SEQ ID NO: 24393 - RNA, 20 nt, Artificial Sequence
  ELANE RNA Guide
aagcggcugccggagucccc

SEQ ID NO: 24394 - RNA, 20 nt, Artificial Sequence
  ELANE RNA Guide
accaagcggcugccggaguc

SEQ ID NO: 24395 - RNA, 20 nt, Artificial Sequence
  ELANE RNA Guide
acuccggcagccgcuugguc

SEQ ID NO: 24396 - RNA, 20 nt, Artificial Sequence
  ELANE RNA Guide
agaccaagcggcugccggag

SEQ ID NO: 24397 - RNA, 20 nt, Artificial Sequence
  ELANE RNA Guide
agcccguugcagaccaagcg

SEQ ID NO: 24398 - RNA, 20 nt, Artificial Sequence
  ELANE RNA Guide
agccgcuuggucugcaacgg

SEQ ID NO: 24399 - RNA, 20 nt, Artificial Sequence
  ELANE RNA Guide
agcggcugccggaguccccc

SEQ ID NO: 24400 - RNA, 20 nt, Artificial Sequence
  ELANE RNA Guide
agggggacuccggcagccgc

SEQ ID NO: 24401 - RNA, 20 nt, Artificial Sequence
  ELANE RNA Guide
caagcggcugccggaguccc

SEQ ID NO: 24402 - RNA, 20 nt, Artificial Sequence
  ELANE RNA Guide
cagaccaagcggcugccgga

SEQ ID NO: 24403 - RNA, 20 nt, Artificial Sequence
  ELANE RNA Guide
cagccgcuuggucugcaacg

SEQ ID NO: 24404 - RNA, 20 nt, Artificial Sequence
  ELANE RNA Guide
cagggggacuccggcagccg

SEQ ID NO: 24405 - RNA, 20 nt, Artificial Sequence
  ELANE RNA Guide
ccaagcggcugccggagucc

SEQ ID NO: 24406 - RNA, 20 nt, Artificial Sequence
  ELANE RNA Guide
cccguugcagaccaagcggc

SEQ ID NO: 24407 - RNA, 20 nt, Artificial Sequence
  ELANE RNA Guide
ccgcuuggucugcaacgggc

SEQ ID NO: 24408 - RNA, 20 nt, Artificial Sequence
  ELANE RNA Guide
ccggcagccgcuuggucugc

SEQ ID NO: 24409 - RNA, 20 nt, Artificial Sequence
  ELANE RNA Guide
ccguugcagaccaagcggcu

SEQ ID NO: 24410 - RNA, 20 nt, Artificial Sequence
  ELANE RNA Guide
cgcuuggucugcaacgggcu

SEQ ID NO: 24411 - RNA, 20 nt, Artificial Sequence
  ELANE RNA Guide
cggcagccgcuuggucugca

SEQ ID NO: 24412 - RNA, 20 nt, Artificial Sequence
  ELANE RNA Guide
cguugcagaccaagcggcug

SEQ ID NO: 24413 - RNA, 20 nt, Artificial Sequence
  ELANE RNA Guide
cuccggcagccgcuuggucu

SEQ ID NO: 24414 - RNA, 20 nt, Artificial Sequence
  ELANE RNA Guide
gaccaagcggcugccggagu

SEQ ID NO: 24415 - RNA, 20 nt, Artificial Sequence
  ELANE RNA Guide
gacuccggcagccgcuuggu

SEQ ID NO: 24416 - RNA, 20 nt, Artificial Sequence
  ELANE RNA Guide
gauuagcccguugcagacca

SEQ ID NO: 24417 - RNA, 20 nt, Artificial Sequence
  ELANE RNA Guide
gcagaccaagcggcugccgg

SEQ ID NO: 24418 - RNA, 20 nt, Artificial Sequence
  ELANE RNA Guide
gcagccgcuuggucugcaac

SEQ ID NO: 24419 - RNA, 20 nt, Artificial Sequence
  ELANE RNA Guide
gcccguugcagaccaagcgg

SEQ ID NO: 24420 - RNA, 20 nt, Artificial Sequence
  ELANE RNA Guide
gccgcuuggucugcaacggg

SEQ ID NO: 24421 - RNA, 20 nt, Artificial Sequence
  ELANE RNA Guide
gcggcugccggagucccccu

SEQ ID NO: 24422 - RNA, 20 nt, Artificial Sequence
  ELANE RNA Guide
ggacuccggcagccgcuugg

SEQ ID NO: 24423 - RNA, 20 nt, Artificial Sequence
  ELANE RNA Guide
ggauuagcccguugcagacc

SEQ ID NO: 24424 - RNA, 20 nt, Artificial Sequence
  ELANE RNA Guide
ggcagccgcuuggucugcaa

SEQ ID NO: 24425 - RNA, 20 nt, Artificial Sequence
  ELANE RNA Guide
gggacuccggcagccgcuug

SEQ ID NO: 24426 - RNA, 20 nt, Artificial Sequence
  ELANE RNA Guide
ggggacuccggcagccgcuu

SEQ ID NO: 24427 - RNA, 20 nt, Artificial Sequence
  ELANE RNA Guide
gggggacuccggcagccgcu

SEQ ID NO: 24428 - RNA, 20 nt, Artificial Sequence
  ELANE RNA Guide
guugcagaccaagcggcugc

SEQ ID NO: 24429 - RNA, 20 nt, Artificial Sequence
  ELANE RNA Guide
uagcccguugcagaccaagc

SEQ ID NO: 24430 - RNA, 20 nt, Artificial Sequence
  ELANE RNA Guide
uccacagggggacuccggca

SEQ ID NO: 24431 - RNA, 20 nt, Artificial Sequence
  ELANE RNA Guide
uccggcagccgcuuggucug

SEQ ID NO: 24432 - RNA, 20 nt, Artificial Sequence
  ELANE RNA Guide
ugcagaccaagcggcugccg

SEQ ID NO: 24433 - RNA, 20 nt, Artificial Sequence
  ELANE RNA Guide
uugcagaccaagcggcugcc

SEQ ID NO: 24434 - RNA, 21 nt, Artificial Sequence
  ELANE RNA Guide
aagcggcugccggaguccccc

SEQ ID NO: 24435 - RNA, 21 nt, Artificial Sequence
  ELANE RNA Guide
acagggggacuccggcagccg

SEQ ID NO: 24436 - RNA, 21 nt, Artificial Sequence
  ELANE RNA Guide
accaagcggcugccggagucc

SEQ ID NO: 24437 - RNA, 21 nt, Artificial Sequence
  ELANE RNA Guide
acuccggcagccgcuuggucu

SEQ ID NO: 24438 - RNA, 21 nt, Artificial Sequence
  ELANE RNA Guide
agaccaagcggcugccggagu

SEQ ID NO: 24439 - RNA, 21 nt, Artificial Sequence
  ELANE RNA Guide
agcccguugcagaccaagcgg

SEQ ID NO: 24440 - RNA, 21 nt, Artificial Sequence
  ELANE RNA Guide
agccgcuuggucugcaacggg

SEQ ID NO: 24441 - RNA, 21 nt, Artificial Sequence
  ELANE RNA Guide
agcggcugccggagucccccu

SEQ ID NO: 24442 - RNA, 21 nt, Artificial Sequence
  ELANE RNA Guide
agggggacuccggcagccgcu

SEQ ID NO: 24443 - RNA, 21 nt, Artificial Sequence
  ELANE RNA Guide
caagcggcugccggagucccc

SEQ ID NO: 24444 - RNA, 21 nt, Artificial Sequence
  ELANE RNA Guide
cagaccaagcggcugccggag

SEQ ID NO: 24445 - RNA, 21 nt, Artificial Sequence
  ELANE RNA Guide
cagccgcuuggucugcaacgg

SEQ ID NO: 24446 - RNA, 21 nt, Artificial Sequence
  ELANE RNA Guide
ccaagcggcugccggaguccc

SEQ ID NO: 24447 - RNA, 21 nt, Artificial Sequence
  ELANE RNA Guide
cccguugcagaccaagcggcu

SEQ ID NO: 24448 - RNA, 21 nt, Artificial Sequence
  ELANE RNA Guide
ccgcuuggucugcaacgggcu

SEQ ID NO: 24449 - RNA, 21 nt, Artificial Sequence
  ELANE RNA Guide
ccggcagccgcuuggucugca

SEQ ID NO: 24450 - RNA, 21 nt, Artificial Sequence
  ELANE RNA Guide
ccguugcagaccaagcggcug

SEQ ID NO: 24451 - RNA, 21 nt, Artificial Sequence
  ELANE RNA Guide
cgcuuggucugcaacgggcua

SEQ ID NO: 24452 - RNA, 21 nt, Artificial Sequence
  ELANE RNA Guide
cggcagccgcuuggucugcaa

SEQ ID NO: 24453 - RNA, 21 nt, Artificial Sequence
  ELANE RNA Guide
cguugcagaccaagcggcugc

SEQ ID NO: 24454 - RNA, 21 nt, Artificial Sequence
  ELANE RNA Guide
cuccacagggggacuccggca

SEQ ID NO: 24455 - RNA, 21 nt, Artificial Sequence
  ELANE RNA Guide
cuccggcagccgcuuggucug

SEQ ID NO: 24456 - RNA, 21 nt, Artificial Sequence
  ELANE RNA Guide
gaccaagcggcugccggaguc

SEQ ID NO: 24457 - RNA, 21 nt, Artificial Sequence
  ELANE RNA Guide
gacuccggcagccgcuugguc

SEQ ID NO: 24458 - RNA, 21 nt, Artificial Sequence
  ELANE RNA Guide
gcagaccaagcggcugccgga

SEQ ID NO: 24459 - RNA, 21 nt, Artificial Sequence
  ELANE RNA Guide
gcagccgcuuggucugcaacg

SEQ ID NO: 24460 - RNA, 21 nt, Artificial Sequence
  ELANE RNA Guide
gcccguugcagaccaagcggc

SEQ ID NO: 24461 - RNA, 21 nt, Artificial Sequence
  ELANE RNA Guide
gccgcuuggucugcaacgggc

SEQ ID NO: 24462 - RNA, 21 nt, Artificial Sequence
  ELANE RNA Guide
ggacuccggcagccgcuuggu

SEQ ID NO: 24463 - RNA, 21 nt, Artificial Sequence
  ELANE RNA Guide
ggauuagcccguugcagacca

SEQ ID NO: 24464 - RNA, 21 nt, Artificial Sequence
  ELANE RNA Guide
ggcagccgcuuggucugcaac

SEQ ID NO: 24465 - RNA, 21 nt, Artificial Sequence
  ELANE RNA Guide
gggacuccggcagccgcuugg

SEQ ID NO: 24466 - RNA, 21 nt, Artificial Sequence
  ELANE RNA Guide
ggggacuccggcagccgcuug

SEQ ID NO: 24467 - RNA, 21 nt, Artificial Sequence
  ELANE RNA Guide
gggggacuccggcagccgcuu

SEQ ID NO: 24468 - RNA, 21 nt, Artificial Sequence
  ELANE RNA Guide
guugcagaccaagcggcugcc

SEQ ID NO: 24469 - RNA, 21 nt, Artificial Sequence
  ELANE RNA Guide
uagcccguugcagaccaagcg

SEQ ID NO: 24470 - RNA, 21 nt, Artificial Sequence
  ELANE RNA Guide
uccggcagccgcuuggucugc

SEQ ID NO: 24471 - RNA, 21 nt, Artificial Sequence
  ELANE RNA Guide
ugcagaccaagcggcugccgg

SEQ ID NO: 24472 - RNA, 21 nt, Artificial Sequence
  ELANE RNA Guide
uggauuagcccguugcagacc

SEQ ID NO: 24473 - RNA, 21 nt, Artificial Sequence
  ELANE RNA Guide
uuagcccguugcagaccaagc

SEQ ID NO: 24474 - RNA, 21 nt, Artificial Sequence
  ELANE RNA Guide
uugcagaccaagcggcugccg

SEQ ID NO: 24475 - RNA, 22 nt, Artificial Sequence
  ELANE RNA Guide
aagcggcugccggagucccccu

SEQ ID NO: 24476 - RNA, 22 nt, Artificial Sequence
  ELANE RNA Guide
acagggggacuccggcagccgc

SEQ ID NO: 24477 - RNA, 22 nt, Artificial Sequence
  ELANE RNA Guide
accaagcggcugccggaguccc

SEQ ID NO: 24478 - RNA, 22 nt, Artificial Sequence
  ELANE RNA Guide
acuccggcagccgcuuggucug

SEQ ID NO: 24479 - RNA, 22 nt, Artificial Sequence
  ELANE RNA Guide
agaccaagcggcugccggaguc

SEQ ID NO: 24480 - RNA, 22 nt, Artificial Sequence
  ELANE RNA Guide
agcccguugcagaccaagcggc

SEQ ID NO: 24481 - RNA, 22 nt, Artificial Sequence
  ELANE RNA Guide
agccgcuuggucugcaacgggc

SEQ ID NO: 24482 - RNA, 22 nt, Artificial Sequence
  ELANE RNA Guide
agcggcugccggagucccccug

SEQ ID NO: 24483 - RNA, 22 nt, Artificial Sequence
  ELANE RNA Guide
agggggacuccggcagccgcuu

SEQ ID NO: 24484 - RNA, 22 nt, Artificial Sequence
  ELANE RNA Guide
auuagcccguugcagaccaagc

SEQ ID NO: 24485 - RNA, 22 nt, Artificial Sequence
  ELANE RNA Guide
caagcggcugccggaguccccc

SEQ ID NO: 24486 - RNA, 22 nt, Artificial Sequence
  ELANE RNA Guide
cacagggggacuccggcagccg

SEQ ID NO: 24487 - RNA, 22 nt, Artificial Sequence
  ELANE RNA Guide
cagaccaagcggcugccggagu

SEQ ID NO: 24488 - RNA, 22 nt, Artificial Sequence
  ELANE RNA Guide
cagccgcuuggucugcaacggg

SEQ ID NO: 24489 - RNA, 22 nt, Artificial Sequence
  ELANE RNA Guide
cagggggacuccggcagccgcu

SEQ ID NO: 24490 - RNA, 22 nt, Artificial Sequence
  ELANE RNA Guide
ccaagcggcugccggagucccc

SEQ ID NO: 24491 - RNA, 22 nt, Artificial Sequence
  ELANE RNA Guide
cccguugcagaccaagcggcug

SEQ ID NO: 24492 - RNA, 22 nt, Artificial Sequence
  ELANE RNA Guide
ccgcuuggucugcaacgggcua

SEQ ID NO: 24493 - RNA, 22 nt, Artificial Sequence
  ELANE RNA Guide
ccggcagccgcuuggucugcaa

SEQ ID NO: 24494 - RNA, 22 nt, Artificial Sequence
  ELANE RNA Guide
ccguugcagaccaagcggcugc

SEQ ID NO: 24495 - RNA, 22 nt, Artificial Sequence
  ELANE RNA Guide
ccuccacagggggacuccggca

SEQ ID NO: 24496 - RNA, 22 nt, Artificial Sequence
  ELANE RNA Guide
cgcuuggucugcaacgggcuaa

SEQ ID NO: 24497 - RNA, 22 nt, Artificial Sequence
  ELANE RNA Guide
cggcagccgcuuggucugcaac

SEQ ID NO: 24498 - RNA, 22 nt, Artificial Sequence
  ELANE RNA Guide
cguugcagaccaagcggcugcc

SEQ ID NO: 24499 - RNA, 22 nt, Artificial Sequence
  ELANE RNA Guide
cuccggcagccgcuuggucugc

SEQ ID NO: 24500 - RNA, 22 nt, Artificial Sequence
  ELANE RNA Guide
gaccaagcggcugccggagucc

SEQ ID NO: 24501 - RNA, 22 nt, Artificial Sequence
  ELANE RNA Guide
gacuccggcagccgcuuggucu

SEQ ID NO: 24502 - RNA, 22 nt, Artificial Sequence
  ELANE RNA Guide
gcagaccaagcggcugccggag

SEQ ID NO: 24503 - RNA, 22 nt, Artificial Sequence
  ELANE RNA Guide
gcagccgcuuggucugcaacgg

SEQ ID NO: 24504 - RNA, 22 nt, Artificial Sequence
  ELANE RNA Guide
gcccguugcagaccaagcggcu

SEQ ID NO: 24505 - RNA, 22 nt, Artificial Sequence
  ELANE RNA Guide
gccgcuuggucugcaacgggcu

SEQ ID NO: 24506 - RNA, 22 nt, Artificial Sequence
  ELANE RNA Guide
gcggcugccggagucccccugu

SEQ ID NO: 24507 - RNA, 22 nt, Artificial Sequence
  ELANE RNA Guide
ggacuccggcagccgcuugguc

SEQ ID NO: 24508 - RNA, 22 nt, Artificial Sequence
  ELANE RNA Guide
ggcagccgcuuggucugcaacg

SEQ ID NO: 24509 - RNA, 22 nt, Artificial Sequence
  ELANE RNA Guide
gggacuccggcagccgcuuggu

SEQ ID NO: 24510 - RNA, 22 nt, Artificial Sequence
  ELANE RNA Guide
ggggacuccggcagccgcuugg

SEQ ID NO: 24511 - RNA, 22 nt, Artificial Sequence
  ELANE RNA Guide
gggggacuccggcagccgcuug

SEQ ID NO: 24512 - RNA, 22 nt, Artificial Sequence
  ELANE RNA Guide
guggauuagcccguugcagacc

SEQ ID NO: 24513 - RNA, 22 nt, Artificial Sequence
  ELANE RNA Guide
guugcagaccaagcggcugccg

SEQ ID NO: 24514 - RNA, 22 nt, Artificial Sequence
  ELANE RNA Guide
uagcccguugcagaccaagcgg

SEQ ID NO: 24515 - RNA, 22 nt, Artificial Sequence
  ELANE RNA Guide
uccggcagccgcuuggucugca

SEQ ID NO: 24516 - RNA, 22 nt, Artificial Sequence
  ELANE RNA Guide
ugcagaccaagcggcugccgga

SEQ ID NO: 24517 - RNA, 22 nt, Artificial Sequence
  ELANE RNA Guide
uggauuagcccguugcagacca

SEQ ID NO: 24518 - RNA, 22 nt, Artificial Sequence
  ELANE RNA Guide
uuagcccguugcagaccaagcg

SEQ ID NO: 24519 - RNA, 22 nt, Artificial Sequence
  ELANE RNA Guide
uugcagaccaagcggcugccgg

SEQ ID NO: 24520 - RNA, 20 nt, Artificial Sequence
  ELANE RNA Guide
accgaggggcugccggaguc

SEQ ID NO: 24521 - RNA, 20 nt, Artificial Sequence
  ELANE RNA Guide
acuccggcagccccucgguc

SEQ ID NO: 24522 - RNA, 20 nt, Artificial Sequence
  ELANE RNA Guide
agaccgaggggcugccggag

SEQ ID NO: 24523 - RNA, 20 nt, Artificial Sequence
  ELANE RNA Guide
agccccucggucugcaacgg

SEQ ID NO: 24524 - RNA, 20 nt, Artificial Sequence
  ELANE RNA Guide
agcccguugcagaccgaggg

SEQ ID NO: 24525 - RNA, 20 nt, Artificial Sequence
  ELANE RNA Guide
agggggacuccggcagcccc

SEQ ID NO: 24526 - RNA, 20 nt, Artificial Sequence
  ELANE RNA Guide
auuagcccguugcagaccga

SEQ ID NO: 24527 - RNA, 20 nt, Artificial Sequence
  ELANE RNA Guide
cagaccgaggggcugccgga

SEQ ID NO: 24528 - RNA, 20 nt, Artificial Sequence
  ELANE RNA Guide
cagccccucggucugcaacg

SEQ ID NO: 24529 - RNA, 20 nt, Artificial Sequence
  ELANE RNA Guide
ccccucggucugcaacgggc

SEQ ID NO: 24530 - RNA, 20 nt, Artificial Sequence
  ELANE RNA Guide
cccguugcagaccgaggggc

SEQ ID NO: 24531 - RNA, 20 nt, Artificial Sequence
  ELANE RNA Guide
cccucggucugcaacgggcu

SEQ ID NO: 24532 - RNA, 20 nt, Artificial Sequence
  ELANE RNA Guide
ccgaggggcugccggagucc

SEQ ID NO: 24533 - RNA, 20 nt, Artificial Sequence
  ELANE RNA Guide
ccggcagccccucggucugc

SEQ ID NO: 24534 - RNA, 20 nt, Artificial Sequence
  ELANE RNA Guide
ccguugcagaccgaggggcu

SEQ ID NO: 24535 - RNA, 20 nt, Artificial Sequence
  ELANE RNA Guide
ccucggucugcaacgggcua

SEQ ID NO: 24536 - RNA, 20 nt, Artificial Sequence
  ELANE RNA Guide
cgaggggcugccggaguccc

SEQ ID NO: 24537 - RNA, 20 nt, Artificial Sequence
  ELANE RNA Guide
cggcagccccucggucugca

SEQ ID NO: 24538 - RNA, 20 nt, Artificial Sequence
  ELANE RNA Guide
cguggauuagcccguugcag

SEQ ID NO: 24539 - RNA, 20 nt, Artificial Sequence
  ELANE RNA Guide
cguugcagaccgaggggcug

SEQ ID NO: 24540 - RNA, 20 nt, Artificial Sequence
  ELANE RNA Guide
cuccggcagccccucggucu

SEQ ID NO: 24541 - RNA, 20 nt, Artificial Sequence
  ELANE RNA Guide
cucggucugcaacgggcuaa

SEQ ID NO: 24542 - RNA, 20 nt, Artificial Sequence
  ELANE RNA Guide
gaccgaggggcugccggagu

SEQ ID NO: 24543 - RNA, 20 nt, Artificial Sequence
  ELANE RNA Guide
gacuccggcagccccucggu

SEQ ID NO: 24544 - RNA, 20 nt, Artificial Sequence
  ELANE RNA Guide
gauuagcccguugcagaccg

SEQ ID NO: 24545 - RNA, 20 nt, Artificial Sequence
  ELANE RNA Guide
gcagaccgaggggcugccgg

SEQ ID NO: 24546 - RNA, 20 nt, Artificial Sequence
  ELANE RNA Guide
gcagccccucggucugcaac

SEQ ID NO: 24547 - RNA, 20 nt, Artificial Sequence
  ELANE RNA Guide
gccccucggucugcaacggg

SEQ ID NO: 24548 - RNA, 20 nt, Artificial Sequence
  ELANE RNA Guide
gcccguugcagaccgagggg

SEQ ID NO: 24549 - RNA, 20 nt, Artificial Sequence
  ELANE RNA Guide
ggacuccggcagccccucgg

SEQ ID NO: 24550 - RNA, 20 nt, Artificial Sequence
  ELANE RNA Guide
ggcagccccucggucugcaa

SEQ ID NO: 24551 - RNA, 20 nt, Artificial Sequence
  ELANE RNA Guide
gggacuccggcagccccucg

SEQ ID NO: 24552 - RNA, 20 nt, Artificial Sequence
  ELANE RNA Guide
ggggacuccggcagccccuc

SEQ ID NO: 24553 - RNA, 20 nt, Artificial Sequence
  ELANE RNA Guide
gggggacuccggcagccccu

SEQ ID NO: 24554 - RNA, 20 nt, Artificial Sequence
  ELANE RNA Guide
guggauuagcccguugcaga

SEQ ID NO: 24555 - RNA, 20 nt, Artificial Sequence
  ELANE RNA Guide
guugcagaccgaggggcugc

SEQ ID NO: 24556 - RNA, 20 nt, Artificial Sequence
  ELANE RNA Guide
uagcccguugcagaccgagg

SEQ ID NO: 24557 - RNA, 20 nt, Artificial Sequence
  ELANE RNA Guide
uccggcagccccucggucug

SEQ ID NO: 24558 - RNA, 20 nt, Artificial Sequence
  ELANE RNA Guide
ucggucugcaacgggcuaau

SEQ ID NO: 24559 - RNA, 20 nt, Artificial Sequence
  ELANE RNA Guide
ugcagaccgaggggcugccg

SEQ ID NO: 24560 - RNA, 20 nt, Artificial Sequence
  ELANE RNA Guide
uggauuagcccguugcagac

SEQ ID NO: 24561 - RNA, 20 nt, Artificial Sequence
  ELANE RNA Guide
uuagcccguugcagaccgag

SEQ ID NO: 24562 - RNA, 20 nt, Artificial Sequence
  ELANE RNA Guide
uugcagaccgaggggcugcc

SEQ ID NO: 24563 - RNA, 21 nt, Artificial Sequence
  ELANE RNA Guide
accgaggggcugccggagucc

SEQ ID NO: 24564 - RNA, 21 nt, Artificial Sequence
  ELANE RNA Guide
acuccggcagccccucggucu

SEQ ID NO: 24565 - RNA, 21 nt, Artificial Sequence
  ELANE RNA Guide
agaccgaggggcugccggagu

SEQ ID NO: 24566 - RNA, 21 nt, Artificial Sequence
  ELANE RNA Guide
agccccucggucugcaacggg

SEQ ID NO: 24567 - RNA, 21 nt, Artificial Sequence
  ELANE RNA Guide
agcccguugcagaccgagggg

SEQ ID NO: 24568 - RNA, 21 nt, Artificial Sequence
  ELANE RNA Guide
agggggacuccggcagccccu

SEQ ID NO: 24569 - RNA, 21 nt, Artificial Sequence
  ELANE RNA Guide
auuagcccguugcagaccgag

SEQ ID NO: 24570 - RNA, 21 nt, Artificial Sequence
  ELANE RNA Guide
cagaccgaggggcugccggag

SEQ ID NO: 24571 - RNA, 21 nt, Artificial Sequence
  ELANE RNA Guide
cagccccucggucugcaacgg

SEQ ID NO: 24572 - RNA, 21 nt, Artificial Sequence
  ELANE RNA Guide
ccccucggucugcaacgggcu

SEQ ID NO: 24573 - RNA, 21 nt, Artificial Sequence
  ELANE RNA Guide
cccguugcagaccgaggggcu

SEQ ID NO: 24574 - RNA, 21 nt, Artificial Sequence
  ELANE RNA Guide
cccucggucugcaacgggcua

SEQ ID NO: 24575 - RNA, 21 nt, Artificial Sequence
  ELANE RNA Guide
ccggcagccccucggucugca

SEQ ID NO: 24576 - RNA, 21 nt, Artificial Sequence
  ELANE RNA Guide
ccguggauuagcccguugcag

SEQ ID NO: 24577 - RNA, 21 nt, Artificial Sequence
  ELANE RNA Guide
ccguugcagaccgaggggcug

SEQ ID NO: 24578 - RNA, 21 nt, Artificial Sequence
  ELANE RNA Guide
ccucggucugcaacgggcuaa

SEQ ID NO: 24579 - RNA, 21 nt, Artificial Sequence
  ELANE RNA Guide
cggcagccccucggucugcaa

SEQ ID NO: 24580 - RNA, 21 nt, Artificial Sequence
  ELANE RNA Guide
cguggauuagcccguugcaga

SEQ ID NO: 24581 - RNA, 21 nt, Artificial Sequence
  ELANE RNA Guide
cguugcagaccgaggggcugc

SEQ ID NO: 24582 - RNA, 21 nt, Artificial Sequence
  ELANE RNA Guide
cuccggcagccccucggucug

SEQ ID NO: 24583 - RNA, 21 nt, Artificial Sequence
  ELANE RNA Guide
cucggucugcaacgggcuaau

SEQ ID NO: 24584 - RNA, 21 nt, Artificial Sequence
  ELANE RNA Guide
gaccgaggggcugccggaguc

SEQ ID NO: 24585 - RNA, 21 nt, Artificial Sequence
  ELANE RNA Guide
gacuccggcagccccucgguc

SEQ ID NO: 24586 - RNA, 21 nt, Artificial Sequence
  ELANE RNA Guide
gauuagcccguugcagaccga

SEQ ID NO: 24587 - RNA, 21 nt, Artificial Sequence
  ELANE RNA Guide
gcagaccgaggggcugccgga

SEQ ID NO: 24588 - RNA, 21 nt, Artificial Sequence
  ELANE RNA Guide
gcagccccucggucugcaacg

SEQ ID NO: 24589 - RNA, 21 nt, Artificial Sequence
  ELANE RNA Guide
gccccucggucugcaacgggc

SEQ ID NO: 24590 - RNA, 21 nt, Artificial Sequence
  ELANE RNA Guide
gcccguugcagaccgaggggc

SEQ ID NO: 24591 - RNA, 21 nt, Artificial Sequence
  ELANE RNA Guide
ggacuccggcagccccucggu

SEQ ID NO: 24592 - RNA, 21 nt, Artificial Sequence
  ELANE RNA Guide
ggauuagcccguugcagaccg

SEQ ID NO: 24593 - RNA, 21 nt, Artificial Sequence
  ELANE RNA Guide
ggcagccccucggucugcaac

SEQ ID NO: 24594 - RNA, 21 nt, Artificial Sequence
  ELANE RNA Guide
guggauuagcccguugcagac

SEQ ID NO: 24595 - RNA, 21 nt, Artificial Sequence
  ELANE RNA Guide
guugcagaccgaggggcugcc

SEQ ID NO: 24596 - RNA, 21 nt, Artificial Sequence
  ELANE RNA Guide
uagcccguugcagaccgaggg

SEQ ID NO: 24597 - RNA, 21 nt, Artificial Sequence
  ELANE RNA Guide
uccggcagccccucggucugc

SEQ ID NO: 24598 - RNA, 21 nt, Artificial Sequence
  ELANE RNA Guide
ucggucugcaacgggcuaauc

SEQ ID NO: 24599 - RNA, 21 nt, Artificial Sequence
  ELANE RNA Guide
ugcagaccgaggggcugccgg

SEQ ID NO: 24600 - RNA, 21 nt, Artificial Sequence
  ELANE RNA Guide
uuagcccguugcagaccgagg

SEQ ID NO: 24601 - RNA, 21 nt, Artificial Sequence
  ELANE RNA Guide
uugcagaccgaggggcugccg

SEQ ID NO: 24602 - RNA, 22 nt, Artificial Sequence
  ELANE RNA Guide
acagggggacuccggcagcccc

SEQ ID NO: 24603 - RNA, 22 nt, Artificial Sequence
  ELANE RNA Guide
accgaggggcugccggaguccc

SEQ ID NO: 24604 - RNA, 22 nt, Artificial Sequence
  ELANE RNA Guide
acuccggcagccccucggucug

SEQ ID NO: 24605 - RNA, 22 nt, Artificial Sequence
  ELANE RNA Guide
agaccgaggggcugccggaguc

SEQ ID NO: 24606 - RNA, 22 nt, Artificial Sequence
  ELANE RNA Guide
agccccucggucugcaacgggc

SEQ ID NO: 24607 - RNA, 22 nt, Artificial Sequence
  ELANE RNA Guide
agcccguugcagaccgaggggc

SEQ ID NO: 24608 - RNA, 22 nt, Artificial Sequence
  ELANE RNA Guide
agggggacuccggcagccccuc

SEQ ID NO: 24609 - RNA, 22 nt, Artificial Sequence
  ELANE RNA Guide
auuagcccguugcagaccgagg

SEQ ID NO: 24610 - RNA, 22 nt, Artificial Sequence
  ELANE RNA Guide
cagaccgaggggcugccggagu

SEQ ID NO: 24611 - RNA, 22 nt, Artificial Sequence
  ELANE RNA Guide
cagccccucggucugcaacggg

SEQ ID NO: 24612 - RNA, 22 nt, Artificial Sequence
  ELANE RNA Guide
cagggggacuccggcagccccu

SEQ ID NO: 24613 - RNA, 22 nt, Artificial Sequence
  ELANE RNA Guide
ccccucggucugcaacgggcua

SEQ ID NO: 24614 - RNA, 22 nt, Artificial Sequence
  ELANE RNA Guide
cccguugcagaccgaggggcug

SEQ ID NO: 24615 - RNA, 22 nt, Artificial Sequence
  ELANE RNA Guide
cccucggucugcaacgggcuaa

SEQ ID NO: 24616 - RNA, 22 nt, Artificial Sequence
  ELANE RNA Guide
ccggcagccccucggucugcaa

SEQ ID NO: 24617 - RNA, 22 nt, Artificial Sequence
  ELANE RNA Guide
ccguggauuagcccguugcaga

SEQ ID NO: 24618 - RNA, 22 nt, Artificial Sequence
  ELANE RNA Guide
ccguugcagaccgaggggcugc

SEQ ID NO: 24619 - RNA, 22 nt, Artificial Sequence
  ELANE RNA Guide
ccucggucugcaacgggcuaau

SEQ ID NO: 24620 - RNA, 22 nt, Artificial Sequence
  ELANE RNA Guide
cggcagccccucggucugcaac

SEQ ID NO: 24621 - RNA, 22 nt, Artificial Sequence
  ELANE RNA Guide
cguggauuagcccguugcagac

SEQ ID NO: 24622 - RNA, 22 nt, Artificial Sequence
  ELANE RNA Guide
cguugcagaccgaggggcugcc

SEQ ID NO: 24623 - RNA, 22 nt, Artificial Sequence
  ELANE RNA Guide
cuccggcagccccucggucugc

SEQ ID NO: 24624 - RNA, 22 nt, Artificial Sequence
  ELANE RNA Guide
cucggucugcaacgggcuaauc

SEQ ID NO: 24625 - RNA, 22 nt, Artificial Sequence
  ELANE RNA Guide
gaccgaggggcugccggagucc

SEQ ID NO: 24626 - RNA, 22 nt, Artificial Sequence
  ELANE RNA Guide
gacuccggcagccccucggucu

SEQ ID NO: 24627 - RNA, 22 nt, Artificial Sequence
  ELANE RNA Guide
gauuagcccguugcagaccgag

SEQ ID NO: 24628 - RNA, 22 nt, Artificial Sequence
  ELANE RNA Guide
gcagaccgaggggcugccggag

SEQ ID NO: 24629 - RNA, 22 nt, Artificial Sequence
  ELANE RNA Guide
gcagccccucggucugcaacgg

SEQ ID NO: 24630 - RNA, 22 nt, Artificial Sequence
  ELANE RNA Guide
gccccucggucugcaacgggcu

SEQ ID NO: 24631 - RNA, 22 nt, Artificial Sequence
  ELANE RNA Guide
gcccguugcagaccgaggggcu

SEQ ID NO: 24632 - RNA, 22 nt, Artificial Sequence
  ELANE RNA Guide
ggacuccggcagccccucgguc

SEQ ID NO: 24633 - RNA, 22 nt, Artificial Sequence
  ELANE RNA Guide
ggauuagcccguugcagaccga

SEQ ID NO: 24634 - RNA, 22 nt, Artificial Sequence
  ELANE RNA Guide
ggcagccccucggucugcaacg

SEQ ID NO: 24635 - RNA, 22 nt, Artificial Sequence
  ELANE RNA Guide
gggacuccggcagccccucggu

SEQ ID NO: 24636 - RNA, 22 nt, Artificial Sequence
  ELANE RNA Guide
guugcagaccgaggggcugccg

SEQ ID NO: 24637 - RNA, 22 nt, Artificial Sequence
  ELANE RNA Guide
uagcccguugcagaccgagggg

SEQ ID NO: 24638 - RNA, 22 nt, Artificial Sequence
  ELANE RNA Guide
uccggcagccccucggucugca

SEQ ID NO: 24639 - RNA, 22 nt, Artificial Sequence
  ELANE RNA Guide
uccguggauuagcccguugcag

SEQ ID NO: 24640 - RNA, 22 nt, Artificial Sequence
  ELANE RNA Guide
ucggucugcaacgggcuaaucc

SEQ ID NO: 24641 - RNA, 22 nt, Artificial Sequence
  ELANE RNA Guide
ugcagaccgaggggcugccgga

SEQ ID NO: 24642 - RNA, 22 nt, Artificial Sequence
  ELANE RNA Guide
uggauuagcccguugcagaccg

SEQ ID NO: 24643 - RNA, 22 nt, Artificial Sequence
  ELANE RNA Guide
uuagcccguugcagaccgaggg

SEQ ID NO: 24644 - RNA, 22 nt, Artificial Sequence
  ELANE RNA Guide
uugcagaccgaggggcugccgg

SEQ ID NO: 24645 - RNA, 20 nt, Artificial Sequence
  ELANE RNA Guide
acaaaggggcugccggaguc

SEQ ID NO: 24646 - RNA, 20 nt, Artificial Sequence
  ELANE RNA Guide
acuccggcagccccuuuguc

SEQ ID NO: 24647 - RNA, 20 nt, Artificial Sequence
  ELANE RNA Guide
agacaaaggggcugccggag

SEQ ID NO: 24648 - RNA, 20 nt, Artificial Sequence
  ELANE RNA Guide
agccccuuugucugcaacgg

SEQ ID NO: 24649 - RNA, 20 nt, Artificial Sequence
  ELANE RNA Guide
agcccguugcagacaaaggg

SEQ ID NO: 24650 - RNA, 20 nt, Artificial Sequence
  ELANE RNA Guide
auuagcccguugcagacaaa

SEQ ID NO: 24651 - RNA, 20 nt, Artificial Sequence
  ELANE RNA Guide
caaaggggcugccggagucc

SEQ ID NO: 24652 - RNA, 20 nt, Artificial Sequence
  ELANE RNA Guide
cagacaaaggggcugccgga

SEQ ID NO: 24653 - RNA, 20 nt, Artificial Sequence
  ELANE RNA Guide
cagccccuuugucugcaacg

SEQ ID NO: 24654 - RNA, 20 nt, Artificial Sequence
  ELANE RNA Guide
ccccuuugucugcaacgggc

SEQ ID NO: 24655 - RNA, 20 nt, Artificial Sequence
  ELANE RNA Guide
cccguugcagacaaaggggc

SEQ ID NO: 24656 - RNA, 20 nt, Artificial Sequence
  ELANE RNA Guide
cccuuugucugcaacgggcu

SEQ ID NO: 24657 - RNA, 20 nt, Artificial Sequence
  ELANE RNA Guide
ccggcagccccuuugucugc

SEQ ID NO: 24658 - RNA, 20 nt, Artificial Sequence
  ELANE RNA Guide
ccguggauuagcccguugca

SEQ ID NO: 24659 - RNA, 20 nt, Artificial Sequence
  ELANE RNA Guide
ccguugcagacaaaggggcu

SEQ ID NO: 24660 - RNA, 20 nt, Artificial Sequence
  ELANE RNA Guide
ccuuugucugcaacgggcua

SEQ ID NO: 24661 - RNA, 20 nt, Artificial Sequence
  ELANE RNA Guide
cggcagccccuuugucugca

SEQ ID NO: 24662 - RNA, 20 nt, Artificial Sequence
  ELANE RNA Guide
cguugcagacaaaggggcug

SEQ ID NO: 24663 - RNA, 20 nt, Artificial Sequence
  ELANE RNA Guide
cuccggcagccccuuugucu

SEQ ID NO: 24664 - RNA, 20 nt, Artificial Sequence
  ELANE RNA Guide
cuuugucugcaacgggcuaa

SEQ ID NO: 24665 - RNA, 20 nt, Artificial Sequence
  ELANE RNA Guide
gacaaaggggcugccggagu

SEQ ID NO: 24666 - RNA, 20 nt, Artificial Sequence
  ELANE RNA Guide
gacuccggcagccccuuugu

SEQ ID NO: 24667 - RNA, 20 nt, Artificial Sequence
  ELANE RNA Guide
gauuagcccguugcagacaa

SEQ ID NO: 24668 - RNA, 20 nt, Artificial Sequence
  ELANE RNA Guide
gcagacaaaggggcugccgg

SEQ ID NO: 24669 - RNA, 20 nt, Artificial Sequence
  ELANE RNA Guide
gcagccccuuugucugcaac

SEQ ID NO: 24670 - RNA, 20 nt, Artificial Sequence
  ELANE RNA Guide
gccccuuugucugcaacggg

SEQ ID NO: 24671 - RNA, 20 nt, Artificial Sequence
  ELANE RNA Guide
gcccguugcagacaaagggg

SEQ ID NO: 24672 - RNA, 20 nt, Artificial Sequence
  ELANE RNA Guide
ggacuccggcagccccuuug

SEQ ID NO: 24673 - RNA, 20 nt, Artificial Sequence
  ELANE RNA Guide
ggauuagcccguugcagaca

SEQ ID NO: 24674 - RNA, 20 nt, Artificial Sequence
  ELANE RNA Guide
ggcagccccuuugucugcaa

SEQ ID NO: 24675 - RNA, 20 nt, Artificial Sequence
  ELANE RNA Guide
gggacuccggcagccccuuu

SEQ ID NO: 24676 - RNA, 20 nt, Artificial Sequence
  ELANE RNA Guide
ggggacuccggcagccccuu

SEQ ID NO: 24677 - RNA, 20 nt, Artificial Sequence
  ELANE RNA Guide
guugcagacaaaggggcugc

SEQ ID NO: 24678 - RNA, 20 nt, Artificial Sequence
  ELANE RNA Guide
uagcccguugcagacaaagg

SEQ ID NO: 24679 - RNA, 20 nt, Artificial Sequence
  ELANE RNA Guide
uccggcagccccuuugucug

SEQ ID NO: 24680 - RNA, 20 nt, Artificial Sequence
  ELANE RNA Guide
ugcagacaaaggggcugccg

SEQ ID NO: 24681 - RNA, 20 nt, Artificial Sequence
  ELANE RNA Guide
uuagcccguugcagacaaag

SEQ ID NO: 24682 - RNA, 20 nt, Artificial Sequence
  ELANE RNA Guide
uugcagacaaaggggcugcc

SEQ ID NO: 24683 - RNA, 20 nt, Artificial Sequence
  ELANE RNA Guide
uugucugcaacgggcuaauc

SEQ ID NO: 24684 - RNA, 20 nt, Artificial Sequence
  ELANE RNA Guide
uuugucugcaacgggcuaau

SEQ ID NO: 24685 - RNA, 21 nt, Artificial Sequence
  ELANE RNA Guide
acaaaggggcugccggagucc

SEQ ID NO: 24686 - RNA, 21 nt, Artificial Sequence
  ELANE RNA Guide
acuccggcagccccuuugucu

SEQ ID NO: 24687 - RNA, 21 nt, Artificial Sequence
  ELANE RNA Guide
agacaaaggggcugccggagu

SEQ ID NO: 24688 - RNA, 21 nt, Artificial Sequence
  ELANE RNA Guide
agccccuuugucugcaacggg

SEQ ID NO: 24689 - RNA, 21 nt, Artificial Sequence
  ELANE RNA Guide
agcccguugcagacaaagggg

SEQ ID NO: 24690 - RNA, 21 nt, Artificial Sequence
  ELANE RNA Guide
auuagcccguugcagacaaag

SEQ ID NO: 24691 - RNA, 21 nt, Artificial Sequence
  ELANE RNA Guide
caaaggggcugccggaguccc

SEQ ID NO: 24692 - RNA, 21 nt, Artificial Sequence
  ELANE RNA Guide
cagacaaaggggcugccggag

SEQ ID NO: 24693 - RNA, 21 nt, Artificial Sequence
  ELANE RNA Guide
cagccccuuugucugcaacgg

SEQ ID NO: 24694 - RNA, 21 nt, Artificial Sequence
  ELANE RNA Guide
ccccuuugucugcaacgggcu

SEQ ID NO: 24695 - RNA, 21 nt, Artificial Sequence
  ELANE RNA Guide
cccguugcagacaaaggggcu

SEQ ID NO: 24696 - RNA, 21 nt, Artificial Sequence
  ELANE RNA Guide
cccuuugucugcaacgggcua

SEQ ID NO: 24697 - RNA, 21 nt, Artificial Sequence
  ELANE RNA Guide
ccggcagccccuuugucugca

SEQ ID NO: 24698 - RNA, 21 nt, Artificial Sequence
  ELANE RNA Guide
ccguugcagacaaaggggcug

SEQ ID NO: 24699 - RNA, 21 nt, Artificial Sequence
  ELANE RNA Guide
ccuuugucugcaacgggcuaa

SEQ ID NO: 24700 - RNA, 21 nt, Artificial Sequence
  ELANE RNA Guide
cggcagccccuuugucugcaa

SEQ ID NO: 24701 - RNA, 21 nt, Artificial Sequence
  ELANE RNA Guide
cguugcagacaaaggggcugc

SEQ ID NO: 24702 - RNA, 21 nt, Artificial Sequence
  ELANE RNA Guide
cuccggcagccccuuugucug

SEQ ID NO: 24703 - RNA, 21 nt, Artificial Sequence
  ELANE RNA Guide
cuuugucugcaacgggcuaau

SEQ ID NO: 24704 - RNA, 21 nt, Artificial Sequence
  ELANE RNA Guide
gacaaaggggcugccggaguc

SEQ ID NO: 24705 - RNA, 21 nt, Artificial Sequence
  ELANE RNA Guide
gacuccggcagccccuuuguc

SEQ ID NO: 24706 - RNA, 21 nt, Artificial Sequence
  ELANE RNA Guide
gauuagcccguugcagacaaa

SEQ ID NO: 24707 - RNA, 21 nt, Artificial Sequence
  ELANE RNA Guide
gcagacaaaggggcugccgga

SEQ ID NO: 24708 - RNA, 21 nt, Artificial Sequence
  ELANE RNA Guide
gcagccccuuugucugcaacg

SEQ ID NO: 24709 - RNA, 21 nt, Artificial Sequence
  ELANE RNA Guide
gccccuuugucugcaacgggc

SEQ ID NO: 24710 - RNA, 21 nt, Artificial Sequence
  ELANE RNA Guide
gcccguugcagacaaaggggc

SEQ ID NO: 24711 - RNA, 21 nt, Artificial Sequence
  ELANE RNA Guide
ggacuccggcagccccuuugu

SEQ ID NO: 24712 - RNA, 21 nt, Artificial Sequence
  ELANE RNA Guide
ggauuagcccguugcagacaa

SEQ ID NO: 24713 - RNA, 21 nt, Artificial Sequence
  ELANE RNA Guide
ggcagccccuuugucugcaac

SEQ ID NO: 24714 - RNA, 21 nt, Artificial Sequence
  ELANE RNA Guide
gggacuccggcagccccuuug

SEQ ID NO: 24715 - RNA, 21 nt, Artificial Sequence
  ELANE RNA Guide
ggggacuccggcagccccuuu

SEQ ID NO: 24716 - RNA, 21 nt, Artificial Sequence
  ELANE RNA Guide
gggggacuccggcagccccuu

SEQ ID NO: 24717 - RNA, 21 nt, Artificial Sequence
  ELANE RNA Guide
guugcagacaaaggggcugcc

SEQ ID NO: 24718 - RNA, 21 nt, Artificial Sequence
  ELANE RNA Guide
uagcccguugcagacaaaggg

SEQ ID NO: 24719 - RNA, 21 nt, Artificial Sequence
  ELANE RNA Guide
uccggcagccccuuugucugc

SEQ ID NO: 24720 - RNA, 21 nt, Artificial Sequence
  ELANE RNA Guide
uccguggauuagcccguugca

SEQ ID NO: 24721 - RNA, 21 nt, Artificial Sequence
  ELANE RNA Guide
ugcagacaaaggggcugccgg

SEQ ID NO: 24722 - RNA, 21 nt, Artificial Sequence
  ELANE RNA Guide
uggauuagcccguugcagaca

SEQ ID NO: 24723 - RNA, 21 nt, Artificial Sequence
  ELANE RNA Guide
uuagcccguugcagacaaagg

SEQ ID NO: 24724 - RNA, 21 nt, Artificial Sequence
  ELANE RNA Guide
uugcagacaaaggggcugccg

SEQ ID NO: 24725 - RNA, 21 nt, Artificial Sequence
  ELANE RNA Guide
uugucugcaacgggcuaaucc

SEQ ID NO: 24726 - RNA, 21 nt, Artificial Sequence
  ELANE RNA Guide
uuugucugcaacgggcuaauc

SEQ ID NO: 24727 - RNA, 22 nt, Artificial Sequence
  ELANE RNA Guide
acaaaggggcugccggaguccc

SEQ ID NO: 24728 - RNA, 22 nt, Artificial Sequence
  ELANE RNA Guide
acuccggcagccccuuugucug

SEQ ID NO: 24729 - RNA, 22 nt, Artificial Sequence
  ELANE RNA Guide
agacaaaggggcugccggaguc

SEQ ID NO: 24730 - RNA, 22 nt, Artificial Sequence
  ELANE RNA Guide
agccccuuugucugcaacgggc

SEQ ID NO: 24731 - RNA, 22 nt, Artificial Sequence
  ELANE RNA Guide
agcccguugcagacaaaggggc

SEQ ID NO: 24732 - RNA, 22 nt, Artificial Sequence
  ELANE RNA Guide
agggggacuccggcagccccuu

SEQ ID NO: 24733 - RNA, 22 nt, Artificial Sequence
  ELANE RNA Guide
auuagcccguugcagacaaagg

SEQ ID NO: 24734 - RNA, 22 nt, Artificial Sequence
  ELANE RNA Guide
caaaggggcugccggagucccc

SEQ ID NO: 24735 - RNA, 22 nt, Artificial Sequence
  ELANE RNA Guide
cagacaaaggggcugccggagu

SEQ ID NO: 24736 - RNA, 22 nt, Artificial Sequence
  ELANE RNA Guide
cagccccuuugucugcaacggg

SEQ ID NO: 24737 - RNA, 22 nt, Artificial Sequence
  ELANE RNA Guide
ccccuuugucugcaacgggcua

SEQ ID NO: 24738 - RNA, 22 nt, Artificial Sequence
  ELANE RNA Guide
cccguugcagacaaaggggcug

SEQ ID NO: 24739 - RNA, 22 nt, Artificial Sequence
  ELANE RNA Guide
cccuuugucugcaacgggcuaa

SEQ ID NO: 24740 - RNA, 22 nt, Artificial Sequence
  ELANE RNA Guide
ccggcagccccuuugucugcaa

SEQ ID NO: 24741 - RNA, 22 nt, Artificial Sequence
  ELANE RNA Guide
ccguugcagacaaaggggcugc

SEQ ID NO: 24742 - RNA, 22 nt, Artificial Sequence
  ELANE RNA Guide
ccuuugucugcaacgggcuaau

SEQ ID NO: 24743 - RNA, 22 nt, Artificial Sequence
  ELANE RNA Guide
cggcagccccuuugucugcaac

SEQ ID NO: 24744 - RNA, 22 nt, Artificial Sequence
  ELANE RNA Guide
cguugcagacaaaggggcugcc

SEQ ID NO: 24745 - RNA, 22 nt, Artificial Sequence
  ELANE RNA Guide
cuccggcagccccuuugucugc

SEQ ID NO: 24746 - RNA, 22 nt, Artificial Sequence
  ELANE RNA Guide
cuuugucugcaacgggcuaauc

SEQ ID NO: 24747 - RNA, 22 nt, Artificial Sequence
  ELANE RNA Guide
gacaaaggggcugccggagucc

SEQ ID NO: 24748 - RNA, 22 nt, Artificial Sequence
  ELANE RNA Guide
gacuccggcagccccuuugucu

SEQ ID NO: 24749 - RNA, 22 nt, Artificial Sequence
  ELANE RNA Guide
gauuagcccguugcagacaaag

SEQ ID NO: 24750 - RNA, 22 nt, Artificial Sequence
  ELANE RNA Guide
gcagacaaaggggcugccggag

SEQ ID NO: 24751 - RNA, 22 nt, Artificial Sequence
  ELANE RNA Guide
gcagccccuuugucugcaacgg

SEQ ID NO: 24752 - RNA, 22 nt, Artificial Sequence
  ELANE RNA Guide
gccccuuugucugcaacgggcu

SEQ ID NO: 24753 - RNA, 22 nt, Artificial Sequence
  ELANE RNA Guide
gcccguugcagacaaaggggcu

SEQ ID NO: 24754 - RNA, 22 nt, Artificial Sequence
  ELANE RNA Guide
ggacuccggcagccccuuuguc

SEQ ID NO: 24755 - RNA, 22 nt, Artificial Sequence
  ELANE RNA Guide
ggauuagcccguugcagacaaa

SEQ ID NO: 24756 - RNA, 22 nt, Artificial Sequence
  ELANE RNA Guide
ggcagccccuuugucugcaacg

SEQ ID NO: 24757 - RNA, 22 nt, Artificial Sequence
  ELANE RNA Guide
gggacuccggcagccccuuugu

SEQ ID NO: 24758 - RNA, 22 nt, Artificial Sequence
  ELANE RNA Guide
ggggacuccggcagccccuuug

SEQ ID NO: 24759 - RNA, 22 nt, Artificial Sequence
  ELANE RNA Guide
gggggacuccggcagccccuuu

SEQ ID NO: 24760 - RNA, 22 nt, Artificial Sequence
  ELANE RNA Guide
guggauuagcccguugcagaca

SEQ ID NO: 24761 - RNA, 22 nt, Artificial Sequence
  ELANE RNA Guide
guugcagacaaaggggcugccg

SEQ ID NO: 24762 - RNA, 22 nt, Artificial Sequence
  ELANE RNA Guide
uagcccguugcagacaaagggg

SEQ ID NO: 24763 - RNA, 22 nt, Artificial Sequence
  ELANE RNA Guide
uccggcagccccuuugucugca

SEQ ID NO: 24764 - RNA, 22 nt, Artificial Sequence
  ELANE RNA Guide
ugcagacaaaggggcugccgga

SEQ ID NO: 24765 - RNA, 22 nt, Artificial Sequence
  ELANE RNA Guide
uggauuagcccguugcagacaa

SEQ ID NO: 24766 - RNA, 22 nt, Artificial Sequence
  ELANE RNA Guide
uuagcccguugcagacaaaggg

SEQ ID NO: 24767 - RNA, 22 nt, Artificial Sequence
  ELANE RNA Guide
uuccguggauuagcccguugca

SEQ ID NO: 24768 - RNA, 22 nt, Artificial Sequence
  ELANE RNA Guide
uugcagacaaaggggcugccgg

SEQ ID NO: 24769 - RNA, 22 nt, Artificial Sequence
  ELANE RNA Guide
uugucugcaacgggcuaaucca

SEQ ID NO: 24770 - RNA, 22 nt, Artificial Sequence
  ELANE RNA Guide
uuugucugcaacgggcuaaucc

SEQ ID NO: 24771 - RNA, 20 nt, Artificial Sequence
  ELANE RNA Guide
aauuccguggauuagcccgu

SEQ ID NO: 24772 - RNA, 20 nt, Artificial Sequence
  ELANE RNA Guide
acuccggcagccccuugguc

SEQ ID NO: 24773 - RNA, 20 nt, Artificial Sequence
  ELANE RNA Guide
agccccuugguccgcaacgg

SEQ ID NO: 24774 - RNA, 20 nt, Artificial Sequence
  ELANE RNA Guide
agcccguugcggaccaaggg

SEQ ID NO: 24775 - RNA, 20 nt, Artificial Sequence
  ELANE RNA Guide
auuagcccguugcggaccaa

SEQ ID NO: 24776 - RNA, 20 nt, Artificial Sequence
  ELANE RNA Guide
auuccguggauuagcccguu

SEQ ID NO: 24777 - RNA, 20 nt, Artificial Sequence
  ELANE RNA Guide
cagccccuugguccgcaacg

SEQ ID NO: 24778 - RNA, 20 nt, Artificial Sequence
  ELANE RNA Guide
ccccuugguccgcaacgggc

SEQ ID NO: 24779 - RNA, 20 nt, Artificial Sequence
  ELANE RNA Guide
cccguugcggaccaaggggc

SEQ ID NO: 24780 - RNA, 20 nt, Artificial Sequence
  ELANE RNA Guide
cccuugguccgcaacgggcu

SEQ ID NO: 24781 - RNA, 20 nt, Artificial Sequence
  ELANE RNA Guide
ccgcaacgggcuaauccacg

SEQ ID NO: 24782 - RNA, 20 nt, Artificial Sequence
  ELANE RNA Guide
ccggcagccccuugguccgc

SEQ ID NO: 24783 - RNA, 20 nt, Artificial Sequence
  ELANE RNA Guide
ccguggauuagcccguugcg

SEQ ID NO: 24784 - RNA, 20 nt, Artificial Sequence
  ELANE RNA Guide
ccguugcggaccaaggggcu

SEQ ID NO: 24785 - RNA, 20 nt, Artificial Sequence
  ELANE RNA Guide
ccuugguccgcaacgggcua

SEQ ID NO: 24786 - RNA, 20 nt, Artificial Sequence
  ELANE RNA Guide
cggaccaaggggcugccgga

SEQ ID NO: 24787 - RNA, 20 nt, Artificial Sequence
  ELANE RNA Guide
cggcagccccuugguccgca

SEQ ID NO: 24788 - RNA, 20 nt, Artificial Sequence
  ELANE RNA Guide
cguggauuagcccguugcgg

SEQ ID NO: 24789 - RNA, 20 nt, Artificial Sequence
  ELANE RNA Guide
cguugcggaccaaggggcug

SEQ ID NO: 24790 - RNA, 20 nt, Artificial Sequence
  ELANE RNA Guide
cuccggcagccccuuggucc

SEQ ID NO: 24791 - RNA, 20 nt, Artificial Sequence
  ELANE RNA Guide
cuugguccgcaacgggcuaa

SEQ ID NO: 24792 - RNA, 20 nt, Artificial Sequence
  ELANE RNA Guide
gacuccggcagccccuuggu

SEQ ID NO: 24793 - RNA, 20 nt, Artificial Sequence
  ELANE RNA Guide
gauuagcccguugcggacca

SEQ ID NO: 24794 - RNA, 20 nt, Artificial Sequence
  ELANE RNA Guide
gcagccccuugguccgcaac

SEQ ID NO: 24795 - RNA, 20 nt, Artificial Sequence
  ELANE RNA Guide
gccccuugguccgcaacggg

SEQ ID NO: 24796 - RNA, 20 nt, Artificial Sequence
  ELANE RNA Guide
gcccguugcggaccaagggg

SEQ ID NO: 24797 - RNA, 20 nt, Artificial Sequence
  ELANE RNA Guide
gcggaccaaggggcugccgg

SEQ ID NO: 24798 - RNA, 20 nt, Artificial Sequence
  ELANE RNA Guide
ggacuccggcagccccuugg

SEQ ID NO: 24799 - RNA, 20 nt, Artificial Sequence
  ELANE RNA Guide
ggauuagcccguugcggacc

SEQ ID NO: 24800 - RNA, 20 nt, Artificial Sequence
  ELANE RNA Guide
ggcagccccuugguccgcaa

SEQ ID NO: 24801 - RNA, 20 nt, Artificial Sequence
  ELANE RNA Guide
gggacuccggcagccccuug

SEQ ID NO: 24802 - RNA, 20 nt, Artificial Sequence
  ELANE RNA Guide
gguccgcaacgggcuaaucc

SEQ ID NO: 24803 - RNA, 20 nt, Artificial Sequence
  ELANE RNA Guide
guccgcaacgggcuaaucca

SEQ ID NO: 24804 - RNA, 20 nt, Artificial Sequence
  ELANE RNA Guide
guggauuagcccguugcgga

SEQ ID NO: 24805 - RNA, 20 nt, Artificial Sequence
  ELANE RNA Guide
guugcggaccaaggggcugc

SEQ ID NO: 24806 - RNA, 20 nt, Artificial Sequence
  ELANE RNA Guide
uagcccguugcggaccaagg

SEQ ID NO: 24807 - RNA, 20 nt, Artificial Sequence
  ELANE RNA Guide
uccgcaacgggcuaauccac

SEQ ID NO: 24808 - RNA, 20 nt, Artificial Sequence
  ELANE RNA Guide
uccggcagccccuugguccg

SEQ ID NO: 24809 - RNA, 20 nt, Artificial Sequence
  ELANE RNA Guide
uccguggauuagcccguugc

SEQ ID NO: 24810 - RNA, 20 nt, Artificial Sequence
  ELANE RNA Guide
ugcggaccaaggggcugccg

SEQ ID NO: 24811 - RNA, 20 nt, Artificial Sequence
  ELANE RNA Guide
uggauuagcccguugcggac

SEQ ID NO: 24812 - RNA, 20 nt, Artificial Sequence
  ELANE RNA Guide
ugguccgcaacgggcuaauc

SEQ ID NO: 24813 - RNA, 20 nt, Artificial Sequence
  ELANE RNA Guide
uuagcccguugcggaccaag

SEQ ID NO: 24814 - RNA, 20 nt, Artificial Sequence
  ELANE RNA Guide
uuccguggauuagcccguug

SEQ ID NO: 24815 - RNA, 20 nt, Artificial Sequence
  ELANE RNA Guide
uugcggaccaaggggcugcc

SEQ ID NO: 24816 - RNA, 20 nt, Artificial Sequence
  ELANE RNA Guide
uugguccgcaacgggcuaau

SEQ ID NO: 24817 - RNA, 21 nt, Artificial Sequence
  ELANE RNA Guide
aauuccguggauuagcccguu

SEQ ID NO: 24818 - RNA, 21 nt, Artificial Sequence
  ELANE RNA Guide
acuccggcagccccuuggucc

SEQ ID NO: 24819 - RNA, 21 nt, Artificial Sequence
  ELANE RNA Guide
agccccuugguccgcaacggg

SEQ ID NO: 24820 - RNA, 21 nt, Artificial Sequence
  ELANE RNA Guide
agcccguugcggaccaagggg

SEQ ID NO: 24821 - RNA, 21 nt, Artificial Sequence
  ELANE RNA Guide
auuagcccguugcggaccaag

SEQ ID NO: 24822 - RNA, 21 nt, Artificial Sequence
  ELANE RNA Guide
auuccguggauuagcccguug

SEQ ID NO: 24823 - RNA, 21 nt, Artificial Sequence
  ELANE RNA Guide
caauuccguggauuagcccgu

SEQ ID NO: 24824 - RNA, 21 nt, Artificial Sequence
  ELANE RNA Guide
cagccccuugguccgcaacgg

SEQ ID NO: 24825 - RNA, 21 nt, Artificial Sequence
  ELANE RNA Guide
ccccuugguccgcaacgggcu

SEQ ID NO: 24826 - RNA, 21 nt, Artificial Sequence
  ELANE RNA Guide
cccguugcggaccaaggggcu

SEQ ID NO: 24827 - RNA, 21 nt, Artificial Sequence
  ELANE RNA Guide
cccuugguccgcaacgggcua

SEQ ID NO: 24828 - RNA, 21 nt, Artificial Sequence
  ELANE RNA Guide
ccgcaacgggcuaauccacgg

SEQ ID NO: 24829 - RNA, 21 nt, Artificial Sequence
  ELANE RNA Guide
ccggcagccccuugguccgca

SEQ ID NO: 24830 - RNA, 21 nt, Artificial Sequence
  ELANE RNA Guide
ccguggauuagcccguugcgg

SEQ ID NO: 24831 - RNA, 21 nt, Artificial Sequence
  ELANE RNA Guide
ccguugcggaccaaggggcug

SEQ ID NO: 24832 - RNA, 21 nt, Artificial Sequence
  ELANE RNA Guide
ccuugguccgcaacgggcuaa

SEQ ID NO: 24833 - RNA, 21 nt, Artificial Sequence
  ELANE RNA Guide
cggaccaaggggcugccggag

SEQ ID NO: 24834 - RNA, 21 nt, Artificial Sequence
  ELANE RNA Guide
cggcagccccuugguccgcaa

SEQ ID NO: 24835 - RNA, 21 nt, Artificial Sequence
  ELANE RNA Guide
cguggauuagcccguugcgga

SEQ ID NO: 24836 - RNA, 21 nt, Artificial Sequence
  ELANE RNA Guide
cguugcggaccaaggggcugc

SEQ ID NO: 24837 - RNA, 21 nt, Artificial Sequence
  ELANE RNA Guide
cuccggcagccccuugguccg

SEQ ID NO: 24838 - RNA, 21 nt, Artificial Sequence
  ELANE RNA Guide
cuugguccgcaacgggcuaau

SEQ ID NO: 24839 - RNA, 21 nt, Artificial Sequence
  ELANE RNA Guide
gacuccggcagccccuugguc

SEQ ID NO: 24840 - RNA, 21 nt, Artificial Sequence
  ELANE RNA Guide
gauuagcccguugcggaccaa

SEQ ID NO: 24841 - RNA, 21 nt, Artificial Sequence
  ELANE RNA Guide
gcagccccuugguccgcaacg

SEQ ID NO: 24842 - RNA, 21 nt, Artificial Sequence
  ELANE RNA Guide
gccccuugguccgcaacgggc

SEQ ID NO: 24843 - RNA, 21 nt, Artificial Sequence
  ELANE RNA Guide
gcccguugcggaccaaggggc

SEQ ID NO: 24844 - RNA, 21 nt, Artificial Sequence
  ELANE RNA Guide
gcggaccaaggggcugccgga

SEQ ID NO: 24845 - RNA, 21 nt, Artificial Sequence
  ELANE RNA Guide
ggacuccggcagccccuuggu

SEQ ID NO: 24846 - RNA, 21 nt, Artificial Sequence
  ELANE RNA Guide
ggauuagcccguugcggacca

SEQ ID NO: 24847 - RNA, 21 nt, Artificial Sequence
  ELANE RNA Guide
ggcagccccuugguccgcaac

SEQ ID NO: 24848 - RNA, 21 nt, Artificial Sequence
  ELANE RNA Guide
gggacuccggcagccccuugg

SEQ ID NO: 24849 - RNA, 21 nt, Artificial Sequence
  ELANE RNA Guide
ggggacuccggcagccccuug

SEQ ID NO: 24850 - RNA, 21 nt, Artificial Sequence
  ELANE RNA Guide
gguccgcaacgggcuaaucca

SEQ ID NO: 24851 - RNA, 21 nt, Artificial Sequence
  ELANE RNA Guide
guccgcaacgggcuaauccac

SEQ ID NO: 24852 - RNA, 21 nt, Artificial Sequence
  ELANE RNA Guide
guggauuagcccguugcggac

SEQ ID NO: 24853 - RNA, 21 nt, Artificial Sequence
  ELANE RNA Guide
guugcggaccaaggggcugcc

SEQ ID NO: 24854 - RNA, 21 nt, Artificial Sequence
  ELANE RNA Guide
uagcccguugcggaccaaggg

SEQ ID NO: 24855 - RNA, 21 nt, Artificial Sequence
  ELANE RNA Guide
uccgcaacgggcuaauccacg

SEQ ID NO: 24856 - RNA, 21 nt, Artificial Sequence
  ELANE RNA Guide
uccggcagccccuugguccgc

SEQ ID NO: 24857 - RNA, 21 nt, Artificial Sequence
  ELANE RNA Guide
uccguggauuagcccguugcg

SEQ ID NO: 24858 - RNA, 21 nt, Artificial Sequence
  ELANE RNA Guide
ugcggaccaaggggcugccgg

SEQ ID NO: 24859 - RNA, 21 nt, Artificial Sequence
  ELANE RNA Guide
uggauuagcccguugcggacc

SEQ ID NO: 24860 - RNA, 21 nt, Artificial Sequence
  ELANE RNA Guide
ugguccgcaacgggcuaaucc

SEQ ID NO: 24861 - RNA, 21 nt, Artificial Sequence
  ELANE RNA Guide
uuagcccguugcggaccaagg

SEQ ID NO: 24862 - RNA, 21 nt, Artificial Sequence
  ELANE RNA Guide
uuccguggauuagcccguugc

SEQ ID NO: 24863 - RNA, 21 nt, Artificial Sequence
  ELANE RNA Guide
uugcggaccaaggggcugccg

SEQ ID NO: 24864 - RNA, 21 nt, Artificial Sequence
  ELANE RNA Guide
uugguccgcaacgggcuaauc

SEQ ID NO: 24865 - RNA, 22 nt, Artificial Sequence
  ELANE RNA Guide
aauuccguggauuagcccguug

SEQ ID NO: 24866 - RNA, 22 nt, Artificial Sequence
  ELANE RNA Guide
acuccggcagccccuugguccg

SEQ ID NO: 24867 - RNA, 22 nt, Artificial Sequence
  ELANE RNA Guide
agccccuugguccgcaacgggc

SEQ ID NO: 24868 - RNA, 22 nt, Artificial Sequence
  ELANE RNA Guide
agcccguugcggaccaaggggc

SEQ ID NO: 24869 - RNA, 22 nt, Artificial Sequence
  ELANE RNA Guide
auuagcccguugcggaccaagg

SEQ ID NO: 24870 - RNA, 22 nt, Artificial Sequence
  ELANE RNA Guide
auuccguggauuagcccguugc

SEQ ID NO: 24871 - RNA, 22 nt, Artificial Sequence
  ELANE RNA Guide
caauuccguggauuagcccguu

SEQ ID NO: 24872 - RNA, 22 nt, Artificial Sequence
  ELANE RNA Guide
cagccccuugguccgcaacggg

SEQ ID NO: 24873 - RNA, 22 nt, Artificial Sequence
  ELANE RNA Guide
ccccuugguccgcaacgggcua

SEQ ID NO: 24874 - RNA, 22 nt, Artificial Sequence
  ELANE RNA Guide
cccguugcggaccaaggggcug

SEQ ID NO: 24875 - RNA, 22 nt, Artificial Sequence
  ELANE RNA Guide
cccuugguccgcaacgggcuaa

SEQ ID NO: 24876 - RNA, 22 nt, Artificial Sequence
  ELANE RNA Guide
ccgcaacgggcuaauccacgga

SEQ ID NO: 24877 - RNA, 22 nt, Artificial Sequence
  ELANE RNA Guide
ccggcagccccuugguccgcaa

SEQ ID NO: 24878 - RNA, 22 nt, Artificial Sequence
  ELANE RNA Guide
ccguggauuagcccguugcgga

SEQ ID NO: 24879 - RNA, 22 nt, Artificial Sequence
  ELANE RNA Guide
ccguugcggaccaaggggcugc

SEQ ID NO: 24880 - RNA, 22 nt, Artificial Sequence
  ELANE RNA Guide
ccuugguccgcaacgggcuaau

SEQ ID NO: 24881 - RNA, 22 nt, Artificial Sequence
  ELANE RNA Guide
cggaccaaggggcugccggagu

SEQ ID NO: 24882 - RNA, 22 nt, Artificial Sequence
  ELANE RNA Guide
cggcagccccuugguccgcaac

SEQ ID NO: 24883 - RNA, 22 nt, Artificial Sequence
  ELANE RNA Guide
cguggauuagcccguugcggac

SEQ ID NO: 24884 - RNA, 22 nt, Artificial Sequence
  ELANE RNA Guide
cguugcggaccaaggggcugcc

SEQ ID NO: 24885 - RNA, 22 nt, Artificial Sequence
  ELANE RNA Guide
cuccggcagccccuugguccgc

SEQ ID NO: 24886 - RNA, 22 nt, Artificial Sequence
  ELANE RNA Guide
cuugguccgcaacgggcuaauc

SEQ ID NO: 24887 - RNA, 22 nt, Artificial Sequence
  ELANE RNA Guide
gacuccggcagccccuuggucc

SEQ ID NO: 24888 - RNA, 22 nt, Artificial Sequence
  ELANE RNA Guide
gauuagcccguugcggaccaag

SEQ ID NO: 24889 - RNA, 22 nt, Artificial Sequence
  ELANE RNA Guide
gcaauuccguggauuagcccgu

SEQ ID NO: 24890 - RNA, 22 nt, Artificial Sequence
  ELANE RNA Guide
gcagccccuugguccgcaacgg

SEQ ID NO: 24891 - RNA, 22 nt, Artificial Sequence
  ELANE RNA Guide
gccccuugguccgcaacgggcu

SEQ ID NO: 24892 - RNA, 22 nt, Artificial Sequence
  ELANE RNA Guide
gcccguugcggaccaaggggcu

SEQ ID NO: 24893 - RNA, 22 nt, Artificial Sequence
  ELANE RNA Guide
gcggaccaaggggcugccggag

SEQ ID NO: 24894 - RNA, 22 nt, Artificial Sequence
  ELANE RNA Guide
ggacuccggcagccccuugguc

SEQ ID NO: 24895 - RNA, 22 nt, Artificial Sequence
  ELANE RNA Guide
ggauuagcccguugcggaccaa

SEQ ID NO: 24896 - RNA, 22 nt, Artificial Sequence
  ELANE RNA Guide
ggcagccccuugguccgcaacg

SEQ ID NO: 24897 - RNA, 22 nt, Artificial Sequence
  ELANE RNA Guide
gggacuccggcagccccuuggu

SEQ ID NO: 24898 - RNA, 22 nt, Artificial Sequence
  ELANE RNA Guide
ggggacuccggcagccccuugg

SEQ ID NO: 24899 - RNA, 22 nt, Artificial Sequence
  ELANE RNA Guide
gggggacuccggcagccccuug

SEQ ID NO: 24900 - RNA, 22 nt, Artificial Sequence
  ELANE RNA Guide
gguccgcaacgggcuaauccac

SEQ ID NO: 24901 - RNA, 22 nt, Artificial Sequence
  ELANE RNA Guide
guccgcaacgggcuaauccacg

SEQ ID NO: 24902 - RNA, 22 nt, Artificial Sequence
  ELANE RNA Guide
guggauuagcccguugcggacc

SEQ ID NO: 24903 - RNA, 22 nt, Artificial Sequence
  ELANE RNA Guide
guugcggaccaaggggcugccg

SEQ ID NO: 24904 - RNA, 22 nt, Artificial Sequence
  ELANE RNA Guide
uagcccguugcggaccaagggg

SEQ ID NO: 24905 - RNA, 22 nt, Artificial Sequence
  ELANE RNA Guide
uccgcaacgggcuaauccacgg

SEQ ID NO: 24906 - RNA, 22 nt, Artificial Sequence
  ELANE RNA Guide
uccggcagccccuugguccgca

SEQ ID NO: 24907 - RNA, 22 nt, Artificial Sequence
  ELANE RNA Guide
uccguggauuagcccguugcgg

SEQ ID NO: 24908 - RNA, 22 nt, Artificial Sequence
  ELANE RNA Guide
ugcggaccaaggggcugccgga

SEQ ID NO: 24909 - RNA, 22 nt, Artificial Sequence
  ELANE RNA Guide
uggauuagcccguugcggacca

SEQ ID NO: 24910 - RNA, 22 nt, Artificial Sequence
  ELANE RNA Guide
ugguccgcaacgggcuaaucca

SEQ ID NO: 24911 - RNA, 22 nt, Artificial Sequence
  ELANE RNA Guide
uuagcccguugcggaccaaggg

SEQ ID NO: 24912 - RNA, 22 nt, Artificial Sequence
  ELANE RNA Guide
uuccguggauuagcccguugcg

SEQ ID NO: 24913 - RNA, 22 nt, Artificial Sequence
  ELANE RNA Guide
uugcggaccaaggggcugccgg

SEQ ID NO: 24914 - RNA, 22 nt, Artificial Sequence
  ELANE RNA Guide
uugguccgcaacgggcuaaucc

SEQ ID NO: 24915 - RNA, 20 nt, Artificial Sequence
  ELANE RNA Guide
agccccuuggucggcaacgg

SEQ ID NO: 24916 - RNA, 20 nt, Artificial Sequence
  ELANE RNA Guide
agcccguugccgaccaaggg

SEQ ID NO: 24917 - RNA, 20 nt, Artificial Sequence
  ELANE RNA Guide
auuagcccguugccgaccaa

SEQ ID NO: 24918 - RNA, 20 nt, Artificial Sequence
  ELANE RNA Guide
cagccccuuggucggcaacg

SEQ ID NO: 24919 - RNA, 20 nt, Artificial Sequence
  ELANE RNA Guide
ccccuuggucggcaacgggc

SEQ ID NO: 24920 - RNA, 20 nt, Artificial Sequence
  ELANE RNA Guide
cccguugccgaccaaggggc

SEQ ID NO: 24921 - RNA, 20 nt, Artificial Sequence
  ELANE RNA Guide
cccuuggucggcaacgggcu

SEQ ID NO: 24922 - RNA, 20 nt, Artificial Sequence
  ELANE RNA Guide
ccgaccaaggggcugccgga

SEQ ID NO: 24923 - RNA, 20 nt, Artificial Sequence
  ELANE RNA Guide
ccggcagccccuuggucggc

SEQ ID NO: 24924 - RNA, 20 nt, Artificial Sequence
  ELANE RNA Guide
ccguggauuagcccguugcc

SEQ ID NO: 24925 - RNA, 20 nt, Artificial Sequence
  ELANE RNA Guide
ccguugccgaccaaggggcu

SEQ ID NO: 24926 - RNA, 20 nt, Artificial Sequence
  ELANE RNA Guide
ccuuggucggcaacgggcua

SEQ ID NO: 24927 - RNA, 20 nt, Artificial Sequence
  ELANE RNA Guide
cggcaacgggcuaauccacg

SEQ ID NO: 24928 - RNA, 20 nt, Artificial Sequence
  ELANE RNA Guide
cggcagccccuuggucggca

SEQ ID NO: 24929 - RNA, 20 nt, Artificial Sequence
  ELANE RNA Guide
cguggauuagcccguugccg

SEQ ID NO: 24930 - RNA, 20 nt, Artificial Sequence
  ELANE RNA Guide
cguugccgaccaaggggcug

SEQ ID NO: 24931 - RNA, 20 nt, Artificial Sequence
  ELANE RNA Guide
cuccggcagccccuuggucg

SEQ ID NO: 24932 - RNA, 20 nt, Artificial Sequence
  ELANE RNA Guide
cuuggucggcaacgggcuaa

SEQ ID NO: 24933 - RNA, 20 nt, Artificial Sequence
  ELANE RNA Guide
gauuagcccguugccgacca

SEQ ID NO: 24934 - RNA, 20 nt, Artificial Sequence
  ELANE RNA Guide
gcagccccuuggucggcaac

SEQ ID NO: 24935 - RNA, 20 nt, Artificial Sequence
  ELANE RNA Guide
gccccuuggucggcaacggg

SEQ ID NO: 24936 - RNA, 20 nt, Artificial Sequence
  ELANE RNA Guide
gcccguugccgaccaagggg

SEQ ID NO: 24937 - RNA, 20 nt, Artificial Sequence
  ELANE RNA Guide
gccgaccaaggggcugccgg

SEQ ID NO: 24938 - RNA, 20 nt, Artificial Sequence
  ELANE RNA Guide
ggauuagcccguugccgacc

SEQ ID NO: 24939 - RNA, 20 nt, Artificial Sequence
  ELANE RNA Guide
ggcagccccuuggucggcaa

SEQ ID NO: 24940 - RNA, 20 nt, Artificial Sequence
  ELANE RNA Guide
ggucggcaacgggcuaaucc

SEQ ID NO: 24941 - RNA, 20 nt, Artificial Sequence
  ELANE RNA Guide
gucggcaacgggcuaaucca

SEQ ID NO: 24942 - RNA, 20 nt, Artificial Sequence
  ELANE RNA Guide
guggauuagcccguugccga

SEQ ID NO: 24943 - RNA, 20 nt, Artificial Sequence
  ELANE RNA Guide
guugccgaccaaggggcugc

SEQ ID NO: 24944 - RNA, 20 nt, Artificial Sequence
  ELANE RNA Guide
uagcccguugccgaccaagg

SEQ ID NO: 24945 - RNA, 20 nt, Artificial Sequence
  ELANE RNA Guide
uccggcagccccuuggucgg

SEQ ID NO: 24946 - RNA, 20 nt, Artificial Sequence
  ELANE RNA Guide
ucggcaacgggcuaauccac

SEQ ID NO: 24947 - RNA, 20 nt, Artificial Sequence
  ELANE RNA Guide
ugccgaccaaggggcugccg

SEQ ID NO: 24948 - RNA, 20 nt, Artificial Sequence
  ELANE RNA Guide
uggauuagcccguugccgac

SEQ ID NO: 24949 - RNA, 20 nt, Artificial Sequence
  ELANE RNA Guide
uggucggcaacgggcuaauc

SEQ ID NO: 24950 - RNA, 20 nt, Artificial Sequence
  ELANE RNA Guide
uuagcccguugccgaccaag

SEQ ID NO: 24951 - RNA, 20 nt, Artificial Sequence
  ELANE RNA Guide
uugccgaccaaggggcugcc

SEQ ID NO: 24952 - RNA, 20 nt, Artificial Sequence
  ELANE RNA Guide
uuggucggcaacgggcuaau

SEQ ID NO: 24953 - RNA, 21 nt, Artificial Sequence
  ELANE RNA Guide
acuccggcagccccuuggucg

SEQ ID NO: 24954 - RNA, 21 nt, Artificial Sequence
  ELANE RNA Guide
agccccuuggucggcaacggg

SEQ ID NO: 24955 - RNA, 21 nt, Artificial Sequence
  ELANE RNA Guide
agcccguugccgaccaagggg

SEQ ID NO: 24956 - RNA, 21 nt, Artificial Sequence
  ELANE RNA Guide
auuagcccguugccgaccaag

SEQ ID NO: 24957 - RNA, 21 nt, Artificial Sequence
  ELANE RNA Guide
cagccccuuggucggcaacgg

SEQ ID NO: 24958 - RNA, 21 nt, Artificial Sequence
  ELANE RNA Guide
ccccuuggucggcaacgggcu

SEQ ID NO: 24959 - RNA, 21 nt, Artificial Sequence
  ELANE RNA Guide
cccguugccgaccaaggggcu

SEQ ID NO: 24960 - RNA, 21 nt, Artificial Sequence
  ELANE RNA Guide
cccuuggucggcaacgggcua

SEQ ID NO: 24961 - RNA, 21 nt, Artificial Sequence
  ELANE RNA Guide
ccgaccaaggggcugccggag

SEQ ID NO: 24962 - RNA, 21 nt, Artificial Sequence
  ELANE RNA Guide
ccggcagccccuuggucggca

SEQ ID NO: 24963 - RNA, 21 nt, Artificial Sequence
  ELANE RNA Guide
ccguggauuagcccguugccg

SEQ ID NO: 24964 - RNA, 21 nt, Artificial Sequence
  ELANE RNA Guide
ccguugccgaccaaggggcug

SEQ ID NO: 24965 - RNA, 21 nt, Artificial Sequence
  ELANE RNA Guide
ccuuggucggcaacgggcuaa

SEQ ID NO: 24966 - RNA, 21 nt, Artificial Sequence
  ELANE RNA Guide
cggcaacgggcuaauccacgg

SEQ ID NO: 24967 - RNA, 21 nt, Artificial Sequence
  ELANE RNA Guide
cggcagccccuuggucggcaa

SEQ ID NO: 24968 - RNA, 21 nt, Artificial Sequence
  ELANE RNA Guide
cguggauuagcccguugccga

SEQ ID NO: 24969 - RNA, 21 nt, Artificial Sequence
  ELANE RNA Guide
cguugccgaccaaggggcugc

SEQ ID NO: 24970 - RNA, 21 nt, Artificial Sequence
  ELANE RNA Guide
cuccggcagccccuuggucgg

SEQ ID NO: 24971 - RNA, 21 nt, Artificial Sequence
  ELANE RNA Guide
cuuggucggcaacgggcuaau

SEQ ID NO: 24972 - RNA, 21 nt, Artificial Sequence
  ELANE RNA Guide
gauuagcccguugccgaccaa

SEQ ID NO: 24973 - RNA, 21 nt, Artificial Sequence
  ELANE RNA Guide
gcagccccuuggucggcaacg

SEQ ID NO: 24974 - RNA, 21 nt, Artificial Sequence
  ELANE RNA Guide
gccccuuggucggcaacgggc

SEQ ID NO: 24975 - RNA, 21 nt, Artificial Sequence
  ELANE RNA Guide
gcccguugccgaccaaggggc

SEQ ID NO: 24976 - RNA, 21 nt, Artificial Sequence
  ELANE RNA Guide
gccgaccaaggggcugccgga

SEQ ID NO: 24977 - RNA, 21 nt, Artificial Sequence
  ELANE RNA Guide
ggauuagcccguugccgacca

SEQ ID NO: 24978 - RNA, 21 nt, Artificial Sequence
  ELANE RNA Guide
ggcagccccuuggucggcaac

SEQ ID NO: 24979 - RNA, 21 nt, Artificial Sequence
  ELANE RNA Guide
ggucggcaacgggcuaaucca

SEQ ID NO: 24980 - RNA, 21 nt, Artificial Sequence
  ELANE RNA Guide
gucggcaacgggcuaauccac

SEQ ID NO: 24981 - RNA, 21 nt, Artificial Sequence
  ELANE RNA Guide
guggauuagcccguugccgac

SEQ ID NO: 24982 - RNA, 21 nt, Artificial Sequence
  ELANE RNA Guide
guugccgaccaaggggcugcc

SEQ ID NO: 24983 - RNA, 21 nt, Artificial Sequence
  ELANE RNA Guide
uagcccguugccgaccaaggg

SEQ ID NO: 24984 - RNA, 21 nt, Artificial Sequence
  ELANE RNA Guide
uccggcagccccuuggucggc

SEQ ID NO: 24985 - RNA, 21 nt, Artificial Sequence
  ELANE RNA Guide
uccguggauuagcccguugcc

SEQ ID NO: 24986 - RNA, 21 nt, Artificial Sequence
  ELANE RNA Guide
ucggcaacgggcuaauccacg

SEQ ID NO: 24987 - RNA, 21 nt, Artificial Sequence
  ELANE RNA Guide
ugccgaccaaggggcugccgg

SEQ ID NO: 24988 - RNA, 21 nt, Artificial Sequence
  ELANE RNA Guide
uggauuagcccguugccgacc

SEQ ID NO: 24989 - RNA, 21 nt, Artificial Sequence
  ELANE RNA Guide
uggucggcaacgggcuaaucc

SEQ ID NO: 24990 - RNA, 21 nt, Artificial Sequence
  ELANE RNA Guide
uuagcccguugccgaccaagg

SEQ ID NO: 24991 - RNA, 21 nt, Artificial Sequence
  ELANE RNA Guide
uugccgaccaaggggcugccg

SEQ ID NO: 24992 - RNA, 21 nt, Artificial Sequence
  ELANE RNA Guide
uuggucggcaacgggcuaauc

SEQ ID NO: 24993 - RNA, 22 nt, Artificial Sequence
  ELANE RNA Guide
acuccggcagccccuuggucgg

SEQ ID NO: 24994 - RNA, 22 nt, Artificial Sequence
  ELANE RNA Guide
agccccuuggucggcaacgggc

SEQ ID NO: 24995 - RNA, 22 nt, Artificial Sequence
  ELANE RNA Guide
agcccguugccgaccaaggggc

SEQ ID NO: 24996 - RNA, 22 nt, Artificial Sequence
  ELANE RNA Guide
auuagcccguugccgaccaagg

SEQ ID NO: 24997 - RNA, 22 nt, Artificial Sequence
  ELANE RNA Guide
cagccccuuggucggcaacggg

SEQ ID NO: 24998 - RNA, 22 nt, Artificial Sequence
  ELANE RNA Guide
ccccuuggucggcaacgggcua

SEQ ID NO: 24999 - RNA, 22 nt, Artificial Sequence
  ELANE RNA Guide
cccguugccgaccaaggggcug

SEQ ID NO: 25000 - RNA, 22 nt, Artificial Sequence
  ELANE RNA Guide
cccuuggucggcaacgggcuaa

SEQ ID NO: 25001 - RNA, 22 nt, Artificial Sequence
  ELANE RNA Guide
ccgaccaaggggcugccggagu

SEQ ID NO: 25002 - RNA, 22 nt, Artificial Sequence
  ELANE RNA Guide
ccggcagccccuuggucggcaa

SEQ ID NO: 25003 - RNA, 22 nt, Artificial Sequence
  ELANE RNA Guide
ccguggauuagcccguugccga

SEQ ID NO: 25004 - RNA, 22 nt, Artificial Sequence
  ELANE RNA Guide
ccguugccgaccaaggggcugc

SEQ ID NO: 25005 - RNA, 22 nt, Artificial Sequence
  ELANE RNA Guide
ccuuggucggcaacgggcuaau

SEQ ID NO: 25006 - RNA, 22 nt, Artificial Sequence
  ELANE RNA Guide
cggcaacgggcuaauccacgga

SEQ ID NO: 25007 - RNA, 22 nt, Artificial Sequence
  ELANE RNA Guide
cggcagccccuuggucggcaac

SEQ ID NO: 25008 - RNA, 22 nt, Artificial Sequence
  ELANE RNA Guide
cguggauuagcccguugccgac

SEQ ID NO: 25009 - RNA, 22 nt, Artificial Sequence
  ELANE RNA Guide
cguugccgaccaaggggcugcc

SEQ ID NO: 25010 - RNA, 22 nt, Artificial Sequence
  ELANE RNA Guide
cuccggcagccccuuggucggc

SEQ ID NO: 25011 - RNA, 22 nt, Artificial Sequence
  ELANE RNA Guide
cuuggucggcaacgggcuaauc

SEQ ID NO: 25012 - RNA, 22 nt, Artificial Sequence
  ELANE RNA Guide
gacuccggcagccccuuggucg

SEQ ID NO: 25013 - RNA, 22 nt, Artificial Sequence
  ELANE RNA Guide
gauuagcccguugccgaccaag

SEQ ID NO: 25014 - RNA, 22 nt, Artificial Sequence
  ELANE RNA Guide
gcagccccuuggucggcaacgg

SEQ ID NO: 25015 - RNA, 22 nt, Artificial Sequence
  ELANE RNA Guide
gccccuuggucggcaacgggcu

SEQ ID NO: 25016 - RNA, 22 nt, Artificial Sequence
  ELANE RNA Guide
gcccguugccgaccaaggggcu

SEQ ID NO: 25017 - RNA, 22 nt, Artificial Sequence
  ELANE RNA Guide
gccgaccaaggggcugccggag

SEQ ID NO: 25018 - RNA, 22 nt, Artificial Sequence
  ELANE RNA Guide
ggauuagcccguugccgaccaa

SEQ ID NO: 25019 - RNA, 22 nt, Artificial Sequence
  ELANE RNA Guide
ggcagccccuuggucggcaacg

SEQ ID NO: 25020 - RNA, 22 nt, Artificial Sequence
  ELANE RNA Guide
ggucggcaacgggcuaauccac

SEQ ID NO: 25021 - RNA, 22 nt, Artificial Sequence
  ELANE RNA Guide
gucggcaacgggcuaauccacg

SEQ ID NO: 25022 - RNA, 22 nt, Artificial Sequence
  ELANE RNA Guide
guggauuagcccguugccgacc

SEQ ID NO: 25023 - RNA, 22 nt, Artificial Sequence
  ELANE RNA Guide
guugccgaccaaggggcugccg

SEQ ID NO: 25024 - RNA, 22 nt, Artificial Sequence
  ELANE RNA Guide
uagcccguugccgaccaagggg

SEQ ID NO: 25025 - RNA, 22 nt, Artificial Sequence
  ELANE RNA Guide
uccggcagccccuuggucggca

SEQ ID NO: 25026 - RNA, 22 nt, Artificial Sequence
  ELANE RNA Guide
uccguggauuagcccguugccg

SEQ ID NO: 25027 - RNA, 22 nt, Artificial Sequence
  ELANE RNA Guide
ucggcaacgggcuaauccacgg

SEQ ID NO: 25028 - RNA, 22 nt, Artificial Sequence
  ELANE RNA Guide
ugccgaccaaggggcugccgga

SEQ ID NO: 25029 - RNA, 22 nt, Artificial Sequence
  ELANE RNA Guide
uggauuagcccguugccgacca

SEQ ID NO: 25030 - RNA, 22 nt, Artificial Sequence
  ELANE RNA Guide
uggucggcaacgggcuaaucca

SEQ ID NO: 25031 - RNA, 22 nt, Artificial Sequence
  ELANE RNA Guide
uuagcccguugccgaccaaggg

SEQ ID NO: 25032 - RNA, 22 nt, Artificial Sequence
  ELANE RNA Guide
uuccguggauuagcccguugcc

SEQ ID NO: 25033 - RNA, 22 nt, Artificial Sequence
  ELANE RNA Guide
uugccgaccaaggggcugccgg

SEQ ID NO: 25034 - RNA, 22 nt, Artificial Sequence
  ELANE RNA Guide
uuggucggcaacgggcuaaucc

SEQ ID NO: 25035 - RNA, 20 nt, Artificial Sequence
  ELANE RNA Guide
agccccuuggucugaaacgg

SEQ ID NO: 25036 - RNA, 20 nt, Artificial Sequence
  ELANE RNA Guide
agcccguuucagaccaaggg

SEQ ID NO: 25037 - RNA, 20 nt, Artificial Sequence
  ELANE RNA Guide
auuagcccguuucagaccaa

SEQ ID NO: 25038 - RNA, 20 nt, Artificial Sequence
  ELANE RNA Guide
caauuccguggauuagcccg

SEQ ID NO: 25039 - RNA, 20 nt, Artificial Sequence
  ELANE RNA Guide
cagccccuuggucugaaacg

SEQ ID NO: 25040 - RNA, 20 nt, Artificial Sequence
  ELANE RNA Guide
ccccuuggucugaaacgggc

SEQ ID NO: 25041 - RNA, 20 nt, Artificial Sequence
  ELANE RNA Guide
cccguuucagaccaaggggc

SEQ ID NO: 25042 - RNA, 20 nt, Artificial Sequence
  ELANE RNA Guide
cccuuggucugaaacgggcu

SEQ ID NO: 25043 - RNA, 20 nt, Artificial Sequence
  ELANE RNA Guide
ccggcagccccuuggucuga

SEQ ID NO: 25044 - RNA, 20 nt, Artificial Sequence
  ELANE RNA Guide
ccguggauuagcccguuuca

SEQ ID NO: 25045 - RNA, 20 nt, Artificial Sequence
  ELANE RNA Guide
ccguuucagaccaaggggcu

SEQ ID NO: 25046 - RNA, 20 nt, Artificial Sequence
  ELANE RNA Guide
ccuuggucugaaacgggcua

SEQ ID NO: 25047 - RNA, 20 nt, Artificial Sequence
  ELANE RNA Guide
cggcagccccuuggucugaa

SEQ ID NO: 25048 - RNA, 20 nt, Artificial Sequence
  ELANE RNA Guide
cguggauuagcccguuucag

SEQ ID NO: 25049 - RNA, 20 nt, Artificial Sequence
  ELANE RNA Guide
cguuucagaccaaggggcug

SEQ ID NO: 25050 - RNA, 20 nt, Artificial Sequence
  ELANE RNA Guide
cuccggcagccccuuggucu

SEQ ID NO: 25051 - RNA, 20 nt, Artificial Sequence
  ELANE RNA Guide
cugaaacgggcuaauccacg

SEQ ID NO: 25052 - RNA, 20 nt, Artificial Sequence
  ELANE RNA Guide
cuuggucugaaacgggcuaa

SEQ ID NO: 25053 - RNA, 20 nt, Artificial Sequence
  ELANE RNA Guide
gaaacgggcuaauccacgga

SEQ ID NO: 25054 - RNA, 20 nt, Artificial Sequence
  ELANE RNA Guide
gauuagcccguuucagacca

SEQ ID NO: 25055 - RNA, 20 nt, Artificial Sequence
  ELANE RNA Guide
gcaauuccguggauuagccc

SEQ ID NO: 25056 - RNA, 20 nt, Artificial Sequence
  ELANE RNA Guide
gcagccccuuggucugaaac

SEQ ID NO: 25057 - RNA, 20 nt, Artificial Sequence
  ELANE RNA Guide
gccccuuggucugaaacggg

SEQ ID NO: 25058 - RNA, 20 nt, Artificial Sequence
  ELANE RNA Guide
gcccguuucagaccaagggg

SEQ ID NO: 25059 - RNA, 20 nt, Artificial Sequence
  ELANE RNA Guide
ggauuagcccguuucagacc

SEQ ID NO: 25060 - RNA, 20 nt, Artificial Sequence
  ELANE RNA Guide
ggcagccccuuggucugaaa

SEQ ID NO: 25061 - RNA, 20 nt, Artificial Sequence
  ELANE RNA Guide
ggucugaaacgggcuaaucc

SEQ ID NO: 25062 - RNA, 20 nt, Artificial Sequence
  ELANE RNA Guide
gucugaaacgggcuaaucca

SEQ ID NO: 25063 - RNA, 20 nt, Artificial Sequence
  ELANE RNA Guide
guggauuagcccguuucaga

SEQ ID NO: 25064 - RNA, 20 nt, Artificial Sequence
  ELANE RNA Guide
guuucagaccaaggggcugc

SEQ ID NO: 25065 - RNA, 20 nt, Artificial Sequence
  ELANE RNA Guide
uagcccguuucagaccaagg

SEQ ID NO: 25066 - RNA, 20 nt, Artificial Sequence
  ELANE RNA Guide
uccggcagccccuuggucug

SEQ ID NO: 25067 - RNA, 20 nt, Artificial Sequence
  ELANE RNA Guide
uccguggauuagcccguuuc

SEQ ID NO: 25068 - RNA, 20 nt, Artificial Sequence
  ELANE RNA Guide
ucugaaacgggcuaauccac

SEQ ID NO: 25069 - RNA, 20 nt, Artificial Sequence
  ELANE RNA Guide
ugaaacgggcuaauccacgg

SEQ ID NO: 25070 - RNA, 20 nt, Artificial Sequence
  ELANE RNA Guide
uggauuagcccguuucagac

SEQ ID NO: 25071 - RNA, 20 nt, Artificial Sequence
  ELANE RNA Guide
uggucugaaacgggcuaauc

SEQ ID NO: 25072 - RNA, 20 nt, Artificial Sequence
  ELANE RNA Guide
uuagcccguuucagaccaag

SEQ ID NO: 25073 - RNA, 20 nt, Artificial Sequence
  ELANE RNA Guide
uucagaccaaggggcugccg

SEQ ID NO: 25074 - RNA, 20 nt, Artificial Sequence
  ELANE RNA Guide
uuccguggauuagcccguuu

SEQ ID NO: 25075 - RNA, 20 nt, Artificial Sequence
  ELANE RNA Guide
uuggucugaaacgggcuaau

SEQ ID NO: 25076 - RNA, 20 nt, Artificial Sequence
  ELANE RNA Guide
uuucagaccaaggggcugcc

SEQ ID NO: 25077 - RNA, 21 nt, Artificial Sequence
  ELANE RNA Guide
acuccggcagccccuuggucu

SEQ ID NO: 25078 - RNA, 21 nt, Artificial Sequence
  ELANE RNA Guide
agccccuuggucugaaacggg

SEQ ID NO: 25079 - RNA, 21 nt, Artificial Sequence
  ELANE RNA Guide
agcccguuucagaccaagggg

SEQ ID NO: 25080 - RNA, 21 nt, Artificial Sequence
  ELANE RNA Guide
auuagcccguuucagaccaag

SEQ ID NO: 25081 - RNA, 21 nt, Artificial Sequence
  ELANE RNA Guide
auuccguggauuagcccguuu

SEQ ID NO: 25082 - RNA, 21 nt, Artificial Sequence
  ELANE RNA Guide
cagccccuuggucugaaacgg

SEQ ID NO: 25083 - RNA, 21 nt, Artificial Sequence
  ELANE RNA Guide
ccccuuggucugaaacgggcu

SEQ ID NO: 25084 - RNA, 21 nt, Artificial Sequence
  ELANE RNA Guide
cccguuucagaccaaggggcu

SEQ ID NO: 25085 - RNA, 21 nt, Artificial Sequence
  ELANE RNA Guide
cccuuggucugaaacgggcua

SEQ ID NO: 25086 - RNA, 21 nt, Artificial Sequence
  ELANE RNA Guide
ccggcagccccuuggucugaa

SEQ ID NO: 25087 - RNA, 21 nt, Artificial Sequence
  ELANE RNA Guide
ccguggauuagcccguuucag

SEQ ID NO: 25088 - RNA, 21 nt, Artificial Sequence
  ELANE RNA Guide
ccguuucagaccaaggggcug

SEQ ID NO: 25089 - RNA, 21 nt, Artificial Sequence
  ELANE RNA Guide
ccuuggucugaaacgggcuaa

SEQ ID NO: 25090 - RNA, 21 nt, Artificial Sequence
  ELANE RNA Guide
cggcagccccuuggucugaaa

SEQ ID NO: 25091 - RNA, 21 nt, Artificial Sequence
  ELANE RNA Guide
cguggauuagcccguuucaga

SEQ ID NO: 25092 - RNA, 21 nt, Artificial Sequence
  ELANE RNA Guide
cguuucagaccaaggggcugc

SEQ ID NO: 25093 - RNA, 21 nt, Artificial Sequence
  ELANE RNA Guide
cuccggcagccccuuggucug

SEQ ID NO: 25094 - RNA, 21 nt, Artificial Sequence
  ELANE RNA Guide
cugaaacgggcuaauccacgg

SEQ ID NO: 25095 - RNA, 21 nt, Artificial Sequence
  ELANE RNA Guide
cuuggucugaaacgggcuaau

SEQ ID NO: 25096 - RNA, 21 nt, Artificial Sequence
  ELANE RNA Guide
gaaacgggcuaauccacggaa

SEQ ID NO: 25097 - RNA, 21 nt, Artificial Sequence
  ELANE RNA Guide
gauuagcccguuucagaccaa

SEQ ID NO: 25098 - RNA, 21 nt, Artificial Sequence
  ELANE RNA Guide
gcaauuccguggauuagcccg

SEQ ID NO: 25099 - RNA, 21 nt, Artificial Sequence
  ELANE RNA Guide
gcagccccuuggucugaaacg

SEQ ID NO: 25100 - RNA, 21 nt, Artificial Sequence
  ELANE RNA Guide
gccccuuggucugaaacgggc

SEQ ID NO: 25101 - RNA, 21 nt, Artificial Sequence
  ELANE RNA Guide
gcccguuucagaccaaggggc

SEQ ID NO: 25102 - RNA, 21 nt, Artificial Sequence
  ELANE RNA Guide
ggauuagcccguuucagacca

SEQ ID NO: 25103 - RNA, 21 nt, Artificial Sequence
  ELANE RNA Guide
ggcaauuccguggauuagccc

SEQ ID NO: 25104 - RNA, 21 nt, Artificial Sequence
  ELANE RNA Guide
ggcagccccuuggucugaaac

SEQ ID NO: 25105 - RNA, 21 nt, Artificial Sequence
  ELANE RNA Guide
ggucugaaacgggcuaaucca

SEQ ID NO: 25106 - RNA, 21 nt, Artificial Sequence
  ELANE RNA Guide
gucugaaacgggcuaauccac

SEQ ID NO: 25107 - RNA, 21 nt, Artificial Sequence
  ELANE RNA Guide
guggauuagcccguuucagac

SEQ ID NO: 25108 - RNA, 21 nt, Artificial Sequence
  ELANE RNA Guide
guuucagaccaaggggcugcc

SEQ ID NO: 25109 - RNA, 21 nt, Artificial Sequence
  ELANE RNA Guide
uagcccguuucagaccaaggg

SEQ ID NO: 25110 - RNA, 21 nt, Artificial Sequence
  ELANE RNA Guide
uccggcagccccuuggucuga

SEQ ID NO: 25111 - RNA, 21 nt, Artificial Sequence
  ELANE RNA Guide
uccguggauuagcccguuuca

SEQ ID NO: 25112 - RNA, 21 nt, Artificial Sequence
  ELANE RNA Guide
ucugaaacgggcuaauccacg

SEQ ID NO: 25113 - RNA, 21 nt, Artificial Sequence
  ELANE RNA Guide
ugaaacgggcuaauccacgga

SEQ ID NO: 25114 - RNA, 21 nt, Artificial Sequence
  ELANE RNA Guide
uggauuagcccguuucagacc

SEQ ID NO: 25115 - RNA, 21 nt, Artificial Sequence
  ELANE RNA Guide
uggucugaaacgggcuaaucc

SEQ ID NO: 25116 - RNA, 21 nt, Artificial Sequence
  ELANE RNA Guide
uuagcccguuucagaccaagg

SEQ ID NO: 25117 - RNA, 21 nt, Artificial Sequence
  ELANE RNA Guide
uucagaccaaggggcugccgg

SEQ ID NO: 25118 - RNA, 21 nt, Artificial Sequence
  ELANE RNA Guide
uuccguggauuagcccguuuc

SEQ ID NO: 25119 - RNA, 21 nt, Artificial Sequence
  ELANE RNA Guide
uuggucugaaacgggcuaauc

SEQ ID NO: 25120 - RNA, 21 nt, Artificial Sequence
  ELANE RNA Guide
uuucagaccaaggggcugccg

SEQ ID NO: 25121 - RNA, 22 nt, Artificial Sequence
  ELANE RNA Guide
aauuccguggauuagcccguuu

SEQ ID NO: 25122 - RNA, 22 nt, Artificial Sequence
  ELANE RNA Guide
acuccggcagccccuuggucug

SEQ ID NO: 25123 - RNA, 22 nt, Artificial Sequence
  ELANE RNA Guide
agccccuuggucugaaacgggc

SEQ ID NO: 25124 - RNA, 22 nt, Artificial Sequence
  ELANE RNA Guide
agcccguuucagaccaaggggc

SEQ ID NO: 25125 - RNA, 22 nt, Artificial Sequence
  ELANE RNA Guide
aggcaauuccguggauuagccc

SEQ ID NO: 25126 - RNA, 22 nt, Artificial Sequence
  ELANE RNA Guide
auuagcccguuucagaccaagg

SEQ ID NO: 25127 - RNA, 22 nt, Artificial Sequence
  ELANE RNA Guide
auuccguggauuagcccguuuc

SEQ ID NO: 25128 - RNA, 22 nt, Artificial Sequence
  ELANE RNA Guide
cagccccuuggucugaaacggg

SEQ ID NO: 25129 - RNA, 22 nt, Artificial Sequence
  ELANE RNA Guide
ccccuuggucugaaacgggcua

SEQ ID NO: 25130 - RNA, 22 nt, Artificial Sequence
  ELANE RNA Guide
cccguuucagaccaaggggcug

SEQ ID NO: 25131 - RNA, 22 nt, Artificial Sequence
  ELANE RNA Guide
cccuuggucugaaacgggcuaa

SEQ ID NO: 25132 - RNA, 22 nt, Artificial Sequence
  ELANE RNA Guide
ccggcagccccuuggucugaaa

SEQ ID NO: 25133 - RNA, 22 nt, Artificial Sequence
  ELANE RNA Guide
ccguggauuagcccguuucaga

SEQ ID NO: 25134 - RNA, 22 nt, Artificial Sequence
  ELANE RNA Guide
ccguuucagaccaaggggcugc

SEQ ID NO: 25135 - RNA, 22 nt, Artificial Sequence
  ELANE RNA Guide
ccuuggucugaaacgggcuaau

SEQ ID NO: 25136 - RNA, 22 nt, Artificial Sequence
  ELANE RNA Guide
cggcagccccuuggucugaaac

SEQ ID NO: 25137 - RNA, 22 nt, Artificial Sequence
  ELANE RNA Guide
cguggauuagcccguuucagac

SEQ ID NO: 25138 - RNA, 22 nt, Artificial Sequence
  ELANE RNA Guide
cguuucagaccaaggggcugcc

SEQ ID NO: 25139 - RNA, 22 nt, Artificial Sequence
  ELANE RNA Guide
cuccggcagccccuuggucuga

SEQ ID NO: 25140 - RNA, 22 nt, Artificial Sequence
  ELANE RNA Guide
cugaaacgggcuaauccacgga

SEQ ID NO: 25141 - RNA, 22 nt, Artificial Sequence
  ELANE RNA Guide
cuuggucugaaacgggcuaauc

SEQ ID NO: 25142 - RNA, 22 nt, Artificial Sequence
  ELANE RNA Guide
gaaacgggcuaauccacggaau

SEQ ID NO: 25143 - RNA, 22 nt, Artificial Sequence
  ELANE RNA Guide
gacuccggcagccccuuggucu

SEQ ID NO: 25144 - RNA, 22 nt, Artificial Sequence
  ELANE RNA Guide
gauuagcccguuucagaccaag

SEQ ID NO: 25145 - RNA, 22 nt, Artificial Sequence
  ELANE RNA Guide
gcagccccuuggucugaaacgg

SEQ ID NO: 25146 - RNA, 22 nt, Artificial Sequence
  ELANE RNA Guide
gccccuuggucugaaacgggcu

SEQ ID NO: 25147 - RNA, 22 nt, Artificial Sequence
  ELANE RNA Guide
gcccguuucagaccaaggggcu

SEQ ID NO: 25148 - RNA, 22 nt, Artificial Sequence
  ELANE RNA Guide
ggauuagcccguuucagaccaa

SEQ ID NO: 25149 - RNA, 22 nt, Artificial Sequence
  ELANE RNA Guide
ggcaauuccguggauuagcccg

SEQ ID NO: 25150 - RNA, 22 nt, Artificial Sequence
  ELANE RNA Guide
ggcagccccuuggucugaaacg

SEQ ID NO: 25151 - RNA, 22 nt, Artificial Sequence
  ELANE RNA Guide
ggucugaaacgggcuaauccac

SEQ ID NO: 25152 - RNA, 22 nt, Artificial Sequence
  ELANE RNA Guide
gucugaaacgggcuaauccacg

SEQ ID NO: 25153 - RNA, 22 nt, Artificial Sequence
  ELANE RNA Guide
guggauuagcccguuucagacc

SEQ ID NO: 25154 - RNA, 22 nt, Artificial Sequence
  ELANE RNA Guide
guuucagaccaaggggcugccg

SEQ ID NO: 25155 - RNA, 22 nt, Artificial Sequence
  ELANE RNA Guide
uagcccguuucagaccaagggg

SEQ ID NO: 25156 - RNA, 22 nt, Artificial Sequence
  ELANE RNA Guide
uccggcagccccuuggucugaa

SEQ ID NO: 25157 - RNA, 22 nt, Artificial Sequence
  ELANE RNA Guide
uccguggauuagcccguuucag

SEQ ID NO: 25158 - RNA, 22 nt, Artificial Sequence
  ELANE RNA Guide
ucugaaacgggcuaauccacgg

SEQ ID NO: 25159 - RNA, 22 nt, Artificial Sequence
  ELANE RNA Guide
ugaaacgggcuaauccacggaa

SEQ ID NO: 25160 - RNA, 22 nt, Artificial Sequence
  ELANE RNA Guide
uggauuagcccguuucagacca

SEQ ID NO: 25161 - RNA, 22 nt, Artificial Sequence
  ELANE RNA Guide
uggucugaaacgggcuaaucca

SEQ ID NO: 25162 - RNA, 22 nt, Artificial Sequence
  ELANE RNA Guide
uuagcccguuucagaccaaggg

SEQ ID NO: 25163 - RNA, 22 nt, Artificial Sequence
  ELANE RNA Guide
uucagaccaaggggcugccgga

SEQ ID NO: 25164 - RNA, 22 nt, Artificial Sequence
  ELANE RNA Guide
uuccguggauuagcccguuuca

SEQ ID NO: 25165 - RNA, 22 nt, Artificial Sequence
  ELANE RNA Guide
uuggucugaaacgggcuaaucc

SEQ ID NO: 25166 - RNA, 22 nt, Artificial Sequence
  ELANE RNA Guide
uuucagaccaaggggcugccgg

SEQ ID NO: 25167 - RNA, 20 nt, Artificial Sequence
  ELANE RNA Guide
aauuccguggauuagcccga

SEQ ID NO: 25168 - RNA, 20 nt, Artificial Sequence
  ELANE RNA Guide
agccccuuggucugcaucgg

SEQ ID NO: 25169 - RNA, 20 nt, Artificial Sequence
  ELANE RNA Guide
agcccgaugcagaccaaggg

SEQ ID NO: 25170 - RNA, 20 nt, Artificial Sequence
  ELANE RNA Guide
aggcaauuccguggauuagc

SEQ ID NO: 25171 - RNA, 20 nt, Artificial Sequence
  ELANE RNA Guide
aucgggcuaauccacggaau

SEQ ID NO: 25172 - RNA, 20 nt, Artificial Sequence
  ELANE RNA Guide
auuagcccgaugcagaccaa

SEQ ID NO: 25173 - RNA, 20 nt, Artificial Sequence
  ELANE RNA Guide
auuccguggauuagcccgau

SEQ ID NO: 25174 - RNA, 20 nt, Artificial Sequence
  ELANE RNA Guide
cagccccuuggucugcaucg

SEQ ID NO: 25175 - RNA, 20 nt, Artificial Sequence
  ELANE RNA Guide
caucgggcuaauccacggaa

SEQ ID NO: 25176 - RNA, 20 nt, Artificial Sequence
  ELANE RNA Guide
ccccuuggucugcaucgggc

SEQ ID NO: 25177 - RNA, 20 nt, Artificial Sequence
  ELANE RNA Guide
cccgaugcagaccaaggggc

SEQ ID NO: 25178 - RNA, 20 nt, Artificial Sequence
  ELANE RNA Guide
cccuuggucugcaucgggcu

SEQ ID NO: 25179 - RNA, 20 nt, Artificial Sequence
  ELANE RNA Guide
ccgaugcagaccaaggggcu

SEQ ID NO: 25180 - RNA, 20 nt, Artificial Sequence
  ELANE RNA Guide
ccggcagccccuuggucugc

SEQ ID NO: 25181 - RNA, 20 nt, Artificial Sequence
  ELANE RNA Guide
ccguggauuagcccgaugca

SEQ ID NO: 25182 - RNA, 20 nt, Artificial Sequence
  ELANE RNA Guide
ccuuggucugcaucgggcua

SEQ ID NO: 25183 - RNA, 20 nt, Artificial Sequence
  ELANE RNA Guide
cgaugcagaccaaggggcug

SEQ ID NO: 25184 - RNA, 20 nt, Artificial Sequence
  ELANE RNA Guide
cggcagccccuuggucugca

SEQ ID NO: 25185 - RNA, 20 nt, Artificial Sequence
  ELANE RNA Guide
cguggauuagcccgaugcag

SEQ ID NO: 25186 - RNA, 20 nt, Artificial Sequence
  ELANE RNA Guide
cugcaucgggcuaauccacg

SEQ ID NO: 25187 - RNA, 20 nt, Artificial Sequence
  ELANE RNA Guide
cuuggucugcaucgggcuaa

SEQ ID NO: 25188 - RNA, 20 nt, Artificial Sequence
  ELANE RNA Guide
gaugcagaccaaggggcugc

SEQ ID NO: 25189 - RNA, 20 nt, Artificial Sequence
  ELANE RNA Guide
gauuagcccgaugcagacca

SEQ ID NO: 25190 - RNA, 20 nt, Artificial Sequence
  ELANE RNA Guide
gcagccccuuggucugcauc

SEQ ID NO: 25191 - RNA, 20 nt, Artificial Sequence
  ELANE RNA Guide
gcaucgggcuaauccacgga

SEQ ID NO: 25192 - RNA, 20 nt, Artificial Sequence
  ELANE RNA Guide
gccccuuggucugcaucggg

SEQ ID NO: 25193 - RNA, 20 nt, Artificial Sequence
  ELANE RNA Guide
gcccgaugcagaccaagggg

SEQ ID NO: 25194 - RNA, 20 nt, Artificial Sequence
  ELANE RNA Guide
ggauuagcccgaugcagacc

SEQ ID NO: 25195 - RNA, 20 nt, Artificial Sequence
  ELANE RNA Guide
ggcaauuccguggauuagcc

SEQ ID NO: 25196 - RNA, 20 nt, Artificial Sequence
  ELANE RNA Guide
ggcagccccuuggucugcau

SEQ ID NO: 25197 - RNA, 20 nt, Artificial Sequence
  ELANE RNA Guide
ggucugcaucgggcuaaucc

SEQ ID NO: 25198 - RNA, 20 nt, Artificial Sequence
  ELANE RNA Guide
gucugcaucgggcuaaucca

SEQ ID NO: 25199 - RNA, 20 nt, Artificial Sequence
  ELANE RNA Guide
guggauuagcccgaugcaga

SEQ ID NO: 25200 - RNA, 20 nt, Artificial Sequence
  ELANE RNA Guide
uagcccgaugcagaccaagg

SEQ ID NO: 25201 - RNA, 20 nt, Artificial Sequence
  ELANE RNA Guide
uccguggauuagcccgaugc

SEQ ID NO: 25202 - RNA, 20 nt, Artificial Sequence
  ELANE RNA Guide
ucugcaucgggcuaauccac

SEQ ID NO: 25203 - RNA, 20 nt, Artificial Sequence
  ELANE RNA Guide
ugcaucgggcuaauccacgg

SEQ ID NO: 25204 - RNA, 20 nt, Artificial Sequence
  ELANE RNA Guide
uggauuagcccgaugcagac

SEQ ID NO: 25205 - RNA, 20 nt, Artificial Sequence
  ELANE RNA Guide
uggucugcaucgggcuaauc

SEQ ID NO: 25206 - RNA, 20 nt, Artificial Sequence
  ELANE RNA Guide
uuagcccgaugcagaccaag

SEQ ID NO: 25207 - RNA, 20 nt, Artificial Sequence
  ELANE RNA Guide
uuccguggauuagcccgaug

SEQ ID NO: 25208 - RNA, 20 nt, Artificial Sequence
  ELANE RNA Guide
uuggucugcaucgggcuaau

SEQ ID NO: 25209 - RNA, 21 nt, Artificial Sequence
  ELANE RNA Guide
aauuccguggauuagcccgau

SEQ ID NO: 25210 - RNA, 21 nt, Artificial Sequence
  ELANE RNA Guide
agccccuuggucugcaucggg

SEQ ID NO: 25211 - RNA, 21 nt, Artificial Sequence
  ELANE RNA Guide
agcccgaugcagaccaagggg

SEQ ID NO: 25212 - RNA, 21 nt, Artificial Sequence
  ELANE RNA Guide
aggcaauuccguggauuagcc

SEQ ID NO: 25213 - RNA, 21 nt, Artificial Sequence
  ELANE RNA Guide
aucgggcuaauccacggaauu

SEQ ID NO: 25214 - RNA, 21 nt, Artificial Sequence
  ELANE RNA Guide
auuagcccgaugcagaccaag

SEQ ID NO: 25215 - RNA, 21 nt, Artificial Sequence
  ELANE RNA Guide
auuccguggauuagcccgaug

SEQ ID NO: 25216 - RNA, 21 nt, Artificial Sequence
  ELANE RNA Guide
caauuccguggauuagcccga

SEQ ID NO: 25217 - RNA, 21 nt, Artificial Sequence
  ELANE RNA Guide
cagccccuuggucugcaucgg

SEQ ID NO: 25218 - RNA, 21 nt, Artificial Sequence
  ELANE RNA Guide
caucgggcuaauccacggaau

SEQ ID NO: 25219 - RNA, 21 nt, Artificial Sequence
  ELANE RNA Guide
ccccuuggucugcaucgggcu

SEQ ID NO: 25220 - RNA, 21 nt, Artificial Sequence
  ELANE RNA Guide
cccgaugcagaccaaggggcu

SEQ ID NO: 25221 - RNA, 21 nt, Artificial Sequence
  ELANE RNA Guide
cccuuggucugcaucgggcua

SEQ ID NO: 25222 - RNA, 21 nt, Artificial Sequence
  ELANE RNA Guide
ccgaugcagaccaaggggcug

SEQ ID NO: 25223 - RNA, 21 nt, Artificial Sequence
  ELANE RNA Guide
ccggcagccccuuggucugca

SEQ ID NO: 25224 - RNA, 21 nt, Artificial Sequence
  ELANE RNA Guide
ccguggauuagcccgaugcag

SEQ ID NO: 25225 - RNA, 21 nt, Artificial Sequence
  ELANE RNA Guide
ccuuggucugcaucgggcuaa

SEQ ID NO: 25226 - RNA, 21 nt, Artificial Sequence
  ELANE RNA Guide
cgaugcagaccaaggggcugc

SEQ ID NO: 25227 - RNA, 21 nt, Artificial Sequence
  ELANE RNA Guide
cggcagccccuuggucugcau

SEQ ID NO: 25228 - RNA, 21 nt, Artificial Sequence
  ELANE RNA Guide
cguggauuagcccgaugcaga

SEQ ID NO: 25229 - RNA, 21 nt, Artificial Sequence
  ELANE RNA Guide
cugcaucgggcuaauccacgg

SEQ ID NO: 25230 - RNA, 21 nt, Artificial Sequence
  ELANE RNA Guide
cuuggucugcaucgggcuaau

SEQ ID NO: 25231 - RNA, 21 nt, Artificial Sequence
  ELANE RNA Guide
gaggcaauuccguggauuagc

SEQ ID NO: 25232 - RNA, 21 nt, Artificial Sequence
  ELANE RNA Guide
gaugcagaccaaggggcugcc

SEQ ID NO: 25233 - RNA, 21 nt, Artificial Sequence
  ELANE RNA Guide
gauuagcccgaugcagaccaa

SEQ ID NO: 25234 - RNA, 21 nt, Artificial Sequence
  ELANE RNA Guide
gcagccccuuggucugcaucg

SEQ ID NO: 25235 - RNA, 21 nt, Artificial Sequence
  ELANE RNA Guide
gcaucgggcuaauccacggaa

SEQ ID NO: 25236 - RNA, 21 nt, Artificial Sequence
  ELANE RNA Guide
gccccuuggucugcaucgggc

SEQ ID NO: 25237 - RNA, 21 nt, Artificial Sequence
  ELANE RNA Guide
gcccgaugcagaccaaggggc

SEQ ID NO: 25238 - RNA, 21 nt, Artificial Sequence
  ELANE RNA Guide
ggauuagcccgaugcagacca

SEQ ID NO: 25239 - RNA, 21 nt, Artificial Sequence
  ELANE RNA Guide
ggcagccccuuggucugcauc

SEQ ID NO: 25240 - RNA, 21 nt, Artificial Sequence
  ELANE RNA Guide
ggucugcaucgggcuaaucca

SEQ ID NO: 25241 - RNA, 21 nt, Artificial Sequence
  ELANE RNA Guide
gucugcaucgggcuaauccac

SEQ ID NO: 25242 - RNA, 21 nt, Artificial Sequence
  ELANE RNA Guide
guggauuagcccgaugcagac

SEQ ID NO: 25243 - RNA, 21 nt, Artificial Sequence
  ELANE RNA Guide
uagcccgaugcagaccaaggg

SEQ ID NO: 25244 - RNA, 21 nt, Artificial Sequence
  ELANE RNA Guide
uccggcagccccuuggucugc

SEQ ID NO: 25245 - RNA, 21 nt, Artificial Sequence
  ELANE RNA Guide
uccguggauuagcccgaugca

SEQ ID NO: 25246 - RNA, 21 nt, Artificial Sequence
  ELANE RNA Guide
ucugcaucgggcuaauccacg

SEQ ID NO: 25247 - RNA, 21 nt, Artificial Sequence
  ELANE RNA Guide
ugcaucgggcuaauccacgga

SEQ ID NO: 25248 - RNA, 21 nt, Artificial Sequence
  ELANE RNA Guide
uggauuagcccgaugcagacc

SEQ ID NO: 25249 - RNA, 21 nt, Artificial Sequence
  ELANE RNA Guide
uggucugcaucgggcuaaucc

SEQ ID NO: 25250 - RNA, 21 nt, Artificial Sequence
  ELANE RNA Guide
uuagcccgaugcagaccaagg

SEQ ID NO: 25251 - RNA, 21 nt, Artificial Sequence
  ELANE RNA Guide
uuccguggauuagcccgaugc

SEQ ID NO: 25252 - RNA, 21 nt, Artificial Sequence
  ELANE RNA Guide
uuggucugcaucgggcuaauc

SEQ ID NO: 25253 - RNA, 22 nt, Artificial Sequence
  ELANE RNA Guide
aauuccguggauuagcccgaug

SEQ ID NO: 25254 - RNA, 22 nt, Artificial Sequence
  ELANE RNA Guide
agccccuuggucugcaucgggc

SEQ ID NO: 25255 - RNA, 22 nt, Artificial Sequence
  ELANE RNA Guide
agcccgaugcagaccaaggggc

SEQ ID NO: 25256 - RNA, 22 nt, Artificial Sequence
  ELANE RNA Guide
aucgggcuaauccacggaauug

SEQ ID NO: 25257 - RNA, 22 nt, Artificial Sequence
  ELANE RNA Guide
auuagcccgaugcagaccaagg

SEQ ID NO: 25258 - RNA, 22 nt, Artificial Sequence
  ELANE RNA Guide
auuccguggauuagcccgaugc

SEQ ID NO: 25259 - RNA, 22 nt, Artificial Sequence
  ELANE RNA Guide
caauuccguggauuagcccgau

SEQ ID NO: 25260 - RNA, 22 nt, Artificial Sequence
  ELANE RNA Guide
cagccccuuggucugcaucggg

SEQ ID NO: 25261 - RNA, 22 nt, Artificial Sequence
  ELANE RNA Guide
caucgggcuaauccacggaauu

SEQ ID NO: 25262 - RNA, 22 nt, Artificial Sequence
  ELANE RNA Guide
ccccuuggucugcaucgggcua

SEQ ID NO: 25263 - RNA, 22 nt, Artificial Sequence
  ELANE RNA Guide
cccgaugcagaccaaggggcug

SEQ ID NO: 25264 - RNA, 22 nt, Artificial Sequence
  ELANE RNA Guide
cccuuggucugcaucgggcuaa

SEQ ID NO: 25265 - RNA, 22 nt, Artificial Sequence
  ELANE RNA Guide
ccgaugcagaccaaggggcugc

SEQ ID NO: 25266 - RNA, 22 nt, Artificial Sequence
  ELANE RNA Guide
ccggcagccccuuggucugcau

SEQ ID NO: 25267 - RNA, 22 nt, Artificial Sequence
  ELANE RNA Guide
ccguggauuagcccgaugcaga

SEQ ID NO: 25268 - RNA, 22 nt, Artificial Sequence
  ELANE RNA Guide
ccuuggucugcaucgggcuaau

SEQ ID NO: 25269 - RNA, 22 nt, Artificial Sequence
  ELANE RNA Guide
cgaugcagaccaaggggcugcc

SEQ ID NO: 25270 - RNA, 22 nt, Artificial Sequence
  ELANE RNA Guide
cggcagccccuuggucugcauc

SEQ ID NO: 25271 - RNA, 22 nt, Artificial Sequence
  ELANE RNA Guide
cguggauuagcccgaugcagac

SEQ ID NO: 25272 - RNA, 22 nt, Artificial Sequence
  ELANE RNA Guide
cuccggcagccccuuggucugc

SEQ ID NO: 25273 - RNA, 22 nt, Artificial Sequence
  ELANE RNA Guide
cugcaucgggcuaauccacgga

SEQ ID NO: 25274 - RNA, 22 nt, Artificial Sequence
  ELANE RNA Guide
cuuggucugcaucgggcuaauc

SEQ ID NO: 25275 - RNA, 22 nt, Artificial Sequence
  ELANE RNA Guide
gaggcaauuccguggauuagcc

SEQ ID NO: 25276 - RNA, 22 nt, Artificial Sequence
  ELANE RNA Guide
gaugcagaccaaggggcugccg

SEQ ID NO: 25277 - RNA, 22 nt, Artificial Sequence
  ELANE RNA Guide
gauuagcccgaugcagaccaag

SEQ ID NO: 25278 - RNA, 22 nt, Artificial Sequence
  ELANE RNA Guide
gcaauuccguggauuagcccga

SEQ ID NO: 25279 - RNA, 22 nt, Artificial Sequence
  ELANE RNA Guide
gcagccccuuggucugcaucgg

SEQ ID NO: 25280 - RNA, 22 nt, Artificial Sequence
  ELANE RNA Guide
gcaucgggcuaauccacggaau

SEQ ID NO: 25281 - RNA, 22 nt, Artificial Sequence
  ELANE RNA Guide
gccccuuggucugcaucgggcu

SEQ ID NO: 25282 - RNA, 22 nt, Artificial Sequence
  ELANE RNA Guide
gcccgaugcagaccaaggggcu

SEQ ID NO: 25283 - RNA, 22 nt, Artificial Sequence
  ELANE RNA Guide
ggaggcaauuccguggauuagc

SEQ ID NO: 25284 - RNA, 22 nt, Artificial Sequence
  ELANE RNA Guide
ggauuagcccgaugcagaccaa

SEQ ID NO: 25285 - RNA, 22 nt, Artificial Sequence
  ELANE RNA Guide
ggcagccccuuggucugcaucg

SEQ ID NO: 25286 - RNA, 22 nt, Artificial Sequence
  ELANE RNA Guide
ggucugcaucgggcuaauccac

SEQ ID NO: 25287 - RNA, 22 nt, Artificial Sequence
  ELANE RNA Guide
gucugcaucgggcuaauccacg

SEQ ID NO: 25288 - RNA, 22 nt, Artificial Sequence
  ELANE RNA Guide
guggauuagcccgaugcagacc

SEQ ID NO: 25289 - RNA, 22 nt, Artificial Sequence
  ELANE RNA Guide
uagcccgaugcagaccaagggg

SEQ ID NO: 25290 - RNA, 22 nt, Artificial Sequence
  ELANE RNA Guide
uccggcagccccuuggucugca

SEQ ID NO: 25291 - RNA, 22 nt, Artificial Sequence
  ELANE RNA Guide
uccguggauuagcccgaugcag

SEQ ID NO: 25292 - RNA, 22 nt, Artificial Sequence
  ELANE RNA Guide
ucugcaucgggcuaauccacgg

SEQ ID NO: 25293 - RNA, 22 nt, Artificial Sequence
  ELANE RNA Guide
ugcaucgggcuaauccacggaa

SEQ ID NO: 25294 - RNA, 22 nt, Artificial Sequence
  ELANE RNA Guide
uggauuagcccgaugcagacca

SEQ ID NO: 25295 - RNA, 22 nt, Artificial Sequence
  ELANE RNA Guide
uggucugcaucgggcuaaucca

SEQ ID NO: 25296 - RNA, 22 nt, Artificial Sequence
  ELANE RNA Guide
uuagcccgaugcagaccaaggg

SEQ ID NO: 25297 - RNA, 22 nt, Artificial Sequence
  ELANE RNA Guide
uuccguggauuagcccgaugca

SEQ ID NO: 25298 - RNA, 22 nt, Artificial Sequence
  ELANE RNA Guide
uuggucugcaucgggcuaaucc

SEQ ID NO: 25299 - RNA, 20 nt, Artificial Sequence
  ELANE RNA Guide
aacaggcuaauccacggaau

SEQ ID NO: 25300 - RNA, 20 nt, Artificial Sequence
  ELANE RNA Guide
aauuccguggauuagccugu

SEQ ID NO: 25301 - RNA, 20 nt, Artificial Sequence
  ELANE RNA Guide
acaggcuaauccacggaauu

SEQ ID NO: 25302 - RNA, 20 nt, Artificial Sequence
  ELANE RNA Guide
agccccuuggucugcaacag

SEQ ID NO: 25303 - RNA, 20 nt, Artificial Sequence
  ELANE RNA Guide
agccuguugcagaccaaggg

SEQ ID NO: 25304 - RNA, 20 nt, Artificial Sequence
  ELANE RNA Guide
auuagccuguugcagaccaa

SEQ ID NO: 25305 - RNA, 20 nt, Artificial Sequence
  ELANE RNA Guide
auuccguggauuagccuguu

SEQ ID NO: 25306 - RNA, 20 nt, Artificial Sequence
  ELANE RNA Guide
caacaggcuaauccacggaa

SEQ ID NO: 25307 - RNA, 20 nt, Artificial Sequence
  ELANE RNA Guide
caauuccguggauuagccug

SEQ ID NO: 25308 - RNA, 20 nt, Artificial Sequence
  ELANE RNA Guide
cagccccuuggucugcaaca

SEQ ID NO: 25309 - RNA, 20 nt, Artificial Sequence
  ELANE RNA Guide
caggcuaauccacggaauug

SEQ ID NO: 25310 - RNA, 20 nt, Artificial Sequence
  ELANE RNA Guide
ccccuuggucugcaacaggc

SEQ ID NO: 25311 - RNA, 20 nt, Artificial Sequence
  ELANE RNA Guide
cccuuggucugcaacaggcu

SEQ ID NO: 25312 - RNA, 20 nt, Artificial Sequence
  ELANE RNA Guide
ccguggauuagccuguugca

SEQ ID NO: 25313 - RNA, 20 nt, Artificial Sequence
  ELANE RNA Guide
ccuguugcagaccaaggggc

SEQ ID NO: 25314 - RNA, 20 nt, Artificial Sequence
  ELANE RNA Guide
ccuuggucugcaacaggcua

SEQ ID NO: 25315 - RNA, 20 nt, Artificial Sequence
  ELANE RNA Guide
cguggauuagccuguugcag

SEQ ID NO: 25316 - RNA, 20 nt, Artificial Sequence
  ELANE RNA Guide
cugcaacaggcuaauccacg

SEQ ID NO: 25317 - RNA, 20 nt, Artificial Sequence
  ELANE RNA Guide
cuguugcagaccaaggggcu

SEQ ID NO: 25318 - RNA, 20 nt, Artificial Sequence
  ELANE RNA Guide
cuuggucugcaacaggcuaa

SEQ ID NO: 25319 - RNA, 20 nt, Artificial Sequence
  ELANE RNA Guide
gaggcaauuccguggauuag

SEQ ID NO: 25320 - RNA, 20 nt, Artificial Sequence
  ELANE RNA Guide
gauuagccuguugcagacca

SEQ ID NO: 25321 - RNA, 20 nt, Artificial Sequence
  ELANE RNA Guide
gcaacaggcuaauccacgga

SEQ ID NO: 25322 - RNA, 20 nt, Artificial Sequence
  ELANE RNA Guide
gcaauuccguggauuagccu

SEQ ID NO: 25323 - RNA, 20 nt, Artificial Sequence
  ELANE RNA Guide
gcagccccuuggucugcaac

SEQ ID NO: 25324 - RNA, 20 nt, Artificial Sequence
  ELANE RNA Guide
gccccuuggucugcaacagg

SEQ ID NO: 25325 - RNA, 20 nt, Artificial Sequence
  ELANE RNA Guide
gccuguugcagaccaagggg

SEQ ID NO: 25326 - RNA, 20 nt, Artificial Sequence
  ELANE RNA Guide
ggaggcaauuccguggauua

SEQ ID NO: 25327 - RNA, 20 nt, Artificial Sequence
  ELANE RNA Guide
ggauuagccuguugcagacc

SEQ ID NO: 25328 - RNA, 20 nt, Artificial Sequence
  ELANE RNA Guide
ggcagccccuuggucugcaa

SEQ ID NO: 25329 - RNA, 20 nt, Artificial Sequence
  ELANE RNA Guide
ggucugcaacaggcuaaucc

SEQ ID NO: 25330 - RNA, 20 nt, Artificial Sequence
  ELANE RNA Guide
gucugcaacaggcuaaucca

SEQ ID NO: 25331 - RNA, 20 nt, Artificial Sequence
  ELANE RNA Guide
guggauuagccuguugcaga

SEQ ID NO: 25332 - RNA, 20 nt, Artificial Sequence
  ELANE RNA Guide
uagccuguugcagaccaagg

SEQ ID NO: 25333 - RNA, 20 nt, Artificial Sequence
  ELANE RNA Guide
uccguggauuagccuguugc

SEQ ID NO: 25334 - RNA, 20 nt, Artificial Sequence
  ELANE RNA Guide
ucugcaacaggcuaauccac

SEQ ID NO: 25335 - RNA, 20 nt, Artificial Sequence
  ELANE RNA Guide
ugcaacaggcuaauccacgg

SEQ ID NO: 25336 - RNA, 20 nt, Artificial Sequence
  ELANE RNA Guide
uggauuagccuguugcagac

SEQ ID NO: 25337 - RNA, 20 nt, Artificial Sequence
  ELANE RNA Guide
uggucugcaacaggcuaauc

SEQ ID NO: 25338 - RNA, 20 nt, Artificial Sequence
  ELANE RNA Guide
uuagccuguugcagaccaag

SEQ ID NO: 25339 - RNA, 20 nt, Artificial Sequence
  ELANE RNA Guide
uuccguggauuagccuguug

SEQ ID NO: 25340 - RNA, 20 nt, Artificial Sequence
  ELANE RNA Guide
uuggucugcaacaggcuaau

SEQ ID NO: 25341 - RNA, 21 nt, Artificial Sequence
  ELANE RNA Guide
aacaggcuaauccacggaauu

SEQ ID NO: 25342 - RNA, 21 nt, Artificial Sequence
  ELANE RNA Guide
aauuccguggauuagccuguu

SEQ ID NO: 25343 - RNA, 21 nt, Artificial Sequence
  ELANE RNA Guide
acaggcuaauccacggaauug

SEQ ID NO: 25344 - RNA, 21 nt, Artificial Sequence
  ELANE RNA Guide
agccccuuggucugcaacagg

SEQ ID NO: 25345 - RNA, 21 nt, Artificial Sequence
  ELANE RNA Guide
agccuguugcagaccaagggg

SEQ ID NO: 25346 - RNA, 21 nt, Artificial Sequence
  ELANE RNA Guide
aggaggcaauuccguggauua

SEQ ID NO: 25347 - RNA, 21 nt, Artificial Sequence
  ELANE RNA Guide
auuagccuguugcagaccaag

SEQ ID NO: 25348 - RNA, 21 nt, Artificial Sequence
  ELANE RNA Guide
auuccguggauuagccuguug

SEQ ID NO: 25349 - RNA, 21 nt, Artificial Sequence
  ELANE RNA Guide
caacaggcuaauccacggaau

SEQ ID NO: 25350 - RNA, 21 nt, Artificial Sequence
  ELANE RNA Guide
caauuccguggauuagccugu

SEQ ID NO: 25351 - RNA, 21 nt, Artificial Sequence
  ELANE RNA Guide
cagccccuuggucugcaacag

SEQ ID NO: 25352 - RNA, 21 nt, Artificial Sequence
  ELANE RNA Guide
caggcuaauccacggaauugc

SEQ ID NO: 25353 - RNA, 21 nt, Artificial Sequence
  ELANE RNA Guide
ccccuuggucugcaacaggcu

SEQ ID NO: 25354 - RNA, 21 nt, Artificial Sequence
  ELANE RNA Guide
cccuuggucugcaacaggcua

SEQ ID NO: 25355 - RNA, 21 nt, Artificial Sequence
  ELANE RNA Guide
ccguggauuagccuguugcag

SEQ ID NO: 25356 - RNA, 21 nt, Artificial Sequence
  ELANE RNA Guide
ccuguugcagaccaaggggcu

SEQ ID NO: 25357 - RNA, 21 nt, Artificial Sequence
  ELANE RNA Guide
ccuuggucugcaacaggcuaa

SEQ ID NO: 25358 - RNA, 21 nt, Artificial Sequence
  ELANE RNA Guide
cggcagccccuuggucugcaa

SEQ ID NO: 25359 - RNA, 21 nt, Artificial Sequence
  ELANE RNA Guide
cguggauuagccuguugcaga

SEQ ID NO: 25360 - RNA, 21 nt, Artificial Sequence
  ELANE RNA Guide
cugcaacaggcuaauccacgg

SEQ ID NO: 25361 - RNA, 21 nt, Artificial Sequence
  ELANE RNA Guide
cuguugcagaccaaggggcug

SEQ ID NO: 25362 - RNA, 21 nt, Artificial Sequence
  ELANE RNA Guide
cuuggucugcaacaggcuaau

SEQ ID NO: 25363 - RNA, 21 nt, Artificial Sequence
  ELANE RNA Guide
gauuagccuguugcagaccaa

SEQ ID NO: 25364 - RNA, 21 nt, Artificial Sequence
  ELANE RNA Guide
gcaacaggcuaauccacggaa

SEQ ID NO: 25365 - RNA, 21 nt, Artificial Sequence
  ELANE RNA Guide
gcaauuccguggauuagccug

SEQ ID NO: 25366 - RNA, 21 nt, Artificial Sequence
  ELANE RNA Guide
gcagccccuuggucugcaaca

SEQ ID NO: 25367 - RNA, 21 nt, Artificial Sequence
  ELANE RNA Guide
gccccuuggucugcaacaggc

SEQ ID NO: 25368 - RNA, 21 nt, Artificial Sequence
  ELANE RNA Guide
gccuguugcagaccaaggggc

SEQ ID NO: 25369 - RNA, 21 nt, Artificial Sequence
  ELANE RNA Guide
ggaggcaauuccguggauuag

SEQ ID NO: 25370 - RNA, 21 nt, Artificial Sequence
  ELANE RNA Guide
ggauuagccuguugcagacca

SEQ ID NO: 25371 - RNA, 21 nt, Artificial Sequence
  ELANE RNA Guide
ggcaauuccguggauuagccu

SEQ ID NO: 25372 - RNA, 21 nt, Artificial Sequence
  ELANE RNA Guide
ggcagccccuuggucugcaac

SEQ ID NO: 25373 - RNA, 21 nt, Artificial Sequence
  ELANE RNA Guide
ggucugcaacaggcuaaucca

SEQ ID NO: 25374 - RNA, 21 nt, Artificial Sequence
  ELANE RNA Guide
gucugcaacaggcuaauccac

SEQ ID NO: 25375 - RNA, 21 nt, Artificial Sequence
  ELANE RNA Guide
guggauuagccuguugcagac

SEQ ID NO: 25376 - RNA, 21 nt, Artificial Sequence
  ELANE RNA Guide
uagccuguugcagaccaaggg

SEQ ID NO: 25377 - RNA, 21 nt, Artificial Sequence
  ELANE RNA Guide
uccguggauuagccuguugca

SEQ ID NO: 25378 - RNA, 21 nt, Artificial Sequence
  ELANE RNA Guide
ucugcaacaggcuaauccacg

SEQ ID NO: 25379 - RNA, 21 nt, Artificial Sequence
  ELANE RNA Guide
ugcaacaggcuaauccacgga

SEQ ID NO: 25380 - RNA, 21 nt, Artificial Sequence
  ELANE RNA Guide
uggauuagccuguugcagacc

SEQ ID NO: 25381 - RNA, 21 nt, Artificial Sequence
  ELANE RNA Guide
uggucugcaacaggcuaaucc

SEQ ID NO: 25382 - RNA, 21 nt, Artificial Sequence
  ELANE RNA Guide
uuagccuguugcagaccaagg

SEQ ID NO: 25383 - RNA, 21 nt, Artificial Sequence
  ELANE RNA Guide
uuccguggauuagccuguugc

SEQ ID NO: 25384 - RNA, 21 nt, Artificial Sequence
  ELANE RNA Guide
uuggucugcaacaggcuaauc

SEQ ID NO: 25385 - RNA, 22 nt, Artificial Sequence
  ELANE RNA Guide
aacaggcuaauccacggaauug

SEQ ID NO: 25386 - RNA, 22 nt, Artificial Sequence
  ELANE RNA Guide
aaggaggcaauuccguggauua

SEQ ID NO: 25387 - RNA, 22 nt, Artificial Sequence
  ELANE RNA Guide
aauuccguggauuagccuguug

SEQ ID NO: 25388 - RNA, 22 nt, Artificial Sequence
  ELANE RNA Guide
acaggcuaauccacggaauugc

SEQ ID NO: 25389 - RNA, 22 nt, Artificial Sequence
  ELANE RNA Guide
agccccuuggucugcaacaggc

SEQ ID NO: 25390 - RNA, 22 nt, Artificial Sequence
  ELANE RNA Guide
agccuguugcagaccaaggggc

SEQ ID NO: 25391 - RNA, 22 nt, Artificial Sequence
  ELANE RNA Guide
aggaggcaauuccguggauuag

SEQ ID NO: 25392 - RNA, 22 nt, Artificial Sequence
  ELANE RNA Guide
aggcaauuccguggauuagccu

SEQ ID NO: 25393 - RNA, 22 nt, Artificial Sequence
  ELANE RNA Guide
auuagccuguugcagaccaagg

SEQ ID NO: 25394 - RNA, 22 nt, Artificial Sequence
  ELANE RNA Guide
auuccguggauuagccuguugc

SEQ ID NO: 25395 - RNA, 22 nt, Artificial Sequence
  ELANE RNA Guide
caacaggcuaauccacggaauu

SEQ ID NO: 25396 - RNA, 22 nt, Artificial Sequence
  ELANE RNA Guide
caauuccguggauuagccuguu

SEQ ID NO: 25397 - RNA, 22 nt, Artificial Sequence
  ELANE RNA Guide
cagccccuuggucugcaacagg

SEQ ID NO: 25398 - RNA, 22 nt, Artificial Sequence
  ELANE RNA Guide
caggcuaauccacggaauugcc

SEQ ID NO: 25399 - RNA, 22 nt, Artificial Sequence
  ELANE RNA Guide
ccccuuggucugcaacaggcua

SEQ ID NO: 25400 - RNA, 22 nt, Artificial Sequence
  ELANE RNA Guide
cccuuggucugcaacaggcuaa

SEQ ID NO: 25401 - RNA, 22 nt, Artificial Sequence
  ELANE RNA Guide
ccggcagccccuuggucugcaa

SEQ ID NO: 25402 - RNA, 22 nt, Artificial Sequence
  ELANE RNA Guide
ccguggauuagccuguugcaga

SEQ ID NO: 25403 - RNA, 22 nt, Artificial Sequence
  ELANE RNA Guide
ccuguugcagaccaaggggcug

SEQ ID NO: 25404 - RNA, 22 nt, Artificial Sequence
  ELANE RNA Guide
ccuuggucugcaacaggcuaau

SEQ ID NO: 25405 - RNA, 22 nt, Artificial Sequence
  ELANE RNA Guide
cggcagccccuuggucugcaac

SEQ ID NO: 25406 - RNA, 22 nt, Artificial Sequence
  ELANE RNA Guide
cguggauuagccuguugcagac

SEQ ID NO: 25407 - RNA, 22 nt, Artificial Sequence
  ELANE RNA Guide
cugcaacaggcuaauccacgga

SEQ ID NO: 25408 - RNA, 22 nt, Artificial Sequence
  ELANE RNA Guide
cuguugcagaccaaggggcugc

SEQ ID NO: 25409 - RNA, 22 nt, Artificial Sequence
  ELANE RNA Guide
cuuggucugcaacaggcuaauc

SEQ ID NO: 25410 - RNA, 22 nt, Artificial Sequence
  ELANE RNA Guide
gauuagccuguugcagaccaag

SEQ ID NO: 25411 - RNA, 22 nt, Artificial Sequence
  ELANE RNA Guide
gcaacaggcuaauccacggaau

SEQ ID NO: 25412 - RNA, 22 nt, Artificial Sequence
  ELANE RNA Guide
gcaauuccguggauuagccugu

SEQ ID NO: 25413 - RNA, 22 nt, Artificial Sequence
  ELANE RNA Guide
gcagccccuuggucugcaacag

SEQ ID NO: 25414 - RNA, 22 nt, Artificial Sequence
  ELANE RNA Guide
gccccuuggucugcaacaggcu

SEQ ID NO: 25415 - RNA, 22 nt, Artificial Sequence
  ELANE RNA Guide
gccuguugcagaccaaggggcu

SEQ ID NO: 25416 - RNA, 22 nt, Artificial Sequence
  ELANE RNA Guide
ggauuagccuguugcagaccaa

SEQ ID NO: 25417 - RNA, 22 nt, Artificial Sequence
  ELANE RNA Guide
ggcaauuccguggauuagccug

SEQ ID NO: 25418 - RNA, 22 nt, Artificial Sequence
  ELANE RNA Guide
ggcagccccuuggucugcaaca

SEQ ID NO: 25419 - RNA, 22 nt, Artificial Sequence
  ELANE RNA Guide
ggucugcaacaggcuaauccac

SEQ ID NO: 25420 - RNA, 22 nt, Artificial Sequence
  ELANE RNA Guide
gucugcaacaggcuaauccacg

SEQ ID NO: 25421 - RNA, 22 nt, Artificial Sequence
  ELANE RNA Guide
guggauuagccuguugcagacc

SEQ ID NO: 25422 - RNA, 22 nt, Artificial Sequence
  ELANE RNA Guide
uagccuguugcagaccaagggg

SEQ ID NO: 25423 - RNA, 22 nt, Artificial Sequence
  ELANE RNA Guide
uccguggauuagccuguugcag

SEQ ID NO: 25424 - RNA, 22 nt, Artificial Sequence
  ELANE RNA Guide
ucugcaacaggcuaauccacgg

SEQ ID NO: 25425 - RNA, 22 nt, Artificial Sequence
  ELANE RNA Guide
ugcaacaggcuaauccacggaa

SEQ ID NO: 25426 - RNA, 22 nt, Artificial Sequence
  ELANE RNA Guide
uggauuagccuguugcagacca

SEQ ID NO: 25427 - RNA, 22 nt, Artificial Sequence
  ELANE RNA Guide
uggucugcaacaggcuaaucca

SEQ ID NO: 25428 - RNA, 22 nt, Artificial Sequence
  ELANE RNA Guide
uuagccuguugcagaccaaggg

SEQ ID NO: 25429 - RNA, 22 nt, Artificial Sequence
  ELANE RNA Guide
uuccguggauuagccuguugca

SEQ ID NO: 25430 - RNA, 22 nt, Artificial Sequence
  ELANE RNA Guide
uuggucugcaacaggcuaaucc

SEQ ID NO: 25431 - RNA, 20 nt, Artificial Sequence
  ELANE RNA Guide
aacuggcuaauccacggaau

SEQ ID NO: 25432 - RNA, 20 nt, Artificial Sequence
  ELANE RNA Guide
aauuccguggauuagccagu

SEQ ID NO: 25433 - RNA, 20 nt, Artificial Sequence
  ELANE RNA Guide
acuggcuaauccacggaauu

SEQ ID NO: 25434 - RNA, 20 nt, Artificial Sequence
  ELANE RNA Guide
agccaguugcagaccaaggg

SEQ ID NO: 25435 - RNA, 20 nt, Artificial Sequence
  ELANE RNA Guide
agccccuuggucugcaacug

SEQ ID NO: 25436 - RNA, 20 nt, Artificial Sequence
  ELANE RNA Guide
auuagccaguugcagaccaa

SEQ ID NO: 25437 - RNA, 20 nt, Artificial Sequence
  ELANE RNA Guide
auuccguggauuagccaguu

SEQ ID NO: 25438 - RNA, 20 nt, Artificial Sequence
  ELANE RNA Guide
caacuggcuaauccacggaa

SEQ ID NO: 25439 - RNA, 20 nt, Artificial Sequence
  ELANE RNA Guide
caauuccguggauuagccag

SEQ ID NO: 25440 - RNA, 20 nt, Artificial Sequence
  ELANE RNA Guide
cagccccuuggucugcaacu

SEQ ID NO: 25441 - RNA, 20 nt, Artificial Sequence
  ELANE RNA Guide
caguugcagaccaaggggcu

SEQ ID NO: 25442 - RNA, 20 nt, Artificial Sequence
  ELANE RNA Guide
ccaguugcagaccaaggggc

SEQ ID NO: 25443 - RNA, 20 nt, Artificial Sequence
  ELANE RNA Guide
ccccuuggucugcaacuggc

SEQ ID NO: 25444 - RNA, 20 nt, Artificial Sequence
  ELANE RNA Guide
cccuuggucugcaacuggcu

SEQ ID NO: 25445 - RNA, 20 nt, Artificial Sequence
  ELANE RNA Guide
ccguggauuagccaguugca

SEQ ID NO: 25446 - RNA, 20 nt, Artificial Sequence
  ELANE RNA Guide
ccuuggucugcaacuggcua

SEQ ID NO: 25447 - RNA, 20 nt, Artificial Sequence
  ELANE RNA Guide
cguggauuagccaguugcag

SEQ ID NO: 25448 - RNA, 20 nt, Artificial Sequence
  ELANE RNA Guide
cugcaacuggcuaauccacg

SEQ ID NO: 25449 - RNA, 20 nt, Artificial Sequence
  ELANE RNA Guide
cuggcuaauccacggaauug

SEQ ID NO: 25450 - RNA, 20 nt, Artificial Sequence
  ELANE RNA Guide
cuuggucugcaacuggcuaa

SEQ ID NO: 25451 - RNA, 20 nt, Artificial Sequence
  ELANE RNA Guide
gauuagccaguugcagacca

SEQ ID NO: 25452 - RNA, 20 nt, Artificial Sequence
  ELANE RNA Guide
gcaacuggcuaauccacgga

SEQ ID NO: 25453 - RNA, 20 nt, Artificial Sequence
  ELANE RNA Guide
gcaauuccguggauuagcca

SEQ ID NO: 25454 - RNA, 20 nt, Artificial Sequence
  ELANE RNA Guide
gccaguugcagaccaagggg

SEQ ID NO: 25455 - RNA, 20 nt, Artificial Sequence
  ELANE RNA Guide
gccccuuggucugcaacugg

SEQ ID NO: 25456 - RNA, 20 nt, Artificial Sequence
  ELANE RNA Guide
ggauuagccaguugcagacc

SEQ ID NO: 25457 - RNA, 20 nt, Artificial Sequence
  ELANE RNA Guide
ggucugcaacuggcuaaucc

SEQ ID NO: 25458 - RNA, 20 nt, Artificial Sequence
  ELANE RNA Guide
gucugcaacuggcuaaucca

SEQ ID NO: 25459 - RNA, 20 nt, Artificial Sequence
  ELANE RNA Guide
guggauuagccaguugcaga

SEQ ID NO: 25460 - RNA, 20 nt, Artificial Sequence
  ELANE RNA Guide
uagccaguugcagaccaagg

SEQ ID NO: 25461 - RNA, 20 nt, Artificial Sequence
  ELANE RNA Guide
uccguggauuagccaguugc

SEQ ID NO: 25462 - RNA, 20 nt, Artificial Sequence
  ELANE RNA Guide
ucugcaacuggcuaauccac

SEQ ID NO: 25463 - RNA, 20 nt, Artificial Sequence
  ELANE RNA Guide
ugcaacuggcuaauccacgg

SEQ ID NO: 25464 - RNA, 20 nt, Artificial Sequence
  ELANE RNA Guide
uggauuagccaguugcagac

SEQ ID NO: 25465 - RNA, 20 nt, Artificial Sequence
  ELANE RNA Guide
uggucugcaacuggcuaauc

SEQ ID NO: 25466 - RNA, 20 nt, Artificial Sequence
  ELANE RNA Guide
uuagccaguugcagaccaag

SEQ ID NO: 25467 - RNA, 20 nt, Artificial Sequence
  ELANE RNA Guide
uuccguggauuagccaguug

SEQ ID NO: 25468 - RNA, 20 nt, Artificial Sequence
  ELANE RNA Guide
uuggucugcaacuggcuaau

SEQ ID NO: 25469 - RNA, 21 nt, Artificial Sequence
  ELANE RNA Guide
aacuggcuaauccacggaauu

SEQ ID NO: 25470 - RNA, 21 nt, Artificial Sequence
  ELANE RNA Guide
aauuccguggauuagccaguu

SEQ ID NO: 25471 - RNA, 21 nt, Artificial Sequence
  ELANE RNA Guide
acuggcuaauccacggaauug

SEQ ID NO: 25472 - RNA, 21 nt, Artificial Sequence
  ELANE RNA Guide
agccaguugcagaccaagggg

SEQ ID NO: 25473 - RNA, 21 nt, Artificial Sequence
  ELANE RNA Guide
agccccuuggucugcaacugg

SEQ ID NO: 25474 - RNA, 21 nt, Artificial Sequence
  ELANE RNA Guide
auuagccaguugcagaccaag

SEQ ID NO: 25475 - RNA, 21 nt, Artificial Sequence
  ELANE RNA Guide
auuccguggauuagccaguug

SEQ ID NO: 25476 - RNA, 21 nt, Artificial Sequence
  ELANE RNA Guide
caacuggcuaauccacggaau

SEQ ID NO: 25477 - RNA, 21 nt, Artificial Sequence
  ELANE RNA Guide
caauuccguggauuagccagu

SEQ ID NO: 25478 - RNA, 21 nt, Artificial Sequence
  ELANE RNA Guide
cagccccuuggucugcaacug

SEQ ID NO: 25479 - RNA, 21 nt, Artificial Sequence
  ELANE RNA Guide
caguugcagaccaaggggcug

SEQ ID NO: 25480 - RNA, 21 nt, Artificial Sequence
  ELANE RNA Guide
ccaguugcagaccaaggggcu

SEQ ID NO: 25481 - RNA, 21 nt, Artificial Sequence
  ELANE RNA Guide
ccccuuggucugcaacuggcu

SEQ ID NO: 25482 - RNA, 21 nt, Artificial Sequence
  ELANE RNA Guide
cccuuggucugcaacuggcua

SEQ ID NO: 25483 - RNA, 21 nt, Artificial Sequence
  ELANE RNA Guide
ccguggauuagccaguugcag

SEQ ID NO: 25484 - RNA, 21 nt, Artificial Sequence
  ELANE RNA Guide
ccuuggucugcaacuggcuaa

SEQ ID NO: 25485 - RNA, 21 nt, Artificial Sequence
  ELANE RNA Guide
cguggauuagccaguugcaga

SEQ ID NO: 25486 - RNA, 21 nt, Artificial Sequence
  ELANE RNA Guide
cugcaacuggcuaauccacgg

SEQ ID NO: 25487 - RNA, 21 nt, Artificial Sequence
  ELANE RNA Guide
cuggcuaauccacggaauugc

SEQ ID NO: 25488 - RNA, 21 nt, Artificial Sequence
  ELANE RNA Guide
cuuggucugcaacuggcuaau

SEQ ID NO: 25489 - RNA, 21 nt, Artificial Sequence
  ELANE RNA Guide
gauuagccaguugcagaccaa

SEQ ID NO: 25490 - RNA, 21 nt, Artificial Sequence
  ELANE RNA Guide
gcaacuggcuaauccacggaa

SEQ ID NO: 25491 - RNA, 21 nt, Artificial Sequence
  ELANE RNA Guide
gcaauuccguggauuagccag

SEQ ID NO: 25492 - RNA, 21 nt, Artificial Sequence
  ELANE RNA Guide
gcagccccuuggucugcaacu

SEQ ID NO: 25493 - RNA, 21 nt, Artificial Sequence
  ELANE RNA Guide
gccaguugcagaccaaggggc

SEQ ID NO: 25494 - RNA, 21 nt, Artificial Sequence
  ELANE RNA Guide
gccccuuggucugcaacuggc

SEQ ID NO: 25495 - RNA, 21 nt, Artificial Sequence
  ELANE RNA Guide
ggauuagccaguugcagacca

SEQ ID NO: 25496 - RNA, 21 nt, Artificial Sequence
  ELANE RNA Guide
ggcaauuccguggauuagcca

SEQ ID NO: 25497 - RNA, 21 nt, Artificial Sequence
  ELANE RNA Guide
ggucugcaacuggcuaaucca

SEQ ID NO: 25498 - RNA, 21 nt, Artificial Sequence
  ELANE RNA Guide
gucugcaacuggcuaauccac

SEQ ID NO: 25499 - RNA, 21 nt, Artificial Sequence
  ELANE RNA Guide
guggauuagccaguugcagac

SEQ ID NO: 25500 - RNA, 21 nt, Artificial Sequence
  ELANE RNA Guide
uagccaguugcagaccaaggg

SEQ ID NO: 25501 - RNA, 21 nt, Artificial Sequence
  ELANE RNA Guide
uccguggauuagccaguugca

SEQ ID NO: 25502 - RNA, 21 nt, Artificial Sequence
  ELANE RNA Guide
ucugcaacuggcuaauccacg

SEQ ID NO: 25503 - RNA, 21 nt, Artificial Sequence
  ELANE RNA Guide
ugcaacuggcuaauccacgga

SEQ ID NO: 25504 - RNA, 21 nt, Artificial Sequence
  ELANE RNA Guide
uggauuagccaguugcagacc

SEQ ID NO: 25505 - RNA, 21 nt, Artificial Sequence
  ELANE RNA Guide
uggucugcaacuggcuaaucc

SEQ ID NO: 25506 - RNA, 21 nt, Artificial Sequence
  ELANE RNA Guide
uuagccaguugcagaccaagg

SEQ ID NO: 25507 - RNA, 21 nt, Artificial Sequence
  ELANE RNA Guide
uuccguggauuagccaguugc

SEQ ID NO: 25508 - RNA, 21 nt, Artificial Sequence
  ELANE RNA Guide
uuggucugcaacuggcuaauc

SEQ ID NO: 25509 - RNA, 22 nt, Artificial Sequence
  ELANE RNA Guide
aacuggcuaauccacggaauug

SEQ ID NO: 25510 - RNA, 22 nt, Artificial Sequence
  ELANE RNA Guide
aauuccguggauuagccaguug

SEQ ID NO: 25511 - RNA, 22 nt, Artificial Sequence
  ELANE RNA Guide
acuggcuaauccacggaauugc

SEQ ID NO: 25512 - RNA, 22 nt, Artificial Sequence
  ELANE RNA Guide
agccaguugcagaccaaggggc

SEQ ID NO: 25513 - RNA, 22 nt, Artificial Sequence
  ELANE RNA Guide
agccccuuggucugcaacuggc

SEQ ID NO: 25514 - RNA, 22 nt, Artificial Sequence
  ELANE RNA Guide
aggcaauuccguggauuagcca

SEQ ID NO: 25515 - RNA, 22 nt, Artificial Sequence
  ELANE RNA Guide
auuagccaguugcagaccaagg

SEQ ID NO: 25516 - RNA, 22 nt, Artificial Sequence
  ELANE RNA Guide
auuccguggauuagccaguugc

SEQ ID NO: 25517 - RNA, 22 nt, Artificial Sequence
  ELANE RNA Guide
caacuggcuaauccacggaauu

SEQ ID NO: 25518 - RNA, 22 nt, Artificial Sequence
  ELANE RNA Guide
caauuccguggauuagccaguu

SEQ ID NO: 25519 - RNA, 22 nt, Artificial Sequence
  ELANE RNA Guide
cagccccuuggucugcaacugg

SEQ ID NO: 25520 - RNA, 22 nt, Artificial Sequence
  ELANE RNA Guide
caguugcagaccaaggggcugc

SEQ ID NO: 25521 - RNA, 22 nt, Artificial Sequence
  ELANE RNA Guide
ccaguugcagaccaaggggcug

SEQ ID NO: 25522 - RNA, 22 nt, Artificial Sequence
  ELANE RNA Guide
ccccuuggucugcaacuggcua

SEQ ID NO: 25523 - RNA, 22 nt, Artificial Sequence
  ELANE RNA Guide
cccuuggucugcaacuggcuaa

SEQ ID NO: 25524 - RNA, 22 nt, Artificial Sequence
  ELANE RNA Guide
ccguggauuagccaguugcaga

SEQ ID NO: 25525 - RNA, 22 nt, Artificial Sequence
  ELANE RNA Guide
ccuuggucugcaacuggcuaau

SEQ ID NO: 25526 - RNA, 22 nt, Artificial Sequence
  ELANE RNA Guide
cguggauuagccaguugcagac

SEQ ID NO: 25527 - RNA, 22 nt, Artificial Sequence
  ELANE RNA Guide
cugcaacuggcuaauccacgga

SEQ ID NO: 25528 - RNA, 22 nt, Artificial Sequence
  ELANE RNA Guide
cuggcuaauccacggaauugcc

SEQ ID NO: 25529 - RNA, 22 nt, Artificial Sequence
  ELANE RNA Guide
cuuggucugcaacuggcuaauc

SEQ ID NO: 25530 - RNA, 22 nt, Artificial Sequence
  ELANE RNA Guide
gauuagccaguugcagaccaag

SEQ ID NO: 25531 - RNA, 22 nt, Artificial Sequence
  ELANE RNA Guide
gcaacuggcuaauccacggaau

SEQ ID NO: 25532 - RNA, 22 nt, Artificial Sequence
  ELANE RNA Guide
gcaauuccguggauuagccagu

SEQ ID NO: 25533 - RNA, 22 nt, Artificial Sequence
  ELANE RNA Guide
gcagccccuuggucugcaacug

SEQ ID NO: 25534 - RNA, 22 nt, Artificial Sequence
  ELANE RNA Guide
gccaguugcagaccaaggggcu

SEQ ID NO: 25535 - RNA, 22 nt, Artificial Sequence
  ELANE RNA Guide
gccccuuggucugcaacuggcu

SEQ ID NO: 25536 - RNA, 22 nt, Artificial Sequence
  ELANE RNA Guide
ggauuagccaguugcagaccaa

SEQ ID NO: 25537 - RNA, 22 nt, Artificial Sequence
  ELANE RNA Guide
ggcaauuccguggauuagccag

SEQ ID NO: 25538 - RNA, 22 nt, Artificial Sequence
  ELANE RNA Guide
ggcagccccuuggucugcaacu

SEQ ID NO: 25539 - RNA, 22 nt, Artificial Sequence
  ELANE RNA Guide
ggucugcaacuggcuaauccac

SEQ ID NO: 25540 - RNA, 22 nt, Artificial Sequence
  ELANE RNA Guide
gucugcaacuggcuaauccacg

SEQ ID NO: 25541 - RNA, 22 nt, Artificial Sequence
  ELANE RNA Guide
guggauuagccaguugcagacc

SEQ ID NO: 25542 - RNA, 22 nt, Artificial Sequence
  ELANE RNA Guide
uagccaguugcagaccaagggg

SEQ ID NO: 25543 - RNA, 22 nt, Artificial Sequence
  ELANE RNA Guide
uccguggauuagccaguugcag

SEQ ID NO: 25544 - RNA, 22 nt, Artificial Sequence
  ELANE RNA Guide
ucugcaacuggcuaauccacgg

SEQ ID NO: 25545 - RNA, 22 nt, Artificial Sequence
  ELANE RNA Guide
ugcaacuggcuaauccacggaa

SEQ ID NO: 25546 - RNA, 22 nt, Artificial Sequence
  ELANE RNA Guide
uggauuagccaguugcagacca

SEQ ID NO: 25547 - RNA, 22 nt, Artificial Sequence
  ELANE RNA Guide
uggucugcaacuggcuaaucca

SEQ ID NO: 25548 - RNA, 22 nt, Artificial Sequence
  ELANE RNA Guide
uuagccaguugcagaccaaggg

SEQ ID NO: 25549 - RNA, 22 nt, Artificial Sequence
  ELANE RNA Guide
uuccguggauuagccaguugca

SEQ ID NO: 25550 - RNA, 22 nt, Artificial Sequence
  ELANE RNA Guide
uuggucugcaacuggcuaaucc

SEQ ID NO: 25551 - RNA, 20 nt, Artificial Sequence
  ELANE RNA Guide
aacgugcuaauccacggaau

SEQ ID NO: 25552 - RNA, 20 nt, Artificial Sequence
  ELANE RNA Guide
aauuccguggauuagcacgu

SEQ ID NO: 25553 - RNA, 20 nt, Artificial Sequence
  ELANE RNA Guide
acgugcuaauccacggaauu

SEQ ID NO: 25554 - RNA, 20 nt, Artificial Sequence
  ELANE RNA Guide
agcacguugcagaccaaggg

SEQ ID NO: 25555 - RNA, 20 nt, Artificial Sequence
  ELANE RNA Guide
agccccuuggucugcaacgu

SEQ ID NO: 25556 - RNA, 20 nt, Artificial Sequence
  ELANE RNA Guide
aggaggcaauuccguggauu

SEQ ID NO: 25557 - RNA, 20 nt, Artificial Sequence
  ELANE RNA Guide
auuagcacguugcagaccaa

SEQ ID NO: 25558 - RNA, 20 nt, Artificial Sequence
  ELANE RNA Guide
auuccguggauuagcacguu

SEQ ID NO: 25559 - RNA, 20 nt, Artificial Sequence
  ELANE RNA Guide
caacgugcuaauccacggaa

SEQ ID NO: 25560 - RNA, 20 nt, Artificial Sequence
  ELANE RNA Guide
caauuccguggauuagcacg

SEQ ID NO: 25561 - RNA, 20 nt, Artificial Sequence
  ELANE RNA Guide
cacguugcagaccaaggggc

SEQ ID NO: 25562 - RNA, 20 nt, Artificial Sequence
  ELANE RNA Guide
cagccccuuggucugcaacg

SEQ ID NO: 25563 - RNA, 20 nt, Artificial Sequence
  ELANE RNA Guide
ccccuuggucugcaacgugc

SEQ ID NO: 25564 - RNA, 20 nt, Artificial Sequence
  ELANE RNA Guide
cccuuggucugcaacgugcu

SEQ ID NO: 25565 - RNA, 20 nt, Artificial Sequence
  ELANE RNA Guide
ccguggauuagcacguugca

SEQ ID NO: 25566 - RNA, 20 nt, Artificial Sequence
  ELANE RNA Guide
ccuuggucugcaacgugcua

SEQ ID NO: 25567 - RNA, 20 nt, Artificial Sequence
  ELANE RNA Guide
cgugcuaauccacggaauug

SEQ ID NO: 25568 - RNA, 20 nt, Artificial Sequence
  ELANE RNA Guide
cguggauuagcacguugcag

SEQ ID NO: 25569 - RNA, 20 nt, Artificial Sequence
  ELANE RNA Guide
cugcaacgugcuaauccacg

SEQ ID NO: 25570 - RNA, 20 nt, Artificial Sequence
  ELANE RNA Guide
cuuggucugcaacgugcuaa

SEQ ID NO: 25571 - RNA, 20 nt, Artificial Sequence
  ELANE RNA Guide
gauuagcacguugcagacca

SEQ ID NO: 25572 - RNA, 20 nt, Artificial Sequence
  ELANE RNA Guide
gcaacgugcuaauccacgga

SEQ ID NO: 25573 - RNA, 20 nt, Artificial Sequence
  ELANE RNA Guide
gcaauuccguggauuagcac

SEQ ID NO: 25574 - RNA, 20 nt, Artificial Sequence
  ELANE RNA Guide
gcacguugcagaccaagggg

SEQ ID NO: 25575 - RNA, 20 nt, Artificial Sequence
  ELANE RNA Guide
gccccuuggucugcaacgug

SEQ ID NO: 25576 - RNA, 20 nt, Artificial Sequence
  ELANE RNA Guide
ggauuagcacguugcagacc

SEQ ID NO: 25577 - RNA, 20 nt, Artificial Sequence
  ELANE RNA Guide
ggcaauuccguggauuagca

SEQ ID NO: 25578 - RNA, 20 nt, Artificial Sequence
  ELANE RNA Guide
ggucugcaacgugcuaaucc

SEQ ID NO: 25579 - RNA, 20 nt, Artificial Sequence
  ELANE RNA Guide
gucugcaacgugcuaaucca

SEQ ID NO: 25580 - RNA, 20 nt, Artificial Sequence
  ELANE RNA Guide
gugcuaauccacggaauugc

SEQ ID NO: 25581 - RNA, 20 nt, Artificial Sequence
  ELANE RNA Guide
guggauuagcacguugcaga

SEQ ID NO: 25582 - RNA, 20 nt, Artificial Sequence
  ELANE RNA Guide
uagcacguugcagaccaagg

SEQ ID NO: 25583 - RNA, 20 nt, Artificial Sequence
  ELANE RNA Guide
uccguggauuagcacguugc

SEQ ID NO: 25584 - RNA, 20 nt, Artificial Sequence
  ELANE RNA Guide
ucugcaacgugcuaauccac

SEQ ID NO: 25585 - RNA, 20 nt, Artificial Sequence
  ELANE RNA Guide
ugcaacgugcuaauccacgg

SEQ ID NO: 25586 - RNA, 20 nt, Artificial Sequence
  ELANE RNA Guide
uggauuagcacguugcagac

SEQ ID NO: 25587 - RNA, 20 nt, Artificial Sequence
  ELANE RNA Guide
uggucugcaacgugcuaauc

SEQ ID NO: 25588 - RNA, 20 nt, Artificial Sequence
  ELANE RNA Guide
uuagcacguugcagaccaag

SEQ ID NO: 25589 - RNA, 20 nt, Artificial Sequence
  ELANE RNA Guide
uuccguggauuagcacguug

SEQ ID NO: 25590 - RNA, 20 nt, Artificial Sequence
  ELANE RNA Guide
uuggucugcaacgugcuaau

SEQ ID NO: 25591 - RNA, 21 nt, Artificial Sequence
  ELANE RNA Guide
aacgugcuaauccacggaauu

SEQ ID NO: 25592 - RNA, 21 nt, Artificial Sequence
  ELANE RNA Guide
aaggaggcaauuccguggauu

SEQ ID NO: 25593 - RNA, 21 nt, Artificial Sequence
  ELANE RNA Guide
aauuccguggauuagcacguu

SEQ ID NO: 25594 - RNA, 21 nt, Artificial Sequence
  ELANE RNA Guide
acgugcuaauccacggaauug

SEQ ID NO: 25595 - RNA, 21 nt, Artificial Sequence
  ELANE RNA Guide
agcacguugcagaccaagggg

SEQ ID NO: 25596 - RNA, 21 nt, Artificial Sequence
  ELANE RNA Guide
agccccuuggucugcaacgug

SEQ ID NO: 25597 - RNA, 21 nt, Artificial Sequence
  ELANE RNA Guide
aggcaauuccguggauuagca

SEQ ID NO: 25598 - RNA, 21 nt, Artificial Sequence
  ELANE RNA Guide
auuagcacguugcagaccaag

SEQ ID NO: 25599 - RNA, 21 nt, Artificial Sequence
  ELANE RNA Guide
auuccguggauuagcacguug

SEQ ID NO: 25600 - RNA, 21 nt, Artificial Sequence
  ELANE RNA Guide
caacgugcuaauccacggaau

SEQ ID NO: 25601 - RNA, 21 nt, Artificial Sequence
  ELANE RNA Guide
caauuccguggauuagcacgu

SEQ ID NO: 25602 - RNA, 21 nt, Artificial Sequence
  ELANE RNA Guide
cacguugcagaccaaggggcu

SEQ ID NO: 25603 - RNA, 21 nt, Artificial Sequence
  ELANE RNA Guide
cagccccuuggucugcaacgu

SEQ ID NO: 25604 - RNA, 21 nt, Artificial Sequence
  ELANE RNA Guide
ccccuuggucugcaacgugcu

SEQ ID NO: 25605 - RNA, 21 nt, Artificial Sequence
  ELANE RNA Guide
cccuuggucugcaacgugcua

SEQ ID NO: 25606 - RNA, 21 nt, Artificial Sequence
  ELANE RNA Guide
ccguggauuagcacguugcag

SEQ ID NO: 25607 - RNA, 21 nt, Artificial Sequence
  ELANE RNA Guide
ccuuggucugcaacgugcuaa

SEQ ID NO: 25608 - RNA, 21 nt, Artificial Sequence
  ELANE RNA Guide
cgugcuaauccacggaauugc

SEQ ID NO: 25609 - RNA, 21 nt, Artificial Sequence
  ELANE RNA Guide
cguggauuagcacguugcaga

SEQ ID NO: 25610 - RNA, 21 nt, Artificial Sequence
  ELANE RNA Guide
cugcaacgugcuaauccacgg

SEQ ID NO: 25611 - RNA, 21 nt, Artificial Sequence
  ELANE RNA Guide
cuuggucugcaacgugcuaau

SEQ ID NO: 25612 - RNA, 21 nt, Artificial Sequence
  ELANE RNA Guide
gauuagcacguugcagaccaa

SEQ ID NO: 25613 - RNA, 21 nt, Artificial Sequence
  ELANE RNA Guide
gcaacgugcuaauccacggaa

SEQ ID NO: 25614 - RNA, 21 nt, Artificial Sequence
  ELANE RNA Guide
gcaauuccguggauuagcacg

SEQ ID NO: 25615 - RNA, 21 nt, Artificial Sequence
  ELANE RNA Guide
gcacguugcagaccaaggggc

SEQ ID NO: 25616 - RNA, 21 nt, Artificial Sequence
  ELANE RNA Guide
gcagccccuuggucugcaacg

SEQ ID NO: 25617 - RNA, 21 nt, Artificial Sequence
  ELANE RNA Guide
gccccuuggucugcaacgugc

SEQ ID NO: 25618 - RNA, 21 nt, Artificial Sequence
  ELANE RNA Guide
ggauuagcacguugcagacca

SEQ ID NO: 25619 - RNA, 21 nt, Artificial Sequence
  ELANE RNA Guide
ggcaauuccguggauuagcac

SEQ ID NO: 25620 - RNA, 21 nt, Artificial Sequence
  ELANE RNA Guide
ggucugcaacgugcuaaucca

SEQ ID NO: 25621 - RNA, 21 nt, Artificial Sequence
  ELANE RNA Guide
gucugcaacgugcuaauccac

SEQ ID NO: 25622 - RNA, 21 nt, Artificial Sequence
  ELANE RNA Guide
gugcuaauccacggaauugcc

SEQ ID NO: 25623 - RNA, 21 nt, Artificial Sequence
  ELANE RNA Guide
guggauuagcacguugcagac

SEQ ID NO: 25624 - RNA, 21 nt, Artificial Sequence
  ELANE RNA Guide
uagcacguugcagaccaaggg

SEQ ID NO: 25625 - RNA, 21 nt, Artificial Sequence
  ELANE RNA Guide
uccguggauuagcacguugca

SEQ ID NO: 25626 - RNA, 21 nt, Artificial Sequence
  ELANE RNA Guide
ucugcaacgugcuaauccacg

SEQ ID NO: 25627 - RNA, 21 nt, Artificial Sequence
  ELANE RNA Guide
ugcaacgugcuaauccacgga

SEQ ID NO: 25628 - RNA, 21 nt, Artificial Sequence
  ELANE RNA Guide
uggauuagcacguugcagacc

SEQ ID NO: 25629 - RNA, 21 nt, Artificial Sequence
  ELANE RNA Guide
uggucugcaacgugcuaaucc

SEQ ID NO: 25630 - RNA, 21 nt, Artificial Sequence
  ELANE RNA Guide
uuagcacguugcagaccaagg

SEQ ID NO: 25631 - RNA, 21 nt, Artificial Sequence
  ELANE RNA Guide
uuccguggauuagcacguugc

SEQ ID NO: 25632 - RNA, 21 nt, Artificial Sequence
  ELANE RNA Guide
uuggucugcaacgugcuaauc

SEQ ID NO: 25633 - RNA, 22 nt, Artificial Sequence
  ELANE RNA Guide
aacgugcuaauccacggaauug

SEQ ID NO: 25634 - RNA, 22 nt, Artificial Sequence
  ELANE RNA Guide
aauuccguggauuagcacguug

SEQ ID NO: 25635 - RNA, 22 nt, Artificial Sequence
  ELANE RNA Guide
acgugcuaauccacggaauugc

SEQ ID NO: 25636 - RNA, 22 nt, Artificial Sequence
  ELANE RNA Guide
agcacguugcagaccaaggggc

SEQ ID NO: 25637 - RNA, 22 nt, Artificial Sequence
  ELANE RNA Guide
agccccuuggucugcaacgugc

SEQ ID NO: 25638 - RNA, 22 nt, Artificial Sequence
  ELANE RNA Guide
aggcaauuccguggauuagcac

SEQ ID NO: 25639 - RNA, 22 nt, Artificial Sequence
  ELANE RNA Guide
auuagcacguugcagaccaagg

SEQ ID NO: 25640 - RNA, 22 nt, Artificial Sequence
  ELANE RNA Guide
auuccguggauuagcacguugc

SEQ ID NO: 25641 - RNA, 22 nt, Artificial Sequence
  ELANE RNA Guide
caacgugcuaauccacggaauu

SEQ ID NO: 25642 - RNA, 22 nt, Artificial Sequence
  ELANE RNA Guide
caauuccguggauuagcacguu

SEQ ID NO: 25643 - RNA, 22 nt, Artificial Sequence
  ELANE RNA Guide
cacguugcagaccaaggggcug

SEQ ID NO: 25644 - RNA, 22 nt, Artificial Sequence
  ELANE RNA Guide
cagccccuuggucugcaacgug

SEQ ID NO: 25645 - RNA, 22 nt, Artificial Sequence
  ELANE RNA Guide
ccccuuggucugcaacgugcua

SEQ ID NO: 25646 - RNA, 22 nt, Artificial Sequence
  ELANE RNA Guide
cccuuggucugcaacgugcuaa

SEQ ID NO: 25647 - RNA, 22 nt, Artificial Sequence
  ELANE RNA Guide
ccguggauuagcacguugcaga

SEQ ID NO: 25648 - RNA, 22 nt, Artificial Sequence
  ELANE RNA Guide
ccuuggucugcaacgugcuaau

SEQ ID NO: 25649 - RNA, 22 nt, Artificial Sequence
  ELANE RNA Guide
cgugcuaauccacggaauugcc

SEQ ID NO: 25650 - RNA, 22 nt, Artificial Sequence
  ELANE RNA Guide
cguggauuagcacguugcagac

SEQ ID NO: 25651 - RNA, 22 nt, Artificial Sequence
  ELANE RNA Guide
cugcaacgugcuaauccacgga

SEQ ID NO: 25652 - RNA, 22 nt, Artificial Sequence
  ELANE RNA Guide
cuuggucugcaacgugcuaauc

SEQ ID NO: 25653 - RNA, 22 nt, Artificial Sequence
  ELANE RNA Guide
gaaggaggcaauuccguggauu

SEQ ID NO: 25654 - RNA, 22 nt, Artificial Sequence
  ELANE RNA Guide
gaggcaauuccguggauuagca

SEQ ID NO: 25655 - RNA, 22 nt, Artificial Sequence
  ELANE RNA Guide
gauuagcacguugcagaccaag

SEQ ID NO: 25656 - RNA, 22 nt, Artificial Sequence
  ELANE RNA Guide
gcaacgugcuaauccacggaau

SEQ ID NO: 25657 - RNA, 22 nt, Artificial Sequence
  ELANE RNA Guide
gcaauuccguggauuagcacgu

SEQ ID NO: 25658 - RNA, 22 nt, Artificial Sequence
  ELANE RNA Guide
gcacguugcagaccaaggggcu

SEQ ID NO: 25659 - RNA, 22 nt, Artificial Sequence
  ELANE RNA Guide
gcagccccuuggucugcaacgu

SEQ ID NO: 25660 - RNA, 22 nt, Artificial Sequence
  ELANE RNA Guide
gccccuuggucugcaacgugcu

SEQ ID NO: 25661 - RNA, 22 nt, Artificial Sequence
  ELANE RNA Guide
ggauuagcacguugcagaccaa

SEQ ID NO: 25662 - RNA, 22 nt, Artificial Sequence
  ELANE RNA Guide
ggcaauuccguggauuagcacg

SEQ ID NO: 25663 - RNA, 22 nt, Artificial Sequence
  ELANE RNA Guide
ggcagccccuuggucugcaacg

SEQ ID NO: 25664 - RNA, 22 nt, Artificial Sequence
  ELANE RNA Guide
ggucugcaacgugcuaauccac

SEQ ID NO: 25665 - RNA, 22 nt, Artificial Sequence
  ELANE RNA Guide
gucugcaacgugcuaauccacg

SEQ ID NO: 25666 - RNA, 22 nt, Artificial Sequence
  ELANE RNA Guide
gugcuaauccacggaauugccu

SEQ ID NO: 25667 - RNA, 22 nt, Artificial Sequence
  ELANE RNA Guide
guggauuagcacguugcagacc

SEQ ID NO: 25668 - RNA, 22 nt, Artificial Sequence
  ELANE RNA Guide
uagcacguugcagaccaagggg

SEQ ID NO: 25669 - RNA, 22 nt, Artificial Sequence
  ELANE RNA Guide
uccguggauuagcacguugcag

SEQ ID NO: 25670 - RNA, 22 nt, Artificial Sequence
  ELANE RNA Guide
ucugcaacgugcuaauccacgg

SEQ ID NO: 25671 - RNA, 22 nt, Artificial Sequence
  ELANE RNA Guide
ugcaacgugcuaauccacggaa

SEQ ID NO: 25672 - RNA, 22 nt, Artificial Sequence
  ELANE RNA Guide
uggauuagcacguugcagacca

SEQ ID NO: 25673 - RNA, 22 nt, Artificial Sequence
  ELANE RNA Guide
uggucugcaacgugcuaaucca

SEQ ID NO: 25674 - RNA, 22 nt, Artificial Sequence
  ELANE RNA Guide
uuagcacguugcagaccaaggg

SEQ ID NO: 25675 - RNA, 22 nt, Artificial Sequence
  ELANE RNA Guide
uuccguggauuagcacguugca

SEQ ID NO: 25676 - RNA, 22 nt, Artificial Sequence
  ELANE RNA Guide
uuggucugcaacgugcuaaucc

SEQ ID NO: 25677 - RNA, 20 nt, Artificial Sequence
  ELANE RNA Guide
aacgggcuaaucuacggaau

SEQ ID NO: 25678 - RNA, 20 nt, Artificial Sequence
  ELANE RNA Guide
aaggaggcaauuccguagau

SEQ ID NO: 25679 - RNA, 20 nt, Artificial Sequence
  ELANE RNA Guide
aaucuacggaauugccuccu

SEQ ID NO: 25680 - RNA, 20 nt, Artificial Sequence
  ELANE RNA Guide
aauuccguagauuagcccgu

SEQ ID NO: 25681 - RNA, 20 nt, Artificial Sequence
  ELANE RNA Guide
acgaaggaggcaauuccgua

SEQ ID NO: 25682 - RNA, 20 nt, Artificial Sequence
  ELANE RNA Guide
acgggcuaaucuacggaauu

SEQ ID NO: 25683 - RNA, 20 nt, Artificial Sequence
  ELANE RNA Guide
aggaggcaauuccguagauu

SEQ ID NO: 25684 - RNA, 20 nt, Artificial Sequence
  ELANE RNA Guide
aggcaauuccguagauuagc

SEQ ID NO: 25685 - RNA, 20 nt, Artificial Sequence
  ELANE RNA Guide
aucuacggaauugccuccuu

SEQ ID NO: 25686 - RNA, 20 nt, Artificial Sequence
  ELANE RNA Guide
auuccguagauuagcccguu

SEQ ID NO: 25687 - RNA, 20 nt, Artificial Sequence
  ELANE RNA Guide
caacgggcuaaucuacggaa

SEQ ID NO: 25688 - RNA, 20 nt, Artificial Sequence
  ELANE RNA Guide
caauuccguagauuagcccg

SEQ ID NO: 25689 - RNA, 20 nt, Artificial Sequence
  ELANE RNA Guide
ccggacgaaggaggcaauuc

SEQ ID NO: 25690 - RNA, 20 nt, Artificial Sequence
  ELANE RNA Guide
ccguagauuagcccguugca

SEQ ID NO: 25691 - RNA, 20 nt, Artificial Sequence
  ELANE RNA Guide
ccuuggucugcaacgggcua

SEQ ID NO: 25692 - RNA, 20 nt, Artificial Sequence
  ELANE RNA Guide
cgaaggaggcaauuccguag

SEQ ID NO: 25693 - RNA, 20 nt, Artificial Sequence
  ELANE RNA Guide
cggacgaaggaggcaauucc

SEQ ID NO: 25694 - RNA, 20 nt, Artificial Sequence
  ELANE RNA Guide
cgggcuaaucuacggaauug

SEQ ID NO: 25695 - RNA, 20 nt, Artificial Sequence
  ELANE RNA Guide
cguagauuagcccguugcag

SEQ ID NO: 25696 - RNA, 20 nt, Artificial Sequence
  ELANE RNA Guide
cuaaucuacggaauugccuc

SEQ ID NO: 25697 - RNA, 20 nt, Artificial Sequence
  ELANE RNA Guide
cuacggaauugccuccuucg

SEQ ID NO: 25698 - RNA, 20 nt, Artificial Sequence
  ELANE RNA Guide
cugcaacgggcuaaucuacg

SEQ ID NO: 25699 - RNA, 20 nt, Artificial Sequence
  ELANE RNA Guide
cuuggucugcaacgggcuaa

SEQ ID NO: 25700 - RNA, 20 nt, Artificial Sequence
  ELANE RNA Guide
gaaggaggcaauuccguaga

SEQ ID NO: 25701 - RNA, 20 nt, Artificial Sequence
  ELANE RNA Guide
gacgaaggaggcaauuccgu

SEQ ID NO: 25702 - RNA, 20 nt, Artificial Sequence
  ELANE RNA Guide
gaggcaauuccguagauuag

SEQ ID NO: 25703 - RNA, 20 nt, Artificial Sequence
  ELANE RNA Guide
gcaacgggcuaaucuacgga

SEQ ID NO: 25704 - RNA, 20 nt, Artificial Sequence
  ELANE RNA Guide
gcaauuccguagauuagccc

SEQ ID NO: 25705 - RNA, 20 nt, Artificial Sequence
  ELANE RNA Guide
gcuaaucuacggaauugccu

SEQ ID NO: 25706 - RNA, 20 nt, Artificial Sequence
  ELANE RNA Guide
ggacgaaggaggcaauuccg

SEQ ID NO: 25707 - RNA, 20 nt, Artificial Sequence
  ELANE RNA Guide
ggaggcaauuccguagauua

SEQ ID NO: 25708 - RNA, 20 nt, Artificial Sequence
  ELANE RNA Guide
ggcaauuccguagauuagcc

SEQ ID NO: 25709 - RNA, 20 nt, Artificial Sequence
  ELANE RNA Guide
ggcuaaucuacggaauugcc

SEQ ID NO: 25710 - RNA, 20 nt, Artificial Sequence
  ELANE RNA Guide
gggcuaaucuacggaauugc

SEQ ID NO: 25711 - RNA, 20 nt, Artificial Sequence
  ELANE RNA Guide
ggucugcaacgggcuaaucu

SEQ ID NO: 25712 - RNA, 20 nt, Artificial Sequence
  ELANE RNA Guide
guagauuagcccguugcaga

SEQ ID NO: 25713 - RNA, 20 nt, Artificial Sequence
  ELANE RNA Guide
gucugcaacgggcuaaucua

SEQ ID NO: 25714 - RNA, 20 nt, Artificial Sequence
  ELANE RNA Guide
uaaucuacggaauugccucc

SEQ ID NO: 25715 - RNA, 20 nt, Artificial Sequence
  ELANE RNA Guide
uagauuagcccguugcagac

SEQ ID NO: 25716 - RNA, 20 nt, Artificial Sequence
  ELANE RNA Guide
uccguagauuagcccguugc

SEQ ID NO: 25717 - RNA, 20 nt, Artificial Sequence
  ELANE RNA Guide
ucuacggaauugccuccuuc

SEQ ID NO: 25718 - RNA, 20 nt, Artificial Sequence
  ELANE RNA Guide
ucugcaacgggcuaaucuac

SEQ ID NO: 25719 - RNA, 20 nt, Artificial Sequence
  ELANE RNA Guide
ugcaacgggcuaaucuacgg

SEQ ID NO: 25720 - RNA, 20 nt, Artificial Sequence
  ELANE RNA Guide
uggucugcaacgggcuaauc

SEQ ID NO: 25721 - RNA, 20 nt, Artificial Sequence
  ELANE RNA Guide
uuccguagauuagcccguug

SEQ ID NO: 25722 - RNA, 20 nt, Artificial Sequence
  ELANE RNA Guide
uuggucugcaacgggcuaau

SEQ ID NO: 25723 - RNA, 21 nt, Artificial Sequence
  ELANE RNA Guide
aacgggcuaaucuacggaauu

SEQ ID NO: 25724 - RNA, 21 nt, Artificial Sequence
  ELANE RNA Guide
aaggaggcaauuccguagauu

SEQ ID NO: 25725 - RNA, 21 nt, Artificial Sequence
  ELANE RNA Guide
aaucuacggaauugccuccuu

SEQ ID NO: 25726 - RNA, 21 nt, Artificial Sequence
  ELANE RNA Guide
aauuccguagauuagcccguu

SEQ ID NO: 25727 - RNA, 21 nt, Artificial Sequence
  ELANE RNA Guide
acgaaggaggcaauuccguag

SEQ ID NO: 25728 - RNA, 21 nt, Artificial Sequence
  ELANE RNA Guide
acgggcuaaucuacggaauug

SEQ ID NO: 25729 - RNA, 21 nt, Artificial Sequence
  ELANE RNA Guide
aggaggcaauuccguagauua

SEQ ID NO: 25730 - RNA, 21 nt, Artificial Sequence
  ELANE RNA Guide
aggcaauuccguagauuagcc

SEQ ID NO: 25731 - RNA, 21 nt, Artificial Sequence
  ELANE RNA Guide
aucuacggaauugccuccuuc

SEQ ID NO: 25732 - RNA, 21 nt, Artificial Sequence
  ELANE RNA Guide
auuccguagauuagcccguug

SEQ ID NO: 25733 - RNA, 21 nt, Artificial Sequence
  ELANE RNA Guide
caacgggcuaaucuacggaau

SEQ ID NO: 25734 - RNA, 21 nt, Artificial Sequence
  ELANE RNA Guide
caauuccguagauuagcccgu

SEQ ID NO: 25735 - RNA, 21 nt, Artificial Sequence
  ELANE RNA Guide
cccggacgaaggaggcaauuc

SEQ ID NO: 25736 - RNA, 21 nt, Artificial Sequence
  ELANE RNA Guide
cccuuggucugcaacgggcua

SEQ ID NO: 25737 - RNA, 21 nt, Artificial Sequence
  ELANE RNA Guide
ccggacgaaggaggcaauucc

SEQ ID NO: 25738 - RNA, 21 nt, Artificial Sequence
  ELANE RNA Guide
ccguagauuagcccguugcag

SEQ ID NO: 25739 - RNA, 21 nt, Artificial Sequence
  ELANE RNA Guide
ccuuggucugcaacgggcuaa

SEQ ID NO: 25740 - RNA, 21 nt, Artificial Sequence
  ELANE RNA Guide
cgaaggaggcaauuccguaga

SEQ ID NO: 25741 - RNA, 21 nt, Artificial Sequence
  ELANE RNA Guide
cggacgaaggaggcaauuccg

SEQ ID NO: 25742 - RNA, 21 nt, Artificial Sequence
  ELANE RNA Guide
cgggcuaaucuacggaauugc

SEQ ID NO: 25743 - RNA, 21 nt, Artificial Sequence
  ELANE RNA Guide
cguagauuagcccguugcaga

SEQ ID NO: 25744 - RNA, 21 nt, Artificial Sequence
  ELANE RNA Guide
cuaaucuacggaauugccucc

SEQ ID NO: 25745 - RNA, 21 nt, Artificial Sequence
  ELANE RNA Guide
cuacggaauugccuccuucgu

SEQ ID NO: 25746 - RNA, 21 nt, Artificial Sequence
  ELANE RNA Guide
cugcaacgggcuaaucuacgg

SEQ ID NO: 25747 - RNA, 21 nt, Artificial Sequence
  ELANE RNA Guide
cuuggucugcaacgggcuaau

SEQ ID NO: 25748 - RNA, 21 nt, Artificial Sequence
  ELANE RNA Guide
gaaggaggcaauuccguagau

SEQ ID NO: 25749 - RNA, 21 nt, Artificial Sequence
  ELANE RNA Guide
gacgaaggaggcaauuccgua

SEQ ID NO: 25750 - RNA, 21 nt, Artificial Sequence
  ELANE RNA Guide
gaggcaauuccguagauuagc

SEQ ID NO: 25751 - RNA, 21 nt, Artificial Sequence
  ELANE RNA Guide
gcaacgggcuaaucuacggaa

SEQ ID NO: 25752 - RNA, 21 nt, Artificial Sequence
  ELANE RNA Guide
gcaauuccguagauuagcccg

SEQ ID NO: 25753 - RNA, 21 nt, Artificial Sequence
  ELANE RNA Guide
gcuaaucuacggaauugccuc

SEQ ID NO: 25754 - RNA, 21 nt, Artificial Sequence
  ELANE RNA Guide
ggacgaaggaggcaauuccgu

SEQ ID NO: 25755 - RNA, 21 nt, Artificial Sequence
  ELANE RNA Guide
ggaggcaauuccguagauuag

SEQ ID NO: 25756 - RNA, 21 nt, Artificial Sequence
  ELANE RNA Guide
ggcaauuccguagauuagccc

SEQ ID NO: 25757 - RNA, 21 nt, Artificial Sequence
  ELANE RNA Guide
ggcuaaucuacggaauugccu

SEQ ID NO: 25758 - RNA, 21 nt, Artificial Sequence
  ELANE RNA Guide
gggcuaaucuacggaauugcc

SEQ ID NO: 25759 - RNA, 21 nt, Artificial Sequence
  ELANE RNA Guide
ggucugcaacgggcuaaucua

SEQ ID NO: 25760 - RNA, 21 nt, Artificial Sequence
  ELANE RNA Guide
guagauuagcccguugcagac

SEQ ID NO: 25761 - RNA, 21 nt, Artificial Sequence
  ELANE RNA Guide
gucugcaacgggcuaaucuac

SEQ ID NO: 25762 - RNA, 21 nt, Artificial Sequence
  ELANE RNA Guide
uaaucuacggaauugccuccu

SEQ ID NO: 25763 - RNA, 21 nt, Artificial Sequence
  ELANE RNA Guide
uagauuagcccguugcagacc

SEQ ID NO: 25764 - RNA, 21 nt, Artificial Sequence
  ELANE RNA Guide
uccguagauuagcccguugca

SEQ ID NO: 25765 - RNA, 21 nt, Artificial Sequence
  ELANE RNA Guide
ucuacggaauugccuccuucg

SEQ ID NO: 25766 - RNA, 21 nt, Artificial Sequence
  ELANE RNA Guide
ucugcaacgggcuaaucuacg

SEQ ID NO: 25767 - RNA, 21 nt, Artificial Sequence
  ELANE RNA Guide
ugcaacgggcuaaucuacgga

SEQ ID NO: 25768 - RNA, 21 nt, Artificial Sequence
  ELANE RNA Guide
uggucugcaacgggcuaaucu

SEQ ID NO: 25769 - RNA, 21 nt, Artificial Sequence
  ELANE RNA Guide
uuccguagauuagcccguugc

SEQ ID NO: 25770 - RNA, 21 nt, Artificial Sequence
  ELANE RNA Guide
uuggucugcaacgggcuaauc

SEQ ID NO: 25771 - RNA, 22 nt, Artificial Sequence
  ELANE RNA Guide
aacgggcuaaucuacggaauug

SEQ ID NO: 25772 - RNA, 22 nt, Artificial Sequence
  ELANE RNA Guide
aaggaggcaauuccguagauua

SEQ ID NO: 25773 - RNA, 22 nt, Artificial Sequence
  ELANE RNA Guide
aaucuacggaauugccuccuuc

SEQ ID NO: 25774 - RNA, 22 nt, Artificial Sequence
  ELANE RNA Guide
aauuccguagauuagcccguug

SEQ ID NO: 25775 - RNA, 22 nt, Artificial Sequence
  ELANE RNA Guide
acgaaggaggcaauuccguaga

SEQ ID NO: 25776 - RNA, 22 nt, Artificial Sequence
  ELANE RNA Guide
acgggcuaaucuacggaauugc

SEQ ID NO: 25777 - RNA, 22 nt, Artificial Sequence
  ELANE RNA Guide
aggaggcaauuccguagauuag

SEQ ID NO: 25778 - RNA, 22 nt, Artificial Sequence
  ELANE RNA Guide
aggcaauuccguagauuagccc

SEQ ID NO: 25779 - RNA, 22 nt, Artificial Sequence
  ELANE RNA Guide
aucuacggaauugccuccuucg

SEQ ID NO: 25780 - RNA, 22 nt, Artificial Sequence
  ELANE RNA Guide
auuccguagauuagcccguugc

SEQ ID NO: 25781 - RNA, 22 nt, Artificial Sequence
  ELANE RNA Guide
caacgggcuaaucuacggaauu

SEQ ID NO: 25782 - RNA, 22 nt, Artificial Sequence
  ELANE RNA Guide
caauuccguagauuagcccguu

SEQ ID NO: 25783 - RNA, 22 nt, Artificial Sequence
  ELANE RNA Guide
ccccggacgaaggaggcaauuc

SEQ ID NO: 25784 - RNA, 22 nt, Artificial Sequence
  ELANE RNA Guide
ccccuuggucugcaacgggcua

SEQ ID NO: 25785 - RNA, 22 nt, Artificial Sequence
  ELANE RNA Guide
cccggacgaaggaggcaauucc

SEQ ID NO: 25786 - RNA, 22 nt, Artificial Sequence
  ELANE RNA Guide
cccuuggucugcaacgggcuaa

SEQ ID NO: 25787 - RNA, 22 nt, Artificial Sequence
  ELANE RNA Guide
ccggacgaaggaggcaauuccg

SEQ ID NO: 25788 - RNA, 22 nt, Artificial Sequence
  ELANE RNA Guide
ccguagauuagcccguugcaga

SEQ ID NO: 25789 - RNA, 22 nt, Artificial Sequence
  ELANE RNA Guide
ccuuggucugcaacgggcuaau

SEQ ID NO: 25790 - RNA, 22 nt, Artificial Sequence
  ELANE RNA Guide
cgaaggaggcaauuccguagau

SEQ ID NO: 25791 - RNA, 22 nt, Artificial Sequence
  ELANE RNA Guide
cggacgaaggaggcaauuccgu

SEQ ID NO: 25792 - RNA, 22 nt, Artificial Sequence
  ELANE RNA Guide
cgggcuaaucuacggaauugcc

SEQ ID NO: 25793 - RNA, 22 nt, Artificial Sequence
  ELANE RNA Guide
cguagauuagcccguugcagac

SEQ ID NO: 25794 - RNA, 22 nt, Artificial Sequence
  ELANE RNA Guide
cuaaucuacggaauugccuccu

SEQ ID NO: 25795 - RNA, 22 nt, Artificial Sequence
  ELANE RNA Guide
cuacggaauugccuccuucguc

SEQ ID NO: 25796 - RNA, 22 nt, Artificial Sequence
  ELANE RNA Guide
cugcaacgggcuaaucuacgga

SEQ ID NO: 25797 - RNA, 22 nt, Artificial Sequence
  ELANE RNA Guide
cuuggucugcaacgggcuaauc

SEQ ID NO: 25798 - RNA, 22 nt, Artificial Sequence
  ELANE RNA Guide
gaaggaggcaauuccguagauu

SEQ ID NO: 25799 - RNA, 22 nt, Artificial Sequence
  ELANE RNA Guide
gacgaaggaggcaauuccguag

SEQ ID NO: 25800 - RNA, 22 nt, Artificial Sequence
  ELANE RNA Guide
gaggcaauuccguagauuagcc

SEQ ID NO: 25801 - RNA, 22 nt, Artificial Sequence
  ELANE RNA Guide
gcaacgggcuaaucuacggaau

SEQ ID NO: 25802 - RNA, 22 nt, Artificial Sequence
  ELANE RNA Guide
gcaauuccguagauuagcccgu

SEQ ID NO: 25803 - RNA, 22 nt, Artificial Sequence
  ELANE RNA Guide
gcuaaucuacggaauugccucc

SEQ ID NO: 25804 - RNA, 22 nt, Artificial Sequence
  ELANE RNA Guide
ggacgaaggaggcaauuccgua

SEQ ID NO: 25805 - RNA, 22 nt, Artificial Sequence
  ELANE RNA Guide
ggaggcaauuccguagauuagc

SEQ ID NO: 25806 - RNA, 22 nt, Artificial Sequence
  ELANE RNA Guide
ggcaauuccguagauuagcccg

SEQ ID NO: 25807 - RNA, 22 nt, Artificial Sequence
  ELANE RNA Guide
ggcuaaucuacggaauugccuc

SEQ ID NO: 25808 - RNA, 22 nt, Artificial Sequence
  ELANE RNA Guide
gggcuaaucuacggaauugccu

SEQ ID NO: 25809 - RNA, 22 nt, Artificial Sequence
  ELANE RNA Guide
ggucugcaacgggcuaaucuac

SEQ ID NO: 25810 - RNA, 22 nt, Artificial Sequence
  ELANE RNA Guide
guagauuagcccguugcagacc

SEQ ID NO: 25811 - RNA, 22 nt, Artificial Sequence
  ELANE RNA Guide
gucugcaacgggcuaaucuacg

SEQ ID NO: 25812 - RNA, 22 nt, Artificial Sequence
  ELANE RNA Guide
uaaucuacggaauugccuccuu

SEQ ID NO: 25813 - RNA, 22 nt, Artificial Sequence
  ELANE RNA Guide
uagauuagcccguugcagacca

SEQ ID NO: 25814 - RNA, 22 nt, Artificial Sequence
  ELANE RNA Guide
uccguagauuagcccguugcag

SEQ ID NO: 25815 - RNA, 22 nt, Artificial Sequence
  ELANE RNA Guide
ucuacggaauugccuccuucgu

SEQ ID NO: 25816 - RNA, 22 nt, Artificial Sequence
  ELANE RNA Guide
ucugcaacgggcuaaucuacgg

SEQ ID NO: 25817 - RNA, 22 nt, Artificial Sequence
  ELANE RNA Guide
ugcaacgggcuaaucuacggaa

SEQ ID NO: 25818 - RNA, 22 nt, Artificial Sequence
  ELANE RNA Guide
uggucugcaacgggcuaaucua

SEQ ID NO: 25819 - RNA, 22 nt, Artificial Sequence
  ELANE RNA Guide
uuccguagauuagcccguugca

SEQ ID NO: 25820 - RNA, 22 nt, Artificial Sequence
  ELANE RNA Guide
uuggucugcaacgggcuaaucu

SEQ ID NO: 25821 - RNA, 20 nt, Artificial Sequence
  ELANE RNA Guide
aacgggcuaauccccggaau

SEQ ID NO: 25822 - RNA, 20 nt, Artificial Sequence
  ELANE RNA Guide
aaggaggcaauuccggggau

SEQ ID NO: 25823 - RNA, 20 nt, Artificial Sequence
  ELANE RNA Guide
aauccccggaauugccuccu

SEQ ID NO: 25824 - RNA, 20 nt, Artificial Sequence
  ELANE RNA Guide
aauuccggggauuagcccgu

SEQ ID NO: 25825 - RNA, 20 nt, Artificial Sequence
  ELANE RNA Guide
acgaaggaggcaauuccggg

SEQ ID NO: 25826 - RNA, 20 nt, Artificial Sequence
  ELANE RNA Guide
acgggcuaauccccggaauu

SEQ ID NO: 25827 - RNA, 20 nt, Artificial Sequence
  ELANE RNA Guide
aggaggcaauuccggggauu

SEQ ID NO: 25828 - RNA, 20 nt, Artificial Sequence
  ELANE RNA Guide
aggcaauuccggggauuagc

SEQ ID NO: 25829 - RNA, 20 nt, Artificial Sequence
  ELANE RNA Guide
auccccggaauugccuccuu

SEQ ID NO: 25830 - RNA, 20 nt, Artificial Sequence
  ELANE RNA Guide
auuccggggauuagcccguu

SEQ ID NO: 25831 - RNA, 20 nt, Artificial Sequence
  ELANE RNA Guide
caacgggcuaauccccggaa

SEQ ID NO: 25832 - RNA, 20 nt, Artificial Sequence
  ELANE RNA Guide
caauuccggggauuagcccg

SEQ ID NO: 25833 - RNA, 20 nt, Artificial Sequence
  ELANE RNA Guide
ccccggaauugccuccuucg

SEQ ID NO: 25834 - RNA, 20 nt, Artificial Sequence
  ELANE RNA Guide
cccggaauugccuccuucgu

SEQ ID NO: 25835 - RNA, 20 nt, Artificial Sequence
  ELANE RNA Guide
cccggacgaaggaggcaauu

SEQ ID NO: 25836 - RNA, 20 nt, Artificial Sequence
  ELANE RNA Guide
ccggggauuagcccguugca

SEQ ID NO: 25837 - RNA, 20 nt, Artificial Sequence
  ELANE RNA Guide
cgaaggaggcaauuccgggg

SEQ ID NO: 25838 - RNA, 20 nt, Artificial Sequence
  ELANE RNA Guide
cgggcuaauccccggaauug

SEQ ID NO: 25839 - RNA, 20 nt, Artificial Sequence
  ELANE RNA Guide
cggggauuagcccguugcag

SEQ ID NO: 25840 - RNA, 20 nt, Artificial Sequence
  ELANE RNA Guide
cuaauccccggaauugccuc

SEQ ID NO: 25841 - RNA, 20 nt, Artificial Sequence
  ELANE RNA Guide
cugcaacgggcuaauccccg

SEQ ID NO: 25842 - RNA, 20 nt, Artificial Sequence
  ELANE RNA Guide
gaaggaggcaauuccgggga

SEQ ID NO: 25843 - RNA, 20 nt, Artificial Sequence
  ELANE RNA Guide
gacgaaggaggcaauuccgg

SEQ ID NO: 25844 - RNA, 20 nt, Artificial Sequence
  ELANE RNA Guide
gaggcaauuccggggauuag

SEQ ID NO: 25845 - RNA, 20 nt, Artificial Sequence
  ELANE RNA Guide
gcaacgggcuaauccccgga

SEQ ID NO: 25846 - RNA, 20 nt, Artificial Sequence
  ELANE RNA Guide
gcaauuccggggauuagccc

SEQ ID NO: 25847 - RNA, 20 nt, Artificial Sequence
  ELANE RNA Guide
gcuaauccccggaauugccu

SEQ ID NO: 25848 - RNA, 20 nt, Artificial Sequence
  ELANE RNA Guide
ggaggcaauuccggggauua

SEQ ID NO: 25849 - RNA, 20 nt, Artificial Sequence
  ELANE RNA Guide
ggcaauuccggggauuagcc

SEQ ID NO: 25850 - RNA, 20 nt, Artificial Sequence
  ELANE RNA Guide
ggcuaauccccggaauugcc

SEQ ID NO: 25851 - RNA, 20 nt, Artificial Sequence
  ELANE RNA Guide
gggcuaauccccggaauugc

SEQ ID NO: 25852 - RNA, 20 nt, Artificial Sequence
  ELANE RNA Guide
ggggauuagcccguugcaga

SEQ ID NO: 25853 - RNA, 20 nt, Artificial Sequence
  ELANE RNA Guide
ggucugcaacgggcuaaucc

SEQ ID NO: 25854 - RNA, 20 nt, Artificial Sequence
  ELANE RNA Guide
gucugcaacgggcuaauccc

SEQ ID NO: 25855 - RNA, 20 nt, Artificial Sequence
  ELANE RNA Guide
uaauccccggaauugccucc

SEQ ID NO: 25856 - RNA, 20 nt, Artificial Sequence
  ELANE RNA Guide
uccccggaauugccuccuuc

SEQ ID NO: 25857 - RNA, 20 nt, Artificial Sequence
  ELANE RNA Guide
uccggggauuagcccguugc

SEQ ID NO: 25858 - RNA, 20 nt, Artificial Sequence
  ELANE RNA Guide
ucugcaacgggcuaaucccc

SEQ ID NO: 25859 - RNA, 20 nt, Artificial Sequence
  ELANE RNA Guide
ugcaacgggcuaauccccgg

SEQ ID NO: 25860 - RNA, 20 nt, Artificial Sequence
  ELANE RNA Guide
uuccggggauuagcccguug

SEQ ID NO: 25861 - RNA, 21 nt, Artificial Sequence
  ELANE RNA Guide
aacgggcuaauccccggaauu

SEQ ID NO: 25862 - RNA, 21 nt, Artificial Sequence
  ELANE RNA Guide
aaggaggcaauuccggggauu

SEQ ID NO: 25863 - RNA, 21 nt, Artificial Sequence
  ELANE RNA Guide
aauccccggaauugccuccuu

SEQ ID NO: 25864 - RNA, 21 nt, Artificial Sequence
  ELANE RNA Guide
aauuccggggauuagcccguu

SEQ ID NO: 25865 - RNA, 21 nt, Artificial Sequence
  ELANE RNA Guide
acgaaggaggcaauuccgggg

SEQ ID NO: 25866 - RNA, 21 nt, Artificial Sequence
  ELANE RNA Guide
acgggcuaauccccggaauug

SEQ ID NO: 25867 - RNA, 21 nt, Artificial Sequence
  ELANE RNA Guide
aggaggcaauuccggggauua

SEQ ID NO: 25868 - RNA, 21 nt, Artificial Sequence
  ELANE RNA Guide
aggcaauuccggggauuagcc

SEQ ID NO: 25869 - RNA, 21 nt, Artificial Sequence
  ELANE RNA Guide
auccccggaauugccuccuuc

SEQ ID NO: 25870 - RNA, 21 nt, Artificial Sequence
  ELANE RNA Guide
auuccggggauuagcccguug

SEQ ID NO: 25871 - RNA, 21 nt, Artificial Sequence
  ELANE RNA Guide
caacgggcuaauccccggaau

SEQ ID NO: 25872 - RNA, 21 nt, Artificial Sequence
  ELANE RNA Guide
caauuccggggauuagcccgu

SEQ ID NO: 25873 - RNA, 21 nt, Artificial Sequence
  ELANE RNA Guide
ccccggaauugccuccuucgu

SEQ ID NO: 25874 - RNA, 21 nt, Artificial Sequence
  ELANE RNA Guide
ccccggacgaaggaggcaauu

SEQ ID NO: 25875 - RNA, 21 nt, Artificial Sequence
  ELANE RNA Guide
cccggaauugccuccuucguc

SEQ ID NO: 25876 - RNA, 21 nt, Artificial Sequence
  ELANE RNA Guide
ccggggauuagcccguugcag

SEQ ID NO: 25877 - RNA, 21 nt, Artificial Sequence
  ELANE RNA Guide
cgaaggaggcaauuccgggga

SEQ ID NO: 25878 - RNA, 21 nt, Artificial Sequence
  ELANE RNA Guide
cgggcuaauccccggaauugc

SEQ ID NO: 25879 - RNA, 21 nt, Artificial Sequence
  ELANE RNA Guide
cggggauuagcccguugcaga

SEQ ID NO: 25880 - RNA, 21 nt, Artificial Sequence
  ELANE RNA Guide
cuaauccccggaauugccucc

SEQ ID NO: 25881 - RNA, 21 nt, Artificial Sequence
  ELANE RNA Guide
cugcaacgggcuaauccccgg

SEQ ID NO: 25882 - RNA, 21 nt, Artificial Sequence
  ELANE RNA Guide
gaaggaggcaauuccggggau

SEQ ID NO: 25883 - RNA, 21 nt, Artificial Sequence
  ELANE RNA Guide
gacgaaggaggcaauuccggg

SEQ ID NO: 25884 - RNA, 21 nt, Artificial Sequence
  ELANE RNA Guide
gaggcaauuccggggauuagc

SEQ ID NO: 25885 - RNA, 21 nt, Artificial Sequence
  ELANE RNA Guide
gcaacgggcuaauccccggaa

SEQ ID NO: 25886 - RNA, 21 nt, Artificial Sequence
  ELANE RNA Guide
gcaauuccggggauuagcccg

SEQ ID NO: 25887 - RNA, 21 nt, Artificial Sequence
  ELANE RNA Guide
gcuaauccccggaauugccuc

SEQ ID NO: 25888 - RNA, 21 nt, Artificial Sequence
  ELANE RNA Guide
ggacgaaggaggcaauuccgg

SEQ ID NO: 25889 - RNA, 21 nt, Artificial Sequence
  ELANE RNA Guide
ggaggcaauuccggggauuag

SEQ ID NO: 25890 - RNA, 21 nt, Artificial Sequence
  ELANE RNA Guide
ggcaauuccggggauuagccc

SEQ ID NO: 25891 - RNA, 21 nt, Artificial Sequence
  ELANE RNA Guide
ggcuaauccccggaauugccu

SEQ ID NO: 25892 - RNA, 21 nt, Artificial Sequence
  ELANE RNA Guide
gggcuaauccccggaauugcc

SEQ ID NO: 25893 - RNA, 21 nt, Artificial Sequence
  ELANE RNA Guide
ggggauuagcccguugcagac

SEQ ID NO: 25894 - RNA, 21 nt, Artificial Sequence
  ELANE RNA Guide
ggucugcaacgggcuaauccc

SEQ ID NO: 25895 - RNA, 21 nt, Artificial Sequence
  ELANE RNA Guide
gucugcaacgggcuaaucccc

SEQ ID NO: 25896 - RNA, 21 nt, Artificial Sequence
  ELANE RNA Guide
uaauccccggaauugccuccu

SEQ ID NO: 25897 - RNA, 21 nt, Artificial Sequence
  ELANE RNA Guide
uccccggaauugccuccuucg

SEQ ID NO: 25898 - RNA, 21 nt, Artificial Sequence
  ELANE RNA Guide
uccggggauuagcccguugca

SEQ ID NO: 25899 - RNA, 21 nt, Artificial Sequence
  ELANE RNA Guide
ucugcaacgggcuaauccccg

SEQ ID NO: 25900 - RNA, 21 nt, Artificial Sequence
  ELANE RNA Guide
ugcaacgggcuaauccccgga

SEQ ID NO: 25901 - RNA, 21 nt, Artificial Sequence
  ELANE RNA Guide
uggucugcaacgggcuaaucc

SEQ ID NO: 25902 - RNA, 21 nt, Artificial Sequence
  ELANE RNA Guide
uuccggggauuagcccguugc

SEQ ID NO: 25903 - RNA, 22 nt, Artificial Sequence
  ELANE RNA Guide
aacgggcuaauccccggaauug

SEQ ID NO: 25904 - RNA, 22 nt, Artificial Sequence
  ELANE RNA Guide
aaggaggcaauuccggggauua

SEQ ID NO: 25905 - RNA, 22 nt, Artificial Sequence
  ELANE RNA Guide
aauccccggaauugccuccuuc

SEQ ID NO: 25906 - RNA, 22 nt, Artificial Sequence
  ELANE RNA Guide
aauuccggggauuagcccguug

SEQ ID NO: 25907 - RNA, 22 nt, Artificial Sequence
  ELANE RNA Guide
acgaaggaggcaauuccgggga

SEQ ID NO: 25908 - RNA, 22 nt, Artificial Sequence
  ELANE RNA Guide
acgggcuaauccccggaauugc

SEQ ID NO: 25909 - RNA, 22 nt, Artificial Sequence
  ELANE RNA Guide
aggaggcaauuccggggauuag

SEQ ID NO: 25910 - RNA, 22 nt, Artificial Sequence
  ELANE RNA Guide
aggcaauuccggggauuagccc

SEQ ID NO: 25911 - RNA, 22 nt, Artificial Sequence
  ELANE RNA Guide
auccccggaauugccuccuucg

SEQ ID NO: 25912 - RNA, 22 nt, Artificial Sequence
  ELANE RNA Guide
auuccggggauuagcccguugc

SEQ ID NO: 25913 - RNA, 22 nt, Artificial Sequence
  ELANE RNA Guide
caacgggcuaauccccggaauu

SEQ ID NO: 25914 - RNA, 22 nt, Artificial Sequence
  ELANE RNA Guide
caauuccggggauuagcccguu

SEQ ID NO: 25915 - RNA, 22 nt, Artificial Sequence
  ELANE RNA Guide
ccccggaauugccuccuucguc

SEQ ID NO: 25916 - RNA, 22 nt, Artificial Sequence
  ELANE RNA Guide
cccggaauugccuccuucgucc

SEQ ID NO: 25917 - RNA, 22 nt, Artificial Sequence
  ELANE RNA Guide
ccggggauuagcccguugcaga

SEQ ID NO: 25918 - RNA, 22 nt, Artificial Sequence
  ELANE RNA Guide
cgaaggaggcaauuccggggau

SEQ ID NO: 25919 - RNA, 22 nt, Artificial Sequence
  ELANE RNA Guide
cggacgaaggaggcaauuccgg

SEQ ID NO: 25920 - RNA, 22 nt, Artificial Sequence
  ELANE RNA Guide
cgggcuaauccccggaauugcc

SEQ ID NO: 25921 - RNA, 22 nt, Artificial Sequence
  ELANE RNA Guide
cggggauuagcccguugcagac

SEQ ID NO: 25922 - RNA, 22 nt, Artificial Sequence
  ELANE RNA Guide
cuaauccccggaauugccuccu

SEQ ID NO: 25923 - RNA, 22 nt, Artificial Sequence
  ELANE RNA Guide
cugcaacgggcuaauccccgga

SEQ ID NO: 25924 - RNA, 22 nt, Artificial Sequence
  ELANE RNA Guide
gaaggaggcaauuccggggauu

SEQ ID NO: 25925 - RNA, 22 nt, Artificial Sequence
  ELANE RNA Guide
gacgaaggaggcaauuccgggg

SEQ ID NO: 25926 - RNA, 22 nt, Artificial Sequence
  ELANE RNA Guide
gaggcaauuccggggauuagcc

SEQ ID NO: 25927 - RNA, 22 nt, Artificial Sequence
  ELANE RNA Guide
gcaacgggcuaauccccggaau

SEQ ID NO: 25928 - RNA, 22 nt, Artificial Sequence
  ELANE RNA Guide
gcaauuccggggauuagcccgu

SEQ ID NO: 25929 - RNA, 22 nt, Artificial Sequence
  ELANE RNA Guide
gcuaauccccggaauugccucc

SEQ ID NO: 25930 - RNA, 22 nt, Artificial Sequence
  ELANE RNA Guide
ggacgaaggaggcaauuccggg

SEQ ID NO: 25931 - RNA, 22 nt, Artificial Sequence
  ELANE RNA Guide
ggaggcaauuccggggauuagc

SEQ ID NO: 25932 - RNA, 22 nt, Artificial Sequence
  ELANE RNA Guide
ggcaauuccggggauuagcccg

SEQ ID NO: 25933 - RNA, 22 nt, Artificial Sequence
  ELANE RNA Guide
ggcuaauccccggaauugccuc

SEQ ID NO: 25934 - RNA, 22 nt, Artificial Sequence
  ELANE RNA Guide
gggcuaauccccggaauugccu

SEQ ID NO: 25935 - RNA, 22 nt, Artificial Sequence
  ELANE RNA Guide
ggggauuagcccguugcagacc

SEQ ID NO: 25936 - RNA, 22 nt, Artificial Sequence
  ELANE RNA Guide
ggucugcaacgggcuaaucccc

SEQ ID NO: 25937 - RNA, 22 nt, Artificial Sequence
  ELANE RNA Guide
gucugcaacgggcuaauccccg

SEQ ID NO: 25938 - RNA, 22 nt, Artificial Sequence
  ELANE RNA Guide
uaauccccggaauugccuccuu

SEQ ID NO: 25939 - RNA, 22 nt, Artificial Sequence
  ELANE RNA Guide
uccccggaauugccuccuucgu

SEQ ID NO: 25940 - RNA, 22 nt, Artificial Sequence
  ELANE RNA Guide
uccccggacgaaggaggcaauu

SEQ ID NO: 25941 - RNA, 22 nt, Artificial Sequence
  ELANE RNA Guide
uccggggauuagcccguugcag

SEQ ID NO: 25942 - RNA, 22 nt, Artificial Sequence
  ELANE RNA Guide
ucugcaacgggcuaauccccgg

SEQ ID NO: 25943 - RNA, 22 nt, Artificial Sequence
  ELANE RNA Guide
ugcaacgggcuaauccccggaa

SEQ ID NO: 25944 - RNA, 22 nt, Artificial Sequence
  ELANE RNA Guide
uggucugcaacgggcuaauccc

SEQ ID NO: 25945 - RNA, 22 nt, Artificial Sequence
  ELANE RNA Guide
uuccggggauuagcccguugca

SEQ ID NO: 25946 - RNA, 22 nt, Artificial Sequence
  ELANE RNA Guide
uuggucugcaacgggcuaaucc

SEQ ID NO: 25947 - RNA, 20 nt, Artificial Sequence
  ELANE RNA Guide
aacgggcuaauccacgaauu

SEQ ID NO: 25948 - RNA, 20 nt, Artificial Sequence
  ELANE RNA Guide
aaggaggcaauucguggauu

SEQ ID NO: 25949 - RNA, 20 nt, Artificial Sequence
  ELANE RNA Guide
aauccacgaauugccuccuu

SEQ ID NO: 25950 - RNA, 20 nt, Artificial Sequence
  ELANE RNA Guide
aauucguggauuagcccguu

SEQ ID NO: 25951 - RNA, 20 nt, Artificial Sequence
  ELANE RNA Guide
acgaaggaggcaauucgugg

SEQ ID NO: 25952 - RNA, 20 nt, Artificial Sequence
  ELANE RNA Guide
acgaauugccuccuucgucc

SEQ ID NO: 25953 - RNA, 20 nt, Artificial Sequence
  ELANE RNA Guide
acgggcuaauccacgaauug

SEQ ID NO: 25954 - RNA, 20 nt, Artificial Sequence
  ELANE RNA Guide
aggaggcaauucguggauua

SEQ ID NO: 25955 - RNA, 20 nt, Artificial Sequence
  ELANE RNA Guide
aggcaauucguggauuagcc

SEQ ID NO: 25956 - RNA, 20 nt, Artificial Sequence
  ELANE RNA Guide
auccacgaauugccuccuuc

SEQ ID NO: 25957 - RNA, 20 nt, Artificial Sequence
  ELANE RNA Guide
auucguggauuagcccguug

SEQ ID NO: 25958 - RNA, 20 nt, Artificial Sequence
  ELANE RNA Guide
caacgggcuaauccacgaau

SEQ ID NO: 25959 - RNA, 20 nt, Artificial Sequence
  ELANE RNA Guide
caauucguggauuagcccgu

SEQ ID NO: 25960 - RNA, 20 nt, Artificial Sequence
  ELANE RNA Guide
cacgaauugccuccuucguc

SEQ ID NO: 25961 - RNA, 20 nt, Artificial Sequence
  ELANE RNA Guide
ccacgaauugccuccuucgu

SEQ ID NO: 25962 - RNA, 20 nt, Artificial Sequence
  ELANE RNA Guide
ccccggacgaaggaggcaau

SEQ ID NO: 25963 - RNA, 20 nt, Artificial Sequence
  ELANE RNA Guide
cgaaggaggcaauucgugga

SEQ ID NO: 25964 - RNA, 20 nt, Artificial Sequence
  ELANE RNA Guide
cggacgaaggaggcaauucg

SEQ ID NO: 25965 - RNA, 20 nt, Artificial Sequence
  ELANE RNA Guide
cgggcuaauccacgaauugc

SEQ ID NO: 25966 - RNA, 20 nt, Artificial Sequence
  ELANE RNA Guide
cuaauccacgaauugccucc

SEQ ID NO: 25967 - RNA, 20 nt, Artificial Sequence
  ELANE RNA Guide
cugcaacgggcuaauccacg

SEQ ID NO: 25968 - RNA, 20 nt, Artificial Sequence
  ELANE RNA Guide
gaaggaggcaauucguggau

SEQ ID NO: 25969 - RNA, 20 nt, Artificial Sequence
  ELANE RNA Guide
gacgaaggaggcaauucgug

SEQ ID NO: 25970 - RNA, 20 nt, Artificial Sequence
  ELANE RNA Guide
gaggcaauucguggauuagc

SEQ ID NO: 25971 - RNA, 20 nt, Artificial Sequence
  ELANE RNA Guide
gcaacgggcuaauccacgaa

SEQ ID NO: 25972 - RNA, 20 nt, Artificial Sequence
  ELANE RNA Guide
gcaauucguggauuagcccg

SEQ ID NO: 25973 - RNA, 20 nt, Artificial Sequence
  ELANE RNA Guide
gcuaauccacgaauugccuc

SEQ ID NO: 25974 - RNA, 20 nt, Artificial Sequence
  ELANE RNA Guide
ggacgaaggaggcaauucgu

SEQ ID NO: 25975 - RNA, 20 nt, Artificial Sequence
  ELANE RNA Guide
ggaggcaauucguggauuag

SEQ ID NO: 25976 - RNA, 20 nt, Artificial Sequence
  ELANE RNA Guide
ggcaauucguggauuagccc

SEQ ID NO: 25977 - RNA, 20 nt, Artificial Sequence
  ELANE RNA Guide
ggcuaauccacgaauugccu

SEQ ID NO: 25978 - RNA, 20 nt, Artificial Sequence
  ELANE RNA Guide
gggcuaauccacgaauugcc

SEQ ID NO: 25979 - RNA, 20 nt, Artificial Sequence
  ELANE RNA Guide
gucugcaacgggcuaaucca

SEQ ID NO: 25980 - RNA, 20 nt, Artificial Sequence
  ELANE RNA Guide
uaauccacgaauugccuccu

SEQ ID NO: 25981 - RNA, 20 nt, Artificial Sequence
  ELANE RNA Guide
uccacgaauugccuccuucg

SEQ ID NO: 25982 - RNA, 20 nt, Artificial Sequence
  ELANE RNA Guide
uccccggacgaaggaggcaa

SEQ ID NO: 25983 - RNA, 20 nt, Artificial Sequence
  ELANE RNA Guide
ucguggauuagcccguugca

SEQ ID NO: 25984 - RNA, 20 nt, Artificial Sequence
  ELANE RNA Guide
ucugcaacgggcuaauccac

SEQ ID NO: 25985 - RNA, 20 nt, Artificial Sequence
  ELANE RNA Guide
ugcaacgggcuaauccacga

SEQ ID NO: 25986 - RNA, 20 nt, Artificial Sequence
  ELANE RNA Guide
uucguggauuagcccguugc

SEQ ID NO: 25987 - RNA, 21 nt, Artificial Sequence
  ELANE RNA Guide
aacgggcuaauccacgaauug

SEQ ID NO: 25988 - RNA, 21 nt, Artificial Sequence
  ELANE RNA Guide
aaggaggcaauucguggauua

SEQ ID NO: 25989 - RNA, 21 nt, Artificial Sequence
  ELANE RNA Guide
aauccacgaauugccuccuuc

SEQ ID NO: 25990 - RNA, 21 nt, Artificial Sequence
  ELANE RNA Guide
aauucguggauuagcccguug

SEQ ID NO: 25991 - RNA, 21 nt, Artificial Sequence
  ELANE RNA Guide
acgaaggaggcaauucgugga

SEQ ID NO: 25992 - RNA, 21 nt, Artificial Sequence
  ELANE RNA Guide
acgaauugccuccuucguccg

SEQ ID NO: 25993 - RNA, 21 nt, Artificial Sequence
  ELANE RNA Guide
acgggcuaauccacgaauugc

SEQ ID NO: 25994 - RNA, 21 nt, Artificial Sequence
  ELANE RNA Guide
aggaggcaauucguggauuag

SEQ ID NO: 25995 - RNA, 21 nt, Artificial Sequence
  ELANE RNA Guide
aggcaauucguggauuagccc

SEQ ID NO: 25996 - RNA, 21 nt, Artificial Sequence
  ELANE RNA Guide
auccacgaauugccuccuucg

SEQ ID NO: 25997 - RNA, 21 nt, Artificial Sequence
  ELANE RNA Guide
auucguggauuagcccguugc

SEQ ID NO: 25998 - RNA, 21 nt, Artificial Sequence
  ELANE RNA Guide
caacgggcuaauccacgaauu

SEQ ID NO: 25999 - RNA, 21 nt, Artificial Sequence
  ELANE RNA Guide
caauucguggauuagcccguu

SEQ ID NO: 26000 - RNA, 21 nt, Artificial Sequence
  ELANE RNA Guide
cacgaauugccuccuucgucc

SEQ ID NO: 26001 - RNA, 21 nt, Artificial Sequence
  ELANE RNA Guide
ccacgaauugccuccuucguc

SEQ ID NO: 26002 - RNA, 21 nt, Artificial Sequence
  ELANE RNA Guide
ccggacgaaggaggcaauucg

SEQ ID NO: 26003 - RNA, 21 nt, Artificial Sequence
  ELANE RNA Guide
cgaaggaggcaauucguggau

SEQ ID NO: 26004 - RNA, 21 nt, Artificial Sequence
  ELANE RNA Guide
cggacgaaggaggcaauucgu

SEQ ID NO: 26005 - RNA, 21 nt, Artificial Sequence
  ELANE RNA Guide
cgggcuaauccacgaauugcc

SEQ ID NO: 26006 - RNA, 21 nt, Artificial Sequence
  ELANE RNA Guide
cuaauccacgaauugccuccu

SEQ ID NO: 26007 - RNA, 21 nt, Artificial Sequence
  ELANE RNA Guide
cuccccggacgaaggaggcaa

SEQ ID NO: 26008 - RNA, 21 nt, Artificial Sequence
  ELANE RNA Guide
cugcaacgggcuaauccacga

SEQ ID NO: 26009 - RNA, 21 nt, Artificial Sequence
  ELANE RNA Guide
gaaggaggcaauucguggauu

SEQ ID NO: 26010 - RNA, 21 nt, Artificial Sequence
  ELANE RNA Guide
gacgaaggaggcaauucgugg

SEQ ID NO: 26011 - RNA, 21 nt, Artificial Sequence
  ELANE RNA Guide
gaggcaauucguggauuagcc

SEQ ID NO: 26012 - RNA, 21 nt, Artificial Sequence
  ELANE RNA Guide
gcaacgggcuaauccacgaau

SEQ ID NO: 26013 - RNA, 21 nt, Artificial Sequence
  ELANE RNA Guide
gcaauucguggauuagcccgu

SEQ ID NO: 26014 - RNA, 21 nt, Artificial Sequence
  ELANE RNA Guide
gcuaauccacgaauugccucc

SEQ ID NO: 26015 - RNA, 21 nt, Artificial Sequence
  ELANE RNA Guide
ggacgaaggaggcaauucgug

SEQ ID NO: 26016 - RNA, 21 nt, Artificial Sequence
  ELANE RNA Guide
ggaggcaauucguggauuagc

SEQ ID NO: 26017 - RNA, 21 nt, Artificial Sequence
  ELANE RNA Guide
ggcaauucguggauuagcccg

SEQ ID NO: 26018 - RNA, 21 nt, Artificial Sequence
  ELANE RNA Guide
ggcuaauccacgaauugccuc

SEQ ID NO: 26019 - RNA, 21 nt, Artificial Sequence
  ELANE RNA Guide
gggcuaauccacgaauugccu

SEQ ID NO: 26020 - RNA, 21 nt, Artificial Sequence
  ELANE RNA Guide
ggucugcaacgggcuaaucca

SEQ ID NO: 26021 - RNA, 21 nt, Artificial Sequence
  ELANE RNA Guide
gucugcaacgggcuaauccac

SEQ ID NO: 26022 - RNA, 21 nt, Artificial Sequence
  ELANE RNA Guide
uaauccacgaauugccuccuu

SEQ ID NO: 26023 - RNA, 21 nt, Artificial Sequence
  ELANE RNA Guide
uccacgaauugccuccuucgu

SEQ ID NO: 26024 - RNA, 21 nt, Artificial Sequence
  ELANE RNA Guide
uccccggacgaaggaggcaau

SEQ ID NO: 26025 - RNA, 21 nt, Artificial Sequence
  ELANE RNA Guide
ucguggauuagcccguugcag

SEQ ID NO: 26026 - RNA, 21 nt, Artificial Sequence
  ELANE RNA Guide
ucugcaacgggcuaauccacg

SEQ ID NO: 26027 - RNA, 21 nt, Artificial Sequence
  ELANE RNA Guide
ugcaacgggcuaauccacgaa

SEQ ID NO: 26028 - RNA, 21 nt, Artificial Sequence
  ELANE RNA Guide
uucguggauuagcccguugca

SEQ ID NO: 26029 - RNA, 22 nt, Artificial Sequence
  ELANE RNA Guide
aacgggcuaauccacgaauugc

SEQ ID NO: 26030 - RNA, 22 nt, Artificial Sequence
  ELANE RNA Guide
aaggaggcaauucguggauuag

SEQ ID NO: 26031 - RNA, 22 nt, Artificial Sequence
  ELANE RNA Guide
aauccacgaauugccuccuucg

SEQ ID NO: 26032 - RNA, 22 nt, Artificial Sequence
  ELANE RNA Guide
aauucguggauuagcccguugc

SEQ ID NO: 26033 - RNA, 22 nt, Artificial Sequence
  ELANE RNA Guide
acgaaggaggcaauucguggau

SEQ ID NO: 26034 - RNA, 22 nt, Artificial Sequence
  ELANE RNA Guide
acgaauugccuccuucguccgg

SEQ ID NO: 26035 - RNA, 22 nt, Artificial Sequence
  ELANE RNA Guide
acgggcuaauccacgaauugcc

SEQ ID NO: 26036 - RNA, 22 nt, Artificial Sequence
  ELANE RNA Guide
aggaggcaauucguggauuagc

SEQ ID NO: 26037 - RNA, 22 nt, Artificial Sequence
  ELANE RNA Guide
aggcaauucguggauuagcccg

SEQ ID NO: 26038 - RNA, 22 nt, Artificial Sequence
  ELANE RNA Guide
auccacgaauugccuccuucgu

SEQ ID NO: 26039 - RNA, 22 nt, Artificial Sequence
  ELANE RNA Guide
auucguggauuagcccguugca

SEQ ID NO: 26040 - RNA, 22 nt, Artificial Sequence
  ELANE RNA Guide
caacgggcuaauccacgaauug

SEQ ID NO: 26041 - RNA, 22 nt, Artificial Sequence
  ELANE RNA Guide
caauucguggauuagcccguug

SEQ ID NO: 26042 - RNA, 22 nt, Artificial Sequence
  ELANE RNA Guide
cacgaauugccuccuucguccg

SEQ ID NO: 26043 - RNA, 22 nt, Artificial Sequence
  ELANE RNA Guide
ccacgaauugccuccuucgucc

SEQ ID NO: 26044 - RNA, 22 nt, Artificial Sequence
  ELANE RNA Guide
cccggacgaaggaggcaauucg

SEQ ID NO: 26045 - RNA, 22 nt, Artificial Sequence
  ELANE RNA Guide
ccggacgaaggaggcaauucgu

SEQ ID NO: 26046 - RNA, 22 nt, Artificial Sequence
  ELANE RNA Guide
ccuccccggacgaaggaggcaa

SEQ ID NO: 26047 - RNA, 22 nt, Artificial Sequence
  ELANE RNA Guide
cgaaggaggcaauucguggauu

SEQ ID NO: 26048 - RNA, 22 nt, Artificial Sequence
  ELANE RNA Guide
cggacgaaggaggcaauucgug

SEQ ID NO: 26049 - RNA, 22 nt, Artificial Sequence
  ELANE RNA Guide
cgggcuaauccacgaauugccu

SEQ ID NO: 26050 - RNA, 22 nt, Artificial Sequence
  ELANE RNA Guide
cuaauccacgaauugccuccuu

SEQ ID NO: 26051 - RNA, 22 nt, Artificial Sequence
  ELANE RNA Guide
cuccccggacgaaggaggcaau

SEQ ID NO: 26052 - RNA, 22 nt, Artificial Sequence
  ELANE RNA Guide
cugcaacgggcuaauccacgaa

SEQ ID NO: 26053 - RNA, 22 nt, Artificial Sequence
  ELANE RNA Guide
gaaggaggcaauucguggauua

SEQ ID NO: 26054 - RNA, 22 nt, Artificial Sequence
  ELANE RNA Guide
gacgaaggaggcaauucgugga

SEQ ID NO: 26055 - RNA, 22 nt, Artificial Sequence
  ELANE RNA Guide
gaggcaauucguggauuagccc

SEQ ID NO: 26056 - RNA, 22 nt, Artificial Sequence
  ELANE RNA Guide
gcaacgggcuaauccacgaauu

SEQ ID NO: 26057 - RNA, 22 nt, Artificial Sequence
  ELANE RNA Guide
gcaauucguggauuagcccguu

SEQ ID NO: 26058 - RNA, 22 nt, Artificial Sequence
  ELANE RNA Guide
gcuaauccacgaauugccuccu

SEQ ID NO: 26059 - RNA, 22 nt, Artificial Sequence
  ELANE RNA Guide
ggacgaaggaggcaauucgugg

SEQ ID NO: 26060 - RNA, 22 nt, Artificial Sequence
  ELANE RNA Guide
ggaggcaauucguggauuagcc

SEQ ID NO: 26061 - RNA, 22 nt, Artificial Sequence
  ELANE RNA Guide
ggcaauucguggauuagcccgu

SEQ ID NO: 26062 - RNA, 22 nt, Artificial Sequence
  ELANE RNA Guide
ggcuaauccacgaauugccucc

SEQ ID NO: 26063 - RNA, 22 nt, Artificial Sequence
  ELANE RNA Guide
gggcuaauccacgaauugccuc

SEQ ID NO: 26064 - RNA, 22 nt, Artificial Sequence
  ELANE RNA Guide
ggucugcaacgggcuaauccac

SEQ ID NO: 26065 - RNA, 22 nt, Artificial Sequence
  ELANE RNA Guide
gucugcaacgggcuaauccacg

SEQ ID NO: 26066 - RNA, 22 nt, Artificial Sequence
  ELANE RNA Guide
uaauccacgaauugccuccuuc

SEQ ID NO: 26067 - RNA, 22 nt, Artificial Sequence
  ELANE RNA Guide
uccacgaauugccuccuucguc

SEQ ID NO: 26068 - RNA, 22 nt, Artificial Sequence
  ELANE RNA Guide
ucguggauuagcccguugcaga

SEQ ID NO: 26069 - RNA, 22 nt, Artificial Sequence
  ELANE RNA Guide
ucugcaacgggcuaauccacga

SEQ ID NO: 26070 - RNA, 22 nt, Artificial Sequence
  ELANE RNA Guide
ugcaacgggcuaauccacgaau

SEQ ID NO: 26071 - RNA, 22 nt, Artificial Sequence
  ELANE RNA Guide
uggucugcaacgggcuaaucca

SEQ ID NO: 26072 - RNA, 22 nt, Artificial Sequence
  ELANE RNA Guide
uucguggauuagcccguugcag

SEQ ID NO: 26073 - RNA, 20 nt, Artificial Sequence
  ELANE RNA Guide
aacgggcuaauccacagaau

SEQ ID NO: 26074 - RNA, 20 nt, Artificial Sequence
  ELANE RNA Guide
aaggaggcaauucuguggau

SEQ ID NO: 26075 - RNA, 20 nt, Artificial Sequence
  ELANE RNA Guide
aauccacagaauugccuccu

SEQ ID NO: 26076 - RNA, 20 nt, Artificial Sequence
  ELANE RNA Guide
aauucuguggauuagcccgu

SEQ ID NO: 26077 - RNA, 20 nt, Artificial Sequence
  ELANE RNA Guide
acagaauugccuccuucguc

SEQ ID NO: 26078 - RNA, 20 nt, Artificial Sequence
  ELANE RNA Guide
acgaaggaggcaauucugug

SEQ ID NO: 26079 - RNA, 20 nt, Artificial Sequence
  ELANE RNA Guide
acgggcuaauccacagaauu

SEQ ID NO: 26080 - RNA, 20 nt, Artificial Sequence
  ELANE RNA Guide
aggaggcaauucuguggauu

SEQ ID NO: 26081 - RNA, 20 nt, Artificial Sequence
  ELANE RNA Guide
aggcaauucuguggauuagc

SEQ ID NO: 26082 - RNA, 20 nt, Artificial Sequence
  ELANE RNA Guide
auccacagaauugccuccuu

SEQ ID NO: 26083 - RNA, 20 nt, Artificial Sequence
  ELANE RNA Guide
auucuguggauuagcccguu

SEQ ID NO: 26084 - RNA, 20 nt, Artificial Sequence
  ELANE RNA Guide
caacgggcuaauccacagaa

SEQ ID NO: 26085 - RNA, 20 nt, Artificial Sequence
  ELANE RNA Guide
caauucuguggauuagcccg

SEQ ID NO: 26086 - RNA, 20 nt, Artificial Sequence
  ELANE RNA Guide
cacagaauugccuccuucgu

SEQ ID NO: 26087 - RNA, 20 nt, Artificial Sequence
  ELANE RNA Guide
cagaauugccuccuucgucc

SEQ ID NO: 26088 - RNA, 20 nt, Artificial Sequence
  ELANE RNA Guide
ccacagaauugccuccuucg

SEQ ID NO: 26089 - RNA, 20 nt, Artificial Sequence
  ELANE RNA Guide
cgaaggaggcaauucugugg

SEQ ID NO: 26090 - RNA, 20 nt, Artificial Sequence
  ELANE RNA Guide
cggacgaaggaggcaauucu

SEQ ID NO: 26091 - RNA, 20 nt, Artificial Sequence
  ELANE RNA Guide
cgggcuaauccacagaauug

SEQ ID NO: 26092 - RNA, 20 nt, Artificial Sequence
  ELANE RNA Guide
cuaauccacagaauugccuc

SEQ ID NO: 26093 - RNA, 20 nt, Artificial Sequence
  ELANE RNA Guide
cugcaacgggcuaauccaca

SEQ ID NO: 26094 - RNA, 20 nt, Artificial Sequence
  ELANE RNA Guide
cuguggauuagcccguugca

SEQ ID NO: 26095 - RNA, 20 nt, Artificial Sequence
  ELANE RNA Guide
gaaggaggcaauucugugga

SEQ ID NO: 26096 - RNA, 20 nt, Artificial Sequence
  ELANE RNA Guide
gacgaaggaggcaauucugu

SEQ ID NO: 26097 - RNA, 20 nt, Artificial Sequence
  ELANE RNA Guide
gaggcaauucuguggauuag

SEQ ID NO: 26098 - RNA, 20 nt, Artificial Sequence
  ELANE RNA Guide
gcaacgggcuaauccacaga

SEQ ID NO: 26099 - RNA, 20 nt, Artificial Sequence
  ELANE RNA Guide
gcaauucuguggauuagccc

SEQ ID NO: 26100 - RNA, 20 nt, Artificial Sequence
  ELANE RNA Guide
gcuaauccacagaauugccu

SEQ ID NO: 26101 - RNA, 20 nt, Artificial Sequence
  ELANE RNA Guide
ggacgaaggaggcaauucug

SEQ ID NO: 26102 - RNA, 20 nt, Artificial Sequence
  ELANE RNA Guide
ggaggcaauucuguggauua

SEQ ID NO: 26103 - RNA, 20 nt, Artificial Sequence
  ELANE RNA Guide
ggcaauucuguggauuagcc

SEQ ID NO: 26104 - RNA, 20 nt, Artificial Sequence
  ELANE RNA Guide
ggcuaauccacagaauugcc

SEQ ID NO: 26105 - RNA, 20 nt, Artificial Sequence
  ELANE RNA Guide
gggcuaauccacagaauugc

SEQ ID NO: 26106 - RNA, 20 nt, Artificial Sequence
  ELANE RNA Guide
uaauccacagaauugccucc

SEQ ID NO: 26107 - RNA, 20 nt, Artificial Sequence
  ELANE RNA Guide
uccacagaauugccuccuuc

SEQ ID NO: 26108 - RNA, 20 nt, Artificial Sequence
  ELANE RNA Guide
ucuguggauuagcccguugc

SEQ ID NO: 26109 - RNA, 20 nt, Artificial Sequence
  ELANE RNA Guide
ugcaacgggcuaauccacag

SEQ ID NO: 26110 - RNA, 20 nt, Artificial Sequence
  ELANE RNA Guide
uucuguggauuagcccguug

SEQ ID NO: 26111 - RNA, 21 nt, Artificial Sequence
  ELANE RNA Guide
aacgggcuaauccacagaauu

SEQ ID NO: 26112 - RNA, 21 nt, Artificial Sequence
  ELANE RNA Guide
aaggaggcaauucuguggauu

SEQ ID NO: 26113 - RNA, 21 nt, Artificial Sequence
  ELANE RNA Guide
aauccacagaauugccuccuu

SEQ ID NO: 26114 - RNA, 21 nt, Artificial Sequence
  ELANE RNA Guide
aauucuguggauuagcccguu

SEQ ID NO: 26115 - RNA, 21 nt, Artificial Sequence
  ELANE RNA Guide
acagaauugccuccuucgucc

SEQ ID NO: 26116 - RNA, 21 nt, Artificial Sequence
  ELANE RNA Guide
acgaaggaggcaauucugugg

SEQ ID NO: 26117 - RNA, 21 nt, Artificial Sequence
  ELANE RNA Guide
acgggcuaauccacagaauug

SEQ ID NO: 26118 - RNA, 21 nt, Artificial Sequence
  ELANE RNA Guide
aggaggcaauucuguggauua

SEQ ID NO: 26119 - RNA, 21 nt, Artificial Sequence
  ELANE RNA Guide
aggcaauucuguggauuagcc

SEQ ID NO: 26120 - RNA, 21 nt, Artificial Sequence
  ELANE RNA Guide
auccacagaauugccuccuuc

SEQ ID NO: 26121 - RNA, 21 nt, Artificial Sequence
  ELANE RNA Guide
auucuguggauuagcccguug

SEQ ID NO: 26122 - RNA, 21 nt, Artificial Sequence
  ELANE RNA Guide
caacgggcuaauccacagaau

SEQ ID NO: 26123 - RNA, 21 nt, Artificial Sequence
  ELANE RNA Guide
caauucuguggauuagcccgu

SEQ ID NO: 26124 - RNA, 21 nt, Artificial Sequence
  ELANE RNA Guide
cacagaauugccuccuucguc

SEQ ID NO: 26125 - RNA, 21 nt, Artificial Sequence
  ELANE RNA Guide
cagaauugccuccuucguccg

SEQ ID NO: 26126 - RNA, 21 nt, Artificial Sequence
  ELANE RNA Guide
ccacagaauugccuccuucgu

SEQ ID NO: 26127 - RNA, 21 nt, Artificial Sequence
  ELANE RNA Guide
ccggacgaaggaggcaauucu

SEQ ID NO: 26128 - RNA, 21 nt, Artificial Sequence
  ELANE RNA Guide
cgaaggaggcaauucugugga

SEQ ID NO: 26129 - RNA, 21 nt, Artificial Sequence
  ELANE RNA Guide
cggacgaaggaggcaauucug

SEQ ID NO: 26130 - RNA, 21 nt, Artificial Sequence
  ELANE RNA Guide
cgggcuaauccacagaauugc

SEQ ID NO: 26131 - RNA, 21 nt, Artificial Sequence
  ELANE RNA Guide
cuaauccacagaauugccucc

SEQ ID NO: 26132 - RNA, 21 nt, Artificial Sequence
  ELANE RNA Guide
cugcaacgggcuaauccacag

SEQ ID NO: 26133 - RNA, 21 nt, Artificial Sequence
  ELANE RNA Guide
cuguggauuagcccguugcag

SEQ ID NO: 26134 - RNA, 21 nt, Artificial Sequence
  ELANE RNA Guide
gaaggaggcaauucuguggau

SEQ ID NO: 26135 - RNA, 21 nt, Artificial Sequence
  ELANE RNA Guide
gacgaaggaggcaauucugug

SEQ ID NO: 26136 - RNA, 21 nt, Artificial Sequence
  ELANE RNA Guide
gaggcaauucuguggauuagc

SEQ ID NO: 26137 - RNA, 21 nt, Artificial Sequence
  ELANE RNA Guide
gcaacgggcuaauccacagaa

SEQ ID NO: 26138 - RNA, 21 nt, Artificial Sequence
  ELANE RNA Guide
gcaauucuguggauuagcccg

SEQ ID NO: 26139 - RNA, 21 nt, Artificial Sequence
  ELANE RNA Guide
gcuaauccacagaauugccuc

SEQ ID NO: 26140 - RNA, 21 nt, Artificial Sequence
  ELANE RNA Guide
ggacgaaggaggcaauucugu

SEQ ID NO: 26141 - RNA, 21 nt, Artificial Sequence
  ELANE RNA Guide
ggaggcaauucuguggauuag

SEQ ID NO: 26142 - RNA, 21 nt, Artificial Sequence
  ELANE RNA Guide
ggcaauucuguggauuagccc

SEQ ID NO: 26143 - RNA, 21 nt, Artificial Sequence
  ELANE RNA Guide
ggcuaauccacagaauugccu

SEQ ID NO: 26144 - RNA, 21 nt, Artificial Sequence
  ELANE RNA Guide
gggcuaauccacagaauugcc

SEQ ID NO: 26145 - RNA, 21 nt, Artificial Sequence
  ELANE RNA Guide
uaauccacagaauugccuccu

SEQ ID NO: 26146 - RNA, 21 nt, Artificial Sequence
  ELANE RNA Guide
uccacagaauugccuccuucg

SEQ ID NO: 26147 - RNA, 21 nt, Artificial Sequence
  ELANE RNA Guide
ucugcaacgggcuaauccaca

SEQ ID NO: 26148 - RNA, 21 nt, Artificial Sequence
  ELANE RNA Guide
ucuguggauuagcccguugca

SEQ ID NO: 26149 - RNA, 21 nt, Artificial Sequence
  ELANE RNA Guide
ugcaacgggcuaauccacaga

SEQ ID NO: 26150 - RNA, 21 nt, Artificial Sequence
  ELANE RNA Guide
uucuguggauuagcccguugc

SEQ ID NO: 26151 - RNA, 22 nt, Artificial Sequence
  ELANE RNA Guide
aacgggcuaauccacagaauug

SEQ ID NO: 26152 - RNA, 22 nt, Artificial Sequence
  ELANE RNA Guide
aaggaggcaauucuguggauua

SEQ ID NO: 26153 - RNA, 22 nt, Artificial Sequence
  ELANE RNA Guide
aauccacagaauugccuccuuc

SEQ ID NO: 26154 - RNA, 22 nt, Artificial Sequence
  ELANE RNA Guide
aauucuguggauuagcccguug

SEQ ID NO: 26155 - RNA, 22 nt, Artificial Sequence
  ELANE RNA Guide
acagaauugccuccuucguccg

SEQ ID NO: 26156 - RNA, 22 nt, Artificial Sequence
  ELANE RNA Guide
acgaaggaggcaauucugugga

SEQ ID NO: 26157 - RNA, 22 nt, Artificial Sequence
  ELANE RNA Guide
acgggcuaauccacagaauugc

SEQ ID NO: 26158 - RNA, 22 nt, Artificial Sequence
  ELANE RNA Guide
aggaggcaauucuguggauuag

SEQ ID NO: 26159 - RNA, 22 nt, Artificial Sequence
  ELANE RNA Guide
aggcaauucuguggauuagccc

SEQ ID NO: 26160 - RNA, 22 nt, Artificial Sequence
  ELANE RNA Guide
auccacagaauugccuccuucg

SEQ ID NO: 26161 - RNA, 22 nt, Artificial Sequence
  ELANE RNA Guide
auucuguggauuagcccguugc

SEQ ID NO: 26162 - RNA, 22 nt, Artificial Sequence
  ELANE RNA Guide
caacgggcuaauccacagaauu

SEQ ID NO: 26163 - RNA, 22 nt, Artificial Sequence
  ELANE RNA Guide
caauucuguggauuagcccguu

SEQ ID NO: 26164 - RNA, 22 nt, Artificial Sequence
  ELANE RNA Guide
cacagaauugccuccuucgucc

SEQ ID NO: 26165 - RNA, 22 nt, Artificial Sequence
  ELANE RNA Guide
cagaauugccuccuucguccgg

SEQ ID NO: 26166 - RNA, 22 nt, Artificial Sequence
  ELANE RNA Guide
ccacagaauugccuccuucguc

SEQ ID NO: 26167 - RNA, 22 nt, Artificial Sequence
  ELANE RNA Guide
cccggacgaaggaggcaauucu

SEQ ID NO: 26168 - RNA, 22 nt, Artificial Sequence
  ELANE RNA Guide
ccggacgaaggaggcaauucug

SEQ ID NO: 26169 - RNA, 22 nt, Artificial Sequence
  ELANE RNA Guide
cgaaggaggcaauucuguggau

SEQ ID NO: 26170 - RNA, 22 nt, Artificial Sequence
  ELANE RNA Guide
cggacgaaggaggcaauucugu

SEQ ID NO: 26171 - RNA, 22 nt, Artificial Sequence
  ELANE RNA Guide
cgggcuaauccacagaauugcc

SEQ ID NO: 26172 - RNA, 22 nt, Artificial Sequence
  ELANE RNA Guide
cuaauccacagaauugccuccu

SEQ ID NO: 26173 - RNA, 22 nt, Artificial Sequence
  ELANE RNA Guide
cugcaacgggcuaauccacaga

SEQ ID NO: 26174 - RNA, 22 nt, Artificial Sequence
  ELANE RNA Guide
cuguggauuagcccguugcaga

SEQ ID NO: 26175 - RNA, 22 nt, Artificial Sequence
  ELANE RNA Guide
gaaggaggcaauucuguggauu

SEQ ID NO: 26176 - RNA, 22 nt, Artificial Sequence
  ELANE RNA Guide
gacgaaggaggcaauucugugg

SEQ ID NO: 26177 - RNA, 22 nt, Artificial Sequence
  ELANE RNA Guide
gaggcaauucuguggauuagcc

SEQ ID NO: 26178 - RNA, 22 nt, Artificial Sequence
  ELANE RNA Guide
gcaacgggcuaauccacagaau

SEQ ID NO: 26179 - RNA, 22 nt, Artificial Sequence
  ELANE RNA Guide
gcaauucuguggauuagcccgu

SEQ ID NO: 26180 - RNA, 22 nt, Artificial Sequence
  ELANE RNA Guide
gcuaauccacagaauugccucc

SEQ ID NO: 26181 - RNA, 22 nt, Artificial Sequence
  ELANE RNA Guide
ggacgaaggaggcaauucugug

SEQ ID NO: 26182 - RNA, 22 nt, Artificial Sequence
  ELANE RNA Guide
ggaggcaauucuguggauuagc

SEQ ID NO: 26183 - RNA, 22 nt, Artificial Sequence
  ELANE RNA Guide
ggcaauucuguggauuagcccg

SEQ ID NO: 26184 - RNA, 22 nt, Artificial Sequence
  ELANE RNA Guide
ggcuaauccacagaauugccuc

SEQ ID NO: 26185 - RNA, 22 nt, Artificial Sequence
  ELANE RNA Guide
gggcuaauccacagaauugccu

SEQ ID NO: 26186 - RNA, 22 nt, Artificial Sequence
  ELANE RNA Guide
gucugcaacgggcuaauccaca

SEQ ID NO: 26187 - RNA, 22 nt, Artificial Sequence
  ELANE RNA Guide
uaauccacagaauugccuccuu

SEQ ID NO: 26188 - RNA, 22 nt, Artificial Sequence
  ELANE RNA Guide
uccacagaauugccuccuucgu

SEQ ID NO: 26189 - RNA, 22 nt, Artificial Sequence
  ELANE RNA Guide
ucugcaacgggcuaauccacag

SEQ ID NO: 26190 - RNA, 22 nt, Artificial Sequence
  ELANE RNA Guide
ucuguggauuagcccguugcag

SEQ ID NO: 26191 - RNA, 22 nt, Artificial Sequence
  ELANE RNA Guide
ugcaacgggcuaauccacagaa

SEQ ID NO: 26192 - RNA, 22 nt, Artificial Sequence
  ELANE RNA Guide
uucuguggauuagcccguugca

SEQ ID NO: 26193 - RNA, 20 nt, Artificial Sequence
  ELANE RNA Guide
aacgggcuaauccaccgaau

SEQ ID NO: 26194 - RNA, 20 nt, Artificial Sequence
  ELANE RNA Guide
aaggaggcaauucgguggau

SEQ ID NO: 26195 - RNA, 20 nt, Artificial Sequence
  ELANE RNA Guide
aauccaccgaauugccuccu

SEQ ID NO: 26196 - RNA, 20 nt, Artificial Sequence
  ELANE RNA Guide
aauucgguggauuagcccgu

SEQ ID NO: 26197 - RNA, 20 nt, Artificial Sequence
  ELANE RNA Guide
accgaauugccuccuucguc

SEQ ID NO: 26198 - RNA, 20 nt, Artificial Sequence
  ELANE RNA Guide
acgaaggaggcaauucggug

SEQ ID NO: 26199 - RNA, 20 nt, Artificial Sequence
  ELANE RNA Guide
acgggcuaauccaccgaauu

SEQ ID NO: 26200 - RNA, 20 nt, Artificial Sequence
  ELANE RNA Guide
aggaggcaauucgguggauu

SEQ ID NO: 26201 - RNA, 20 nt, Artificial Sequence
  ELANE RNA Guide
aggcaauucgguggauuagc

SEQ ID NO: 26202 - RNA, 20 nt, Artificial Sequence
  ELANE RNA Guide
auccaccgaauugccuccuu

SEQ ID NO: 26203 - RNA, 20 nt, Artificial Sequence
  ELANE RNA Guide
auucgguggauuagcccguu

SEQ ID NO: 26204 - RNA, 20 nt, Artificial Sequence
  ELANE RNA Guide
caacgggcuaauccaccgaa

SEQ ID NO: 26205 - RNA, 20 nt, Artificial Sequence
  ELANE RNA Guide
caauucgguggauuagcccg

SEQ ID NO: 26206 - RNA, 20 nt, Artificial Sequence
  ELANE RNA Guide
caccgaauugccuccuucgu

SEQ ID NO: 26207 - RNA, 20 nt, Artificial Sequence
  ELANE RNA Guide
ccaccgaauugccuccuucg

SEQ ID NO: 26208 - RNA, 20 nt, Artificial Sequence
  ELANE RNA Guide
ccgaauugccuccuucgucc

SEQ ID NO: 26209 - RNA, 20 nt, Artificial Sequence
  ELANE RNA Guide
cgaaggaggcaauucggugg

SEQ ID NO: 26210 - RNA, 20 nt, Artificial Sequence
  ELANE RNA Guide
cgggcuaauccaccgaauug

SEQ ID NO: 26211 - RNA, 20 nt, Artificial Sequence
  ELANE RNA Guide
cgguggauuagcccguugca

SEQ ID NO: 26212 - RNA, 20 nt, Artificial Sequence
  ELANE RNA Guide
cuaauccaccgaauugccuc

SEQ ID NO: 26213 - RNA, 20 nt, Artificial Sequence
  ELANE RNA Guide
cugcaacgggcuaauccacc

SEQ ID NO: 26214 - RNA, 20 nt, Artificial Sequence
  ELANE RNA Guide
gaaggaggcaauucggugga

SEQ ID NO: 26215 - RNA, 20 nt, Artificial Sequence
  ELANE RNA Guide
gacgaaggaggcaauucggu

SEQ ID NO: 26216 - RNA, 20 nt, Artificial Sequence
  ELANE RNA Guide
gaggcaauucgguggauuag

SEQ ID NO: 26217 - RNA, 20 nt, Artificial Sequence
  ELANE RNA Guide
gcaacgggcuaauccaccga

SEQ ID NO: 26218 - RNA, 20 nt, Artificial Sequence
  ELANE RNA Guide
gcaauucgguggauuagccc

SEQ ID NO: 26219 - RNA, 20 nt, Artificial Sequence
  ELANE RNA Guide
gcuaauccaccgaauugccu

SEQ ID NO: 26220 - RNA, 20 nt, Artificial Sequence
  ELANE RNA Guide
ggacgaaggaggcaauucgg

SEQ ID NO: 26221 - RNA, 20 nt, Artificial Sequence
  ELANE RNA Guide
ggaggcaauucgguggauua

SEQ ID NO: 26222 - RNA, 20 nt, Artificial Sequence
  ELANE RNA Guide
ggcaauucgguggauuagcc

SEQ ID NO: 26223 - RNA, 20 nt, Artificial Sequence
  ELANE RNA Guide
ggcuaauccaccgaauugcc

SEQ ID NO: 26224 - RNA, 20 nt, Artificial Sequence
  ELANE RNA Guide
gggcuaauccaccgaauugc

SEQ ID NO: 26225 - RNA, 20 nt, Artificial Sequence
  ELANE RNA Guide
uaauccaccgaauugccucc

SEQ ID NO: 26226 - RNA, 20 nt, Artificial Sequence
  ELANE RNA Guide
uccaccgaauugccuccuuc

SEQ ID NO: 26227 - RNA, 20 nt, Artificial Sequence
  ELANE RNA Guide
ucgguggauuagcccguugc

SEQ ID NO: 26228 - RNA, 20 nt, Artificial Sequence
  ELANE RNA Guide
ugcaacgggcuaauccaccg

SEQ ID NO: 26229 - RNA, 20 nt, Artificial Sequence
  ELANE RNA Guide
uucgguggauuagcccguug

SEQ ID NO: 26230 - RNA, 21 nt, Artificial Sequence
  ELANE RNA Guide
aacgggcuaauccaccgaauu

SEQ ID NO: 26231 - RNA, 21 nt, Artificial Sequence
  ELANE RNA Guide
aaggaggcaauucgguggauu

SEQ ID NO: 26232 - RNA, 21 nt, Artificial Sequence
  ELANE RNA Guide
aauccaccgaauugccuccuu

SEQ ID NO: 26233 - RNA, 21 nt, Artificial Sequence
  ELANE RNA Guide
aauucgguggauuagcccguu

SEQ ID NO: 26234 - RNA, 21 nt, Artificial Sequence
  ELANE RNA Guide
accgaauugccuccuucgucc

SEQ ID NO: 26235 - RNA, 21 nt, Artificial Sequence
  ELANE RNA Guide
acgaaggaggcaauucggugg

SEQ ID NO: 26236 - RNA, 21 nt, Artificial Sequence
  ELANE RNA Guide
acgggcuaauccaccgaauug

SEQ ID NO: 26237 - RNA, 21 nt, Artificial Sequence
  ELANE RNA Guide
aggaggcaauucgguggauua

SEQ ID NO: 26238 - RNA, 21 nt, Artificial Sequence
  ELANE RNA Guide
aggcaauucgguggauuagcc

SEQ ID NO: 26239 - RNA, 21 nt, Artificial Sequence
  ELANE RNA Guide
auccaccgaauugccuccuuc

SEQ ID NO: 26240 - RNA, 21 nt, Artificial Sequence
  ELANE RNA Guide
auucgguggauuagcccguug

SEQ ID NO: 26241 - RNA, 21 nt, Artificial Sequence
  ELANE RNA Guide
caacgggcuaauccaccgaau

SEQ ID NO: 26242 - RNA, 21 nt, Artificial Sequence
  ELANE RNA Guide
caauucgguggauuagcccgu

SEQ ID NO: 26243 - RNA, 21 nt, Artificial Sequence
  ELANE RNA Guide
caccgaauugccuccuucguc

SEQ ID NO: 26244 - RNA, 21 nt, Artificial Sequence
  ELANE RNA Guide
ccaccgaauugccuccuucgu

SEQ ID NO: 26245 - RNA, 21 nt, Artificial Sequence
  ELANE RNA Guide
ccgaauugccuccuucguccg

SEQ ID NO: 26246 - RNA, 21 nt, Artificial Sequence
  ELANE RNA Guide
cgaaggaggcaauucggugga

SEQ ID NO: 26247 - RNA, 21 nt, Artificial Sequence
  ELANE RNA Guide
cggacgaaggaggcaauucgg

SEQ ID NO: 26248 - RNA, 21 nt, Artificial Sequence
  ELANE RNA Guide
cgggcuaauccaccgaauugc

SEQ ID NO: 26249 - RNA, 21 nt, Artificial Sequence
  ELANE RNA Guide
cgguggauuagcccguugcag

SEQ ID NO: 26250 - RNA, 21 nt, Artificial Sequence
  ELANE RNA Guide
cuaauccaccgaauugccucc

SEQ ID NO: 26251 - RNA, 21 nt, Artificial Sequence
  ELANE RNA Guide
cugcaacgggcuaauccaccg

SEQ ID NO: 26252 - RNA, 21 nt, Artificial Sequence
  ELANE RNA Guide
gaaggaggcaauucgguggau

SEQ ID NO: 26253 - RNA, 21 nt, Artificial Sequence
  ELANE RNA Guide
gacgaaggaggcaauucggug

SEQ ID NO: 26254 - RNA, 21 nt, Artificial Sequence
  ELANE RNA Guide
gaggcaauucgguggauuagc

SEQ ID NO: 26255 - RNA, 21 nt, Artificial Sequence
  ELANE RNA Guide
gcaacgggcuaauccaccgaa

SEQ ID NO: 26256 - RNA, 21 nt, Artificial Sequence
  ELANE RNA Guide
gcaauucgguggauuagcccg

SEQ ID NO: 26257 - RNA, 21 nt, Artificial Sequence
  ELANE RNA Guide
gcuaauccaccgaauugccuc

SEQ ID NO: 26258 - RNA, 21 nt, Artificial Sequence
  ELANE RNA Guide
ggacgaaggaggcaauucggu

SEQ ID NO: 26259 - RNA, 21 nt, Artificial Sequence
  ELANE RNA Guide
ggaggcaauucgguggauuag

SEQ ID NO: 26260 - RNA, 21 nt, Artificial Sequence
  ELANE RNA Guide
ggcaauucgguggauuagccc

SEQ ID NO: 26261 - RNA, 21 nt, Artificial Sequence
  ELANE RNA Guide
ggcuaauccaccgaauugccu

SEQ ID NO: 26262 - RNA, 21 nt, Artificial Sequence
  ELANE RNA Guide
gggcuaauccaccgaauugcc

SEQ ID NO: 26263 - RNA, 21 nt, Artificial Sequence
  ELANE RNA Guide
uaauccaccgaauugccuccu

SEQ ID NO: 26264 - RNA, 21 nt, Artificial Sequence
  ELANE RNA Guide
uccaccgaauugccuccuucg

SEQ ID NO: 26265 - RNA, 21 nt, Artificial Sequence
  ELANE RNA Guide
ucgguggauuagcccguugca

SEQ ID NO: 26266 - RNA, 21 nt, Artificial Sequence
  ELANE RNA Guide
ucugcaacgggcuaauccacc

SEQ ID NO: 26267 - RNA, 21 nt, Artificial Sequence
  ELANE RNA Guide
ugcaacgggcuaauccaccga

SEQ ID NO: 26268 - RNA, 21 nt, Artificial Sequence
  ELANE RNA Guide
uucgguggauuagcccguugc

SEQ ID NO: 26269 - RNA, 22 nt, Artificial Sequence
  ELANE RNA Guide
aacgggcuaauccaccgaauug

SEQ ID NO: 26270 - RNA, 22 nt, Artificial Sequence
  ELANE RNA Guide
aaggaggcaauucgguggauua

SEQ ID NO: 26271 - RNA, 22 nt, Artificial Sequence
  ELANE RNA Guide
aauccaccgaauugccuccuuc

SEQ ID NO: 26272 - RNA, 22 nt, Artificial Sequence
  ELANE RNA Guide
aauucgguggauuagcccguug

SEQ ID NO: 26273 - RNA, 22 nt, Artificial Sequence
  ELANE RNA Guide
accgaauugccuccuucguccg

SEQ ID NO: 26274 - RNA, 22 nt, Artificial Sequence
  ELANE RNA Guide
acgaaggaggcaauucggugga

SEQ ID NO: 26275 - RNA, 22 nt, Artificial Sequence
  ELANE RNA Guide
acgggcuaauccaccgaauugc

SEQ ID NO: 26276 - RNA, 22 nt, Artificial Sequence
  ELANE RNA Guide
aggaggcaauucgguggauuag

SEQ ID NO: 26277 - RNA, 22 nt, Artificial Sequence
  ELANE RNA Guide
aggcaauucgguggauuagccc

SEQ ID NO: 26278 - RNA, 22 nt, Artificial Sequence
  ELANE RNA Guide
auccaccgaauugccuccuucg

SEQ ID NO: 26279 - RNA, 22 nt, Artificial Sequence
  ELANE RNA Guide
auucgguggauuagcccguugc

SEQ ID NO: 26280 - RNA, 22 nt, Artificial Sequence
  ELANE RNA Guide
caacgggcuaauccaccgaauu

SEQ ID NO: 26281 - RNA, 22 nt, Artificial Sequence
  ELANE RNA Guide
caauucgguggauuagcccguu

SEQ ID NO: 26282 - RNA, 22 nt, Artificial Sequence
  ELANE RNA Guide
caccgaauugccuccuucgucc

SEQ ID NO: 26283 - RNA, 22 nt, Artificial Sequence
  ELANE RNA Guide
ccaccgaauugccuccuucguc

SEQ ID NO: 26284 - RNA, 22 nt, Artificial Sequence
  ELANE RNA Guide
ccgaauugccuccuucguccgg

SEQ ID NO: 26285 - RNA, 22 nt, Artificial Sequence
  ELANE RNA Guide
ccggacgaaggaggcaauucgg

SEQ ID NO: 26286 - RNA, 22 nt, Artificial Sequence
  ELANE RNA Guide
cgaaggaggcaauucgguggau

SEQ ID NO: 26287 - RNA, 22 nt, Artificial Sequence
  ELANE RNA Guide
cggacgaaggaggcaauucggu

SEQ ID NO: 26288 - RNA, 22 nt, Artificial Sequence
  ELANE RNA Guide
cgggcuaauccaccgaauugcc

SEQ ID NO: 26289 - RNA, 22 nt, Artificial Sequence
  ELANE RNA Guide
cgguggauuagcccguugcaga

SEQ ID NO: 26290 - RNA, 22 nt, Artificial Sequence
  ELANE RNA Guide
cuaauccaccgaauugccuccu

SEQ ID NO: 26291 - RNA, 22 nt, Artificial Sequence
  ELANE RNA Guide
cugcaacgggcuaauccaccga

SEQ ID NO: 26292 - RNA, 22 nt, Artificial Sequence
  ELANE RNA Guide
gaaggaggcaauucgguggauu

SEQ ID NO: 26293 - RNA, 22 nt, Artificial Sequence
  ELANE RNA Guide
gacgaaggaggcaauucggugg

SEQ ID NO: 26294 - RNA, 22 nt, Artificial Sequence
  ELANE RNA Guide
gaggcaauucgguggauuagcc

SEQ ID NO: 26295 - RNA, 22 nt, Artificial Sequence
  ELANE RNA Guide
gcaacgggcuaauccaccgaau

SEQ ID NO: 26296 - RNA, 22 nt, Artificial Sequence
  ELANE RNA Guide
gcaauucgguggauuagcccgu

SEQ ID NO: 26297 - RNA, 22 nt, Artificial Sequence
  ELANE RNA Guide
gcuaauccaccgaauugccucc

SEQ ID NO: 26298 - RNA, 22 nt, Artificial Sequence
  ELANE RNA Guide
ggacgaaggaggcaauucggug

SEQ ID NO: 26299 - RNA, 22 nt, Artificial Sequence
  ELANE RNA Guide
ggaggcaauucgguggauuagc

SEQ ID NO: 26300 - RNA, 22 nt, Artificial Sequence
  ELANE RNA Guide
ggcaauucgguggauuagcccg

SEQ ID NO: 26301 - RNA, 22 nt, Artificial Sequence
  ELANE RNA Guide
ggcuaauccaccgaauugccuc

SEQ ID NO: 26302 - RNA, 22 nt, Artificial Sequence
  ELANE RNA Guide
gggcuaauccaccgaauugccu

SEQ ID NO: 26303 - RNA, 22 nt, Artificial Sequence
  ELANE RNA Guide
gucugcaacgggcuaauccacc

SEQ ID NO: 26304 - RNA, 22 nt, Artificial Sequence
  ELANE RNA Guide
uaauccaccgaauugccuccuu

SEQ ID NO: 26305 - RNA, 22 nt, Artificial Sequence
  ELANE RNA Guide
uccaccgaauugccuccuucgu

SEQ ID NO: 26306 - RNA, 22 nt, Artificial Sequence
  ELANE RNA Guide
ucgguggauuagcccguugcag

SEQ ID NO: 26307 - RNA, 22 nt, Artificial Sequence
  ELANE RNA Guide
ucugcaacgggcuaauccaccg

SEQ ID NO: 26308 - RNA, 22 nt, Artificial Sequence
  ELANE RNA Guide
ugcaacgggcuaauccaccgaa

SEQ ID NO: 26309 - RNA, 22 nt, Artificial Sequence
  ELANE RNA Guide
uucgguggauuagcccguugca

SEQ ID NO: 26310 - RNA, 20 nt, Artificial Sequence
  ELANE RNA Guide
aacgggcuaauccacugaau

SEQ ID NO: 26311 - RNA, 20 nt, Artificial Sequence
  ELANE RNA Guide
aaggaggcaauucaguggau

SEQ ID NO: 26312 - RNA, 20 nt, Artificial Sequence
  ELANE RNA Guide
aauccacugaauugccuccu

SEQ ID NO: 26313 - RNA, 20 nt, Artificial Sequence
  ELANE RNA Guide
aauucaguggauuagcccgu

SEQ ID NO: 26314 - RNA, 20 nt, Artificial Sequence
  ELANE RNA Guide
acgaaggaggcaauucagug

SEQ ID NO: 26315 - RNA, 20 nt, Artificial Sequence
  ELANE RNA Guide
acgggcuaauccacugaauu

SEQ ID NO: 26316 - RNA, 20 nt, Artificial Sequence
  ELANE RNA Guide
acugaauugccuccuucguc

SEQ ID NO: 26317 - RNA, 20 nt, Artificial Sequence
  ELANE RNA Guide
aggaggcaauucaguggauu

SEQ ID NO: 26318 - RNA, 20 nt, Artificial Sequence
  ELANE RNA Guide
aggcaauucaguggauuagc

SEQ ID NO: 26319 - RNA, 20 nt, Artificial Sequence
  ELANE RNA Guide
auccacugaauugccuccuu

SEQ ID NO: 26320 - RNA, 20 nt, Artificial Sequence
  ELANE RNA Guide
auucaguggauuagcccguu

SEQ ID NO: 26321 - RNA, 20 nt, Artificial Sequence
  ELANE RNA Guide
caacgggcuaauccacugaa

SEQ ID NO: 26322 - RNA, 20 nt, Artificial Sequence
  ELANE RNA Guide
caauucaguggauuagcccg

SEQ ID NO: 26323 - RNA, 20 nt, Artificial Sequence
  ELANE RNA Guide
cacugaauugccuccuucgu

SEQ ID NO: 26324 - RNA, 20 nt, Artificial Sequence
  ELANE RNA Guide
caguggauuagcccguugca

SEQ ID NO: 26325 - RNA, 20 nt, Artificial Sequence
  ELANE RNA Guide
ccacugaauugccuccuucg

SEQ ID NO: 26326 - RNA, 20 nt, Artificial Sequence
  ELANE RNA Guide
cgaaggaggcaauucagugg

SEQ ID NO: 26327 - RNA, 20 nt, Artificial Sequence
  ELANE RNA Guide
cggacgaaggaggcaauuca

SEQ ID NO: 26328 - RNA, 20 nt, Artificial Sequence
  ELANE RNA Guide
cgggcuaauccacugaauug

SEQ ID NO: 26329 - RNA, 20 nt, Artificial Sequence
  ELANE RNA Guide
cuaauccacugaauugccuc

SEQ ID NO: 26330 - RNA, 20 nt, Artificial Sequence
  ELANE RNA Guide
cugaauugccuccuucgucc

SEQ ID NO: 26331 - RNA, 20 nt, Artificial Sequence
  ELANE RNA Guide
cugcaacgggcuaauccacu

SEQ ID NO: 26332 - RNA, 20 nt, Artificial Sequence
  ELANE RNA Guide
gaaggaggcaauucagugga

SEQ ID NO: 26333 - RNA, 20 nt, Artificial Sequence
  ELANE RNA Guide
gacgaaggaggcaauucagu

SEQ ID NO: 26334 - RNA, 20 nt, Artificial Sequence
  ELANE RNA Guide
gaggcaauucaguggauuag

SEQ ID NO: 26335 - RNA, 20 nt, Artificial Sequence
  ELANE RNA Guide
gcaacgggcuaauccacuga

SEQ ID NO: 26336 - RNA, 20 nt, Artificial Sequence
  ELANE RNA Guide
gcaauucaguggauuagccc

SEQ ID NO: 26337 - RNA, 20 nt, Artificial Sequence
  ELANE RNA Guide
gcuaauccacugaauugccu

SEQ ID NO: 26338 - RNA, 20 nt, Artificial Sequence
  ELANE RNA Guide
ggacgaaggaggcaauucag

SEQ ID NO: 26339 - RNA, 20 nt, Artificial Sequence
  ELANE RNA Guide
ggaggcaauucaguggauua

SEQ ID NO: 26340 - RNA, 20 nt, Artificial Sequence
  ELANE RNA Guide
ggcaauucaguggauuagcc

SEQ ID NO: 26341 - RNA, 20 nt, Artificial Sequence
  ELANE RNA Guide
ggcuaauccacugaauugcc

SEQ ID NO: 26342 - RNA, 20 nt, Artificial Sequence
  ELANE RNA Guide
gggcuaauccacugaauugc

SEQ ID NO: 26343 - RNA, 20 nt, Artificial Sequence
  ELANE RNA Guide
uaauccacugaauugccucc

SEQ ID NO: 26344 - RNA, 20 nt, Artificial Sequence
  ELANE RNA Guide
ucaguggauuagcccguugc

SEQ ID NO: 26345 - RNA, 20 nt, Artificial Sequence
  ELANE RNA Guide
uccacugaauugccuccuuc

SEQ ID NO: 26346 - RNA, 20 nt, Artificial Sequence
  ELANE RNA Guide
ugcaacgggcuaauccacug

SEQ ID NO: 26347 - RNA, 20 nt, Artificial Sequence
  ELANE RNA Guide
uucaguggauuagcccguug

SEQ ID NO: 26348 - RNA, 21 nt, Artificial Sequence
  ELANE RNA Guide
aacgggcuaauccacugaauu

SEQ ID NO: 26349 - RNA, 21 nt, Artificial Sequence
  ELANE RNA Guide
aaggaggcaauucaguggauu

SEQ ID NO: 26350 - RNA, 21 nt, Artificial Sequence
  ELANE RNA Guide
aauccacugaauugccuccuu

SEQ ID NO: 26351 - RNA, 21 nt, Artificial Sequence
  ELANE RNA Guide
aauucaguggauuagcccguu

SEQ ID NO: 26352 - RNA, 21 nt, Artificial Sequence
  ELANE RNA Guide
acgaaggaggcaauucagugg

SEQ ID NO: 26353 - RNA, 21 nt, Artificial Sequence
  ELANE RNA Guide
acgggcuaauccacugaauug

SEQ ID NO: 26354 - RNA, 21 nt, Artificial Sequence
  ELANE RNA Guide
acugaauugccuccuucgucc

SEQ ID NO: 26355 - RNA, 21 nt, Artificial Sequence
  ELANE RNA Guide
aggaggcaauucaguggauua

SEQ ID NO: 26356 - RNA, 21 nt, Artificial Sequence
  ELANE RNA Guide
aggcaauucaguggauuagcc

SEQ ID NO: 26357 - RNA, 21 nt, Artificial Sequence
  ELANE RNA Guide
auccacugaauugccuccuuc

SEQ ID NO: 26358 - RNA, 21 nt, Artificial Sequence
  ELANE RNA Guide
auucaguggauuagcccguug

SEQ ID NO: 26359 - RNA, 21 nt, Artificial Sequence
  ELANE RNA Guide
caacgggcuaauccacugaau

SEQ ID NO: 26360 - RNA, 21 nt, Artificial Sequence
  ELANE RNA Guide
caauucaguggauuagcccgu

SEQ ID NO: 26361 - RNA, 21 nt, Artificial Sequence
  ELANE RNA Guide
cacugaauugccuccuucguc

SEQ ID NO: 26362 - RNA, 21 nt, Artificial Sequence
  ELANE RNA Guide
caguggauuagcccguugcag

SEQ ID NO: 26363 - RNA, 21 nt, Artificial Sequence
  ELANE RNA Guide
ccacugaauugccuccuucgu

SEQ ID NO: 26364 - RNA, 21 nt, Artificial Sequence
  ELANE RNA Guide
ccggacgaaggaggcaauuca

SEQ ID NO: 26365 - RNA, 21 nt, Artificial Sequence
  ELANE RNA Guide
cgaaggaggcaauucagugga

SEQ ID NO: 26366 - RNA, 21 nt, Artificial Sequence
  ELANE RNA Guide
cggacgaaggaggcaauucag

SEQ ID NO: 26367 - RNA, 21 nt, Artificial Sequence
  ELANE RNA Guide
cgggcuaauccacugaauugc

SEQ ID NO: 26368 - RNA, 21 nt, Artificial Sequence
  ELANE RNA Guide
cuaauccacugaauugccucc

SEQ ID NO: 26369 - RNA, 21 nt, Artificial Sequence
  ELANE RNA Guide
cugaauugccuccuucguccg

SEQ ID NO: 26370 - RNA, 21 nt, Artificial Sequence
  ELANE RNA Guide
cugcaacgggcuaauccacug

SEQ ID NO: 26371 - RNA, 21 nt, Artificial Sequence
  ELANE RNA Guide
gaaggaggcaauucaguggau

SEQ ID NO: 26372 - RNA, 21 nt, Artificial Sequence
  ELANE RNA Guide
gacgaaggaggcaauucagug

SEQ ID NO: 26373 - RNA, 21 nt, Artificial Sequence
  ELANE RNA Guide
gaggcaauucaguggauuagc

SEQ ID NO: 26374 - RNA, 21 nt, Artificial Sequence
  ELANE RNA Guide
gcaacgggcuaauccacugaa

SEQ ID NO: 26375 - RNA, 21 nt, Artificial Sequence
  ELANE RNA Guide
gcaauucaguggauuagcccg

SEQ ID NO: 26376 - RNA, 21 nt, Artificial Sequence
  ELANE RNA Guide
gcuaauccacugaauugccuc

SEQ ID NO: 26377 - RNA, 21 nt, Artificial Sequence
  ELANE RNA Guide
ggacgaaggaggcaauucagu

SEQ ID NO: 26378 - RNA, 21 nt, Artificial Sequence
  ELANE RNA Guide
ggaggcaauucaguggauuag

SEQ ID NO: 26379 - RNA, 21 nt, Artificial Sequence
  ELANE RNA Guide
ggcaauucaguggauuagccc

SEQ ID NO: 26380 - RNA, 21 nt, Artificial Sequence
  ELANE RNA Guide
ggcuaauccacugaauugccu

SEQ ID NO: 26381 - RNA, 21 nt, Artificial Sequence
  ELANE RNA Guide
gggcuaauccacugaauugcc

SEQ ID NO: 26382 - RNA, 21 nt, Artificial Sequence
  ELANE RNA Guide
uaauccacugaauugccuccu

SEQ ID NO: 26383 - RNA, 21 nt, Artificial Sequence
  ELANE RNA Guide
ucaguggauuagcccguugca

SEQ ID NO: 26384 - RNA, 21 nt, Artificial Sequence
  ELANE RNA Guide
uccacugaauugccuccuucg

SEQ ID NO: 26385 - RNA, 21 nt, Artificial Sequence
  ELANE RNA Guide
ucugcaacgggcuaauccacu

SEQ ID NO: 26386 - RNA, 21 nt, Artificial Sequence
  ELANE RNA Guide
ugcaacgggcuaauccacuga

SEQ ID NO: 26387 - RNA, 21 nt, Artificial Sequence
  ELANE RNA Guide
uucaguggauuagcccguugc

SEQ ID NO: 26388 - RNA, 22 nt, Artificial Sequence
  ELANE RNA Guide
aacgggcuaauccacugaauug

SEQ ID NO: 26389 - RNA, 22 nt, Artificial Sequence
  ELANE RNA Guide
aaggaggcaauucaguggauua

SEQ ID NO: 26390 - RNA, 22 nt, Artificial Sequence
  ELANE RNA Guide
aauccacugaauugccuccuuc

SEQ ID NO: 26391 - RNA, 22 nt, Artificial Sequence
  ELANE RNA Guide
aauucaguggauuagcccguug

SEQ ID NO: 26392 - RNA, 22 nt, Artificial Sequence
  ELANE RNA Guide
acgaaggaggcaauucagugga

SEQ ID NO: 26393 - RNA, 22 nt, Artificial Sequence
  ELANE RNA Guide
acgggcuaauccacugaauugc

SEQ ID NO: 26394 - RNA, 22 nt, Artificial Sequence
  ELANE RNA Guide
acugaauugccuccuucguccg

SEQ ID NO: 26395 - RNA, 22 nt, Artificial Sequence
  ELANE RNA Guide
aggaggcaauucaguggauuag

SEQ ID NO: 26396 - RNA, 22 nt, Artificial Sequence
  ELANE RNA Guide
aggcaauucaguggauuagccc

SEQ ID NO: 26397 - RNA, 22 nt, Artificial Sequence
  ELANE RNA Guide
auccacugaauugccuccuucg

SEQ ID NO: 26398 - RNA, 22 nt, Artificial Sequence
  ELANE RNA Guide
auucaguggauuagcccguugc

SEQ ID NO: 26399 - RNA, 22 nt, Artificial Sequence
  ELANE RNA Guide
caacgggcuaauccacugaauu

SEQ ID NO: 26400 - RNA, 22 nt, Artificial Sequence
  ELANE RNA Guide
caauucaguggauuagcccguu

SEQ ID NO: 26401 - RNA, 22 nt, Artificial Sequence
  ELANE RNA Guide
cacugaauugccuccuucgucc

SEQ ID NO: 26402 - RNA, 22 nt, Artificial Sequence
  ELANE RNA Guide
caguggauuagcccguugcaga

SEQ ID NO: 26403 - RNA, 22 nt, Artificial Sequence
  ELANE RNA Guide
ccacugaauugccuccuucguc

SEQ ID NO: 26404 - RNA, 22 nt, Artificial Sequence
  ELANE RNA Guide
cccggacgaaggaggcaauuca

SEQ ID NO: 26405 - RNA, 22 nt, Artificial Sequence
  ELANE RNA Guide
ccggacgaaggaggcaauucag

SEQ ID NO: 26406 - RNA, 22 nt, Artificial Sequence
  ELANE RNA Guide
cgaaggaggcaauucaguggau

SEQ ID NO: 26407 - RNA, 22 nt, Artificial Sequence
  ELANE RNA Guide
cggacgaaggaggcaauucagu

SEQ ID NO: 26408 - RNA, 22 nt, Artificial Sequence
  ELANE RNA Guide
cgggcuaauccacugaauugcc

SEQ ID NO: 26409 - RNA, 22 nt, Artificial Sequence
  ELANE RNA Guide
cuaauccacugaauugccuccu

SEQ ID NO: 26410 - RNA, 22 nt, Artificial Sequence
  ELANE RNA Guide
cugaauugccuccuucguccgg

SEQ ID NO: 26411 - RNA, 22 nt, Artificial Sequence
  ELANE RNA Guide
cugcaacgggcuaauccacuga

SEQ ID NO: 26412 - RNA, 22 nt, Artificial Sequence
  ELANE RNA Guide
gaaggaggcaauucaguggauu

SEQ ID NO: 26413 - RNA, 22 nt, Artificial Sequence
  ELANE RNA Guide
gacgaaggaggcaauucagugg

SEQ ID NO: 26414 - RNA, 22 nt, Artificial Sequence
  ELANE RNA Guide
gaggcaauucaguggauuagcc

SEQ ID NO: 26415 - RNA, 22 nt, Artificial Sequence
  ELANE RNA Guide
gcaacgggcuaauccacugaau

SEQ ID NO: 26416 - RNA, 22 nt, Artificial Sequence
  ELANE RNA Guide
gcaauucaguggauuagcccgu

SEQ ID NO: 26417 - RNA, 22 nt, Artificial Sequence
  ELANE RNA Guide
gcuaauccacugaauugccucc

SEQ ID NO: 26418 - RNA, 22 nt, Artificial Sequence
  ELANE RNA Guide
ggacgaaggaggcaauucagug

SEQ ID NO: 26419 - RNA, 22 nt, Artificial Sequence
  ELANE RNA Guide
ggaggcaauucaguggauuagc

SEQ ID NO: 26420 - RNA, 22 nt, Artificial Sequence
  ELANE RNA Guide
ggcaauucaguggauuagcccg

SEQ ID NO: 26421 - RNA, 22 nt, Artificial Sequence
  ELANE RNA Guide
ggcuaauccacugaauugccuc

SEQ ID NO: 26422 - RNA, 22 nt, Artificial Sequence
  ELANE RNA Guide
gggcuaauccacugaauugccu

SEQ ID NO: 26423 - RNA, 22 nt, Artificial Sequence
  ELANE RNA Guide
gucugcaacgggcuaauccacu

SEQ ID NO: 26424 - RNA, 22 nt, Artificial Sequence
  ELANE RNA Guide
uaauccacugaauugccuccuu

SEQ ID NO: 26425 - RNA, 22 nt, Artificial Sequence
  ELANE RNA Guide
ucaguggauuagcccguugcag

SEQ ID NO: 26426 - RNA, 22 nt, Artificial Sequence
  ELANE RNA Guide
uccacugaauugccuccuucgu

SEQ ID NO: 26427 - RNA, 22 nt, Artificial Sequence
  ELANE RNA Guide
ucugcaacgggcuaauccacug

SEQ ID NO: 26428 - RNA, 22 nt, Artificial Sequence
  ELANE RNA Guide
ugcaacgggcuaauccacugaa

SEQ ID NO: 26429 - RNA, 22 nt, Artificial Sequence
  ELANE RNA Guide
uucaguggauuagcccguugca

SEQ ID NO: 26430 - RNA, 20 nt, Artificial Sequence
  ELANE RNA Guide
aacgggcuaauccacgaaau

SEQ ID NO: 26431 - RNA, 20 nt, Artificial Sequence
  ELANE RNA Guide
aaggaggcaauuucguggau

SEQ ID NO: 26432 - RNA, 20 nt, Artificial Sequence
  ELANE RNA Guide
aauccacgaaauugccuccu

SEQ ID NO: 26433 - RNA, 20 nt, Artificial Sequence
  ELANE RNA Guide
aauuucguggauuagcccgu

SEQ ID NO: 26434 - RNA, 20 nt, Artificial Sequence
  ELANE RNA Guide
acgaaauugccuccuucguc

SEQ ID NO: 26435 - RNA, 20 nt, Artificial Sequence
  ELANE RNA Guide
acgaaggaggcaauuucgug

SEQ ID NO: 26436 - RNA, 20 nt, Artificial Sequence
  ELANE RNA Guide
acgggcuaauccacgaaauu

SEQ ID NO: 26437 - RNA, 20 nt, Artificial Sequence
  ELANE RNA Guide
aggaggcaauuucguggauu

SEQ ID NO: 26438 - RNA, 20 nt, Artificial Sequence
  ELANE RNA Guide
aggcaauuucguggauuagc

SEQ ID NO: 26439 - RNA, 20 nt, Artificial Sequence
  ELANE RNA Guide
auccacgaaauugccuccuu

SEQ ID NO: 26440 - RNA, 20 nt, Artificial Sequence
  ELANE RNA Guide
auuucguggauuagcccguu

SEQ ID NO: 26441 - RNA, 20 nt, Artificial Sequence
  ELANE RNA Guide
caacgggcuaauccacgaaa

SEQ ID NO: 26442 - RNA, 20 nt, Artificial Sequence
  ELANE RNA Guide
caauuucguggauuagcccg

SEQ ID NO: 26443 - RNA, 20 nt, Artificial Sequence
  ELANE RNA Guide
cacgaaauugccuccuucgu

SEQ ID NO: 26444 - RNA, 20 nt, Artificial Sequence
  ELANE RNA Guide
ccacgaaauugccuccuucg

SEQ ID NO: 26445 - RNA, 20 nt, Artificial Sequence
  ELANE RNA Guide
ccggacgaaggaggcaauuu

SEQ ID NO: 26446 - RNA, 20 nt, Artificial Sequence
  ELANE RNA Guide
cgaaauugccuccuucgucc

SEQ ID NO: 26447 - RNA, 20 nt, Artificial Sequence
  ELANE RNA Guide
cgaaggaggcaauuucgugg

SEQ ID NO: 26448 - RNA, 20 nt, Artificial Sequence
  ELANE RNA Guide
cggacgaaggaggcaauuuc

SEQ ID NO: 26449 - RNA, 20 nt, Artificial Sequence
  ELANE RNA Guide
cgggcuaauccacgaaauug

SEQ ID NO: 26450 - RNA, 20 nt, Artificial Sequence
  ELANE RNA Guide
cuaauccacgaaauugccuc

SEQ ID NO: 26451 - RNA, 20 nt, Artificial Sequence
  ELANE RNA Guide
cuccccggacgaaggaggca

SEQ ID NO: 26452 - RNA, 20 nt, Artificial Sequence
  ELANE RNA Guide
gaaauugccuccuucguccg

SEQ ID NO: 26453 - RNA, 20 nt, Artificial Sequence
  ELANE RNA Guide
gaaggaggcaauuucgugga

SEQ ID NO: 26454 - RNA, 20 nt, Artificial Sequence
  ELANE RNA Guide
gacgaaggaggcaauuucgu

SEQ ID NO: 26455 - RNA, 20 nt, Artificial Sequence
  ELANE RNA Guide
gaggcaauuucguggauuag

SEQ ID NO: 26456 - RNA, 20 nt, Artificial Sequence
  ELANE RNA Guide
gcaauuucguggauuagccc

SEQ ID NO: 26457 - RNA, 20 nt, Artificial Sequence
  ELANE RNA Guide
gcuaauccacgaaauugccu

SEQ ID NO: 26458 - RNA, 20 nt, Artificial Sequence
  ELANE RNA Guide
ggacgaaggaggcaauuucg

SEQ ID NO: 26459 - RNA, 20 nt, Artificial Sequence
  ELANE RNA Guide
ggaggcaauuucguggauua

SEQ ID NO: 26460 - RNA, 20 nt, Artificial Sequence
  ELANE RNA Guide
ggcaauuucguggauuagcc

SEQ ID NO: 26461 - RNA, 20 nt, Artificial Sequence
  ELANE RNA Guide
ggcuaauccacgaaauugcc

SEQ ID NO: 26462 - RNA, 20 nt, Artificial Sequence
  ELANE RNA Guide
gggcuaauccacgaaauugc

SEQ ID NO: 26463 - RNA, 20 nt, Artificial Sequence
  ELANE RNA Guide
uaauccacgaaauugccucc

SEQ ID NO: 26464 - RNA, 20 nt, Artificial Sequence
  ELANE RNA Guide
uccacgaaauugccuccuuc

SEQ ID NO: 26465 - RNA, 20 nt, Artificial Sequence
  ELANE RNA Guide
uuucguggauuagcccguug

SEQ ID NO: 26466 - RNA, 21 nt, Artificial Sequence
  ELANE RNA Guide
aacgggcuaauccacgaaauu

SEQ ID NO: 26467 - RNA, 21 nt, Artificial Sequence
  ELANE RNA Guide
aaggaggcaauuucguggauu

SEQ ID NO: 26468 - RNA, 21 nt, Artificial Sequence
  ELANE RNA Guide
aauccacgaaauugccuccuu

SEQ ID NO: 26469 - RNA, 21 nt, Artificial Sequence
  ELANE RNA Guide
aauuucguggauuagcccguu

SEQ ID NO: 26470 - RNA, 21 nt, Artificial Sequence
  ELANE RNA Guide
acgaaauugccuccuucgucc

SEQ ID NO: 26471 - RNA, 21 nt, Artificial Sequence
  ELANE RNA Guide
acgaaggaggcaauuucgugg

SEQ ID NO: 26472 - RNA, 21 nt, Artificial Sequence
  ELANE RNA Guide
acgggcuaauccacgaaauug

SEQ ID NO: 26473 - RNA, 21 nt, Artificial Sequence
  ELANE RNA Guide
aggaggcaauuucguggauua

SEQ ID NO: 26474 - RNA, 21 nt, Artificial Sequence
  ELANE RNA Guide
aggcaauuucguggauuagcc

SEQ ID NO: 26475 - RNA, 21 nt, Artificial Sequence
  ELANE RNA Guide
auccacgaaauugccuccuuc

SEQ ID NO: 26476 - RNA, 21 nt, Artificial Sequence
  ELANE RNA Guide
auuucguggauuagcccguug

SEQ ID NO: 26477 - RNA, 21 nt, Artificial Sequence
  ELANE RNA Guide
caacgggcuaauccacgaaau

SEQ ID NO: 26478 - RNA, 21 nt, Artificial Sequence
  ELANE RNA Guide
caauuucguggauuagcccgu

SEQ ID NO: 26479 - RNA, 21 nt, Artificial Sequence
  ELANE RNA Guide
cacgaaauugccuccuucguc

SEQ ID NO: 26480 - RNA, 21 nt, Artificial Sequence
  ELANE RNA Guide
ccacgaaauugccuccuucgu

SEQ ID NO: 26481 - RNA, 21 nt, Artificial Sequence
  ELANE RNA Guide
cccggacgaaggaggcaauuu

SEQ ID NO: 26482 - RNA, 21 nt, Artificial Sequence
  ELANE RNA Guide
ccggacgaaggaggcaauuuc

SEQ ID NO: 26483 - RNA, 21 nt, Artificial Sequence
  ELANE RNA Guide
ccuccccggacgaaggaggca

SEQ ID NO: 26484 - RNA, 21 nt, Artificial Sequence
  ELANE RNA Guide
cgaaauugccuccuucguccg

SEQ ID NO: 26485 - RNA, 21 nt, Artificial Sequence
  ELANE RNA Guide
cgaaggaggcaauuucgugga

SEQ ID NO: 26486 - RNA, 21 nt, Artificial Sequence
  ELANE RNA Guide
cggacgaaggaggcaauuucg

SEQ ID NO: 26487 - RNA, 21 nt, Artificial Sequence
  ELANE RNA Guide
cgggcuaauccacgaaauugc

SEQ ID NO: 26488 - RNA, 21 nt, Artificial Sequence
  ELANE RNA Guide
cuaauccacgaaauugccucc

SEQ ID NO: 26489 - RNA, 21 nt, Artificial Sequence
  ELANE RNA Guide
gaaauugccuccuucguccgg

SEQ ID NO: 26490 - RNA, 21 nt, Artificial Sequence
  ELANE RNA Guide
gaaggaggcaauuucguggau

SEQ ID NO: 26491 - RNA, 21 nt, Artificial Sequence
  ELANE RNA Guide
gacgaaggaggcaauuucgug

SEQ ID NO: 26492 - RNA, 21 nt, Artificial Sequence
  ELANE RNA Guide
gaggcaauuucguggauuagc

SEQ ID NO: 26493 - RNA, 21 nt, Artificial Sequence
  ELANE RNA Guide
gcaacgggcuaauccacgaaa

SEQ ID NO: 26494 - RNA, 21 nt, Artificial Sequence
  ELANE RNA Guide
gcaauuucguggauuagcccg

SEQ ID NO: 26495 - RNA, 21 nt, Artificial Sequence
  ELANE RNA Guide
gcuaauccacgaaauugccuc

SEQ ID NO: 26496 - RNA, 21 nt, Artificial Sequence
  ELANE RNA Guide
ggacgaaggaggcaauuucgu

SEQ ID NO: 26497 - RNA, 21 nt, Artificial Sequence
  ELANE RNA Guide
ggaggcaauuucguggauuag

SEQ ID NO: 26498 - RNA, 21 nt, Artificial Sequence
  ELANE RNA Guide
ggcaauuucguggauuagccc

SEQ ID NO: 26499 - RNA, 21 nt, Artificial Sequence
  ELANE RNA Guide
ggcuaauccacgaaauugccu

SEQ ID NO: 26500 - RNA, 21 nt, Artificial Sequence
  ELANE RNA Guide
gggcuaauccacgaaauugcc

SEQ ID NO: 26501 - RNA, 21 nt, Artificial Sequence
  ELANE RNA Guide
uaauccacgaaauugccuccu

SEQ ID NO: 26502 - RNA, 21 nt, Artificial Sequence
  ELANE RNA Guide
uccacgaaauugccuccuucg

SEQ ID NO: 26503 - RNA, 21 nt, Artificial Sequence
  ELANE RNA Guide
uuucguggauuagcccguugc

SEQ ID NO: 26504 - RNA, 22 nt, Artificial Sequence
  ELANE RNA Guide
aacgggcuaauccacgaaauug

SEQ ID NO: 26505 - RNA, 22 nt, Artificial Sequence
  ELANE RNA Guide
aaggaggcaauuucguggauua

SEQ ID NO: 26506 - RNA, 22 nt, Artificial Sequence
  ELANE RNA Guide
aauccacgaaauugccuccuuc

SEQ ID NO: 26507 - RNA, 22 nt, Artificial Sequence
  ELANE RNA Guide
aauuucguggauuagcccguug

SEQ ID NO: 26508 - RNA, 22 nt, Artificial Sequence
  ELANE RNA Guide
acgaaauugccuccuucguccg

SEQ ID NO: 26509 - RNA, 22 nt, Artificial Sequence
  ELANE RNA Guide
acgaaggaggcaauuucgugga

SEQ ID NO: 26510 - RNA, 22 nt, Artificial Sequence
  ELANE RNA Guide
acgggcuaauccacgaaauugc

SEQ ID NO: 26511 - RNA, 22 nt, Artificial Sequence
  ELANE RNA Guide
aggaggcaauuucguggauuag

SEQ ID NO: 26512 - RNA, 22 nt, Artificial Sequence
  ELANE RNA Guide
aggcaauuucguggauuagccc

SEQ ID NO: 26513 - RNA, 22 nt, Artificial Sequence
  ELANE RNA Guide
auccacgaaauugccuccuucg

SEQ ID NO: 26514 - RNA, 22 nt, Artificial Sequence
  ELANE RNA Guide
auuucguggauuagcccguugc

SEQ ID NO: 26515 - RNA, 22 nt, Artificial Sequence
  ELANE RNA Guide
caacgggcuaauccacgaaauu

SEQ ID NO: 26516 - RNA, 22 nt, Artificial Sequence
  ELANE RNA Guide
caauuucguggauuagcccguu

SEQ ID NO: 26517 - RNA, 22 nt, Artificial Sequence
  ELANE RNA Guide
cacgaaauugccuccuucgucc

SEQ ID NO: 26518 - RNA, 22 nt, Artificial Sequence
  ELANE RNA Guide
ccacgaaauugccuccuucguc

SEQ ID NO: 26519 - RNA, 22 nt, Artificial Sequence
  ELANE RNA Guide
ccccggacgaaggaggcaauuu

SEQ ID NO: 26520 - RNA, 22 nt, Artificial Sequence
  ELANE RNA Guide
cccggacgaaggaggcaauuuc

SEQ ID NO: 26521 - RNA, 22 nt, Artificial Sequence
  ELANE RNA Guide
ccggacgaaggaggcaauuucg

SEQ ID NO: 26522 - RNA, 22 nt, Artificial Sequence
  ELANE RNA Guide
cgaaauugccuccuucguccgg

SEQ ID NO: 26523 - RNA, 22 nt, Artificial Sequence
  ELANE RNA Guide
cgaaggaggcaauuucguggau

SEQ ID NO: 26524 - RNA, 22 nt, Artificial Sequence
  ELANE RNA Guide
cggacgaaggaggcaauuucgu

SEQ ID NO: 26525 - RNA, 22 nt, Artificial Sequence
  ELANE RNA Guide
cgggcuaauccacgaaauugcc

SEQ ID NO: 26526 - RNA, 22 nt, Artificial Sequence
  ELANE RNA Guide
cuaauccacgaaauugccuccu

SEQ ID NO: 26527 - RNA, 22 nt, Artificial Sequence
  ELANE RNA Guide
gaaauugccuccuucguccggg

SEQ ID NO: 26528 - RNA, 22 nt, Artificial Sequence
  ELANE RNA Guide
gaaggaggcaauuucguggauu

SEQ ID NO: 26529 - RNA, 22 nt, Artificial Sequence
  ELANE RNA Guide
gacgaaggaggcaauuucgugg

SEQ ID NO: 26530 - RNA, 22 nt, Artificial Sequence
  ELANE RNA Guide
gaggcaauuucguggauuagcc

SEQ ID NO: 26531 - RNA, 22 nt, Artificial Sequence
  ELANE RNA Guide
gcaacgggcuaauccacgaaau

SEQ ID NO: 26532 - RNA, 22 nt, Artificial Sequence
  ELANE RNA Guide
gcaauuucguggauuagcccgu

SEQ ID NO: 26533 - RNA, 22 nt, Artificial Sequence
  ELANE RNA Guide
gccuccccggacgaaggaggca

SEQ ID NO: 26534 - RNA, 22 nt, Artificial Sequence
  ELANE RNA Guide
gcuaauccacgaaauugccucc

SEQ ID NO: 26535 - RNA, 22 nt, Artificial Sequence
  ELANE RNA Guide
ggacgaaggaggcaauuucgug

SEQ ID NO: 26536 - RNA, 22 nt, Artificial Sequence
  ELANE RNA Guide
ggaggcaauuucguggauuagc

SEQ ID NO: 26537 - RNA, 22 nt, Artificial Sequence
  ELANE RNA Guide
ggcaauuucguggauuagcccg

SEQ ID NO: 26538 - RNA, 22 nt, Artificial Sequence
  ELANE RNA Guide
ggcuaauccacgaaauugccuc

SEQ ID NO: 26539 - RNA, 22 nt, Artificial Sequence
  ELANE RNA Guide
gggcuaauccacgaaauugccu

SEQ ID NO: 26540 - RNA, 22 nt, Artificial Sequence
  ELANE RNA Guide
uaauccacgaaauugccuccuu

SEQ ID NO: 26541 - RNA, 22 nt, Artificial Sequence
  ELANE RNA Guide
uccacgaaauugccuccuucgu

SEQ ID NO: 26542 - RNA, 22 nt, Artificial Sequence
  ELANE RNA Guide
ugcaacgggcuaauccacgaaa

SEQ ID NO: 26543 - RNA, 22 nt, Artificial Sequence
  ELANE RNA Guide
uuucguggauuagcccguugca

SEQ ID NO: 26544 - RNA, 20 nt, Artificial Sequence
  ELANE RNA Guide
aacgggcuaauccacguaau

SEQ ID NO: 26545 - RNA, 20 nt, Artificial Sequence
  ELANE RNA Guide
aaggaggcaauuacguggau

SEQ ID NO: 26546 - RNA, 20 nt, Artificial Sequence
  ELANE RNA Guide
aauccacguaauugccuccu

SEQ ID NO: 26547 - RNA, 20 nt, Artificial Sequence
  ELANE RNA Guide
aauuacguggauuagcccgu

SEQ ID NO: 26548 - RNA, 20 nt, Artificial Sequence
  ELANE RNA Guide
acgaaggaggcaauuacgug

SEQ ID NO: 26549 - RNA, 20 nt, Artificial Sequence
  ELANE RNA Guide
acgggcuaauccacguaauu

SEQ ID NO: 26550 - RNA, 20 nt, Artificial Sequence
  ELANE RNA Guide
acguaauugccuccuucguc

SEQ ID NO: 26551 - RNA, 20 nt, Artificial Sequence
  ELANE RNA Guide
aggaggcaauuacguggauu

SEQ ID NO: 26552 - RNA, 20 nt, Artificial Sequence
  ELANE RNA Guide
aggcaauuacguggauuagc

SEQ ID NO: 26553 - RNA, 20 nt, Artificial Sequence
  ELANE RNA Guide
auccacguaauugccuccuu

SEQ ID NO: 26554 - RNA, 20 nt, Artificial Sequence
  ELANE RNA Guide
auuacguggauuagcccguu

SEQ ID NO: 26555 - RNA, 20 nt, Artificial Sequence
  ELANE RNA Guide
caacgggcuaauccacguaa

SEQ ID NO: 26556 - RNA, 20 nt, Artificial Sequence
  ELANE RNA Guide
caauuacguggauuagcccg

SEQ ID NO: 26557 - RNA, 20 nt, Artificial Sequence
  ELANE RNA Guide
cacguaauugccuccuucgu

SEQ ID NO: 26558 - RNA, 20 nt, Artificial Sequence
  ELANE RNA Guide
ccacguaauugccuccuucg

SEQ ID NO: 26559 - RNA, 20 nt, Artificial Sequence
  ELANE RNA Guide
ccggacgaaggaggcaauua

SEQ ID NO: 26560 - RNA, 20 nt, Artificial Sequence
  ELANE RNA Guide
cgaaggaggcaauuacgugg

SEQ ID NO: 26561 - RNA, 20 nt, Artificial Sequence
  ELANE RNA Guide
cggacgaaggaggcaauuac

SEQ ID NO: 26562 - RNA, 20 nt, Artificial Sequence
  ELANE RNA Guide
cgggcuaauccacguaauug

SEQ ID NO: 26563 - RNA, 20 nt, Artificial Sequence
  ELANE RNA Guide
cguaauugccuccuucgucc

SEQ ID NO: 26564 - RNA, 20 nt, Artificial Sequence
  ELANE RNA Guide
cuaauccacguaauugccuc

SEQ ID NO: 26565 - RNA, 20 nt, Artificial Sequence
  ELANE RNA Guide
gaaggaggcaauuacgugga

SEQ ID NO: 26566 - RNA, 20 nt, Artificial Sequence
  ELANE RNA Guide
gacgaaggaggcaauuacgu

SEQ ID NO: 26567 - RNA, 20 nt, Artificial Sequence
  ELANE RNA Guide
gaggcaauuacguggauuag

SEQ ID NO: 26568 - RNA, 20 nt, Artificial Sequence
  ELANE RNA Guide
gcaacgggcuaauccacgua

SEQ ID NO: 26569 - RNA, 20 nt, Artificial Sequence
  ELANE RNA Guide
gcaauuacguggauuagccc

SEQ ID NO: 26570 - RNA, 20 nt, Artificial Sequence
  ELANE RNA Guide
gcuaauccacguaauugccu

SEQ ID NO: 26571 - RNA, 20 nt, Artificial Sequence
  ELANE RNA Guide
ggacgaaggaggcaauuacg

SEQ ID NO: 26572 - RNA, 20 nt, Artificial Sequence
  ELANE RNA Guide
ggaggcaauuacguggauua

SEQ ID NO: 26573 - RNA, 20 nt, Artificial Sequence
  ELANE RNA Guide
ggcaauuacguggauuagcc

SEQ ID NO: 26574 - RNA, 20 nt, Artificial Sequence
  ELANE RNA Guide
ggcuaauccacguaauugcc

SEQ ID NO: 26575 - RNA, 20 nt, Artificial Sequence
  ELANE RNA Guide
gggcuaauccacguaauugc

SEQ ID NO: 26576 - RNA, 20 nt, Artificial Sequence
  ELANE RNA Guide
guaauugccuccuucguccg

SEQ ID NO: 26577 - RNA, 20 nt, Artificial Sequence
  ELANE RNA Guide
uaauccacguaauugccucc

SEQ ID NO: 26578 - RNA, 20 nt, Artificial Sequence
  ELANE RNA Guide
uacguggauuagcccguugc

SEQ ID NO: 26579 - RNA, 20 nt, Artificial Sequence
  ELANE RNA Guide
uccacguaauugccuccuuc

SEQ ID NO: 26580 - RNA, 20 nt, Artificial Sequence
  ELANE RNA Guide
ugcaacgggcuaauccacgu

SEQ ID NO: 26581 - RNA, 20 nt, Artificial Sequence
  ELANE RNA Guide
uuacguggauuagcccguug

SEQ ID NO: 26582 - RNA, 21 nt, Artificial Sequence
  ELANE RNA Guide
aacgggcuaauccacguaauu

SEQ ID NO: 26583 - RNA, 21 nt, Artificial Sequence
  ELANE RNA Guide
aaggaggcaauuacguggauu

SEQ ID NO: 26584 - RNA, 21 nt, Artificial Sequence
  ELANE RNA Guide
aauccacguaauugccuccuu

SEQ ID NO: 26585 - RNA, 21 nt, Artificial Sequence
  ELANE RNA Guide
aauuacguggauuagcccguu

SEQ ID NO: 26586 - RNA, 21 nt, Artificial Sequence
  ELANE RNA Guide
acgaaggaggcaauuacgugg

SEQ ID NO: 26587 - RNA, 21 nt, Artificial Sequence
  ELANE RNA Guide
acgggcuaauccacguaauug

SEQ ID NO: 26588 - RNA, 21 nt, Artificial Sequence
  ELANE RNA Guide
acguaauugccuccuucgucc

SEQ ID NO: 26589 - RNA, 21 nt, Artificial Sequence
  ELANE RNA Guide
aggaggcaauuacguggauua

SEQ ID NO: 26590 - RNA, 21 nt, Artificial Sequence
  ELANE RNA Guide
aggcaauuacguggauuagcc

SEQ ID NO: 26591 - RNA, 21 nt, Artificial Sequence
  ELANE RNA Guide
auccacguaauugccuccuuc

SEQ ID NO: 26592 - RNA, 21 nt, Artificial Sequence
  ELANE RNA Guide
auuacguggauuagcccguug

SEQ ID NO: 26593 - RNA, 21 nt, Artificial Sequence
  ELANE RNA Guide
caacgggcuaauccacguaau

SEQ ID NO: 26594 - RNA, 21 nt, Artificial Sequence
  ELANE RNA Guide
caauuacguggauuagcccgu

SEQ ID NO: 26595 - RNA, 21 nt, Artificial Sequence
  ELANE RNA Guide
cacguaauugccuccuucguc

SEQ ID NO: 26596 - RNA, 21 nt, Artificial Sequence
  ELANE RNA Guide
ccacguaauugccuccuucgu

SEQ ID NO: 26597 - RNA, 21 nt, Artificial Sequence
  ELANE RNA Guide
cccggacgaaggaggcaauua

SEQ ID NO: 26598 - RNA, 21 nt, Artificial Sequence
  ELANE RNA Guide
ccggacgaaggaggcaauuac

SEQ ID NO: 26599 - RNA, 21 nt, Artificial Sequence
  ELANE RNA Guide
cgaaggaggcaauuacgugga

SEQ ID NO: 26600 - RNA, 21 nt, Artificial Sequence
  ELANE RNA Guide
cggacgaaggaggcaauuacg

SEQ ID NO: 26601 - RNA, 21 nt, Artificial Sequence
  ELANE RNA Guide
cgggcuaauccacguaauugc

SEQ ID NO: 26602 - RNA, 21 nt, Artificial Sequence
  ELANE RNA Guide
cguaauugccuccuucguccg

SEQ ID NO: 26603 - RNA, 21 nt, Artificial Sequence
  ELANE RNA Guide
cuaauccacguaauugccucc

SEQ ID NO: 26604 - RNA, 21 nt, Artificial Sequence
  ELANE RNA Guide
cugcaacgggcuaauccacgu

SEQ ID NO: 26605 - RNA, 21 nt, Artificial Sequence
  ELANE RNA Guide
gaaggaggcaauuacguggau

SEQ ID NO: 26606 - RNA, 21 nt, Artificial Sequence
  ELANE RNA Guide
gacgaaggaggcaauuacgug

SEQ ID NO: 26607 - RNA, 21 nt, Artificial Sequence
  ELANE RNA Guide
gaggcaauuacguggauuagc

SEQ ID NO: 26608 - RNA, 21 nt, Artificial Sequence
  ELANE RNA Guide
gcaacgggcuaauccacguaa

SEQ ID NO: 26609 - RNA, 21 nt, Artificial Sequence
  ELANE RNA Guide
gcaauuacguggauuagcccg

SEQ ID NO: 26610 - RNA, 21 nt, Artificial Sequence
  ELANE RNA Guide
gcuaauccacguaauugccuc

SEQ ID NO: 26611 - RNA, 21 nt, Artificial Sequence
  ELANE RNA Guide
ggacgaaggaggcaauuacgu

SEQ ID NO: 26612 - RNA, 21 nt, Artificial Sequence
  ELANE RNA Guide
ggaggcaauuacguggauuag

SEQ ID NO: 26613 - RNA, 21 nt, Artificial Sequence
  ELANE RNA Guide
ggcaauuacguggauuagccc

SEQ ID NO: 26614 - RNA, 21 nt, Artificial Sequence
  ELANE RNA Guide
ggcuaauccacguaauugccu

SEQ ID NO: 26615 - RNA, 21 nt, Artificial Sequence
  ELANE RNA Guide
gggcuaauccacguaauugcc

SEQ ID NO: 26616 - RNA, 21 nt, Artificial Sequence
  ELANE RNA Guide
guaauugccuccuucguccgg

SEQ ID NO: 26617 - RNA, 21 nt, Artificial Sequence
  ELANE RNA Guide
uaauccacguaauugccuccu

SEQ ID NO: 26618 - RNA, 21 nt, Artificial Sequence
  ELANE RNA Guide
uacguggauuagcccguugca

SEQ ID NO: 26619 - RNA, 21 nt, Artificial Sequence
  ELANE RNA Guide
uccacguaauugccuccuucg

SEQ ID NO: 26620 - RNA, 21 nt, Artificial Sequence
  ELANE RNA Guide
ugcaacgggcuaauccacgua

SEQ ID NO: 26621 - RNA, 21 nt, Artificial Sequence
  ELANE RNA Guide
uuacguggauuagcccguugc

SEQ ID NO: 26622 - RNA, 22 nt, Artificial Sequence
  ELANE RNA Guide
aacgggcuaauccacguaauug

SEQ ID NO: 26623 - RNA, 22 nt, Artificial Sequence
  ELANE RNA Guide
aaggaggcaauuacguggauua

SEQ ID NO: 26624 - RNA, 22 nt, Artificial Sequence
  ELANE RNA Guide
aauccacguaauugccuccuuc

SEQ ID NO: 26625 - RNA, 22 nt, Artificial Sequence
  ELANE RNA Guide
aauuacguggauuagcccguug

SEQ ID NO: 26626 - RNA, 22 nt, Artificial Sequence
  ELANE RNA Guide
acgaaggaggcaauuacgugga

SEQ ID NO: 26627 - RNA, 22 nt, Artificial Sequence
  ELANE RNA Guide
acgggcuaauccacguaauugc

SEQ ID NO: 26628 - RNA, 22 nt, Artificial Sequence
  ELANE RNA Guide
acguaauugccuccuucguccg

SEQ ID NO: 26629 - RNA, 22 nt, Artificial Sequence
  ELANE RNA Guide
aggaggcaauuacguggauuag

SEQ ID NO: 26630 - RNA, 22 nt, Artificial Sequence
  ELANE RNA Guide
aggcaauuacguggauuagccc

SEQ ID NO: 26631 - RNA, 22 nt, Artificial Sequence
  ELANE RNA Guide
auccacguaauugccuccuucg

SEQ ID NO: 26632 - RNA, 22 nt, Artificial Sequence
  ELANE RNA Guide
auuacguggauuagcccguugc

SEQ ID NO: 26633 - RNA, 22 nt, Artificial Sequence
  ELANE RNA Guide
caacgggcuaauccacguaauu

SEQ ID NO: 26634 - RNA, 22 nt, Artificial Sequence
  ELANE RNA Guide
caauuacguggauuagcccguu

SEQ ID NO: 26635 - RNA, 22 nt, Artificial Sequence
  ELANE RNA Guide
cacguaauugccuccuucgucc

SEQ ID NO: 26636 - RNA, 22 nt, Artificial Sequence
  ELANE RNA Guide
ccacguaauugccuccuucguc

SEQ ID NO: 26637 - RNA, 22 nt, Artificial Sequence
  ELANE RNA Guide
ccccggacgaaggaggcaauua

SEQ ID NO: 26638 - RNA, 22 nt, Artificial Sequence
  ELANE RNA Guide
cccggacgaaggaggcaauuac

SEQ ID NO: 26639 - RNA, 22 nt, Artificial Sequence
  ELANE RNA Guide
ccggacgaaggaggcaauuacg

SEQ ID NO: 26640 - RNA, 22 nt, Artificial Sequence
  ELANE RNA Guide
cgaaggaggcaauuacguggau

SEQ ID NO: 26641 - RNA, 22 nt, Artificial Sequence
  ELANE RNA Guide
cggacgaaggaggcaauuacgu

SEQ ID NO: 26642 - RNA, 22 nt, Artificial Sequence
  ELANE RNA Guide
cgggcuaauccacguaauugcc

SEQ ID NO: 26643 - RNA, 22 nt, Artificial Sequence
  ELANE RNA Guide
cguaauugccuccuucguccgg

SEQ ID NO: 26644 - RNA, 22 nt, Artificial Sequence
  ELANE RNA Guide
cuaauccacguaauugccuccu

SEQ ID NO: 26645 - RNA, 22 nt, Artificial Sequence
  ELANE RNA Guide
cugcaacgggcuaauccacgua

SEQ ID NO: 26646 - RNA, 22 nt, Artificial Sequence
  ELANE RNA Guide
gaaggaggcaauuacguggauu

SEQ ID NO: 26647 - RNA, 22 nt, Artificial Sequence
  ELANE RNA Guide
gacgaaggaggcaauuacgugg

SEQ ID NO: 26648 - RNA, 22 nt, Artificial Sequence
  ELANE RNA Guide
gaggcaauuacguggauuagcc

SEQ ID NO: 26649 - RNA, 22 nt, Artificial Sequence
  ELANE RNA Guide
gcaacgggcuaauccacguaau

SEQ ID NO: 26650 - RNA, 22 nt, Artificial Sequence
  ELANE RNA Guide
gcaauuacguggauuagcccgu

SEQ ID NO: 26651 - RNA, 22 nt, Artificial Sequence
  ELANE RNA Guide
gcuaauccacguaauugccucc

SEQ ID NO: 26652 - RNA, 22 nt, Artificial Sequence
  ELANE RNA Guide
ggacgaaggaggcaauuacgug

SEQ ID NO: 26653 - RNA, 22 nt, Artificial Sequence
  ELANE RNA Guide
ggaggcaauuacguggauuagc

SEQ ID NO: 26654 - RNA, 22 nt, Artificial Sequence
  ELANE RNA Guide
ggcaauuacguggauuagcccg

SEQ ID NO: 26655 - RNA, 22 nt, Artificial Sequence
  ELANE RNA Guide
ggcuaauccacguaauugccuc

SEQ ID NO: 26656 - RNA, 22 nt, Artificial Sequence
  ELANE RNA Guide
gggcuaauccacguaauugccu

SEQ ID NO: 26657 - RNA, 22 nt, Artificial Sequence
  ELANE RNA Guide
guaauugccuccuucguccggg

SEQ ID NO: 26658 - RNA, 22 nt, Artificial Sequence
  ELANE RNA Guide
uaauccacguaauugccuccuu

SEQ ID NO: 26659 - RNA, 22 nt, Artificial Sequence
  ELANE RNA Guide
uacguggauuagcccguugcag

SEQ ID NO: 26660 - RNA, 22 nt, Artificial Sequence
  ELANE RNA Guide
uccacguaauugccuccuucgu

SEQ ID NO: 26661 - RNA, 22 nt, Artificial Sequence
  ELANE RNA Guide
ucugcaacgggcuaauccacgu

SEQ ID NO: 26662 - RNA, 22 nt, Artificial Sequence
  ELANE RNA Guide
ugcaacgggcuaauccacguaa

SEQ ID NO: 26663 - RNA, 22 nt, Artificial Sequence
  ELANE RNA Guide
uuacguggauuagcccguugca

SEQ ID NO: 26664 - RNA, 20 nt, Artificial Sequence
  ELANE RNA Guide
aacgggcuaauccacggaau

SEQ ID NO: 26665 - RNA, 20 nt, Artificial Sequence
  ELANE RNA Guide
aaggagacaauuccguggau

SEQ ID NO: 26666 - RNA, 20 nt, Artificial Sequence
  ELANE RNA Guide
aauccacggaauugucuccu

SEQ ID NO: 26667 - RNA, 20 nt, Artificial Sequence
  ELANE RNA Guide
aauugucuccuucguccggg

SEQ ID NO: 26668 - RNA, 20 nt, Artificial Sequence
  ELANE RNA Guide
acgaaggagacaauuccgug

SEQ ID NO: 26669 - RNA, 20 nt, Artificial Sequence
  ELANE RNA Guide
acggaauugucuccuucguc

SEQ ID NO: 26670 - RNA, 20 nt, Artificial Sequence
  ELANE RNA Guide
acgggcuaauccacggaauu

SEQ ID NO: 26671 - RNA, 20 nt, Artificial Sequence
  ELANE RNA Guide
agacaauuccguggauuagc

SEQ ID NO: 26672 - RNA, 20 nt, Artificial Sequence
  ELANE RNA Guide
agccuccccggacgaaggag

SEQ ID NO: 26673 - RNA, 20 nt, Artificial Sequence
  ELANE RNA Guide
aggagacaauuccguggauu

SEQ ID NO: 26674 - RNA, 20 nt, Artificial Sequence
  ELANE RNA Guide
auccacggaauugucuccuu

SEQ ID NO: 26675 - RNA, 20 nt, Artificial Sequence
  ELANE RNA Guide
auugucuccuucguccgggg

SEQ ID NO: 26676 - RNA, 20 nt, Artificial Sequence
  ELANE RNA Guide
caacgggcuaauccacggaa

SEQ ID NO: 26677 - RNA, 20 nt, Artificial Sequence
  ELANE RNA Guide
cacggaauugucuccuucgu

SEQ ID NO: 26678 - RNA, 20 nt, Artificial Sequence
  ELANE RNA Guide
cagccuccccggacgaagga

SEQ ID NO: 26679 - RNA, 20 nt, Artificial Sequence
  ELANE RNA Guide
ccacggaauugucuccuucg

SEQ ID NO: 26680 - RNA, 20 nt, Artificial Sequence
  ELANE RNA Guide
ccccggacgaaggagacaau

SEQ ID NO: 26681 - RNA, 20 nt, Artificial Sequence
  ELANE RNA Guide
cccggacgaaggagacaauu

SEQ ID NO: 26682 - RNA, 20 nt, Artificial Sequence
  ELANE RNA Guide
ccggacgaaggagacaauuc

SEQ ID NO: 26683 - RNA, 20 nt, Artificial Sequence
  ELANE RNA Guide
ccuccccggacgaaggagac

SEQ ID NO: 26684 - RNA, 20 nt, Artificial Sequence
  ELANE RNA Guide
cgaaggagacaauuccgugg

SEQ ID NO: 26685 - RNA, 20 nt, Artificial Sequence
  ELANE RNA Guide
cgcagccuccccggacgaag

SEQ ID NO: 26686 - RNA, 20 nt, Artificial Sequence
  ELANE RNA Guide
cggaauugucuccuucgucc

SEQ ID NO: 26687 - RNA, 20 nt, Artificial Sequence
  ELANE RNA Guide
cggacgaaggagacaauucc

SEQ ID NO: 26688 - RNA, 20 nt, Artificial Sequence
  ELANE RNA Guide
cgggcuaauccacggaauug

SEQ ID NO: 26689 - RNA, 20 nt, Artificial Sequence
  ELANE RNA Guide
cuaauccacggaauugucuc

SEQ ID NO: 26690 - RNA, 20 nt, Artificial Sequence
  ELANE RNA Guide
cuccccggacgaaggagaca

SEQ ID NO: 26691 - RNA, 20 nt, Artificial Sequence
  ELANE RNA Guide
gaaggagacaauuccgugga

SEQ ID NO: 26692 - RNA, 20 nt, Artificial Sequence
  ELANE RNA Guide
gaauugucuccuucguccgg

SEQ ID NO: 26693 - RNA, 20 nt, Artificial Sequence
  ELANE RNA Guide
gacaauuccguggauuagcc

SEQ ID NO: 26694 - RNA, 20 nt, Artificial Sequence
  ELANE RNA Guide
gacgaaggagacaauuccgu

SEQ ID NO: 26695 - RNA, 20 nt, Artificial Sequence
  ELANE RNA Guide
gagacaauuccguggauuag

SEQ ID NO: 26696 - RNA, 20 nt, Artificial Sequence
  ELANE RNA Guide
gcagccuccccggacgaagg

SEQ ID NO: 26697 - RNA, 20 nt, Artificial Sequence
  ELANE RNA Guide
gccuccccggacgaaggaga

SEQ ID NO: 26698 - RNA, 20 nt, Artificial Sequence
  ELANE RNA Guide
gcuaauccacggaauugucu

SEQ ID NO: 26699 - RNA, 20 nt, Artificial Sequence
  ELANE RNA Guide
ggaauugucuccuucguccg

SEQ ID NO: 26700 - RNA, 20 nt, Artificial Sequence
  ELANE RNA Guide
ggacgaaggagacaauuccg

SEQ ID NO: 26701 - RNA, 20 nt, Artificial Sequence
  ELANE RNA Guide
ggagacaauuccguggauua

SEQ ID NO: 26702 - RNA, 20 nt, Artificial Sequence
  ELANE RNA Guide
ggcuaauccacggaauuguc

SEQ ID NO: 26703 - RNA, 20 nt, Artificial Sequence
  ELANE RNA Guide
gggcuaauccacggaauugu

SEQ ID NO: 26704 - RNA, 20 nt, Artificial Sequence
  ELANE RNA Guide
gucuccuucguccggggagg

SEQ ID NO: 26705 - RNA, 20 nt, Artificial Sequence
  ELANE RNA Guide
uaauccacggaauugucucc

SEQ ID NO: 26706 - RNA, 20 nt, Artificial Sequence
  ELANE RNA Guide
uccacggaauugucuccuuc

SEQ ID NO: 26707 - RNA, 20 nt, Artificial Sequence
  ELANE RNA Guide
uccccggacgaaggagacaa

SEQ ID NO: 26708 - RNA, 20 nt, Artificial Sequence
  ELANE RNA Guide
ugucuccuucguccggggag

SEQ ID NO: 26709 - RNA, 20 nt, Artificial Sequence
  ELANE RNA Guide
uugucuccuucguccgggga

SEQ ID NO: 26710 - RNA, 21 nt, Artificial Sequence
  ELANE RNA Guide
aacgggcuaauccacggaauu

SEQ ID NO: 26711 - RNA, 21 nt, Artificial Sequence
  ELANE RNA Guide
aaggagacaauuccguggauu

SEQ ID NO: 26712 - RNA, 21 nt, Artificial Sequence
  ELANE RNA Guide
aauccacggaauugucuccuu

SEQ ID NO: 26713 - RNA, 21 nt, Artificial Sequence
  ELANE RNA Guide
aauugucuccuucguccgggg

SEQ ID NO: 26714 - RNA, 21 nt, Artificial Sequence
  ELANE RNA Guide
acgaaggagacaauuccgugg

SEQ ID NO: 26715 - RNA, 21 nt, Artificial Sequence
  ELANE RNA Guide
acggaauugucuccuucgucc

SEQ ID NO: 26716 - RNA, 21 nt, Artificial Sequence
  ELANE RNA Guide
acgggcuaauccacggaauug

SEQ ID NO: 26717 - RNA, 21 nt, Artificial Sequence
  ELANE RNA Guide
agacaauuccguggauuagcc

SEQ ID NO: 26718 - RNA, 21 nt, Artificial Sequence
  ELANE RNA Guide
agccuccccggacgaaggaga

SEQ ID NO: 26719 - RNA, 21 nt, Artificial Sequence
  ELANE RNA Guide
aggagacaauuccguggauua

SEQ ID NO: 26720 - RNA, 21 nt, Artificial Sequence
  ELANE RNA Guide
auccacggaauugucuccuuc

SEQ ID NO: 26721 - RNA, 21 nt, Artificial Sequence
  ELANE RNA Guide
auugucuccuucguccgggga

SEQ ID NO: 26722 - RNA, 21 nt, Artificial Sequence
  ELANE RNA Guide
caacgggcuaauccacggaau

SEQ ID NO: 26723 - RNA, 21 nt, Artificial Sequence
  ELANE RNA Guide
cacggaauugucuccuucguc

SEQ ID NO: 26724 - RNA, 21 nt, Artificial Sequence
  ELANE RNA Guide
cagccuccccggacgaaggag

SEQ ID NO: 26725 - RNA, 21 nt, Artificial Sequence
  ELANE RNA Guide
ccacggaauugucuccuucgu

SEQ ID NO: 26726 - RNA, 21 nt, Artificial Sequence
  ELANE RNA Guide
ccccggacgaaggagacaauu

SEQ ID NO: 26727 - RNA, 21 nt, Artificial Sequence
  ELANE RNA Guide
cccggacgaaggagacaauuc

SEQ ID NO: 26728 - RNA, 21 nt, Artificial Sequence
  ELANE RNA Guide
ccggacgaaggagacaauucc

SEQ ID NO: 26729 - RNA, 21 nt, Artificial Sequence
  ELANE RNA Guide
ccuccccggacgaaggagaca

SEQ ID NO: 26730 - RNA, 21 nt, Artificial Sequence
  ELANE RNA Guide
cgaaggagacaauuccgugga

SEQ ID NO: 26731 - RNA, 21 nt, Artificial Sequence
  ELANE RNA Guide
cgcagccuccccggacgaagg

SEQ ID NO: 26732 - RNA, 21 nt, Artificial Sequence
  ELANE RNA Guide
cggaauugucuccuucguccg

SEQ ID NO: 26733 - RNA, 21 nt, Artificial Sequence
  ELANE RNA Guide
cggacgaaggagacaauuccg

SEQ ID NO: 26734 - RNA, 21 nt, Artificial Sequence
  ELANE RNA Guide
cgggcuaauccacggaauugu

SEQ ID NO: 26735 - RNA, 21 nt, Artificial Sequence
  ELANE RNA Guide
cuaauccacggaauugucucc

SEQ ID NO: 26736 - RNA, 21 nt, Artificial Sequence
  ELANE RNA Guide
cuccccggacgaaggagacaa

SEQ ID NO: 26737 - RNA, 21 nt, Artificial Sequence
  ELANE RNA Guide
gaaggagacaauuccguggau

SEQ ID NO: 26738 - RNA, 21 nt, Artificial Sequence
  ELANE RNA Guide
gaauugucuccuucguccggg

SEQ ID NO: 26739 - RNA, 21 nt, Artificial Sequence
  ELANE RNA Guide
gacaauuccguggauuagccc

SEQ ID NO: 26740 - RNA, 21 nt, Artificial Sequence
  ELANE RNA Guide
gacgaaggagacaauuccgug

SEQ ID NO: 26741 - RNA, 21 nt, Artificial Sequence
  ELANE RNA Guide
gagacaauuccguggauuagc

SEQ ID NO: 26742 - RNA, 21 nt, Artificial Sequence
  ELANE RNA Guide
gcaacgggcuaauccacggaa

SEQ ID NO: 26743 - RNA, 21 nt, Artificial Sequence
  ELANE RNA Guide
gcagccuccccggacgaagga

SEQ ID NO: 26744 - RNA, 21 nt, Artificial Sequence
  ELANE RNA Guide
gccuccccggacgaaggagac

SEQ ID NO: 26745 - RNA, 21 nt, Artificial Sequence
  ELANE RNA Guide
gcgcagccuccccggacgaag

SEQ ID NO: 26746 - RNA, 21 nt, Artificial Sequence
  ELANE RNA Guide
gcuaauccacggaauugucuc

SEQ ID NO: 26747 - RNA, 21 nt, Artificial Sequence
  ELANE RNA Guide
ggaauugucuccuucguccgg

SEQ ID NO: 26748 - RNA, 21 nt, Artificial Sequence
  ELANE RNA Guide
ggacgaaggagacaauuccgu

SEQ ID NO: 26749 - RNA, 21 nt, Artificial Sequence
  ELANE RNA Guide
ggagacaauuccguggauuag

SEQ ID NO: 26750 - RNA, 21 nt, Artificial Sequence
  ELANE RNA Guide
ggcuaauccacggaauugucu

SEQ ID NO: 26751 - RNA, 21 nt, Artificial Sequence
  ELANE RNA Guide
gggcuaauccacggaauuguc

SEQ ID NO: 26752 - RNA, 21 nt, Artificial Sequence
  ELANE RNA Guide
gucuccuucguccggggaggc

SEQ ID NO: 26753 - RNA, 21 nt, Artificial Sequence
  ELANE RNA Guide
uaauccacggaauugucuccu

SEQ ID NO: 26754 - RNA, 21 nt, Artificial Sequence
  ELANE RNA Guide
uccacggaauugucuccuucg

SEQ ID NO: 26755 - RNA, 21 nt, Artificial Sequence
  ELANE RNA Guide
uccccggacgaaggagacaau

SEQ ID NO: 26756 - RNA, 21 nt, Artificial Sequence
  ELANE RNA Guide
ugucuccuucguccggggagg

SEQ ID NO: 26757 - RNA, 21 nt, Artificial Sequence
  ELANE RNA Guide
uugucuccuucguccggggag

SEQ ID NO: 26758 - RNA, 22 nt, Artificial Sequence
  ELANE RNA Guide
aacgggcuaauccacggaauug

SEQ ID NO: 26759 - RNA, 22 nt, Artificial Sequence
  ELANE RNA Guide
aaggagacaauuccguggauua

SEQ ID NO: 26760 - RNA, 22 nt, Artificial Sequence
  ELANE RNA Guide
aauccacggaauugucuccuuc

SEQ ID NO: 26761 - RNA, 22 nt, Artificial Sequence
  ELANE RNA Guide
aauugucuccuucguccgggga

SEQ ID NO: 26762 - RNA, 22 nt, Artificial Sequence
  ELANE RNA Guide
acgaaggagacaauuccgugga

SEQ ID NO: 26763 - RNA, 22 nt, Artificial Sequence
  ELANE RNA Guide
acggaauugucuccuucguccg

SEQ ID NO: 26764 - RNA, 22 nt, Artificial Sequence
  ELANE RNA Guide
acgggcuaauccacggaauugu

SEQ ID NO: 26765 - RNA, 22 nt, Artificial Sequence
  ELANE RNA Guide
agacaauuccguggauuagccc

SEQ ID NO: 26766 - RNA, 22 nt, Artificial Sequence
  ELANE RNA Guide
agccuccccggacgaaggagac

SEQ ID NO: 26767 - RNA, 22 nt, Artificial Sequence
  ELANE RNA Guide
aggagacaauuccguggauuag

SEQ ID NO: 26768 - RNA, 22 nt, Artificial Sequence
  ELANE RNA Guide
auccacggaauugucuccuucg

SEQ ID NO: 26769 - RNA, 22 nt, Artificial Sequence
  ELANE RNA Guide
auugucuccuucguccggggag

SEQ ID NO: 26770 - RNA, 22 nt, Artificial Sequence
  ELANE RNA Guide
caacgggcuaauccacggaauu

SEQ ID NO: 26771 - RNA, 22 nt, Artificial Sequence
  ELANE RNA Guide
cacggaauugucuccuucgucc

SEQ ID NO: 26772 - RNA, 22 nt, Artificial Sequence
  ELANE RNA Guide
cagccuccccggacgaaggaga

SEQ ID NO: 26773 - RNA, 22 nt, Artificial Sequence
  ELANE RNA Guide
ccacggaauugucuccuucguc

SEQ ID NO: 26774 - RNA, 22 nt, Artificial Sequence
  ELANE RNA Guide
ccccggacgaaggagacaauuc

SEQ ID NO: 26775 - RNA, 22 nt, Artificial Sequence
  ELANE RNA Guide
cccggacgaaggagacaauucc

SEQ ID NO: 26776 - RNA, 22 nt, Artificial Sequence
  ELANE RNA Guide
ccggacgaaggagacaauuccg

SEQ ID NO: 26777 - RNA, 22 nt, Artificial Sequence
  ELANE RNA Guide
ccuccccggacgaaggagacaa

SEQ ID NO: 26778 - RNA, 22 nt, Artificial Sequence
  ELANE RNA Guide
cgaaggagacaauuccguggau

SEQ ID NO: 26779 - RNA, 22 nt, Artificial Sequence
  ELANE RNA Guide
cgcagccuccccggacgaagga

SEQ ID NO: 26780 - RNA, 22 nt, Artificial Sequence
  ELANE RNA Guide
cggaauugucuccuucguccgg

SEQ ID NO: 26781 - RNA, 22 nt, Artificial Sequence
  ELANE RNA Guide
cggacgaaggagacaauuccgu

SEQ ID NO: 26782 - RNA, 22 nt, Artificial Sequence
  ELANE RNA Guide
cgggcuaauccacggaauuguc

SEQ ID NO: 26783 - RNA, 22 nt, Artificial Sequence
  ELANE RNA Guide
cuaauccacggaauugucuccu

SEQ ID NO: 26784 - RNA, 22 nt, Artificial Sequence
  ELANE RNA Guide
cuccccggacgaaggagacaau

SEQ ID NO: 26785 - RNA, 22 nt, Artificial Sequence
  ELANE RNA Guide
gaaggagacaauuccguggauu

SEQ ID NO: 26786 - RNA, 22 nt, Artificial Sequence
  ELANE RNA Guide
gaauugucuccuucguccgggg

SEQ ID NO: 26787 - RNA, 22 nt, Artificial Sequence
  ELANE RNA Guide
gacaauuccguggauuagcccg

SEQ ID NO: 26788 - RNA, 22 nt, Artificial Sequence
  ELANE RNA Guide
gacgaaggagacaauuccgugg

SEQ ID NO: 26789 - RNA, 22 nt, Artificial Sequence
  ELANE RNA Guide
gagacaauuccguggauuagcc

SEQ ID NO: 26790 - RNA, 22 nt, Artificial Sequence
  ELANE RNA Guide
gcaacgggcuaauccacggaau

SEQ ID NO: 26791 - RNA, 22 nt, Artificial Sequence
  ELANE RNA Guide
gcagccuccccggacgaaggag

SEQ ID NO: 26792 - RNA, 22 nt, Artificial Sequence
  ELANE RNA Guide
gccuccccggacgaaggagaca

SEQ ID NO: 26793 - RNA, 22 nt, Artificial Sequence
  ELANE RNA Guide
gcgcagccuccccggacgaagg

SEQ ID NO: 26794 - RNA, 22 nt, Artificial Sequence
  ELANE RNA Guide
gcuaauccacggaauugucucc

SEQ ID NO: 26795 - RNA, 22 nt, Artificial Sequence
  ELANE RNA Guide
ggaauugucuccuucguccggg

SEQ ID NO: 26796 - RNA, 22 nt, Artificial Sequence
  ELANE RNA Guide
ggacgaaggagacaauuccgug

SEQ ID NO: 26797 - RNA, 22 nt, Artificial Sequence
  ELANE RNA Guide
ggagacaauuccguggauuagc

SEQ ID NO: 26798 - RNA, 22 nt, Artificial Sequence
  ELANE RNA Guide
ggcgcagccuccccggacgaag

SEQ ID NO: 26799 - RNA, 22 nt, Artificial Sequence
  ELANE RNA Guide
ggcuaauccacggaauugucuc

SEQ ID NO: 26800 - RNA, 22 nt, Artificial Sequence
  ELANE RNA Guide
gggcuaauccacggaauugucu

SEQ ID NO: 26801 - RNA, 22 nt, Artificial Sequence
  ELANE RNA Guide
gucuccuucguccggggaggcu

SEQ ID NO: 26802 - RNA, 22 nt, Artificial Sequence
  ELANE RNA Guide
uaauccacggaauugucuccuu

SEQ ID NO: 26803 - RNA, 22 nt, Artificial Sequence
  ELANE RNA Guide
uccacggaauugucuccuucgu

SEQ ID NO: 26804 - RNA, 22 nt, Artificial Sequence
  ELANE RNA Guide
uccccggacgaaggagacaauu

SEQ ID NO: 26805 - RNA, 22 nt, Artificial Sequence
  ELANE RNA Guide
ugcaacgggcuaauccacggaa

SEQ ID NO: 26806 - RNA, 22 nt, Artificial Sequence
  ELANE RNA Guide
ugucuccuucguccggggaggc

SEQ ID NO: 26807 - RNA, 22 nt, Artificial Sequence
  ELANE RNA Guide
uugucuccuucguccggggagg

SEQ ID NO: 26808 - RNA, 20 nt, Artificial Sequence
  ELANE RNA Guide
aaggggcaauuccguggauu

SEQ ID NO: 26809 - RNA, 20 nt, Artificial Sequence
  ELANE RNA Guide
aauccacggaauugccccuu

SEQ ID NO: 26810 - RNA, 20 nt, Artificial Sequence
  ELANE RNA Guide
aauugccccuucguccgggg

SEQ ID NO: 26811 - RNA, 20 nt, Artificial Sequence
  ELANE RNA Guide
acgaaggggcaauuccgugg

SEQ ID NO: 26812 - RNA, 20 nt, Artificial Sequence
  ELANE RNA Guide
acggaauugccccuucgucc

SEQ ID NO: 26813 - RNA, 20 nt, Artificial Sequence
  ELANE RNA Guide
agccuccccggacgaagggg

SEQ ID NO: 26814 - RNA, 20 nt, Artificial Sequence
  ELANE RNA Guide
aggggcaauuccguggauua

SEQ ID NO: 26815 - RNA, 20 nt, Artificial Sequence
  ELANE RNA Guide
auccacggaauugccccuuc

SEQ ID NO: 26816 - RNA, 20 nt, Artificial Sequence
  ELANE RNA Guide
auugccccuucguccgggga

SEQ ID NO: 26817 - RNA, 20 nt, Artificial Sequence
  ELANE RNA Guide
cacggaauugccccuucguc

SEQ ID NO: 26818 - RNA, 20 nt, Artificial Sequence
  ELANE RNA Guide
cagccuccccggacgaaggg

SEQ ID NO: 26819 - RNA, 20 nt, Artificial Sequence
  ELANE RNA Guide
ccacggaauugccccuucgu

SEQ ID NO: 26820 - RNA, 20 nt, Artificial Sequence
  ELANE RNA Guide
ccccggacgaaggggcaauu

SEQ ID NO: 26821 - RNA, 20 nt, Artificial Sequence
  ELANE RNA Guide
ccccuucguccggggaggcu

SEQ ID NO: 26822 - RNA, 20 nt, Artificial Sequence
  ELANE RNA Guide
cccggacgaaggggcaauuc

SEQ ID NO: 26823 - RNA, 20 nt, Artificial Sequence
  ELANE RNA Guide
ccggacgaaggggcaauucc

SEQ ID NO: 26824 - RNA, 20 nt, Artificial Sequence
  ELANE RNA Guide
ccuccccggacgaaggggca

SEQ ID NO: 26825 - RNA, 20 nt, Artificial Sequence
  ELANE RNA Guide
cgaaggggcaauuccgugga

SEQ ID NO: 26826 - RNA, 20 nt, Artificial Sequence
  ELANE RNA Guide
cggaauugccccuucguccg

SEQ ID NO: 26827 - RNA, 20 nt, Artificial Sequence
  ELANE RNA Guide
cggacgaaggggcaauuccg

SEQ ID NO: 26828 - RNA, 20 nt, Artificial Sequence
  ELANE RNA Guide
cuaauccacggaauugcccc

SEQ ID NO: 26829 - RNA, 20 nt, Artificial Sequence
  ELANE RNA Guide
cuccccggacgaaggggcaa

SEQ ID NO: 26830 - RNA, 20 nt, Artificial Sequence
  ELANE RNA Guide
gaaggggcaauuccguggau

SEQ ID NO: 26831 - RNA, 20 nt, Artificial Sequence
  ELANE RNA Guide
gaauugccccuucguccggg

SEQ ID NO: 26832 - RNA, 20 nt, Artificial Sequence
  ELANE RNA Guide
gacgaaggggcaauuccgug

SEQ ID NO: 26833 - RNA, 20 nt, Artificial Sequence
  ELANE RNA Guide
gccccuucguccggggaggc

SEQ ID NO: 26834 - RNA, 20 nt, Artificial Sequence
  ELANE RNA Guide
gccuccccggacgaaggggc

SEQ ID NO: 26835 - RNA, 20 nt, Artificial Sequence
  ELANE RNA Guide
gcgcagccuccccggacgaa

SEQ ID NO: 26836 - RNA, 20 nt, Artificial Sequence
  ELANE RNA Guide
gcuaauccacggaauugccc

SEQ ID NO: 26837 - RNA, 20 nt, Artificial Sequence
  ELANE RNA Guide
ggaauugccccuucguccgg

SEQ ID NO: 26838 - RNA, 20 nt, Artificial Sequence
  ELANE RNA Guide
ggacgaaggggcaauuccgu

SEQ ID NO: 26839 - RNA, 20 nt, Artificial Sequence
  ELANE RNA Guide
ggcgcagccuccccggacga

SEQ ID NO: 26840 - RNA, 20 nt, Artificial Sequence
  ELANE RNA Guide
ggcuaauccacggaauugcc

SEQ ID NO: 26841 - RNA, 20 nt, Artificial Sequence
  ELANE RNA Guide
gggcaauuccguggauuagc

SEQ ID NO: 26842 - RNA, 20 nt, Artificial Sequence
  ELANE RNA Guide
gggcuaauccacggaauugc

SEQ ID NO: 26843 - RNA, 20 nt, Artificial Sequence
  ELANE RNA Guide
ggggcaauuccguggauuag

SEQ ID NO: 26844 - RNA, 20 nt, Artificial Sequence
  ELANE RNA Guide
uaauccacggaauugccccu

SEQ ID NO: 26845 - RNA, 20 nt, Artificial Sequence
  ELANE RNA Guide
uccacggaauugccccuucg

SEQ ID NO: 26846 - RNA, 20 nt, Artificial Sequence
  ELANE RNA Guide
uccccggacgaaggggcaau

SEQ ID NO: 26847 - RNA, 20 nt, Artificial Sequence
  ELANE RNA Guide
ugccccuucguccggggagg

SEQ ID NO: 26848 - RNA, 20 nt, Artificial Sequence
  ELANE RNA Guide
uugccccuucguccggggag

SEQ ID NO: 26849 - RNA, 21 nt, Artificial Sequence
  ELANE RNA Guide
aaggggcaauuccguggauua

SEQ ID NO: 26850 - RNA, 21 nt, Artificial Sequence
  ELANE RNA Guide
aauccacggaauugccccuuc

SEQ ID NO: 26851 - RNA, 21 nt, Artificial Sequence
  ELANE RNA Guide
aauugccccuucguccgggga

SEQ ID NO: 26852 - RNA, 21 nt, Artificial Sequence
  ELANE RNA Guide
acgaaggggcaauuccgugga

SEQ ID NO: 26853 - RNA, 21 nt, Artificial Sequence
  ELANE RNA Guide
acggaauugccccuucguccg

SEQ ID NO: 26854 - RNA, 21 nt, Artificial Sequence
  ELANE RNA Guide
agccuccccggacgaaggggc

SEQ ID NO: 26855 - RNA, 21 nt, Artificial Sequence
  ELANE RNA Guide
aggcgcagccuccccggacga

SEQ ID NO: 26856 - RNA, 21 nt, Artificial Sequence
  ELANE RNA Guide
aggggcaauuccguggauuag

SEQ ID NO: 26857 - RNA, 21 nt, Artificial Sequence
  ELANE RNA Guide
auccacggaauugccccuucg

SEQ ID NO: 26858 - RNA, 21 nt, Artificial Sequence
  ELANE RNA Guide
auugccccuucguccggggag

SEQ ID NO: 26859 - RNA, 21 nt, Artificial Sequence
  ELANE RNA Guide
cacggaauugccccuucgucc

SEQ ID NO: 26860 - RNA, 21 nt, Artificial Sequence
  ELANE RNA Guide
cagccuccccggacgaagggg

SEQ ID NO: 26861 - RNA, 21 nt, Artificial Sequence
  ELANE RNA Guide
ccacggaauugccccuucguc

SEQ ID NO: 26862 - RNA, 21 nt, Artificial Sequence
  ELANE RNA Guide
ccccggacgaaggggcaauuc

SEQ ID NO: 26863 - RNA, 21 nt, Artificial Sequence
  ELANE RNA Guide
ccccuucguccggggaggcug

SEQ ID NO: 26864 - RNA, 21 nt, Artificial Sequence
  ELANE RNA Guide
cccggacgaaggggcaauucc

SEQ ID NO: 26865 - RNA, 21 nt, Artificial Sequence
  ELANE RNA Guide
ccggacgaaggggcaauuccg

SEQ ID NO: 26866 - RNA, 21 nt, Artificial Sequence
  ELANE RNA Guide
ccuccccggacgaaggggcaa

SEQ ID NO: 26867 - RNA, 21 nt, Artificial Sequence
  ELANE RNA Guide
cgaaggggcaauuccguggau

SEQ ID NO: 26868 - RNA, 21 nt, Artificial Sequence
  ELANE RNA Guide
cggaauugccccuucguccgg

SEQ ID NO: 26869 - RNA, 21 nt, Artificial Sequence
  ELANE RNA Guide
cggacgaaggggcaauuccgu

SEQ ID NO: 26870 - RNA, 21 nt, Artificial Sequence
  ELANE RNA Guide
cgggcuaauccacggaauugc

SEQ ID NO: 26871 - RNA, 21 nt, Artificial Sequence
  ELANE RNA Guide
cuaauccacggaauugccccu

SEQ ID NO: 26872 - RNA, 21 nt, Artificial Sequence
  ELANE RNA Guide
cuccccggacgaaggggcaau

SEQ ID NO: 26873 - RNA, 21 nt, Artificial Sequence
  ELANE RNA Guide
gaaggggcaauuccguggauu

SEQ ID NO: 26874 - RNA, 21 nt, Artificial Sequence
  ELANE RNA Guide
gaauugccccuucguccgggg

SEQ ID NO: 26875 - RNA, 21 nt, Artificial Sequence
  ELANE RNA Guide
gacgaaggggcaauuccgugg

SEQ ID NO: 26876 - RNA, 21 nt, Artificial Sequence
  ELANE RNA Guide
gcagccuccccggacgaaggg

SEQ ID NO: 26877 - RNA, 21 nt, Artificial Sequence
  ELANE RNA Guide
gccccuucguccggggaggcu

SEQ ID NO: 26878 - RNA, 21 nt, Artificial Sequence
  ELANE RNA Guide
gccuccccggacgaaggggca

SEQ ID NO: 26879 - RNA, 21 nt, Artificial Sequence
  ELANE RNA Guide
gcuaauccacggaauugcccc

SEQ ID NO: 26880 - RNA, 21 nt, Artificial Sequence
  ELANE RNA Guide
ggaauugccccuucguccggg

SEQ ID NO: 26881 - RNA, 21 nt, Artificial Sequence
  ELANE RNA Guide
ggacgaaggggcaauuccgug

SEQ ID NO: 26882 - RNA, 21 nt, Artificial Sequence
  ELANE RNA Guide
ggcgcagccuccccggacgaa

SEQ ID NO: 26883 - RNA, 21 nt, Artificial Sequence
  ELANE RNA Guide
ggcuaauccacggaauugccc

SEQ ID NO: 26884 - RNA, 21 nt, Artificial Sequence
  ELANE RNA Guide
gggcaauuccguggauuagcc

SEQ ID NO: 26885 - RNA, 21 nt, Artificial Sequence
  ELANE RNA Guide
gggcuaauccacggaauugcc

SEQ ID NO: 26886 - RNA, 21 nt, Artificial Sequence
  ELANE RNA Guide
ggggcaauuccguggauuagc

SEQ ID NO: 26887 - RNA, 21 nt, Artificial Sequence
  ELANE RNA Guide
uaauccacggaauugccccuu

SEQ ID NO: 26888 - RNA, 21 nt, Artificial Sequence
  ELANE RNA Guide
uccacggaauugccccuucgu

SEQ ID NO: 26889 - RNA, 21 nt, Artificial Sequence
  ELANE RNA Guide
uccccggacgaaggggcaauu

SEQ ID NO: 26890 - RNA, 21 nt, Artificial Sequence
  ELANE RNA Guide
ugccccuucguccggggaggc

SEQ ID NO: 26891 - RNA, 21 nt, Artificial Sequence
  ELANE RNA Guide
uugccccuucguccggggagg

SEQ ID NO: 26892 - RNA, 22 nt, Artificial Sequence
  ELANE RNA Guide
aaggggcaauuccguggauuag

SEQ ID NO: 26893 - RNA, 22 nt, Artificial Sequence
  ELANE RNA Guide
aauccacggaauugccccuucg

SEQ ID NO: 26894 - RNA, 22 nt, Artificial Sequence
  ELANE RNA Guide
aauugccccuucguccggggag

SEQ ID NO: 26895 - RNA, 22 nt, Artificial Sequence
  ELANE RNA Guide
acgaaggggcaauuccguggau

SEQ ID NO: 26896 - RNA, 22 nt, Artificial Sequence
  ELANE RNA Guide
acggaauugccccuucguccgg

SEQ ID NO: 26897 - RNA, 22 nt, Artificial Sequence
  ELANE RNA Guide
acgggcuaauccacggaauugc

SEQ ID NO: 26898 - RNA, 22 nt, Artificial Sequence
  ELANE RNA Guide
agccuccccggacgaaggggca

SEQ ID NO: 26899 - RNA, 22 nt, Artificial Sequence
  ELANE RNA Guide
aggcgcagccuccccggacgaa

SEQ ID NO: 26900 - RNA, 22 nt, Artificial Sequence
  ELANE RNA Guide
aggggcaauuccguggauuagc

SEQ ID NO: 26901 - RNA, 22 nt, Artificial Sequence
  ELANE RNA Guide
auccacggaauugccccuucgu

SEQ ID NO: 26902 - RNA, 22 nt, Artificial Sequence
  ELANE RNA Guide
auugccccuucguccggggagg

SEQ ID NO: 26903 - RNA, 22 nt, Artificial Sequence
  ELANE RNA Guide
cacggaauugccccuucguccg

SEQ ID NO: 26904 - RNA, 22 nt, Artificial Sequence
  ELANE RNA Guide
cagccuccccggacgaaggggc

SEQ ID NO: 26905 - RNA, 22 nt, Artificial Sequence
  ELANE RNA Guide
ccacggaauugccccuucgucc

SEQ ID NO: 26906 - RNA, 22 nt, Artificial Sequence
  ELANE RNA Guide
ccccggacgaaggggcaauucc

SEQ ID NO: 26907 - RNA, 22 nt, Artificial Sequence
  ELANE RNA Guide
ccccuucguccggggaggcugc

SEQ ID NO: 26908 - RNA, 22 nt, Artificial Sequence
  ELANE RNA Guide
cccggacgaaggggcaauuccg

SEQ ID NO: 26909 - RNA, 22 nt, Artificial Sequence
  ELANE RNA Guide
ccggacgaaggggcaauuccgu

SEQ ID NO: 26910 - RNA, 22 nt, Artificial Sequence
  ELANE RNA Guide
ccuccccggacgaaggggcaau

SEQ ID NO: 26911 - RNA, 22 nt, Artificial Sequence
  ELANE RNA Guide
cgaaggggcaauuccguggauu

SEQ ID NO: 26912 - RNA, 22 nt, Artificial Sequence
  ELANE RNA Guide
cgcagccuccccggacgaaggg

SEQ ID NO: 26913 - RNA, 22 nt, Artificial Sequence
  ELANE RNA Guide
cggaauugccccuucguccggg

SEQ ID NO: 26914 - RNA, 22 nt, Artificial Sequence
  ELANE RNA Guide
cggacgaaggggcaauuccgug

SEQ ID NO: 26915 - RNA, 22 nt, Artificial Sequence
  ELANE RNA Guide
cgggcuaauccacggaauugcc

SEQ ID NO: 26916 - RNA, 22 nt, Artificial Sequence
  ELANE RNA Guide
cuaauccacggaauugccccuu

SEQ ID NO: 26917 - RNA, 22 nt, Artificial Sequence
  ELANE RNA Guide
cuccccggacgaaggggcaauu

SEQ ID NO: 26918 - RNA, 22 nt, Artificial Sequence
  ELANE RNA Guide
gaaggggcaauuccguggauua

SEQ ID NO: 26919 - RNA, 22 nt, Artificial Sequence
  ELANE RNA Guide
gaauugccccuucguccgggga

SEQ ID NO: 26920 - RNA, 22 nt, Artificial Sequence
  ELANE RNA Guide
gacgaaggggcaauuccgugga

SEQ ID NO: 26921 - RNA, 22 nt, Artificial Sequence
  ELANE RNA Guide
gaggcgcagccuccccggacga

SEQ ID NO: 26922 - RNA, 22 nt, Artificial Sequence
  ELANE RNA Guide
gcagccuccccggacgaagggg

SEQ ID NO: 26923 - RNA, 22 nt, Artificial Sequence
  ELANE RNA Guide
gccccuucguccggggaggcug

SEQ ID NO: 26924 - RNA, 22 nt, Artificial Sequence
  ELANE RNA Guide
gccuccccggacgaaggggcaa

SEQ ID NO: 26925 - RNA, 22 nt, Artificial Sequence
  ELANE RNA Guide
gcuaauccacggaauugccccu

SEQ ID NO: 26926 - RNA, 22 nt, Artificial Sequence
  ELANE RNA Guide
ggaauugccccuucguccgggg

SEQ ID NO: 26927 - RNA, 22 nt, Artificial Sequence
  ELANE RNA Guide
ggacgaaggggcaauuccgugg

SEQ ID NO: 26928 - RNA, 22 nt, Artificial Sequence
  ELANE RNA Guide
ggcuaauccacggaauugcccc

SEQ ID NO: 26929 - RNA, 22 nt, Artificial Sequence
  ELANE RNA Guide
gggcaauuccguggauuagccc

SEQ ID NO: 26930 - RNA, 22 nt, Artificial Sequence
  ELANE RNA Guide
gggcuaauccacggaauugccc

SEQ ID NO: 26931 - RNA, 22 nt, Artificial Sequence
  ELANE RNA Guide
ggggcaauuccguggauuagcc

SEQ ID NO: 26932 - RNA, 22 nt, Artificial Sequence
  ELANE RNA Guide
uaauccacggaauugccccuuc

SEQ ID NO: 26933 - RNA, 22 nt, Artificial Sequence
  ELANE RNA Guide
uccacggaauugccccuucguc

SEQ ID NO: 26934 - RNA, 22 nt, Artificial Sequence
  ELANE RNA Guide
uccccggacgaaggggcaauuc

SEQ ID NO: 26935 - RNA, 22 nt, Artificial Sequence
  ELANE RNA Guide
ugccccuucguccggggaggcu

SEQ ID NO: 26936 - RNA, 22 nt, Artificial Sequence
  ELANE RNA Guide
uugccccuucguccggggaggc

SEQ ID NO: 26937 - RNA, 20 nt, Artificial Sequence
  ELANE RNA Guide
aauccacggaauugccuccu

SEQ ID NO: 26938 - RNA, 20 nt, Artificial Sequence
  ELANE RNA Guide
aauugccuccuucauccggg

SEQ ID NO: 26939 - RNA, 20 nt, Artificial Sequence
  ELANE RNA Guide
acggaauugccuccuucauc

SEQ ID NO: 26940 - RNA, 20 nt, Artificial Sequence
  ELANE RNA Guide
agccuccccggaugaaggag

SEQ ID NO: 26941 - RNA, 20 nt, Artificial Sequence
  ELANE RNA Guide
aggcgcagccuccccggaug

SEQ ID NO: 26942 - RNA, 20 nt, Artificial Sequence
  ELANE RNA Guide
auccacggaauugccuccuu

SEQ ID NO: 26943 - RNA, 20 nt, Artificial Sequence
  ELANE RNA Guide
augaaggaggcaauuccgug

SEQ ID NO: 26944 - RNA, 20 nt, Artificial Sequence
  ELANE RNA Guide
auugccuccuucauccgggg

SEQ ID NO: 26945 - RNA, 20 nt, Artificial Sequence
  ELANE RNA Guide
cacggaauugccuccuucau

SEQ ID NO: 26946 - RNA, 20 nt, Artificial Sequence
  ELANE RNA Guide
cagccuccccggaugaagga

SEQ ID NO: 26947 - RNA, 20 nt, Artificial Sequence
  ELANE RNA Guide
cauccggggaggcugcgccu

SEQ ID NO: 26948 - RNA, 20 nt, Artificial Sequence
  ELANE RNA Guide
ccacggaauugccuccuuca

SEQ ID NO: 26949 - RNA, 20 nt, Artificial Sequence
  ELANE RNA Guide
ccccggaugaaggaggcaau

SEQ ID NO: 26950 - RNA, 20 nt, Artificial Sequence
  ELANE RNA Guide
cccggaugaaggaggcaauu

SEQ ID NO: 26951 - RNA, 20 nt, Artificial Sequence
  ELANE RNA Guide
cccugaggcgcagccucccc

SEQ ID NO: 26952 - RNA, 20 nt, Artificial Sequence
  ELANE RNA Guide
ccggaugaaggaggcaauuc

SEQ ID NO: 26953 - RNA, 20 nt, Artificial Sequence
  ELANE RNA Guide
ccuccccggaugaaggaggc

SEQ ID NO: 26954 - RNA, 20 nt, Artificial Sequence
  ELANE RNA Guide
ccuccuucauccggggaggc

SEQ ID NO: 26955 - RNA, 20 nt, Artificial Sequence
  ELANE RNA Guide
ccugaggcgcagccuccccg

SEQ ID NO: 26956 - RNA, 20 nt, Artificial Sequence
  ELANE RNA Guide
ccuucauccggggaggcugc

SEQ ID NO: 26957 - RNA, 20 nt, Artificial Sequence
  ELANE RNA Guide
cgcagccuccccggaugaag

SEQ ID NO: 26958 - RNA, 20 nt, Artificial Sequence
  ELANE RNA Guide
cggaauugccuccuucaucc

SEQ ID NO: 26959 - RNA, 20 nt, Artificial Sequence
  ELANE RNA Guide
cggaugaaggaggcaauucc

SEQ ID NO: 26960 - RNA, 20 nt, Artificial Sequence
  ELANE RNA Guide
cuccccggaugaaggaggca

SEQ ID NO: 26961 - RNA, 20 nt, Artificial Sequence
  ELANE RNA Guide
cuccuucauccggggaggcu

SEQ ID NO: 26962 - RNA, 20 nt, Artificial Sequence
  ELANE RNA Guide
cugaggcgcagccuccccgg

SEQ ID NO: 26963 - RNA, 20 nt, Artificial Sequence
  ELANE RNA Guide
cuucauccggggaggcugcg

SEQ ID NO: 26964 - RNA, 20 nt, Artificial Sequence
  ELANE RNA Guide
gaauugccuccuucauccgg

SEQ ID NO: 26965 - RNA, 20 nt, Artificial Sequence
  ELANE RNA Guide
gaggcgcagccuccccggau

SEQ ID NO: 26966 - RNA, 20 nt, Artificial Sequence
  ELANE RNA Guide
gaugaaggaggcaauuccgu

SEQ ID NO: 26967 - RNA, 20 nt, Artificial Sequence
  ELANE RNA Guide
gcagccuccccggaugaagg

SEQ ID NO: 26968 - RNA, 20 nt, Artificial Sequence
  ELANE RNA Guide
gccuccccggaugaaggagg

SEQ ID NO: 26969 - RNA, 20 nt, Artificial Sequence
  ELANE RNA Guide
gccuccuucauccggggagg

SEQ ID NO: 26970 - RNA, 20 nt, Artificial Sequence
  ELANE RNA Guide
gcgcagccuccccggaugaa

SEQ ID NO: 26971 - RNA, 20 nt, Artificial Sequence
  ELANE RNA Guide
ggaauugccuccuucauccg

SEQ ID NO: 26972 - RNA, 20 nt, Artificial Sequence
  ELANE RNA Guide
ggaugaaggaggcaauuccg

SEQ ID NO: 26973 - RNA, 20 nt, Artificial Sequence
  ELANE RNA Guide
ggcgcagccuccccggauga

SEQ ID NO: 26974 - RNA, 20 nt, Artificial Sequence
  ELANE RNA Guide
uaauccacggaauugccucc

SEQ ID NO: 26975 - RNA, 20 nt, Artificial Sequence
  ELANE RNA Guide
ucauccggggaggcugcgcc

SEQ ID NO: 26976 - RNA, 20 nt, Artificial Sequence
  ELANE RNA Guide
uccacggaauugccuccuuc

SEQ ID NO: 26977 - RNA, 20 nt, Artificial Sequence
  ELANE RNA Guide
uccccggaugaaggaggcaa

SEQ ID NO: 26978 - RNA, 20 nt, Artificial Sequence
  ELANE RNA Guide
uccuucauccggggaggcug

SEQ ID NO: 26979 - RNA, 20 nt, Artificial Sequence
  ELANE RNA Guide
ugaggcgcagccuccccgga

SEQ ID NO: 26980 - RNA, 20 nt, Artificial Sequence
  ELANE RNA Guide
ugccuccuucauccggggag

SEQ ID NO: 26981 - RNA, 20 nt, Artificial Sequence
  ELANE RNA Guide
uucauccggggaggcugcgc

SEQ ID NO: 26982 - RNA, 20 nt, Artificial Sequence
  ELANE RNA Guide
uugccuccuucauccgggga

SEQ ID NO: 26983 - RNA, 21 nt, Artificial Sequence
  ELANE RNA Guide
aauccacggaauugccuccuu

SEQ ID NO: 26984 - RNA, 21 nt, Artificial Sequence
  ELANE RNA Guide
aauugccuccuucauccgggg

SEQ ID NO: 26985 - RNA, 21 nt, Artificial Sequence
  ELANE RNA Guide
acggaauugccuccuucaucc

SEQ ID NO: 26986 - RNA, 21 nt, Artificial Sequence
  ELANE RNA Guide
agccuccccggaugaaggagg

SEQ ID NO: 26987 - RNA, 21 nt, Artificial Sequence
  ELANE RNA Guide
aggcgcagccuccccggauga

SEQ ID NO: 26988 - RNA, 21 nt, Artificial Sequence
  ELANE RNA Guide
auccacggaauugccuccuuc

SEQ ID NO: 26989 - RNA, 21 nt, Artificial Sequence
  ELANE RNA Guide
augaaggaggcaauuccgugg

SEQ ID NO: 26990 - RNA, 21 nt, Artificial Sequence
  ELANE RNA Guide
auugccuccuucauccgggga

SEQ ID NO: 26991 - RNA, 21 nt, Artificial Sequence
  ELANE RNA Guide
cacggaauugccuccuucauc

SEQ ID NO: 26992 - RNA, 21 nt, Artificial Sequence
  ELANE RNA Guide
cagccuccccggaugaaggag

SEQ ID NO: 26993 - RNA, 21 nt, Artificial Sequence
  ELANE RNA Guide
cauccggggaggcugcgccuc

SEQ ID NO: 26994 - RNA, 21 nt, Artificial Sequence
  ELANE RNA Guide
ccacggaauugccuccuucau

SEQ ID NO: 26995 - RNA, 21 nt, Artificial Sequence
  ELANE RNA Guide
ccccggaugaaggaggcaauu

SEQ ID NO: 26996 - RNA, 21 nt, Artificial Sequence
  ELANE RNA Guide
cccggaugaaggaggcaauuc

SEQ ID NO: 26997 - RNA, 21 nt, Artificial Sequence
  ELANE RNA Guide
ccggaugaaggaggcaauucc

SEQ ID NO: 26998 - RNA, 21 nt, Artificial Sequence
  ELANE RNA Guide
ccuccccggaugaaggaggca

SEQ ID NO: 26999 - RNA, 21 nt, Artificial Sequence
  ELANE RNA Guide
ccuccuucauccggggaggcu

SEQ ID NO: 27000 - RNA, 21 nt, Artificial Sequence
  ELANE RNA Guide
ccuucauccggggaggcugcg

SEQ ID NO: 27001 - RNA, 21 nt, Artificial Sequence
  ELANE RNA Guide
cgcagccuccccggaugaagg

SEQ ID NO: 27002 - RNA, 21 nt, Artificial Sequence
  ELANE RNA Guide
cggaauugccuccuucauccg

SEQ ID NO: 27003 - RNA, 21 nt, Artificial Sequence
  ELANE RNA Guide
cggaugaaggaggcaauuccg

SEQ ID NO: 27004 - RNA, 21 nt, Artificial Sequence
  ELANE RNA Guide
cuaauccacggaauugccucc

SEQ ID NO: 27005 - RNA, 21 nt, Artificial Sequence
  ELANE RNA Guide
cuccccggaugaaggaggcaa

SEQ ID NO: 27006 - RNA, 21 nt, Artificial Sequence
  ELANE RNA Guide
cuccuucauccggggaggcug

SEQ ID NO: 27007 - RNA, 21 nt, Artificial Sequence
  ELANE RNA Guide
cugaggcgcagccuccccgga

SEQ ID NO: 27008 - RNA, 21 nt, Artificial Sequence
  ELANE RNA Guide
cuucauccggggaggcugcgc

SEQ ID NO: 27009 - RNA, 21 nt, Artificial Sequence
  ELANE RNA Guide
gaauugccuccuucauccggg

SEQ ID NO: 27010 - RNA, 21 nt, Artificial Sequence
  ELANE RNA Guide
gaggcgcagccuccccggaug

SEQ ID NO: 27011 - RNA, 21 nt, Artificial Sequence
  ELANE RNA Guide
gaugaaggaggcaauuccgug

SEQ ID NO: 27012 - RNA, 21 nt, Artificial Sequence
  ELANE RNA Guide
gcagccuccccggaugaagga

SEQ ID NO: 27013 - RNA, 21 nt, Artificial Sequence
  ELANE RNA Guide
gccuccccggaugaaggaggc

SEQ ID NO: 27014 - RNA, 21 nt, Artificial Sequence
  ELANE RNA Guide
gccuccuucauccggggaggc

SEQ ID NO: 27015 - RNA, 21 nt, Artificial Sequence
  ELANE RNA Guide
gcgcagccuccccggaugaag

SEQ ID NO: 27016 - RNA, 21 nt, Artificial Sequence
  ELANE RNA Guide
ggaauugccuccuucauccgg

SEQ ID NO: 27017 - RNA, 21 nt, Artificial Sequence
  ELANE RNA Guide
ggaugaaggaggcaauuccgu

SEQ ID NO: 27018 - RNA, 21 nt, Artificial Sequence
  ELANE RNA Guide
ggcgcagccuccccggaugaa

SEQ ID NO: 27019 - RNA, 21 nt, Artificial Sequence
  ELANE RNA Guide
uaauccacggaauugccuccu

SEQ ID NO: 27020 - RNA, 21 nt, Artificial Sequence
  ELANE RNA Guide
ucauccggggaggcugcgccu

SEQ ID NO: 27021 - RNA, 21 nt, Artificial Sequence
  ELANE RNA Guide
uccacggaauugccuccuuca

SEQ ID NO: 27022 - RNA, 21 nt, Artificial Sequence
  ELANE RNA Guide
uccccggaugaaggaggcaau

SEQ ID NO: 27023 - RNA, 21 nt, Artificial Sequence
  ELANE RNA Guide
uccuucauccggggaggcugc

SEQ ID NO: 27024 - RNA, 21 nt, Artificial Sequence
  ELANE RNA Guide
ugaggcgcagccuccccggau

SEQ ID NO: 27025 - RNA, 21 nt, Artificial Sequence
  ELANE RNA Guide
ugccuccuucauccggggagg

SEQ ID NO: 27026 - RNA, 21 nt, Artificial Sequence
  ELANE RNA Guide
uucauccggggaggcugcgcc

SEQ ID NO: 27027 - RNA, 21 nt, Artificial Sequence
  ELANE RNA Guide
uugccuccuucauccggggag

SEQ ID NO: 27028 - RNA, 22 nt, Artificial Sequence
  ELANE RNA Guide
aauccacggaauugccuccuuc

SEQ ID NO: 27029 - RNA, 22 nt, Artificial Sequence
  ELANE RNA Guide
aauugccuccuucauccgggga

SEQ ID NO: 27030 - RNA, 22 nt, Artificial Sequence
  ELANE RNA Guide
acggaauugccuccuucauccg

SEQ ID NO: 27031 - RNA, 22 nt, Artificial Sequence
  ELANE RNA Guide
agcccugaggcgcagccucccc

SEQ ID NO: 27032 - RNA, 22 nt, Artificial Sequence
  ELANE RNA Guide
agccuccccggaugaaggaggc

SEQ ID NO: 27033 - RNA, 22 nt, Artificial Sequence
  ELANE RNA Guide
aggcgcagccuccccggaugaa

SEQ ID NO: 27034 - RNA, 22 nt, Artificial Sequence
  ELANE RNA Guide
auccacggaauugccuccuuca

SEQ ID NO: 27035 - RNA, 22 nt, Artificial Sequence
  ELANE RNA Guide
augaaggaggcaauuccgugga

SEQ ID NO: 27036 - RNA, 22 nt, Artificial Sequence
  ELANE RNA Guide
auugccuccuucauccggggag

SEQ ID NO: 27037 - RNA, 22 nt, Artificial Sequence
  ELANE RNA Guide
cacggaauugccuccuucaucc

SEQ ID NO: 27038 - RNA, 22 nt, Artificial Sequence
  ELANE RNA Guide
cagccuccccggaugaaggagg

SEQ ID NO: 27039 - RNA, 22 nt, Artificial Sequence
  ELANE RNA Guide
cauccggggaggcugcgccuca

SEQ ID NO: 27040 - RNA, 22 nt, Artificial Sequence
  ELANE RNA Guide
ccacggaauugccuccuucauc

SEQ ID NO: 27041 - RNA, 22 nt, Artificial Sequence
  ELANE RNA Guide
ccccggaugaaggaggcaauuc

SEQ ID NO: 27042 - RNA, 22 nt, Artificial Sequence
  ELANE RNA Guide
cccggaugaaggaggcaauucc

SEQ ID NO: 27043 - RNA, 22 nt, Artificial Sequence
  ELANE RNA Guide
ccggaugaaggaggcaauuccg

SEQ ID NO: 27044 - RNA, 22 nt, Artificial Sequence
  ELANE RNA Guide
ccuccccggaugaaggaggcaa

SEQ ID NO: 27045 - RNA, 22 nt, Artificial Sequence
  ELANE RNA Guide
ccuccuucauccggggaggcug

SEQ ID NO: 27046 - RNA, 22 nt, Artificial Sequence
  ELANE RNA Guide
ccugaggcgcagccuccccgga

SEQ ID NO: 27047 - RNA, 22 nt, Artificial Sequence
  ELANE RNA Guide
ccuucauccggggaggcugcgc

SEQ ID NO: 27048 - RNA, 22 nt, Artificial Sequence
  ELANE RNA Guide
cgcagccuccccggaugaagga

SEQ ID NO: 27049 - RNA, 22 nt, Artificial Sequence
  ELANE RNA Guide
cggaauugccuccuucauccgg

SEQ ID NO: 27050 - RNA, 22 nt, Artificial Sequence
  ELANE RNA Guide
cggaugaaggaggcaauuccgu

SEQ ID NO: 27051 - RNA, 22 nt, Artificial Sequence
  ELANE RNA Guide
cuaauccacggaauugccuccu

SEQ ID NO: 27052 - RNA, 22 nt, Artificial Sequence
  ELANE RNA Guide
cuccccggaugaaggaggcaau

SEQ ID NO: 27053 - RNA, 22 nt, Artificial Sequence
  ELANE RNA Guide
cuccuucauccggggaggcugc

SEQ ID NO: 27054 - RNA, 22 nt, Artificial Sequence
  ELANE RNA Guide
cugaggcgcagccuccccggau

SEQ ID NO: 27055 - RNA, 22 nt, Artificial Sequence
  ELANE RNA Guide
cuucauccggggaggcugcgcc

SEQ ID NO: 27056 - RNA, 22 nt, Artificial Sequence
  ELANE RNA Guide
gaauugccuccuucauccgggg

SEQ ID NO: 27057 - RNA, 22 nt, Artificial Sequence
  ELANE RNA Guide
gaggcgcagccuccccggauga

SEQ ID NO: 27058 - RNA, 22 nt, Artificial Sequence
  ELANE RNA Guide
gaugaaggaggcaauuccgugg

SEQ ID NO: 27059 - RNA, 22 nt, Artificial Sequence
  ELANE RNA Guide
gcagccuccccggaugaaggag

SEQ ID NO: 27060 - RNA, 22 nt, Artificial Sequence
  ELANE RNA Guide
gccuccccggaugaaggaggca

SEQ ID NO: 27061 - RNA, 22 nt, Artificial Sequence
  ELANE RNA Guide
gccuccuucauccggggaggcu

SEQ ID NO: 27062 - RNA, 22 nt, Artificial Sequence
  ELANE RNA Guide
gcgcagccuccccggaugaagg

SEQ ID NO: 27063 - RNA, 22 nt, Artificial Sequence
  ELANE RNA Guide
gcuaauccacggaauugccucc

SEQ ID NO: 27064 - RNA, 22 nt, Artificial Sequence
  ELANE RNA Guide
ggaauugccuccuucauccggg

SEQ ID NO: 27065 - RNA, 22 nt, Artificial Sequence
  ELANE RNA Guide
ggaugaaggaggcaauuccgug

SEQ ID NO: 27066 - RNA, 22 nt, Artificial Sequence
  ELANE RNA Guide
ggcgcagccuccccggaugaag

SEQ ID NO: 27067 - RNA, 22 nt, Artificial Sequence
  ELANE RNA Guide
uaauccacggaauugccuccuu

SEQ ID NO: 27068 - RNA, 22 nt, Artificial Sequence
  ELANE RNA Guide
ucauccggggaggcugcgccuc

SEQ ID NO: 27069 - RNA, 22 nt, Artificial Sequence
  ELANE RNA Guide
uccacggaauugccuccuucau

SEQ ID NO: 27070 - RNA, 22 nt, Artificial Sequence
  ELANE RNA Guide
uccccggaugaaggaggcaauu

SEQ ID NO: 27071 - RNA, 22 nt, Artificial Sequence
  ELANE RNA Guide
uccuucauccggggaggcugcg

SEQ ID NO: 27072 - RNA, 22 nt, Artificial Sequence
  ELANE RNA Guide
ugaggcgcagccuccccggaug

SEQ ID NO: 27073 - RNA, 22 nt, Artificial Sequence
  ELANE RNA Guide
ugccuccuucauccggggaggc

SEQ ID NO: 27074 - RNA, 22 nt, Artificial Sequence
  ELANE RNA Guide
uucauccggggaggcugcgccu

SEQ ID NO: 27075 - RNA, 22 nt, Artificial Sequence
  ELANE RNA Guide
uugccuccuucauccggggagg

SEQ ID NO: 27076 - RNA, 20 nt, Artificial Sequence
  ELANE RNA Guide
aauugccuccuucguccggg

SEQ ID NO: 27077 - RNA, 20 nt, Artificial Sequence
  ELANE RNA Guide
agagcccugaggcgcagccu

SEQ ID NO: 27078 - RNA, 20 nt, Artificial Sequence
  ELANE RNA Guide
agcccugaggcgcagccucc

SEQ ID NO: 27079 - RNA, 20 nt, Artificial Sequence
  ELANE RNA Guide
agccucccggacgaaggagg

SEQ ID NO: 27080 - RNA, 20 nt, Artificial Sequence
  ELANE RNA Guide
aggcgcagccucccggacga

SEQ ID NO: 27081 - RNA, 20 nt, Artificial Sequence
  ELANE RNA Guide
auugccuccuucguccggga

SEQ ID NO: 27082 - RNA, 20 nt, Artificial Sequence
  ELANE RNA Guide
cagccucccggacgaaggag

SEQ ID NO: 27083 - RNA, 20 nt, Artificial Sequence
  ELANE RNA Guide
cccugaggcgcagccucccg

SEQ ID NO: 27084 - RNA, 20 nt, Artificial Sequence
  ELANE RNA Guide
ccgggaggcugcgccucagg

SEQ ID NO: 27085 - RNA, 20 nt, Artificial Sequence
  ELANE RNA Guide
ccucccggacgaaggaggca

SEQ ID NO: 27086 - RNA, 20 nt, Artificial Sequence
  ELANE RNA Guide
ccuccuucguccgggaggcu

SEQ ID NO: 27087 - RNA, 20 nt, Artificial Sequence
  ELANE RNA Guide
ccugaggcgcagccucccgg

SEQ ID NO: 27088 - RNA, 20 nt, Artificial Sequence
  ELANE RNA Guide
ccuucguccgggaggcugcg

SEQ ID NO: 27089 - RNA, 20 nt, Artificial Sequence
  ELANE RNA Guide
cgcagccucccggacgaagg

SEQ ID NO: 27090 - RNA, 20 nt, Artificial Sequence
  ELANE RNA Guide
cggaauugccuccuucgucc

SEQ ID NO: 27091 - RNA, 20 nt, Artificial Sequence
  ELANE RNA Guide
cguccgggaggcugcgccuc

SEQ ID NO: 27092 - RNA, 20 nt, Artificial Sequence
  ELANE RNA Guide
cucccggacgaaggaggcaa

SEQ ID NO: 27093 - RNA, 20 nt, Artificial Sequence
  ELANE RNA Guide
cuccuucguccgggaggcug

SEQ ID NO: 27094 - RNA, 20 nt, Artificial Sequence
  ELANE RNA Guide
cugaggcgcagccucccgga

SEQ ID NO: 27095 - RNA, 20 nt, Artificial Sequence
  ELANE RNA Guide
cuucguccgggaggcugcgc

SEQ ID NO: 27096 - RNA, 20 nt, Artificial Sequence
  ELANE RNA Guide
gaauugccuccuucguccgg

SEQ ID NO: 27097 - RNA, 20 nt, Artificial Sequence
  ELANE RNA Guide
gagcccugaggcgcagccuc

SEQ ID NO: 27098 - RNA, 20 nt, Artificial Sequence
  ELANE RNA Guide
gaggcgcagccucccggacg

SEQ ID NO: 27099 - RNA, 20 nt, Artificial Sequence
  ELANE RNA Guide
gcagccucccggacgaagga

SEQ ID NO: 27100 - RNA, 20 nt, Artificial Sequence
  ELANE RNA Guide
gcccugaggcgcagccuccc

SEQ ID NO: 27101 - RNA, 20 nt, Artificial Sequence
  ELANE RNA Guide
gccucccggacgaaggaggc

SEQ ID NO: 27102 - RNA, 20 nt, Artificial Sequence
  ELANE RNA Guide
gccuccuucguccgggaggc

SEQ ID NO: 27103 - RNA, 20 nt, Artificial Sequence
  ELANE RNA Guide
gcgcagccucccggacgaag

SEQ ID NO: 27104 - RNA, 20 nt, Artificial Sequence
  ELANE RNA Guide
ggaauugccuccuucguccg

SEQ ID NO: 27105 - RNA, 20 nt, Artificial Sequence
  ELANE RNA Guide
ggcgcagccucccggacgaa

SEQ ID NO: 27106 - RNA, 20 nt, Artificial Sequence
  ELANE RNA Guide
guccgggaggcugcgccuca

SEQ ID NO: 27107 - RNA, 20 nt, Artificial Sequence
  ELANE RNA Guide
ucccggacgaaggaggcaau

SEQ ID NO: 27108 - RNA, 20 nt, Artificial Sequence
  ELANE RNA Guide
uccgggaggcugcgccucag

SEQ ID NO: 27109 - RNA, 20 nt, Artificial Sequence
  ELANE RNA Guide
uccuucguccgggaggcugc

SEQ ID NO: 27110 - RNA, 20 nt, Artificial Sequence
  ELANE RNA Guide
ucguccgggaggcugcgccu

SEQ ID NO: 27111 - RNA, 20 nt, Artificial Sequence
  ELANE RNA Guide
ugaggcgcagccucccggac

SEQ ID NO: 27112 - RNA, 20 nt, Artificial Sequence
  ELANE RNA Guide
ugccuccuucguccgggagg

SEQ ID NO: 27113 - RNA, 20 nt, Artificial Sequence
  ELANE RNA Guide
uucguccgggaggcugcgcc

SEQ ID NO: 27114 - RNA, 20 nt, Artificial Sequence
  ELANE RNA Guide
uugccuccuucguccgggag

SEQ ID NO: 27115 - RNA, 21 nt, Artificial Sequence
  ELANE RNA Guide
aauugccuccuucguccggga

SEQ ID NO: 27116 - RNA, 21 nt, Artificial Sequence
  ELANE RNA Guide
acggaauugccuccuucgucc

SEQ ID NO: 27117 - RNA, 21 nt, Artificial Sequence
  ELANE RNA Guide
agagcccugaggcgcagccuc

SEQ ID NO: 27118 - RNA, 21 nt, Artificial Sequence
  ELANE RNA Guide
agcccugaggcgcagccuccc

SEQ ID NO: 27119 - RNA, 21 nt, Artificial Sequence
  ELANE RNA Guide
agccucccggacgaaggaggc

SEQ ID NO: 27120 - RNA, 21 nt, Artificial Sequence
  ELANE RNA Guide
aggcgcagccucccggacgaa

SEQ ID NO: 27121 - RNA, 21 nt, Artificial Sequence
  ELANE RNA Guide
auugccuccuucguccgggag

SEQ ID NO: 27122 - RNA, 21 nt, Artificial Sequence
  ELANE RNA Guide
cagccucccggacgaaggagg

SEQ ID NO: 27123 - RNA, 21 nt, Artificial Sequence
  ELANE RNA Guide
ccucccggacgaaggaggcaa

SEQ ID NO: 27124 - RNA, 21 nt, Artificial Sequence
  ELANE RNA Guide
ccuccuucguccgggaggcug

SEQ ID NO: 27125 - RNA, 21 nt, Artificial Sequence
  ELANE RNA Guide
ccugaggcgcagccucccgga

SEQ ID NO: 27126 - RNA, 21 nt, Artificial Sequence
  ELANE RNA Guide
ccuucguccgggaggcugcgc

SEQ ID NO: 27127 - RNA, 21 nt, Artificial Sequence
  ELANE RNA Guide
cgcagccucccggacgaagga

SEQ ID NO: 27128 - RNA, 21 nt, Artificial Sequence
  ELANE RNA Guide
cggaauugccuccuucguccg

SEQ ID NO: 27129 - RNA, 21 nt, Artificial Sequence
  ELANE RNA Guide
cguccgggaggcugcgccuca

SEQ ID NO: 27130 - RNA, 21 nt, Artificial Sequence
  ELANE RNA Guide
cucccggacgaaggaggcaau

SEQ ID NO: 27131 - RNA, 21 nt, Artificial Sequence
  ELANE RNA Guide
cuccuucguccgggaggcugc

SEQ ID NO: 27132 - RNA, 21 nt, Artificial Sequence
  ELANE RNA Guide
cugaggcgcagccucccggac

SEQ ID NO: 27133 - RNA, 21 nt, Artificial Sequence
  ELANE RNA Guide
cuucguccgggaggcugcgcc

SEQ ID NO: 27134 - RNA, 21 nt, Artificial Sequence
  ELANE RNA Guide
gaauugccuccuucguccggg

SEQ ID NO: 27135 - RNA, 21 nt, Artificial Sequence
  ELANE RNA Guide
gagcccugaggcgcagccucc

SEQ ID NO: 27136 - RNA, 21 nt, Artificial Sequence
  ELANE RNA Guide
gaggcgcagccucccggacga

SEQ ID NO: 27137 - RNA, 21 nt, Artificial Sequence
  ELANE RNA Guide
gcagccucccggacgaaggag

SEQ ID NO: 27138 - RNA, 21 nt, Artificial Sequence
  ELANE RNA Guide
gccucccggacgaaggaggca

SEQ ID NO: 27139 - RNA, 21 nt, Artificial Sequence
  ELANE RNA Guide
gccuccuucguccgggaggcu

SEQ ID NO: 27140 - RNA, 21 nt, Artificial Sequence
  ELANE RNA Guide
gcgcagccucccggacgaagg

SEQ ID NO: 27141 - RNA, 21 nt, Artificial Sequence
  ELANE RNA Guide
ggaauugccuccuucguccgg

SEQ ID NO: 27142 - RNA, 21 nt, Artificial Sequence
  ELANE RNA Guide
ggcgcagccucccggacgaag

SEQ ID NO: 27143 - RNA, 21 nt, Artificial Sequence
  ELANE RNA Guide
guccgggaggcugcgccucag

SEQ ID NO: 27144 - RNA, 21 nt, Artificial Sequence
  ELANE RNA Guide
uagagcccugaggcgcagccu

SEQ ID NO: 27145 - RNA, 21 nt, Artificial Sequence
  ELANE RNA Guide
ucccggacgaaggaggcaauu

SEQ ID NO: 27146 - RNA, 21 nt, Artificial Sequence
  ELANE RNA Guide
uccgggaggcugcgccucagg

SEQ ID NO: 27147 - RNA, 21 nt, Artificial Sequence
  ELANE RNA Guide
uccuucguccgggaggcugcg

SEQ ID NO: 27148 - RNA, 21 nt, Artificial Sequence
  ELANE RNA Guide
ucguccgggaggcugcgccuc

SEQ ID NO: 27149 - RNA, 21 nt, Artificial Sequence
  ELANE RNA Guide
ugaggcgcagccucccggacg

SEQ ID NO: 27150 - RNA, 21 nt, Artificial Sequence
  ELANE RNA Guide
ugccuccuucguccgggaggc

SEQ ID NO: 27151 - RNA, 21 nt, Artificial Sequence
  ELANE RNA Guide
uucguccgggaggcugcgccu

SEQ ID NO: 27152 - RNA, 21 nt, Artificial Sequence
  ELANE RNA Guide
uugccuccuucguccgggagg

SEQ ID NO: 27153 - RNA, 22 nt, Artificial Sequence
  ELANE RNA Guide
aauugccuccuucguccgggag

SEQ ID NO: 27154 - RNA, 22 nt, Artificial Sequence
  ELANE RNA Guide
acggaauugccuccuucguccg

SEQ ID NO: 27155 - RNA, 22 nt, Artificial Sequence
  ELANE RNA Guide
agagcccugaggcgcagccucc

SEQ ID NO: 27156 - RNA, 22 nt, Artificial Sequence
  ELANE RNA Guide
agcccugaggcgcagccucccg

SEQ ID NO: 27157 - RNA, 22 nt, Artificial Sequence
  ELANE RNA Guide
agccucccggacgaaggaggca

SEQ ID NO: 27158 - RNA, 22 nt, Artificial Sequence
  ELANE RNA Guide
aggcgcagccucccggacgaag

SEQ ID NO: 27159 - RNA, 22 nt, Artificial Sequence
  ELANE RNA Guide
auugccuccuucguccgggagg

SEQ ID NO: 27160 - RNA, 22 nt, Artificial Sequence
  ELANE RNA Guide
cacggaauugccuccuucgucc

SEQ ID NO: 27161 - RNA, 22 nt, Artificial Sequence
  ELANE RNA Guide
cagccucccggacgaaggaggc

SEQ ID NO: 27162 - RNA, 22 nt, Artificial Sequence
  ELANE RNA Guide
cccugaggcgcagccucccgga

SEQ ID NO: 27163 - RNA, 22 nt, Artificial Sequence
  ELANE RNA Guide
ccucccggacgaaggaggcaau

SEQ ID NO: 27164 - RNA, 22 nt, Artificial Sequence
  ELANE RNA Guide
ccuccuucguccgggaggcugc

SEQ ID NO: 27165 - RNA, 22 nt, Artificial Sequence
  ELANE RNA Guide
ccugaggcgcagccucccggac

SEQ ID NO: 27166 - RNA, 22 nt, Artificial Sequence
  ELANE RNA Guide
ccuucguccgggaggcugcgcc

SEQ ID NO: 27167 - RNA, 22 nt, Artificial Sequence
  ELANE RNA Guide
cgcagccucccggacgaaggag

SEQ ID NO: 27168 - RNA, 22 nt, Artificial Sequence
  ELANE RNA Guide
cggaauugccuccuucguccgg

SEQ ID NO: 27169 - RNA, 22 nt, Artificial Sequence
  ELANE RNA Guide
cguccgggaggcugcgccucag

SEQ ID NO: 27170 - RNA, 22 nt, Artificial Sequence
  ELANE RNA Guide
cucccggacgaaggaggcaauu

SEQ ID NO: 27171 - RNA, 22 nt, Artificial Sequence
  ELANE RNA Guide
cuccuucguccgggaggcugcg

SEQ ID NO: 27172 - RNA, 22 nt, Artificial Sequence
  ELANE RNA Guide
cugaggcgcagccucccggacg

SEQ ID NO: 27173 - RNA, 22 nt, Artificial Sequence
  ELANE RNA Guide
cuucguccgggaggcugcgccu

SEQ ID NO: 27174 - RNA, 22 nt, Artificial Sequence
  ELANE RNA Guide
gaauugccuccuucguccggga

SEQ ID NO: 27175 - RNA, 22 nt, Artificial Sequence
  ELANE RNA Guide
gagcccugaggcgcagccuccc

SEQ ID NO: 27176 - RNA, 22 nt, Artificial Sequence
  ELANE RNA Guide
gaggcgcagccucccggacgaa

SEQ ID NO: 27177 - RNA, 22 nt, Artificial Sequence
  ELANE RNA Guide
gcagccucccggacgaaggagg

SEQ ID NO: 27178 - RNA, 22 nt, Artificial Sequence
  ELANE RNA Guide
gccucccggacgaaggaggcaa

SEQ ID NO: 27179 - RNA, 22 nt, Artificial Sequence
  ELANE RNA Guide
gccuccuucguccgggaggcug

SEQ ID NO: 27180 - RNA, 22 nt, Artificial Sequence
  ELANE RNA Guide
gcgcagccucccggacgaagga

SEQ ID NO: 27181 - RNA, 22 nt, Artificial Sequence
  ELANE RNA Guide
ggaauugccuccuucguccggg

SEQ ID NO: 27182 - RNA, 22 nt, Artificial Sequence
  ELANE RNA Guide
ggcgcagccucccggacgaagg

SEQ ID NO: 27183 - RNA, 22 nt, Artificial Sequence
  ELANE RNA Guide
guagagcccugaggcgcagccu

SEQ ID NO: 27184 - RNA, 22 nt, Artificial Sequence
  ELANE RNA Guide
guccgggaggcugcgccucagg

SEQ ID NO: 27185 - RNA, 22 nt, Artificial Sequence
  ELANE RNA Guide
uagagcccugaggcgcagccuc

SEQ ID NO: 27186 - RNA, 22 nt, Artificial Sequence
  ELANE RNA Guide
ucccggacgaaggaggcaauuc

SEQ ID NO: 27187 - RNA, 22 nt, Artificial Sequence
  ELANE RNA Guide
uccgggaggcugcgccucaggg

SEQ ID NO: 27188 - RNA, 22 nt, Artificial Sequence
  ELANE RNA Guide
uccuucguccgggaggcugcgc

SEQ ID NO: 27189 - RNA, 22 nt, Artificial Sequence
  ELANE RNA Guide
ucguccgggaggcugcgccuca

SEQ ID NO: 27190 - RNA, 22 nt, Artificial Sequence
  ELANE RNA Guide
ugaggcgcagccucccggacga

SEQ ID NO: 27191 - RNA, 22 nt, Artificial Sequence
  ELANE RNA Guide
ugccuccuucguccgggaggcu

SEQ ID NO: 27192 - RNA, 22 nt, Artificial Sequence
  ELANE RNA Guide
uucguccgggaggcugcgccuc

SEQ ID NO: 27193 - RNA, 22 nt, Artificial Sequence
  ELANE RNA Guide
uugccuccuucguccgggaggc

SEQ ID NO: 27194 - RNA, 20 nt, Artificial Sequence
  ELANE RNA Guide
aauugccuccuucguccagg

SEQ ID NO: 27195 - RNA, 20 nt, Artificial Sequence
  ELANE RNA Guide
acggaauugccuccuucguc

SEQ ID NO: 27196 - RNA, 20 nt, Artificial Sequence
  ELANE RNA Guide
agccucccuggacgaaggag

SEQ ID NO: 27197 - RNA, 20 nt, Artificial Sequence
  ELANE RNA Guide
aggcgcagccucccuggacg

SEQ ID NO: 27198 - RNA, 20 nt, Artificial Sequence
  ELANE RNA Guide
auugccuccuucguccaggg

SEQ ID NO: 27199 - RNA, 20 nt, Artificial Sequence
  ELANE RNA Guide
cacggaauugccuccuucgu

SEQ ID NO: 27200 - RNA, 20 nt, Artificial Sequence
  ELANE RNA Guide
cagccucccuggacgaagga

SEQ ID NO: 27201 - RNA, 20 nt, Artificial Sequence
  ELANE RNA Guide
cagggaggcugcgccucagg

SEQ ID NO: 27202 - RNA, 20 nt, Artificial Sequence
  ELANE RNA Guide
ccacggaauugccuccuucg

SEQ ID NO: 27203 - RNA, 20 nt, Artificial Sequence
  ELANE RNA Guide
ccagggaggcugcgccucag

SEQ ID NO: 27204 - RNA, 20 nt, Artificial Sequence
  ELANE RNA Guide
cccugaggcgcagccucccu

SEQ ID NO: 27205 - RNA, 20 nt, Artificial Sequence
  ELANE RNA Guide
cccuggacgaaggaggcaau

SEQ ID NO: 27206 - RNA, 20 nt, Artificial Sequence
  ELANE RNA Guide
ccucccuggacgaaggaggc

SEQ ID NO: 27207 - RNA, 20 nt, Artificial Sequence
  ELANE RNA Guide
ccuccuucguccagggaggc

SEQ ID NO: 27208 - RNA, 20 nt, Artificial Sequence
  ELANE RNA Guide
ccugaggcgcagccucccug

SEQ ID NO: 27209 - RNA, 20 nt, Artificial Sequence
  ELANE RNA Guide
ccuggacgaaggaggcaauu

SEQ ID NO: 27210 - RNA, 20 nt, Artificial Sequence
  ELANE RNA Guide
ccuucguccagggaggcugc

SEQ ID NO: 27211 - RNA, 20 nt, Artificial Sequence
  ELANE RNA Guide
cgcagccucccuggacgaag

SEQ ID NO: 27212 - RNA, 20 nt, Artificial Sequence
  ELANE RNA Guide
cguccagggaggcugcgccu

SEQ ID NO: 27213 - RNA, 20 nt, Artificial Sequence
  ELANE RNA Guide
cucccuggacgaaggaggca

SEQ ID NO: 27214 - RNA, 20 nt, Artificial Sequence
  ELANE RNA Guide
cuccuucguccagggaggcu

SEQ ID NO: 27215 - RNA, 20 nt, Artificial Sequence
  ELANE RNA Guide
cugaggcgcagccucccugg

SEQ ID NO: 27216 - RNA, 20 nt, Artificial Sequence
  ELANE RNA Guide
cuggacgaaggaggcaauuc

SEQ ID NO: 27217 - RNA, 20 nt, Artificial Sequence
  ELANE RNA Guide
cuucguccagggaggcugcg

SEQ ID NO: 27218 - RNA, 20 nt, Artificial Sequence
  ELANE RNA Guide
gaauugccuccuucguccag

SEQ ID NO: 27219 - RNA, 20 nt, Artificial Sequence
  ELANE RNA Guide
gaggcgcagccucccuggac

SEQ ID NO: 27220 - RNA, 20 nt, Artificial Sequence
  ELANE RNA Guide
gcagccucccuggacgaagg

SEQ ID NO: 27221 - RNA, 20 nt, Artificial Sequence
  ELANE RNA Guide
gccucccuggacgaaggagg

SEQ ID NO: 27222 - RNA, 20 nt, Artificial Sequence
  ELANE RNA Guide
gccuccuucguccagggagg

SEQ ID NO: 27223 - RNA, 20 nt, Artificial Sequence
  ELANE RNA Guide
gcgcagccucccuggacgaa

SEQ ID NO: 27224 - RNA, 20 nt, Artificial Sequence
  ELANE RNA Guide
ggaauugccuccuucgucca

SEQ ID NO: 27225 - RNA, 20 nt, Artificial Sequence
  ELANE RNA Guide
ggcgcagccucccuggacga

SEQ ID NO: 27226 - RNA, 20 nt, Artificial Sequence
  ELANE RNA Guide
guccagggaggcugcgccuc

SEQ ID NO: 27227 - RNA, 20 nt, Artificial Sequence
  ELANE RNA Guide
uccagggaggcugcgccuca

SEQ ID NO: 27228 - RNA, 20 nt, Artificial Sequence
  ELANE RNA Guide
ucccuggacgaaggaggcaa

SEQ ID NO: 27229 - RNA, 20 nt, Artificial Sequence
  ELANE RNA Guide
uccuucguccagggaggcug

SEQ ID NO: 27230 - RNA, 20 nt, Artificial Sequence
  ELANE RNA Guide
ucguccagggaggcugcgcc

SEQ ID NO: 27231 - RNA, 20 nt, Artificial Sequence
  ELANE RNA Guide
ugaggcgcagccucccugga

SEQ ID NO: 27232 - RNA, 20 nt, Artificial Sequence
  ELANE RNA Guide
ugccuccuucguccagggag

SEQ ID NO: 27233 - RNA, 20 nt, Artificial Sequence
  ELANE RNA Guide
uucguccagggaggcugcgc

SEQ ID NO: 27234 - RNA, 20 nt, Artificial Sequence
  ELANE RNA Guide
uugccuccuucguccaggga

SEQ ID NO: 27235 - RNA, 21 nt, Artificial Sequence
  ELANE RNA Guide
aauugccuccuucguccaggg

SEQ ID NO: 27236 - RNA, 21 nt, Artificial Sequence
  ELANE RNA Guide
agccucccuggacgaaggagg

SEQ ID NO: 27237 - RNA, 21 nt, Artificial Sequence
  ELANE RNA Guide
aggcgcagccucccuggacga

SEQ ID NO: 27238 - RNA, 21 nt, Artificial Sequence
  ELANE RNA Guide
auugccuccuucguccaggga

SEQ ID NO: 27239 - RNA, 21 nt, Artificial Sequence
  ELANE RNA Guide
cacggaauugccuccuucguc

SEQ ID NO: 27240 - RNA, 21 nt, Artificial Sequence
  ELANE RNA Guide
cagccucccuggacgaaggag

SEQ ID NO: 27241 - RNA, 21 nt, Artificial Sequence
  ELANE RNA Guide
cagggaggcugcgccucaggg

SEQ ID NO: 27242 - RNA, 21 nt, Artificial Sequence
  ELANE RNA Guide
ccacggaauugccuccuucgu

SEQ ID NO: 27243 - RNA, 21 nt, Artificial Sequence
  ELANE RNA Guide
ccagggaggcugcgccucagg

SEQ ID NO: 27244 - RNA, 21 nt, Artificial Sequence
  ELANE RNA Guide
cccugaggcgcagccucccug

SEQ ID NO: 27245 - RNA, 21 nt, Artificial Sequence
  ELANE RNA Guide
cccuggacgaaggaggcaauu

SEQ ID NO: 27246 - RNA, 21 nt, Artificial Sequence
  ELANE RNA Guide
ccucccuggacgaaggaggca

SEQ ID NO: 27247 - RNA, 21 nt, Artificial Sequence
  ELANE RNA Guide
ccuccuucguccagggaggcu

SEQ ID NO: 27248 - RNA, 21 nt, Artificial Sequence
  ELANE RNA Guide
ccugaggcgcagccucccugg

SEQ ID NO: 27249 - RNA, 21 nt, Artificial Sequence
  ELANE RNA Guide
ccuggacgaaggaggcaauuc

SEQ ID NO: 27250 - RNA, 21 nt, Artificial Sequence
  ELANE RNA Guide
ccuucguccagggaggcugcg

SEQ ID NO: 27251 - RNA, 21 nt, Artificial Sequence
  ELANE RNA Guide
cgcagccucccuggacgaagg

SEQ ID NO: 27252 - RNA, 21 nt, Artificial Sequence
  ELANE RNA Guide
cggaauugccuccuucgucca

SEQ ID NO: 27253 - RNA, 21 nt, Artificial Sequence
  ELANE RNA Guide
cguccagggaggcugcgccuc

SEQ ID NO: 27254 - RNA, 21 nt, Artificial Sequence
  ELANE RNA Guide
cucccuggacgaaggaggcaa

SEQ ID NO: 27255 - RNA, 21 nt, Artificial Sequence
  ELANE RNA Guide
cuccuucguccagggaggcug

SEQ ID NO: 27256 - RNA, 21 nt, Artificial Sequence
  ELANE RNA Guide
cugaggcgcagccucccugga

SEQ ID NO: 27257 - RNA, 21 nt, Artificial Sequence
  ELANE RNA Guide
cuggacgaaggaggcaauucc

SEQ ID NO: 27258 - RNA, 21 nt, Artificial Sequence
  ELANE RNA Guide
cuucguccagggaggcugcgc

SEQ ID NO: 27259 - RNA, 21 nt, Artificial Sequence
  ELANE RNA Guide
gaauugccuccuucguccagg

SEQ ID NO: 27260 - RNA, 21 nt, Artificial Sequence
  ELANE RNA Guide
gaggcgcagccucccuggacg

SEQ ID NO: 27261 - RNA, 21 nt, Artificial Sequence
  ELANE RNA Guide
gcagccucccuggacgaagga

SEQ ID NO: 27262 - RNA, 21 nt, Artificial Sequence
  ELANE RNA Guide
gcccugaggcgcagccucccu

SEQ ID NO: 27263 - RNA, 21 nt, Artificial Sequence
  ELANE RNA Guide
gccucccuggacgaaggaggc

SEQ ID NO: 27264 - RNA, 21 nt, Artificial Sequence
  ELANE RNA Guide
gccuccuucguccagggaggc

SEQ ID NO: 27265 - RNA, 21 nt, Artificial Sequence
  ELANE RNA Guide
gcgcagccucccuggacgaag

SEQ ID NO: 27266 - RNA, 21 nt, Artificial Sequence
  ELANE RNA Guide
ggaauugccuccuucguccag

SEQ ID NO: 27267 - RNA, 21 nt, Artificial Sequence
  ELANE RNA Guide
ggcgcagccucccuggacgaa

SEQ ID NO: 27268 - RNA, 21 nt, Artificial Sequence
  ELANE RNA Guide
guccagggaggcugcgccuca

SEQ ID NO: 27269 - RNA, 21 nt, Artificial Sequence
  ELANE RNA Guide
uccacggaauugccuccuucg

SEQ ID NO: 27270 - RNA, 21 nt, Artificial Sequence
  ELANE RNA Guide
uccagggaggcugcgccucag

SEQ ID NO: 27271 - RNA, 21 nt, Artificial Sequence
  ELANE RNA Guide
ucccuggacgaaggaggcaau

SEQ ID NO: 27272 - RNA, 21 nt, Artificial Sequence
  ELANE RNA Guide
uccuucguccagggaggcugc

SEQ ID NO: 27273 - RNA, 21 nt, Artificial Sequence
  ELANE RNA Guide
ucguccagggaggcugcgccu

SEQ ID NO: 27274 - RNA, 21 nt, Artificial Sequence
  ELANE RNA Guide
ugaggcgcagccucccuggac

SEQ ID NO: 27275 - RNA, 21 nt, Artificial Sequence
  ELANE RNA Guide
ugccuccuucguccagggagg

SEQ ID NO: 27276 - RNA, 21 nt, Artificial Sequence
  ELANE RNA Guide
uucguccagggaggcugcgcc

SEQ ID NO: 27277 - RNA, 21 nt, Artificial Sequence
  ELANE RNA Guide
uugccuccuucguccagggag

SEQ ID NO: 27278 - RNA, 22 nt, Artificial Sequence
  ELANE RNA Guide
aauugccuccuucguccaggga

SEQ ID NO: 27279 - RNA, 22 nt, Artificial Sequence
  ELANE RNA Guide
acggaauugccuccuucgucca

SEQ ID NO: 27280 - RNA, 22 nt, Artificial Sequence
  ELANE RNA Guide
agcccugaggcgcagccucccu

SEQ ID NO: 27281 - RNA, 22 nt, Artificial Sequence
  ELANE RNA Guide
agccucccuggacgaaggaggc

SEQ ID NO: 27282 - RNA, 22 nt, Artificial Sequence
  ELANE RNA Guide
aggcgcagccucccuggacgaa

SEQ ID NO: 27283 - RNA, 22 nt, Artificial Sequence
  ELANE RNA Guide
auccacggaauugccuccuucg

SEQ ID NO: 27284 - RNA, 22 nt, Artificial Sequence
  ELANE RNA Guide
auugccuccuucguccagggag

SEQ ID NO: 27285 - RNA, 22 nt, Artificial Sequence
  ELANE RNA Guide
cagccucccuggacgaaggagg

SEQ ID NO: 27286 - RNA, 22 nt, Artificial Sequence
  ELANE RNA Guide
cagggaggcugcgccucagggc

SEQ ID NO: 27287 - RNA, 22 nt, Artificial Sequence
  ELANE RNA Guide
ccacggaauugccuccuucguc

SEQ ID NO: 27288 - RNA, 22 nt, Artificial Sequence
  ELANE RNA Guide
ccagggaggcugcgccucaggg

SEQ ID NO: 27289 - RNA, 22 nt, Artificial Sequence
  ELANE RNA Guide
cccugaggcgcagccucccugg

SEQ ID NO: 27290 - RNA, 22 nt, Artificial Sequence
  ELANE RNA Guide
cccuggacgaaggaggcaauuc

SEQ ID NO: 27291 - RNA, 22 nt, Artificial Sequence
  ELANE RNA Guide
ccucccuggacgaaggaggcaa

SEQ ID NO: 27292 - RNA, 22 nt, Artificial Sequence
  ELANE RNA Guide
ccuccuucguccagggaggcug

SEQ ID NO: 27293 - RNA, 22 nt, Artificial Sequence
  ELANE RNA Guide
ccugaggcgcagccucccugga

SEQ ID NO: 27294 - RNA, 22 nt, Artificial Sequence
  ELANE RNA Guide
ccuggacgaaggaggcaauucc

SEQ ID NO: 27295 - RNA, 22 nt, Artificial Sequence
  ELANE RNA Guide
ccuucguccagggaggcugcgc

SEQ ID NO: 27296 - RNA, 22 nt, Artificial Sequence
  ELANE RNA Guide
cgcagccucccuggacgaagga

SEQ ID NO: 27297 - RNA, 22 nt, Artificial Sequence
  ELANE RNA Guide
cggaauugccuccuucguccag

SEQ ID NO: 27298 - RNA, 22 nt, Artificial Sequence
  ELANE RNA Guide
cguccagggaggcugcgccuca

SEQ ID NO: 27299 - RNA, 22 nt, Artificial Sequence
  ELANE RNA Guide
cucccuggacgaaggaggcaau

SEQ ID NO: 27300 - RNA, 22 nt, Artificial Sequence
  ELANE RNA Guide
cuccuucguccagggaggcugc

SEQ ID NO: 27301 - RNA, 22 nt, Artificial Sequence
  ELANE RNA Guide
cugaggcgcagccucccuggac

SEQ ID NO: 27302 - RNA, 22 nt, Artificial Sequence
  ELANE RNA Guide
cuggacgaaggaggcaauuccg

SEQ ID NO: 27303 - RNA, 22 nt, Artificial Sequence
  ELANE RNA Guide
cuucguccagggaggcugcgcc

SEQ ID NO: 27304 - RNA, 22 nt, Artificial Sequence
  ELANE RNA Guide
gaauugccuccuucguccaggg

SEQ ID NO: 27305 - RNA, 22 nt, Artificial Sequence
  ELANE RNA Guide
gaggcgcagccucccuggacga

SEQ ID NO: 27306 - RNA, 22 nt, Artificial Sequence
  ELANE RNA Guide
gcagccucccuggacgaaggag

SEQ ID NO: 27307 - RNA, 22 nt, Artificial Sequence
  ELANE RNA Guide
gcccugaggcgcagccucccug

SEQ ID NO: 27308 - RNA, 22 nt, Artificial Sequence
  ELANE RNA Guide
gccucccuggacgaaggaggca

SEQ ID NO: 27309 - RNA, 22 nt, Artificial Sequence
  ELANE RNA Guide
gccuccuucguccagggaggcu

SEQ ID NO: 27310 - RNA, 22 nt, Artificial Sequence
  ELANE RNA Guide
gcgcagccucccuggacgaagg

SEQ ID NO: 27311 - RNA, 22 nt, Artificial Sequence
  ELANE RNA Guide
ggaauugccuccuucguccagg

SEQ ID NO: 27312 - RNA, 22 nt, Artificial Sequence
  ELANE RNA Guide
ggcgcagccucccuggacgaag

SEQ ID NO: 27313 - RNA, 22 nt, Artificial Sequence
  ELANE RNA Guide
guccagggaggcugcgccucag

SEQ ID NO: 27314 - RNA, 22 nt, Artificial Sequence
  ELANE RNA Guide
uccacggaauugccuccuucgu

SEQ ID NO: 27315 - RNA, 22 nt, Artificial Sequence
  ELANE RNA Guide
uccagggaggcugcgccucagg

SEQ ID NO: 27316 - RNA, 22 nt, Artificial Sequence
  ELANE RNA Guide
ucccuggacgaaggaggcaauu

SEQ ID NO: 27317 - RNA, 22 nt, Artificial Sequence
  ELANE RNA Guide
uccuucguccagggaggcugcg

SEQ ID NO: 27318 - RNA, 22 nt, Artificial Sequence
  ELANE RNA Guide
ucguccagggaggcugcgccuc

SEQ ID NO: 27319 - RNA, 22 nt, Artificial Sequence
  ELANE RNA Guide
ugaggcgcagccucccuggacg

SEQ ID NO: 27320 - RNA, 22 nt, Artificial Sequence
  ELANE RNA Guide
ugccuccuucguccagggaggc

SEQ ID NO: 27321 - RNA, 22 nt, Artificial Sequence
  ELANE RNA Guide
uucguccagggaggcugcgccu

SEQ ID NO: 27322 - RNA, 22 nt, Artificial Sequence
  ELANE RNA Guide
uugccuccuucguccagggagg

SEQ ID NO: 27323 - RNA, 20 nt, Artificial Sequence
  ELANE RNA Guide
aauugccuccuucguccggu

SEQ ID NO: 27324 - RNA, 20 nt, Artificial Sequence
  ELANE RNA Guide
agcccugaggcgcagccuca

SEQ ID NO: 27325 - RNA, 20 nt, Artificial Sequence
  ELANE RNA Guide
agccucaccggacgaaggag

SEQ ID NO: 27326 - RNA, 20 nt, Artificial Sequence
  ELANE RNA Guide
aggcgcagccucaccggacg

SEQ ID NO: 27327 - RNA, 20 nt, Artificial Sequence
  ELANE RNA Guide
auugccuccuucguccggug

SEQ ID NO: 27328 - RNA, 20 nt, Artificial Sequence
  ELANE RNA Guide
caccggacgaaggaggcaau

SEQ ID NO: 27329 - RNA, 20 nt, Artificial Sequence
  ELANE RNA Guide
cagccucaccggacgaagga

SEQ ID NO: 27330 - RNA, 20 nt, Artificial Sequence
  ELANE RNA Guide
cccugaggcgcagccucacc

SEQ ID NO: 27331 - RNA, 20 nt, Artificial Sequence
  ELANE RNA Guide
ccggugaggcugcgccucag

SEQ ID NO: 27332 - RNA, 20 nt, Artificial Sequence
  ELANE RNA Guide
ccucaccggacgaaggaggc

SEQ ID NO: 27333 - RNA, 20 nt, Artificial Sequence
  ELANE RNA Guide
ccuccuucguccggugaggc

SEQ ID NO: 27334 - RNA, 20 nt, Artificial Sequence
  ELANE RNA Guide
ccugaggcgcagccucaccg

SEQ ID NO: 27335 - RNA, 20 nt, Artificial Sequence
  ELANE RNA Guide
ccuucguccggugaggcugc

SEQ ID NO: 27336 - RNA, 20 nt, Artificial Sequence
  ELANE RNA Guide
cgcagccucaccggacgaag

SEQ ID NO: 27337 - RNA, 20 nt, Artificial Sequence
  ELANE RNA Guide
cggugaggcugcgccucagg

SEQ ID NO: 27338 - RNA, 20 nt, Artificial Sequence
  ELANE RNA Guide
cguccggugaggcugcgccu

SEQ ID NO: 27339 - RNA, 20 nt, Artificial Sequence
  ELANE RNA Guide
cucaccggacgaaggaggca

SEQ ID NO: 27340 - RNA, 20 nt, Artificial Sequence
  ELANE RNA Guide
cuccuucguccggugaggcu

SEQ ID NO: 27341 - RNA, 20 nt, Artificial Sequence
  ELANE RNA Guide
cugaggcgcagccucaccgg

SEQ ID NO: 27342 - RNA, 20 nt, Artificial Sequence
  ELANE RNA Guide
cuucguccggugaggcugcg

SEQ ID NO: 27343 - RNA, 20 nt, Artificial Sequence
  ELANE RNA Guide
gaggcgcagccucaccggac

SEQ ID NO: 27344 - RNA, 20 nt, Artificial Sequence
  ELANE RNA Guide
gcagccucaccggacgaagg

SEQ ID NO: 27345 - RNA, 20 nt, Artificial Sequence
  ELANE RNA Guide
gcccugaggcgcagccucac

SEQ ID NO: 27346 - RNA, 20 nt, Artificial Sequence
  ELANE RNA Guide
gccucaccggacgaaggagg

SEQ ID NO: 27347 - RNA, 20 nt, Artificial Sequence
  ELANE RNA Guide
gccuccuucguccggugagg

SEQ ID NO: 27348 - RNA, 20 nt, Artificial Sequence
  ELANE RNA Guide
gcgcagccucaccggacgaa

SEQ ID NO: 27349 - RNA, 20 nt, Artificial Sequence
  ELANE RNA Guide
ggcgcagccucaccggacga

SEQ ID NO: 27350 - RNA, 20 nt, Artificial Sequence
  ELANE RNA Guide
ggugaggcugcgccucaggg

SEQ ID NO: 27351 - RNA, 20 nt, Artificial Sequence
  ELANE RNA Guide
guagagcccugaggcgcagc

SEQ ID NO: 27352 - RNA, 20 nt, Artificial Sequence
  ELANE RNA Guide
guccggugaggcugcgccuc

SEQ ID NO: 27353 - RNA, 20 nt, Artificial Sequence
  ELANE RNA Guide
gugaggcugcgccucagggc

SEQ ID NO: 27354 - RNA, 20 nt, Artificial Sequence
  ELANE RNA Guide
uagagcccugaggcgcagcc

SEQ ID NO: 27355 - RNA, 20 nt, Artificial Sequence
  ELANE RNA Guide
ucaccggacgaaggaggcaa

SEQ ID NO: 27356 - RNA, 20 nt, Artificial Sequence
  ELANE RNA Guide
uccggugaggcugcgccuca

SEQ ID NO: 27357 - RNA, 20 nt, Artificial Sequence
  ELANE RNA Guide
uccuucguccggugaggcug

SEQ ID NO: 27358 - RNA, 20 nt, Artificial Sequence
  ELANE RNA Guide
ucguccggugaggcugcgcc

SEQ ID NO: 27359 - RNA, 20 nt, Artificial Sequence
  ELANE RNA Guide
ugaggcgcagccucaccgga

SEQ ID NO: 27360 - RNA, 20 nt, Artificial Sequence
  ELANE RNA Guide
ugccuccuucguccggugag

SEQ ID NO: 27361 - RNA, 20 nt, Artificial Sequence
  ELANE RNA Guide
uucguccggugaggcugcgc

SEQ ID NO: 27362 - RNA, 20 nt, Artificial Sequence
  ELANE RNA Guide
uugccuccuucguccgguga

SEQ ID NO: 27363 - RNA, 21 nt, Artificial Sequence
  ELANE RNA Guide
aauugccuccuucguccggug

SEQ ID NO: 27364 - RNA, 21 nt, Artificial Sequence
  ELANE RNA Guide
agcccugaggcgcagccucac

SEQ ID NO: 27365 - RNA, 21 nt, Artificial Sequence
  ELANE RNA Guide
agccucaccggacgaaggagg

SEQ ID NO: 27366 - RNA, 21 nt, Artificial Sequence
  ELANE RNA Guide
aggcgcagccucaccggacga

SEQ ID NO: 27367 - RNA, 21 nt, Artificial Sequence
  ELANE RNA Guide
auugccuccuucguccgguga

SEQ ID NO: 27368 - RNA, 21 nt, Artificial Sequence
  ELANE RNA Guide
caccggacgaaggaggcaauu

SEQ ID NO: 27369 - RNA, 21 nt, Artificial Sequence
  ELANE RNA Guide
cagccucaccggacgaaggag

SEQ ID NO: 27370 - RNA, 21 nt, Artificial Sequence
  ELANE RNA Guide
cccugaggcgcagccucaccg

SEQ ID NO: 27371 - RNA, 21 nt, Artificial Sequence
  ELANE RNA Guide
ccggugaggcugcgccucagg

SEQ ID NO: 27372 - RNA, 21 nt, Artificial Sequence
  ELANE RNA Guide
ccucaccggacgaaggaggca

SEQ ID NO: 27373 - RNA, 21 nt, Artificial Sequence
  ELANE RNA Guide
ccuccuucguccggugaggcu

SEQ ID NO: 27374 - RNA, 21 nt, Artificial Sequence
  ELANE RNA Guide
ccugaggcgcagccucaccgg

SEQ ID NO: 27375 - RNA, 21 nt, Artificial Sequence
  ELANE RNA Guide
ccuucguccggugaggcugcg

SEQ ID NO: 27376 - RNA, 21 nt, Artificial Sequence
  ELANE RNA Guide
cgcagccucaccggacgaagg

SEQ ID NO: 27377 - RNA, 21 nt, Artificial Sequence
  ELANE RNA Guide
cggugaggcugcgccucaggg

SEQ ID NO: 27378 - RNA, 21 nt, Artificial Sequence
  ELANE RNA Guide
cguccggugaggcugcgccuc

SEQ ID NO: 27379 - RNA, 21 nt, Artificial Sequence
  ELANE RNA Guide
cucaccggacgaaggaggcaa

SEQ ID NO: 27380 - RNA, 21 nt, Artificial Sequence
  ELANE RNA Guide
cuccuucguccggugaggcug

SEQ ID NO: 27381 - RNA, 21 nt, Artificial Sequence
  ELANE RNA Guide
cugaggcgcagccucaccgga

SEQ ID NO: 27382 - RNA, 21 nt, Artificial Sequence
  ELANE RNA Guide
cuucguccggugaggcugcgc

SEQ ID NO: 27383 - RNA, 21 nt, Artificial Sequence
  ELANE RNA Guide
gaauugccuccuucguccggu

SEQ ID NO: 27384 - RNA, 21 nt, Artificial Sequence
  ELANE RNA Guide
gagcccugaggcgcagccuca

SEQ ID NO: 27385 - RNA, 21 nt, Artificial Sequence
  ELANE RNA Guide
gaggcgcagccucaccggacg

SEQ ID NO: 27386 - RNA, 21 nt, Artificial Sequence
  ELANE RNA Guide
gcagccucaccggacgaagga

SEQ ID NO: 27387 - RNA, 21 nt, Artificial Sequence
  ELANE RNA Guide
gcccugaggcgcagccucacc

SEQ ID NO: 27388 - RNA, 21 nt, Artificial Sequence
  ELANE RNA Guide
gccucaccggacgaaggaggc

SEQ ID NO: 27389 - RNA, 21 nt, Artificial Sequence
  ELANE RNA Guide
gccuccuucguccggugaggc

SEQ ID NO: 27390 - RNA, 21 nt, Artificial Sequence
  ELANE RNA Guide
gcgcagccucaccggacgaag

SEQ ID NO: 27391 - RNA, 21 nt, Artificial Sequence
  ELANE RNA Guide
ggcgcagccucaccggacgaa

SEQ ID NO: 27392 - RNA, 21 nt, Artificial Sequence
  ELANE RNA Guide
gguagagcccugaggcgcagc

SEQ ID NO: 27393 - RNA, 21 nt, Artificial Sequence
  ELANE RNA Guide
ggugaggcugcgccucagggc

SEQ ID NO: 27394 - RNA, 21 nt, Artificial Sequence
  ELANE RNA Guide
guagagcccugaggcgcagcc

SEQ ID NO: 27395 - RNA, 21 nt, Artificial Sequence
  ELANE RNA Guide
guccggugaggcugcgccuca

SEQ ID NO: 27396 - RNA, 21 nt, Artificial Sequence
  ELANE RNA Guide
gugaggcugcgccucagggcu

SEQ ID NO: 27397 - RNA, 21 nt, Artificial Sequence
  ELANE RNA Guide
ucaccggacgaaggaggcaau

SEQ ID NO: 27398 - RNA, 21 nt, Artificial Sequence
  ELANE RNA Guide
uccggugaggcugcgccucag

SEQ ID NO: 27399 - RNA, 21 nt, Artificial Sequence
  ELANE RNA Guide
uccuucguccggugaggcugc

SEQ ID NO: 27400 - RNA, 21 nt, Artificial Sequence
  ELANE RNA Guide
ucguccggugaggcugcgccu

SEQ ID NO: 27401 - RNA, 21 nt, Artificial Sequence
  ELANE RNA Guide
ugaggcgcagccucaccggac

SEQ ID NO: 27402 - RNA, 21 nt, Artificial Sequence
  ELANE RNA Guide
ugccuccuucguccggugagg

SEQ ID NO: 27403 - RNA, 21 nt, Artificial Sequence
  ELANE RNA Guide
uucguccggugaggcugcgcc

SEQ ID NO: 27404 - RNA, 21 nt, Artificial Sequence
  ELANE RNA Guide
uugccuccuucguccggugag

SEQ ID NO: 27405 - RNA, 22 nt, Artificial Sequence
  ELANE RNA Guide
aauugccuccuucguccgguga

SEQ ID NO: 27406 - RNA, 22 nt, Artificial Sequence
  ELANE RNA Guide
agagcccugaggcgcagccuca

SEQ ID NO: 27407 - RNA, 22 nt, Artificial Sequence
  ELANE RNA Guide
agcccugaggcgcagccucacc

SEQ ID NO: 27408 - RNA, 22 nt, Artificial Sequence
  ELANE RNA Guide
agccucaccggacgaaggaggc

SEQ ID NO: 27409 - RNA, 22 nt, Artificial Sequence
  ELANE RNA Guide
aggcgcagccucaccggacgaa

SEQ ID NO: 27410 - RNA, 22 nt, Artificial Sequence
  ELANE RNA Guide
auugccuccuucguccggugag

SEQ ID NO: 27411 - RNA, 22 nt, Artificial Sequence
  ELANE RNA Guide
caccggacgaaggaggcaauuc

SEQ ID NO: 27412 - RNA, 22 nt, Artificial Sequence
  ELANE RNA Guide
cagccucaccggacgaaggagg

SEQ ID NO: 27413 - RNA, 22 nt, Artificial Sequence
  ELANE RNA Guide
cccugaggcgcagccucaccgg

SEQ ID NO: 27414 - RNA, 22 nt, Artificial Sequence
  ELANE RNA Guide
ccggugaggcugcgccucaggg

SEQ ID NO: 27415 - RNA, 22 nt, Artificial Sequence
  ELANE RNA Guide
ccucaccggacgaaggaggcaa

SEQ ID NO: 27416 - RNA, 22 nt, Artificial Sequence
  ELANE RNA Guide
ccuccuucguccggugaggcug

SEQ ID NO: 27417 - RNA, 22 nt, Artificial Sequence
  ELANE RNA Guide
ccugaggcgcagccucaccgga

SEQ ID NO: 27418 - RNA, 22 nt, Artificial Sequence
  ELANE RNA Guide
ccuucguccggugaggcugcgc

SEQ ID NO: 27419 - RNA, 22 nt, Artificial Sequence
  ELANE RNA Guide
cgcagccucaccggacgaagga

SEQ ID NO: 27420 - RNA, 22 nt, Artificial Sequence
  ELANE RNA Guide
cggugaggcugcgccucagggc

SEQ ID NO: 27421 - RNA, 22 nt, Artificial Sequence
  ELANE RNA Guide
cguccggugaggcugcgccuca

SEQ ID NO: 27422 - RNA, 22 nt, Artificial Sequence
  ELANE RNA Guide
cucaccggacgaaggaggcaau

SEQ ID NO: 27423 - RNA, 22 nt, Artificial Sequence
  ELANE RNA Guide
cuccuucguccggugaggcugc

SEQ ID NO: 27424 - RNA, 22 nt, Artificial Sequence
  ELANE RNA Guide
cugaggcgcagccucaccggac

SEQ ID NO: 27425 - RNA, 22 nt, Artificial Sequence
  ELANE RNA Guide
cuucguccggugaggcugcgcc

SEQ ID NO: 27426 - RNA, 22 nt, Artificial Sequence
  ELANE RNA Guide
gaauugccuccuucguccggug

SEQ ID NO: 27427 - RNA, 22 nt, Artificial Sequence
  ELANE RNA Guide
gagcccugaggcgcagccucac

SEQ ID NO: 27428 - RNA, 22 nt, Artificial Sequence
  ELANE RNA Guide
gaggcgcagccucaccggacga

SEQ ID NO: 27429 - RNA, 22 nt, Artificial Sequence
  ELANE RNA Guide
gcagccucaccggacgaaggag

SEQ ID NO: 27430 - RNA, 22 nt, Artificial Sequence
  ELANE RNA Guide
gcccugaggcgcagccucaccg

SEQ ID NO: 27431 - RNA, 22 nt, Artificial Sequence
  ELANE RNA Guide
gccucaccggacgaaggaggca

SEQ ID NO: 27432 - RNA, 22 nt, Artificial Sequence
  ELANE RNA Guide
gccuccuucguccggugaggcu

SEQ ID NO: 27433 - RNA, 22 nt, Artificial Sequence
  ELANE RNA Guide
gcgcagccucaccggacgaagg

SEQ ID NO: 27434 - RNA, 22 nt, Artificial Sequence
  ELANE RNA Guide
ggaauugccuccuucguccggu

SEQ ID NO: 27435 - RNA, 22 nt, Artificial Sequence
  ELANE RNA Guide
ggcgcagccucaccggacgaag

SEQ ID NO: 27436 - RNA, 22 nt, Artificial Sequence
  ELANE RNA Guide
ggguagagcccugaggcgcagc

SEQ ID NO: 27437 - RNA, 22 nt, Artificial Sequence
  ELANE RNA Guide
gguagagcccugaggcgcagcc

SEQ ID NO: 27438 - RNA, 22 nt, Artificial Sequence
  ELANE RNA Guide
ggugaggcugcgccucagggcu

SEQ ID NO: 27439 - RNA, 22 nt, Artificial Sequence
  ELANE RNA Guide
guccggugaggcugcgccucag

SEQ ID NO: 27440 - RNA, 22 nt, Artificial Sequence
  ELANE RNA Guide
gugaggcugcgccucagggcuc

SEQ ID NO: 27441 - RNA, 22 nt, Artificial Sequence
  ELANE RNA Guide
ucaccggacgaaggaggcaauu

SEQ ID NO: 27442 - RNA, 22 nt, Artificial Sequence
  ELANE RNA Guide
uccggugaggcugcgccucagg

SEQ ID NO: 27443 - RNA, 22 nt, Artificial Sequence
  ELANE RNA Guide
uccuucguccggugaggcugcg

SEQ ID NO: 27444 - RNA, 22 nt, Artificial Sequence
  ELANE RNA Guide
ucguccggugaggcugcgccuc

SEQ ID NO: 27445 - RNA, 22 nt, Artificial Sequence
  ELANE RNA Guide
ugaggcgcagccucaccggacg

SEQ ID NO: 27446 - RNA, 22 nt, Artificial Sequence
  ELANE RNA Guide
ugccuccuucguccggugaggc

SEQ ID NO: 27447 - RNA, 22 nt, Artificial Sequence
  ELANE RNA Guide
uucguccggugaggcugcgccu

SEQ ID NO: 27448 - RNA, 22 nt, Artificial Sequence
  ELANE RNA Guide
uugccuccuucguccggugagg

SEQ ID NO: 27449 - RNA, 20 nt, Artificial Sequence
  ELANE RNA Guide
agacugcgccucagggcucu

SEQ ID NO: 27450 - RNA, 20 nt, Artificial Sequence
  ELANE RNA Guide
agagcccugaggcgcagucu

SEQ ID NO: 27451 - RNA, 20 nt, Artificial Sequence
  ELANE RNA Guide
agcccugaggcgcagucucc

SEQ ID NO: 27452 - RNA, 20 nt, Artificial Sequence
  ELANE RNA Guide
aggcgcagucuccccggacg

SEQ ID NO: 27453 - RNA, 20 nt, Artificial Sequence
  ELANE RNA Guide
agucuccccggacgaaggag

SEQ ID NO: 27454 - RNA, 20 nt, Artificial Sequence
  ELANE RNA Guide
auugccuccuucguccgggg

SEQ ID NO: 27455 - RNA, 20 nt, Artificial Sequence
  ELANE RNA Guide
cagucuccccggacgaagga

SEQ ID NO: 27456 - RNA, 20 nt, Artificial Sequence
  ELANE RNA Guide
cccugaggcgcagucucccc

SEQ ID NO: 27457 - RNA, 20 nt, Artificial Sequence
  ELANE RNA Guide
ccggggagacugcgccucag

SEQ ID NO: 27458 - RNA, 20 nt, Artificial Sequence
  ELANE RNA Guide
ccuccuucguccggggagac

SEQ ID NO: 27459 - RNA, 20 nt, Artificial Sequence
  ELANE RNA Guide
ccugaggcgcagucuccccg

SEQ ID NO: 27460 - RNA, 20 nt, Artificial Sequence
  ELANE RNA Guide
ccuucguccggggagacugc

SEQ ID NO: 27461 - RNA, 20 nt, Artificial Sequence
  ELANE RNA Guide
cgcagucuccccggacgaag

SEQ ID NO: 27462 - RNA, 20 nt, Artificial Sequence
  ELANE RNA Guide
cggggagacugcgccucagg

SEQ ID NO: 27463 - RNA, 20 nt, Artificial Sequence
  ELANE RNA Guide
cgggguagagcccugaggcg

SEQ ID NO: 27464 - RNA, 20 nt, Artificial Sequence
  ELANE RNA Guide
cguccggggagacugcgccu

SEQ ID NO: 27465 - RNA, 20 nt, Artificial Sequence
  ELANE RNA Guide
cuccuucguccggggagacu

SEQ ID NO: 27466 - RNA, 20 nt, Artificial Sequence
  ELANE RNA Guide
cugaggcgcagucuccccgg

SEQ ID NO: 27467 - RNA, 20 nt, Artificial Sequence
  ELANE RNA Guide
cuucguccggggagacugcg

SEQ ID NO: 27468 - RNA, 20 nt, Artificial Sequence
  ELANE RNA Guide
gacugcgccucagggcucua

SEQ ID NO: 27469 - RNA, 20 nt, Artificial Sequence
  ELANE RNA Guide
gagacugcgccucagggcuc

SEQ ID NO: 27470 - RNA, 20 nt, Artificial Sequence
  ELANE RNA Guide
gagcccugaggcgcagucuc

SEQ ID NO: 27471 - RNA, 20 nt, Artificial Sequence
  ELANE RNA Guide
gaggcgcagucuccccggac

SEQ ID NO: 27472 - RNA, 20 nt, Artificial Sequence
  ELANE RNA Guide
gcagucuccccggacgaagg

SEQ ID NO: 27473 - RNA, 20 nt, Artificial Sequence
  ELANE RNA Guide
gcccugaggcgcagucuccc

SEQ ID NO: 27474 - RNA, 20 nt, Artificial Sequence
  ELANE RNA Guide
gccuccuucguccggggaga

SEQ ID NO: 27475 - RNA, 20 nt, Artificial Sequence
  ELANE RNA Guide
gcgcagucuccccggacgaa

SEQ ID NO: 27476 - RNA, 20 nt, Artificial Sequence
  ELANE RNA Guide
ggagacugcgccucagggcu

SEQ ID NO: 27477 - RNA, 20 nt, Artificial Sequence
  ELANE RNA Guide
ggcgcagucuccccggacga

SEQ ID NO: 27478 - RNA, 20 nt, Artificial Sequence
  ELANE RNA Guide
gggagacugcgccucagggc

SEQ ID NO: 27479 - RNA, 20 nt, Artificial Sequence
  ELANE RNA Guide
ggggagacugcgccucaggg

SEQ ID NO: 27480 - RNA, 20 nt, Artificial Sequence
  ELANE RNA Guide
gggguagagcccugaggcgc

SEQ ID NO: 27481 - RNA, 20 nt, Artificial Sequence
  ELANE RNA Guide
ggguagagcccugaggcgca

SEQ ID NO: 27482 - RNA, 20 nt, Artificial Sequence
  ELANE RNA Guide
gguagagcccugaggcgcag

SEQ ID NO: 27483 - RNA, 20 nt, Artificial Sequence
  ELANE RNA Guide
guagagcccugaggcgcagu

SEQ ID NO: 27484 - RNA, 20 nt, Artificial Sequence
  ELANE RNA Guide
guccggggagacugcgccuc

SEQ ID NO: 27485 - RNA, 20 nt, Artificial Sequence
  ELANE RNA Guide
gucuccccggacgaaggagg

SEQ ID NO: 27486 - RNA, 20 nt, Artificial Sequence
  ELANE RNA Guide
uagagcccugaggcgcaguc

SEQ ID NO: 27487 - RNA, 20 nt, Artificial Sequence
  ELANE RNA Guide
uccggggagacugcgccuca

SEQ ID NO: 27488 - RNA, 20 nt, Artificial Sequence
  ELANE RNA Guide
uccuucguccggggagacug

SEQ ID NO: 27489 - RNA, 20 nt, Artificial Sequence
  ELANE RNA Guide
ucguccggggagacugcgcc

SEQ ID NO: 27490 - RNA, 20 nt, Artificial Sequence
  ELANE RNA Guide
ugaggcgcagucuccccgga

SEQ ID NO: 27491 - RNA, 20 nt, Artificial Sequence
  ELANE RNA Guide
ugccuccuucguccggggag

SEQ ID NO: 27492 - RNA, 20 nt, Artificial Sequence
  ELANE RNA Guide
uucguccggggagacugcgc

SEQ ID NO: 27493 - RNA, 20 nt, Artificial Sequence
  ELANE RNA Guide
uugccuccuucguccgggga

SEQ ID NO: 27494 - RNA, 21 nt, Artificial Sequence
  ELANE RNA Guide
aauugccuccuucguccgggg

SEQ ID NO: 27495 - RNA, 21 nt, Artificial Sequence
  ELANE RNA Guide
agacugcgccucagggcucua

SEQ ID NO: 27496 - RNA, 21 nt, Artificial Sequence
  ELANE RNA Guide
agagcccugaggcgcagucuc

SEQ ID NO: 27497 - RNA, 21 nt, Artificial Sequence
  ELANE RNA Guide
agcccugaggcgcagucuccc

SEQ ID NO: 27498 - RNA, 21 nt, Artificial Sequence
  ELANE RNA Guide
aggcgcagucuccccggacga

SEQ ID NO: 27499 - RNA, 21 nt, Artificial Sequence
  ELANE RNA Guide
agucuccccggacgaaggagg

SEQ ID NO: 27500 - RNA, 21 nt, Artificial Sequence
  ELANE RNA Guide
auugccuccuucguccgggga

SEQ ID NO: 27501 - RNA, 21 nt, Artificial Sequence
  ELANE RNA Guide
cagucuccccggacgaaggag

SEQ ID NO: 27502 - RNA, 21 nt, Artificial Sequence
  ELANE RNA Guide
cccugaggcgcagucuccccg

SEQ ID NO: 27503 - RNA, 21 nt, Artificial Sequence
  ELANE RNA Guide
ccggggagacugcgccucagg

SEQ ID NO: 27504 - RNA, 21 nt, Artificial Sequence
  ELANE RNA Guide
ccuccuucguccggggagacu

SEQ ID NO: 27505 - RNA, 21 nt, Artificial Sequence
  ELANE RNA Guide
ccugaggcgcagucuccccgg

SEQ ID NO: 27506 - RNA, 21 nt, Artificial Sequence
  ELANE RNA Guide
ccuucguccggggagacugcg

SEQ ID NO: 27507 - RNA, 21 nt, Artificial Sequence
  ELANE RNA Guide
cgcagucuccccggacgaagg

SEQ ID NO: 27508 - RNA, 21 nt, Artificial Sequence
  ELANE RNA Guide
cggggagacugcgccucaggg

SEQ ID NO: 27509 - RNA, 21 nt, Artificial Sequence
  ELANE RNA Guide
cgggguagagcccugaggcgc

SEQ ID NO: 27510 - RNA, 21 nt, Artificial Sequence
  ELANE RNA Guide
cguccggggagacugcgccuc

SEQ ID NO: 27511 - RNA, 21 nt, Artificial Sequence
  ELANE RNA Guide
cuccuucguccggggagacug

SEQ ID NO: 27512 - RNA, 21 nt, Artificial Sequence
  ELANE RNA Guide
cugaggcgcagucuccccgga

SEQ ID NO: 27513 - RNA, 21 nt, Artificial Sequence
  ELANE RNA Guide
cuucguccggggagacugcgc

SEQ ID NO: 27514 - RNA, 21 nt, Artificial Sequence
  ELANE RNA Guide
gacugcgccucagggcucuac

SEQ ID NO: 27515 - RNA, 21 nt, Artificial Sequence
  ELANE RNA Guide
gagacugcgccucagggcucu

SEQ ID NO: 27516 - RNA, 21 nt, Artificial Sequence
  ELANE RNA Guide
gagcccugaggcgcagucucc

SEQ ID NO: 27517 - RNA, 21 nt, Artificial Sequence
  ELANE RNA Guide
gaggcgcagucuccccggacg

SEQ ID NO: 27518 - RNA, 21 nt, Artificial Sequence
  ELANE RNA Guide
gcagucuccccggacgaagga

SEQ ID NO: 27519 - RNA, 21 nt, Artificial Sequence
  ELANE RNA Guide
gcccugaggcgcagucucccc

SEQ ID NO: 27520 - RNA, 21 nt, Artificial Sequence
  ELANE RNA Guide
gccuccuucguccggggagac

SEQ ID NO: 27521 - RNA, 21 nt, Artificial Sequence
  ELANE RNA Guide
gcgcagucuccccggacgaag

SEQ ID NO: 27522 - RNA, 21 nt, Artificial Sequence
  ELANE RNA Guide
ggagacugcgccucagggcuc

SEQ ID NO: 27523 - RNA, 21 nt, Artificial Sequence
  ELANE RNA Guide
ggcgcagucuccccggacgaa

SEQ ID NO: 27524 - RNA, 21 nt, Artificial Sequence
  ELANE RNA Guide
gggagacugcgccucagggcu

SEQ ID NO: 27525 - RNA, 21 nt, Artificial Sequence
  ELANE RNA Guide
ggggagacugcgccucagggc

SEQ ID NO: 27526 - RNA, 21 nt, Artificial Sequence
  ELANE RNA Guide
gggguagagcccugaggcgca

SEQ ID NO: 27527 - RNA, 21 nt, Artificial Sequence
  ELANE RNA Guide
ggguagagcccugaggcgcag

SEQ ID NO: 27528 - RNA, 21 nt, Artificial Sequence
  ELANE RNA Guide
gguagagcccugaggcgcagu

SEQ ID NO: 27529 - RNA, 21 nt, Artificial Sequence
  ELANE RNA Guide
guagagcccugaggcgcaguc

SEQ ID NO: 27530 - RNA, 21 nt, Artificial Sequence
  ELANE RNA Guide
guccggggagacugcgccuca

SEQ ID NO: 27531 - RNA, 21 nt, Artificial Sequence
  ELANE RNA Guide
gucuccccggacgaaggaggc

SEQ ID NO: 27532 - RNA, 21 nt, Artificial Sequence
  ELANE RNA Guide
uagagcccugaggcgcagucu

SEQ ID NO: 27533 - RNA, 21 nt, Artificial Sequence
  ELANE RNA Guide
uccggggagacugcgccucag

SEQ ID NO: 27534 - RNA, 21 nt, Artificial Sequence
  ELANE RNA Guide
uccuucguccggggagacugc

SEQ ID NO: 27535 - RNA, 21 nt, Artificial Sequence
  ELANE RNA Guide
ucgggguagagcccugaggcg

SEQ ID NO: 27536 - RNA, 21 nt, Artificial Sequence
  ELANE RNA Guide
ucguccggggagacugcgccu

SEQ ID NO: 27537 - RNA, 21 nt, Artificial Sequence
  ELANE RNA Guide
ugaggcgcagucuccccggac

SEQ ID NO: 27538 - RNA, 21 nt, Artificial Sequence
  ELANE RNA Guide
ugccuccuucguccggggaga

SEQ ID NO: 27539 - RNA, 21 nt, Artificial Sequence
  ELANE RNA Guide
uucguccggggagacugcgcc

SEQ ID NO: 27540 - RNA, 21 nt, Artificial Sequence
  ELANE RNA Guide
uugccuccuucguccggggag

SEQ ID NO: 27541 - RNA, 22 nt, Artificial Sequence
  ELANE RNA Guide
aauugccuccuucguccgggga

SEQ ID NO: 27542 - RNA, 22 nt, Artificial Sequence
  ELANE RNA Guide
agacugcgccucagggcucuac

SEQ ID NO: 27543 - RNA, 22 nt, Artificial Sequence
  ELANE RNA Guide
agagcccugaggcgcagucucc

SEQ ID NO: 27544 - RNA, 22 nt, Artificial Sequence
  ELANE RNA Guide
agcccugaggcgcagucucccc

SEQ ID NO: 27545 - RNA, 22 nt, Artificial Sequence
  ELANE RNA Guide
aggcgcagucuccccggacgaa

SEQ ID NO: 27546 - RNA, 22 nt, Artificial Sequence
  ELANE RNA Guide
agucuccccggacgaaggaggc

SEQ ID NO: 27547 - RNA, 22 nt, Artificial Sequence
  ELANE RNA Guide
aucgggguagagcccugaggcg

SEQ ID NO: 27548 - RNA, 22 nt, Artificial Sequence
  ELANE RNA Guide
auugccuccuucguccggggag

SEQ ID NO: 27549 - RNA, 22 nt, Artificial Sequence
  ELANE RNA Guide
cagucuccccggacgaaggagg

SEQ ID NO: 27550 - RNA, 22 nt, Artificial Sequence
  ELANE RNA Guide
cccugaggcgcagucuccccgg

SEQ ID NO: 27551 - RNA, 22 nt, Artificial Sequence
  ELANE RNA Guide
ccggggagacugcgccucaggg

SEQ ID NO: 27552 - RNA, 22 nt, Artificial Sequence
  ELANE RNA Guide
ccuccuucguccggggagacug

SEQ ID NO: 27553 - RNA, 22 nt, Artificial Sequence
  ELANE RNA Guide
ccugaggcgcagucuccccgga

SEQ ID NO: 27554 - RNA, 22 nt, Artificial Sequence
  ELANE RNA Guide
ccuucguccggggagacugcgc

SEQ ID NO: 27555 - RNA, 22 nt, Artificial Sequence
  ELANE RNA Guide
cgcagucuccccggacgaagga

SEQ ID NO: 27556 - RNA, 22 nt, Artificial Sequence
  ELANE RNA Guide
cggggagacugcgccucagggc

SEQ ID NO: 27557 - RNA, 22 nt, Artificial Sequence
  ELANE RNA Guide
cgggguagagcccugaggcgca

SEQ ID NO: 27558 - RNA, 22 nt, Artificial Sequence
  ELANE RNA Guide
cguccggggagacugcgccuca

SEQ ID NO: 27559 - RNA, 22 nt, Artificial Sequence
  ELANE RNA Guide
cuccuucguccggggagacugc

SEQ ID NO: 27560 - RNA, 22 nt, Artificial Sequence
  ELANE RNA Guide
cugaggcgcagucuccccggac

SEQ ID NO: 27561 - RNA, 22 nt, Artificial Sequence
  ELANE RNA Guide
cuucguccggggagacugcgcc

SEQ ID NO: 27562 - RNA, 22 nt, Artificial Sequence
  ELANE RNA Guide
gaauugccuccuucguccgggg

SEQ ID NO: 27563 - RNA, 22 nt, Artificial Sequence
  ELANE RNA Guide
gacugcgccucagggcucuacc

SEQ ID NO: 27564 - RNA, 22 nt, Artificial Sequence
  ELANE RNA Guide
gagacugcgccucagggcucua

SEQ ID NO: 27565 - RNA, 22 nt, Artificial Sequence
  ELANE RNA Guide
gagcccugaggcgcagucuccc

SEQ ID NO: 27566 - RNA, 22 nt, Artificial Sequence
  ELANE RNA Guide
gaggcgcagucuccccggacga

SEQ ID NO: 27567 - RNA, 22 nt, Artificial Sequence
  ELANE RNA Guide
gcagucuccccggacgaaggag

SEQ ID NO: 27568 - RNA, 22 nt, Artificial Sequence
  ELANE RNA Guide
gcccugaggcgcagucuccccg

SEQ ID NO: 27569 - RNA, 22 nt, Artificial Sequence
  ELANE RNA Guide
gccuccuucguccggggagacu

SEQ ID NO: 27570 - RNA, 22 nt, Artificial Sequence
  ELANE RNA Guide
gcgcagucuccccggacgaagg

SEQ ID NO: 27571 - RNA, 22 nt, Artificial Sequence
  ELANE RNA Guide
ggagacugcgccucagggcucu

SEQ ID NO: 27572 - RNA, 22 nt, Artificial Sequence
  ELANE RNA Guide
ggcgcagucuccccggacgaag

SEQ ID NO: 27573 - RNA, 22 nt, Artificial Sequence
  ELANE RNA Guide
gggagacugcgccucagggcuc

SEQ ID NO: 27574 - RNA, 22 nt, Artificial Sequence
  ELANE RNA Guide
ggggagacugcgccucagggcu

SEQ ID NO: 27575 - RNA, 22 nt, Artificial Sequence
  ELANE RNA Guide
gggguagagcccugaggcgcag

SEQ ID NO: 27576 - RNA, 22 nt, Artificial Sequence
  ELANE RNA Guide
ggguagagcccugaggcgcagu

SEQ ID NO: 27577 - RNA, 22 nt, Artificial Sequence
  ELANE RNA Guide
gguagagcccugaggcgcaguc

SEQ ID NO: 27578 - RNA, 22 nt, Artificial Sequence
  ELANE RNA Guide
guagagcccugaggcgcagucu

SEQ ID NO: 27579 - RNA, 22 nt, Artificial Sequence
  ELANE RNA Guide
guccggggagacugcgccucag

SEQ ID NO: 27580 - RNA, 22 nt, Artificial Sequence
  ELANE RNA Guide
gucuccccggacgaaggaggca

SEQ ID NO: 27581 - RNA, 22 nt, Artificial Sequence
  ELANE RNA Guide
uagagcccugaggcgcagucuc

SEQ ID NO: 27582 - RNA, 22 nt, Artificial Sequence
  ELANE RNA Guide
uccggggagacugcgccucagg

SEQ ID NO: 27583 - RNA, 22 nt, Artificial Sequence
  ELANE RNA Guide
uccuucguccggggagacugcg

SEQ ID NO: 27584 - RNA, 22 nt, Artificial Sequence
  ELANE RNA Guide
ucgggguagagcccugaggcgc

SEQ ID NO: 27585 - RNA, 22 nt, Artificial Sequence
  ELANE RNA Guide
ucguccggggagacugcgccuc

SEQ ID NO: 27586 - RNA, 22 nt, Artificial Sequence
  ELANE RNA Guide
ugaggcgcagucuccccggacg

SEQ ID NO: 27587 - RNA, 22 nt, Artificial Sequence
  ELANE RNA Guide
ugccuccuucguccggggagac

SEQ ID NO: 27588 - RNA, 22 nt, Artificial Sequence
  ELANE RNA Guide
uucguccggggagacugcgccu

SEQ ID NO: 27589 - RNA, 22 nt, Artificial Sequence
  ELANE RNA Guide
uugccuccuucguccggggaga

SEQ ID NO: 27590 - RNA, 20 nt, Artificial Sequence
  ELANE RNA Guide
agagcccugaggcgcaccuc

SEQ ID NO: 27591 - RNA, 20 nt, Artificial Sequence
  ELANE RNA Guide
agcccugaggcgcaccuccc

SEQ ID NO: 27592 - RNA, 20 nt, Artificial Sequence
  ELANE RNA Guide
aggcgcaccuccccggacga

SEQ ID NO: 27593 - RNA, 20 nt, Artificial Sequence
  ELANE RNA Guide
aggugcgccucagggcucua

SEQ ID NO: 27594 - RNA, 20 nt, Artificial Sequence
  ELANE RNA Guide
caccuccccggacgaaggag

SEQ ID NO: 27595 - RNA, 20 nt, Artificial Sequence
  ELANE RNA Guide
cccugaggcgcaccuccccg

SEQ ID NO: 27596 - RNA, 20 nt, Artificial Sequence
  ELANE RNA Guide
ccggggaggugcgccucagg

SEQ ID NO: 27597 - RNA, 20 nt, Artificial Sequence
  ELANE RNA Guide
ccuccuucguccggggaggu

SEQ ID NO: 27598 - RNA, 20 nt, Artificial Sequence
  ELANE RNA Guide
ccugaggcgcaccuccccgg

SEQ ID NO: 27599 - RNA, 20 nt, Artificial Sequence
  ELANE RNA Guide
ccuucguccggggaggugcg

SEQ ID NO: 27600 - RNA, 20 nt, Artificial Sequence
  ELANE RNA Guide
cgcaccuccccggacgaagg

SEQ ID NO: 27601 - RNA, 20 nt, Artificial Sequence
  ELANE RNA Guide
cggggaggugcgccucaggg

SEQ ID NO: 27602 - RNA, 20 nt, Artificial Sequence
  ELANE RNA Guide
cguccggggaggugcgccuc

SEQ ID NO: 27603 - RNA, 20 nt, Artificial Sequence
  ELANE RNA Guide
cuccuucguccggggaggug

SEQ ID NO: 27604 - RNA, 20 nt, Artificial Sequence
  ELANE RNA Guide
cugaggcgcaccuccccgga

SEQ ID NO: 27605 - RNA, 20 nt, Artificial Sequence
  ELANE RNA Guide
cuucguccggggaggugcgc

SEQ ID NO: 27606 - RNA, 20 nt, Artificial Sequence
  ELANE RNA Guide
gagcccugaggcgcaccucc

SEQ ID NO: 27607 - RNA, 20 nt, Artificial Sequence
  ELANE RNA Guide
gaggcgcaccuccccggacg

SEQ ID NO: 27608 - RNA, 20 nt, Artificial Sequence
  ELANE RNA Guide
gaggugcgccucagggcucu

SEQ ID NO: 27609 - RNA, 20 nt, Artificial Sequence
  ELANE RNA Guide
gcaccuccccggacgaagga

SEQ ID NO: 27610 - RNA, 20 nt, Artificial Sequence
  ELANE RNA Guide
gcccugaggcgcaccucccc

SEQ ID NO: 27611 - RNA, 20 nt, Artificial Sequence
  ELANE RNA Guide
gccuccuucguccggggagg

SEQ ID NO: 27612 - RNA, 20 nt, Artificial Sequence
  ELANE RNA Guide
gcgcaccuccccggacgaag

SEQ ID NO: 27613 - RNA, 20 nt, Artificial Sequence
  ELANE RNA Guide
ggaggugcgccucagggcuc

SEQ ID NO: 27614 - RNA, 20 nt, Artificial Sequence
  ELANE RNA Guide
ggcgcaccuccccggacgaa

SEQ ID NO: 27615 - RNA, 20 nt, Artificial Sequence
  ELANE RNA Guide
gggaggugcgccucagggcu

SEQ ID NO: 27616 - RNA, 20 nt, Artificial Sequence
  ELANE RNA Guide
ggggaggugcgccucagggc

SEQ ID NO: 27617 - RNA, 20 nt, Artificial Sequence
  ELANE RNA Guide
gguagagcccugaggcgcac

SEQ ID NO: 27618 - RNA, 20 nt, Artificial Sequence
  ELANE RNA Guide
ggugcgccucagggcucuac

SEQ ID NO: 27619 - RNA, 20 nt, Artificial Sequence
  ELANE RNA Guide
guagagcccugaggcgcacc

SEQ ID NO: 27620 - RNA, 20 nt, Artificial Sequence
  ELANE RNA Guide
guccggggaggugcgccuca

SEQ ID NO: 27621 - RNA, 20 nt, Artificial Sequence
  ELANE RNA Guide
gugcgccucagggcucuacc

SEQ ID NO: 27622 - RNA, 20 nt, Artificial Sequence
  ELANE RNA Guide
uagagcccugaggcgcaccu

SEQ ID NO: 27623 - RNA, 20 nt, Artificial Sequence
  ELANE RNA Guide
uccggggaggugcgccucag

SEQ ID NO: 27624 - RNA, 20 nt, Artificial Sequence
  ELANE RNA Guide
uccuucguccggggaggugc

SEQ ID NO: 27625 - RNA, 20 nt, Artificial Sequence
  ELANE RNA Guide
ucgggguagagcccugaggc

SEQ ID NO: 27626 - RNA, 20 nt, Artificial Sequence
  ELANE RNA Guide
ucguccggggaggugcgccu

SEQ ID NO: 27627 - RNA, 20 nt, Artificial Sequence
  ELANE RNA Guide
ugaggcgcaccuccccggac

SEQ ID NO: 27628 - RNA, 20 nt, Artificial Sequence
  ELANE RNA Guide
uucguccggggaggugcgcc

SEQ ID NO: 27629 - RNA, 21 nt, Artificial Sequence
  ELANE RNA Guide
agagcccugaggcgcaccucc

SEQ ID NO: 27630 - RNA, 21 nt, Artificial Sequence
  ELANE RNA Guide
agcccugaggcgcaccucccc

SEQ ID NO: 27631 - RNA, 21 nt, Artificial Sequence
  ELANE RNA Guide
aggcgcaccuccccggacgaa

SEQ ID NO: 27632 - RNA, 21 nt, Artificial Sequence
  ELANE RNA Guide
aggugcgccucagggcucuac

SEQ ID NO: 27633 - RNA, 21 nt, Artificial Sequence
  ELANE RNA Guide
aucgggguagagcccugaggc

SEQ ID NO: 27634 - RNA, 21 nt, Artificial Sequence
  ELANE RNA Guide
caccuccccggacgaaggagg

SEQ ID NO: 27635 - RNA, 21 nt, Artificial Sequence
  ELANE RNA Guide
ccuccuucguccggggaggug

SEQ ID NO: 27636 - RNA, 21 nt, Artificial Sequence
  ELANE RNA Guide
ccugaggcgcaccuccccgga

SEQ ID NO: 27637 - RNA, 21 nt, Artificial Sequence
  ELANE RNA Guide
ccuucguccggggaggugcgc

SEQ ID NO: 27638 - RNA, 21 nt, Artificial Sequence
  ELANE RNA Guide
cgcaccuccccggacgaagga

SEQ ID NO: 27639 - RNA, 21 nt, Artificial Sequence
  ELANE RNA Guide
cguccggggaggugcgccuca

SEQ ID NO: 27640 - RNA, 21 nt, Artificial Sequence
  ELANE RNA Guide
cuccuucguccggggaggugc

SEQ ID NO: 27641 - RNA, 21 nt, Artificial Sequence
  ELANE RNA Guide
cugaggcgcaccuccccggac

SEQ ID NO: 27642 - RNA, 21 nt, Artificial Sequence
  ELANE RNA Guide
cuucguccggggaggugcgcc

SEQ ID NO: 27643 - RNA, 21 nt, Artificial Sequence
  ELANE RNA Guide
gagcccugaggcgcaccuccc

SEQ ID NO: 27644 - RNA, 21 nt, Artificial Sequence
  ELANE RNA Guide
gaggcgcaccuccccggacga

SEQ ID NO: 27645 - RNA, 21 nt, Artificial Sequence
  ELANE RNA Guide
gaggugcgccucagggcucua

SEQ ID NO: 27646 - RNA, 21 nt, Artificial Sequence
  ELANE RNA Guide
gcaccuccccggacgaaggag

SEQ ID NO: 27647 - RNA, 21 nt, Artificial Sequence
  ELANE RNA Guide
gccuccuucguccggggaggu

SEQ ID NO: 27648 - RNA, 21 nt, Artificial Sequence
  ELANE RNA Guide
gcgcaccuccccggacgaagg

SEQ ID NO: 27649 - RNA, 21 nt, Artificial Sequence
  ELANE RNA Guide
ggaggugcgccucagggcucu

SEQ ID NO: 27650 - RNA, 21 nt, Artificial Sequence
  ELANE RNA Guide
ggcgcaccuccccggacgaag

SEQ ID NO: 27651 - RNA, 21 nt, Artificial Sequence
  ELANE RNA Guide
gggaggugcgccucagggcuc

SEQ ID NO: 27652 - RNA, 21 nt, Artificial Sequence
  ELANE RNA Guide
ggggaggugcgccucagggcu

SEQ ID NO: 27653 - RNA, 21 nt, Artificial Sequence
  ELANE RNA Guide
ggguagagcccugaggcgcac

SEQ ID NO: 27654 - RNA, 21 nt, Artificial Sequence
  ELANE RNA Guide
gguagagcccugaggcgcacc

SEQ ID NO: 27655 - RNA, 21 nt, Artificial Sequence
  ELANE RNA Guide
ggugcgccucagggcucuacc

SEQ ID NO: 27656 - RNA, 21 nt, Artificial Sequence
  ELANE RNA Guide
guagagcccugaggcgcaccu

SEQ ID NO: 27657 - RNA, 21 nt, Artificial Sequence
  ELANE RNA Guide
guccggggaggugcgccucag

SEQ ID NO: 27658 - RNA, 21 nt, Artificial Sequence
  ELANE RNA Guide
gugcgccucagggcucuaccc

SEQ ID NO: 27659 - RNA, 21 nt, Artificial Sequence
  ELANE RNA Guide
uagagcccugaggcgcaccuc

SEQ ID NO: 27660 - RNA, 21 nt, Artificial Sequence
  ELANE RNA Guide
uccggggaggugcgccucagg

SEQ ID NO: 27661 - RNA, 21 nt, Artificial Sequence
  ELANE RNA Guide
uccuucguccggggaggugcg

SEQ ID NO: 27662 - RNA, 21 nt, Artificial Sequence
  ELANE RNA Guide
ucguccggggaggugcgccuc

SEQ ID NO: 27663 - RNA, 21 nt, Artificial Sequence
  ELANE RNA Guide
ugaggcgcaccuccccggacg

SEQ ID NO: 27664 - RNA, 21 nt, Artificial Sequence
  ELANE RNA Guide
ugccuccuucguccggggagg

SEQ ID NO: 27665 - RNA, 21 nt, Artificial Sequence
  ELANE RNA Guide
uucguccggggaggugcgccu

SEQ ID NO: 27666 - RNA, 22 nt, Artificial Sequence
  ELANE RNA Guide
agagcccugaggcgcaccuccc

SEQ ID NO: 27667 - RNA, 22 nt, Artificial Sequence
  ELANE RNA Guide
agcccugaggcgcaccuccccg

SEQ ID NO: 27668 - RNA, 22 nt, Artificial Sequence
  ELANE RNA Guide
aggcgcaccuccccggacgaag

SEQ ID NO: 27669 - RNA, 22 nt, Artificial Sequence
  ELANE RNA Guide
aggugcgccucagggcucuacc

SEQ ID NO: 27670 - RNA, 22 nt, Artificial Sequence
  ELANE RNA Guide
caccuccccggacgaaggaggc

SEQ ID NO: 27671 - RNA, 22 nt, Artificial Sequence
  ELANE RNA Guide
caucgggguagagcccugaggc

SEQ ID NO: 27672 - RNA, 22 nt, Artificial Sequence
  ELANE RNA Guide
cccugaggcgcaccuccccgga

SEQ ID NO: 27673 - RNA, 22 nt, Artificial Sequence
  ELANE RNA Guide
ccuccuucguccggggaggugc

SEQ ID NO: 27674 - RNA, 22 nt, Artificial Sequence
  ELANE RNA Guide
ccugaggcgcaccuccccggac

SEQ ID NO: 27675 - RNA, 22 nt, Artificial Sequence
  ELANE RNA Guide
ccuucguccggggaggugcgcc

SEQ ID NO: 27676 - RNA, 22 nt, Artificial Sequence
  ELANE RNA Guide
cgcaccuccccggacgaaggag

SEQ ID NO: 27677 - RNA, 22 nt, Artificial Sequence
  ELANE RNA Guide
cggggaggugcgccucagggcu

SEQ ID NO: 27678 - RNA, 22 nt, Artificial Sequence
  ELANE RNA Guide
cguccggggaggugcgccucag

SEQ ID NO: 27679 - RNA, 22 nt, Artificial Sequence
  ELANE RNA Guide
cuccuucguccggggaggugcg

SEQ ID NO: 27680 - RNA, 22 nt, Artificial Sequence
  ELANE RNA Guide
cugaggcgcaccuccccggacg

SEQ ID NO: 27681 - RNA, 22 nt, Artificial Sequence
  ELANE RNA Guide
cuucguccggggaggugcgccu

SEQ ID NO: 27682 - RNA, 22 nt, Artificial Sequence
  ELANE RNA Guide
gagcccugaggcgcaccucccc

SEQ ID NO: 27683 - RNA, 22 nt, Artificial Sequence
  ELANE RNA Guide
gaggcgcaccuccccggacgaa

SEQ ID NO: 27684 - RNA, 22 nt, Artificial Sequence
  ELANE RNA Guide
gaggugcgccucagggcucuac

SEQ ID NO: 27685 - RNA, 22 nt, Artificial Sequence
  ELANE RNA Guide
gcaccuccccggacgaaggagg

SEQ ID NO: 27686 - RNA, 22 nt, Artificial Sequence
  ELANE RNA Guide
gccuccuucguccggggaggug

SEQ ID NO: 27687 - RNA, 22 nt, Artificial Sequence
  ELANE RNA Guide
gcgcaccuccccggacgaagga

SEQ ID NO: 27688 - RNA, 22 nt, Artificial Sequence
  ELANE RNA Guide
ggaggugcgccucagggcucua

SEQ ID NO: 27689 - RNA, 22 nt, Artificial Sequence
  ELANE RNA Guide
ggcgcaccuccccggacgaagg

SEQ ID NO: 27690 - RNA, 22 nt, Artificial Sequence
  ELANE RNA Guide
gggaggugcgccucagggcucu

SEQ ID NO: 27691 - RNA, 22 nt, Artificial Sequence
  ELANE RNA Guide
ggggaggugcgccucagggcuc

SEQ ID NO: 27692 - RNA, 22 nt, Artificial Sequence
  ELANE RNA Guide
gggguagagcccugaggcgcac

SEQ ID NO: 27693 - RNA, 22 nt, Artificial Sequence
  ELANE RNA Guide
ggguagagcccugaggcgcacc

SEQ ID NO: 27694 - RNA, 22 nt, Artificial Sequence
  ELANE RNA Guide
gguagagcccugaggcgcaccu

SEQ ID NO: 27695 - RNA, 22 nt, Artificial Sequence
  ELANE RNA Guide
ggugcgccucagggcucuaccc

SEQ ID NO: 27696 - RNA, 22 nt, Artificial Sequence
  ELANE RNA Guide
guagagcccugaggcgcaccuc

SEQ ID NO: 27697 - RNA, 22 nt, Artificial Sequence
  ELANE RNA Guide
guccggggaggugcgccucagg

SEQ ID NO: 27698 - RNA, 22 nt, Artificial Sequence
  ELANE RNA Guide
gugcgccucagggcucuacccc

SEQ ID NO: 27699 - RNA, 22 nt, Artificial Sequence
  ELANE RNA Guide
uagagcccugaggcgcaccucc

SEQ ID NO: 27700 - RNA, 22 nt, Artificial Sequence
  ELANE RNA Guide
uccggggaggugcgccucaggg

SEQ ID NO: 27701 - RNA, 22 nt, Artificial Sequence
  ELANE RNA Guide
uccuucguccggggaggugcgc

SEQ ID NO: 27702 - RNA, 22 nt, Artificial Sequence
  ELANE RNA Guide
ucguccggggaggugcgccuca

SEQ ID NO: 27703 - RNA, 22 nt, Artificial Sequence
  ELANE RNA Guide
ugaggcgcaccuccccggacga

SEQ ID NO: 27704 - RNA, 22 nt, Artificial Sequence
  ELANE RNA Guide
ugccuccuucguccggggaggu

SEQ ID NO: 27705 - RNA, 22 nt, Artificial Sequence
  ELANE RNA Guide
uucguccggggaggugcgccuc

SEQ ID NO: 27706 - RNA, 22 nt, Artificial Sequence
  ELANE RNA Guide
uugccuccuucguccggggagg

SEQ ID NO: 27707 - RNA, 20 nt, Artificial Sequence
  ELANE RNA Guide
agagcccugaggcucagccu

SEQ ID NO: 27708 - RNA, 20 nt, Artificial Sequence
  ELANE RNA Guide
agcccugaggcucagccucc

SEQ ID NO: 27709 - RNA, 20 nt, Artificial Sequence
  ELANE RNA Guide
aggcucagccuccccggacg

SEQ ID NO: 27710 - RNA, 20 nt, Artificial Sequence
  ELANE RNA Guide
aggcugagccucagggcucu

SEQ ID NO: 27711 - RNA, 20 nt, Artificial Sequence
  ELANE RNA Guide
aucgggguagagcccugagg

SEQ ID NO: 27712 - RNA, 20 nt, Artificial Sequence
  ELANE RNA Guide
caucgggguagagcccugag

SEQ ID NO: 27713 - RNA, 20 nt, Artificial Sequence
  ELANE RNA Guide
cccugaggcucagccucccc

SEQ ID NO: 27714 - RNA, 20 nt, Artificial Sequence
  ELANE RNA Guide
ccggggaggcugagccucag

SEQ ID NO: 27715 - RNA, 20 nt, Artificial Sequence
  ELANE RNA Guide
ccuccuucguccggggaggc

SEQ ID NO: 27716 - RNA, 20 nt, Artificial Sequence
  ELANE RNA Guide
ccugaggcucagccuccccg

SEQ ID NO: 27717 - RNA, 20 nt, Artificial Sequence
  ELANE RNA Guide
ccuucguccggggaggcuga

SEQ ID NO: 27718 - RNA, 20 nt, Artificial Sequence
  ELANE RNA Guide
cggggaggcugagccucagg

SEQ ID NO: 27719 - RNA, 20 nt, Artificial Sequence
  ELANE RNA Guide
cgggguagagcccugaggcu

SEQ ID NO: 27720 - RNA, 20 nt, Artificial Sequence
  ELANE RNA Guide
cguccggggaggcugagccu

SEQ ID NO: 27721 - RNA, 20 nt, Artificial Sequence
  ELANE RNA Guide
cucagccuccccggacgaag

SEQ ID NO: 27722 - RNA, 20 nt, Artificial Sequence
  ELANE RNA Guide
cuccuucguccggggaggcu

SEQ ID NO: 27723 - RNA, 20 nt, Artificial Sequence
  ELANE RNA Guide
cugagccucagggcucuacc

SEQ ID NO: 27724 - RNA, 20 nt, Artificial Sequence
  ELANE RNA Guide
cugaggcucagccuccccgg

SEQ ID NO: 27725 - RNA, 20 nt, Artificial Sequence
  ELANE RNA Guide
cuucguccggggaggcugag

SEQ ID NO: 27726 - RNA, 20 nt, Artificial Sequence
  ELANE RNA Guide
gagcccugaggcucagccuc

SEQ ID NO: 27727 - RNA, 20 nt, Artificial Sequence
  ELANE RNA Guide
gagccucagggcucuacccc

SEQ ID NO: 27728 - RNA, 20 nt, Artificial Sequence
  ELANE RNA Guide
gaggcucagccuccccggac

SEQ ID NO: 27729 - RNA, 20 nt, Artificial Sequence
  ELANE RNA Guide
gaggcugagccucagggcuc

SEQ ID NO: 27730 - RNA, 20 nt, Artificial Sequence
  ELANE RNA Guide
gcaucgggguagagcccuga

SEQ ID NO: 27731 - RNA, 20 nt, Artificial Sequence
  ELANE RNA Guide
gcccugaggcucagccuccc

SEQ ID NO: 27732 - RNA, 20 nt, Artificial Sequence
  ELANE RNA Guide
gcucagccuccccggacgaa

SEQ ID NO: 27733 - RNA, 20 nt, Artificial Sequence
  ELANE RNA Guide
gcugagccucagggcucuac

SEQ ID NO: 27734 - RNA, 20 nt, Artificial Sequence
  ELANE RNA Guide
ggaggcugagccucagggcu

SEQ ID NO: 27735 - RNA, 20 nt, Artificial Sequence
  ELANE RNA Guide
ggcucagccuccccggacga

SEQ ID NO: 27736 - RNA, 20 nt, Artificial Sequence
  ELANE RNA Guide
ggcugagccucagggcucua

SEQ ID NO: 27737 - RNA, 20 nt, Artificial Sequence
  ELANE RNA Guide
gggaggcugagccucagggc

SEQ ID NO: 27738 - RNA, 20 nt, Artificial Sequence
  ELANE RNA Guide
ggggaggcugagccucaggg

SEQ ID NO: 27739 - RNA, 20 nt, Artificial Sequence
  ELANE RNA Guide
gggguagagcccugaggcuc

SEQ ID NO: 27740 - RNA, 20 nt, Artificial Sequence
  ELANE RNA Guide
ggguagagcccugaggcuca

SEQ ID NO: 27741 - RNA, 20 nt, Artificial Sequence
  ELANE RNA Guide
gguagagcccugaggcucag

SEQ ID NO: 27742 - RNA, 20 nt, Artificial Sequence
  ELANE RNA Guide
guagagcccugaggcucagc

SEQ ID NO: 27743 - RNA, 20 nt, Artificial Sequence
  ELANE RNA Guide
guccggggaggcugagccuc

SEQ ID NO: 27744 - RNA, 20 nt, Artificial Sequence
  ELANE RNA Guide
uagagcccugaggcucagcc

SEQ ID NO: 27745 - RNA, 20 nt, Artificial Sequence
  ELANE RNA Guide
uccggggaggcugagccuca

SEQ ID NO: 27746 - RNA, 20 nt, Artificial Sequence
  ELANE RNA Guide
uccuucguccggggaggcug

SEQ ID NO: 27747 - RNA, 20 nt, Artificial Sequence
  ELANE RNA Guide
ucguccggggaggcugagcc

SEQ ID NO: 27748 - RNA, 20 nt, Artificial Sequence
  ELANE RNA Guide
ugagccucagggcucuaccc

SEQ ID NO: 27749 - RNA, 20 nt, Artificial Sequence
  ELANE RNA Guide
ugaggcucagccuccccgga

SEQ ID NO: 27750 - RNA, 20 nt, Artificial Sequence
  ELANE RNA Guide
uucguccggggaggcugagc

SEQ ID NO: 27751 - RNA, 21 nt, Artificial Sequence
  ELANE RNA Guide
agagcccugaggcucagccuc

SEQ ID NO: 27752 - RNA, 21 nt, Artificial Sequence
  ELANE RNA Guide
agcccugaggcucagccuccc

SEQ ID NO: 27753 - RNA, 21 nt, Artificial Sequence
  ELANE RNA Guide
aggcucagccuccccggacga

SEQ ID NO: 27754 - RNA, 21 nt, Artificial Sequence
  ELANE RNA Guide
aggcugagccucagggcucua

SEQ ID NO: 27755 - RNA, 21 nt, Artificial Sequence
  ELANE RNA Guide
caucgggguagagcccugagg

SEQ ID NO: 27756 - RNA, 21 nt, Artificial Sequence
  ELANE RNA Guide
cccugaggcucagccuccccg

SEQ ID NO: 27757 - RNA, 21 nt, Artificial Sequence
  ELANE RNA Guide
ccggggaggcugagccucagg

SEQ ID NO: 27758 - RNA, 21 nt, Artificial Sequence
  ELANE RNA Guide
ccuccuucguccggggaggcu

SEQ ID NO: 27759 - RNA, 21 nt, Artificial Sequence
  ELANE RNA Guide
ccugaggcucagccuccccgg

SEQ ID NO: 27760 - RNA, 21 nt, Artificial Sequence
  ELANE RNA Guide
ccuucguccggggaggcugag

SEQ ID NO: 27761 - RNA, 21 nt, Artificial Sequence
  ELANE RNA Guide
cggggaggcugagccucaggg

SEQ ID NO: 27762 - RNA, 21 nt, Artificial Sequence
  ELANE RNA Guide
cgggguagagcccugaggcuc

SEQ ID NO: 27763 - RNA, 21 nt, Artificial Sequence
  ELANE RNA Guide
cguccggggaggcugagccuc

SEQ ID NO: 27764 - RNA, 21 nt, Artificial Sequence
  ELANE RNA Guide
cucagccuccccggacgaagg

SEQ ID NO: 27765 - RNA, 21 nt, Artificial Sequence
  ELANE RNA Guide
cuccuucguccggggaggcug

SEQ ID NO: 27766 - RNA, 21 nt, Artificial Sequence
  ELANE RNA Guide
cugagccucagggcucuaccc

SEQ ID NO: 27767 - RNA, 21 nt, Artificial Sequence
  ELANE RNA Guide
cugaggcucagccuccccgga

SEQ ID NO: 27768 - RNA, 21 nt, Artificial Sequence
  ELANE RNA Guide
cuucguccggggaggcugagc

SEQ ID NO: 27769 - RNA, 21 nt, Artificial Sequence
  ELANE RNA Guide
gagcccugaggcucagccucc

SEQ ID NO: 27770 - RNA, 21 nt, Artificial Sequence
  ELANE RNA Guide
gagccucagggcucuaccccg

SEQ ID NO: 27771 - RNA, 21 nt, Artificial Sequence
  ELANE RNA Guide
gaggcucagccuccccggacg

SEQ ID NO: 27772 - RNA, 21 nt, Artificial Sequence
  ELANE RNA Guide
gaggcugagccucagggcucu

SEQ ID NO: 27773 - RNA, 21 nt, Artificial Sequence
  ELANE RNA Guide
gcaucgggguagagcccugag

SEQ ID NO: 27774 - RNA, 21 nt, Artificial Sequence
  ELANE RNA Guide
gcccugaggcucagccucccc

SEQ ID NO: 27775 - RNA, 21 nt, Artificial Sequence
  ELANE RNA Guide
gccuccuucguccggggaggc

SEQ ID NO: 27776 - RNA, 21 nt, Artificial Sequence
  ELANE RNA Guide
gcucagccuccccggacgaag

SEQ ID NO: 27777 - RNA, 21 nt, Artificial Sequence
  ELANE RNA Guide
gcugagccucagggcucuacc

SEQ ID NO: 27778 - RNA, 21 nt, Artificial Sequence
  ELANE RNA Guide
ggaggcugagccucagggcuc

SEQ ID NO: 27779 - RNA, 21 nt, Artificial Sequence
  ELANE RNA Guide
ggcaucgggguagagcccuga

SEQ ID NO: 27780 - RNA, 21 nt, Artificial Sequence
  ELANE RNA Guide
ggcucagccuccccggacgaa

SEQ ID NO: 27781 - RNA, 21 nt, Artificial Sequence
  ELANE RNA Guide
ggcugagccucagggcucuac

SEQ ID NO: 27782 - RNA, 21 nt, Artificial Sequence
  ELANE RNA Guide
gggaggcugagccucagggcu

SEQ ID NO: 27783 - RNA, 21 nt, Artificial Sequence
  ELANE RNA Guide
ggggaggcugagccucagggc

SEQ ID NO: 27784 - RNA, 21 nt, Artificial Sequence
  ELANE RNA Guide
gggguagagcccugaggcuca

SEQ ID NO: 27785 - RNA, 21 nt, Artificial Sequence
  ELANE RNA Guide
ggguagagcccugaggcucag

SEQ ID NO: 27786 - RNA, 21 nt, Artificial Sequence
  ELANE RNA Guide
gguagagcccugaggcucagc

SEQ ID NO: 27787 - RNA, 21 nt, Artificial Sequence
  ELANE RNA Guide
guagagcccugaggcucagcc

SEQ ID NO: 27788 - RNA, 21 nt, Artificial Sequence
  ELANE RNA Guide
guccggggaggcugagccuca

SEQ ID NO: 27789 - RNA, 21 nt, Artificial Sequence
  ELANE RNA Guide
uagagcccugaggcucagccu

SEQ ID NO: 27790 - RNA, 21 nt, Artificial Sequence
  ELANE RNA Guide
uccggggaggcugagccucag

SEQ ID NO: 27791 - RNA, 21 nt, Artificial Sequence
  ELANE RNA Guide
uccuucguccggggaggcuga

SEQ ID NO: 27792 - RNA, 21 nt, Artificial Sequence
  ELANE RNA Guide
ucgggguagagcccugaggcu

SEQ ID NO: 27793 - RNA, 21 nt, Artificial Sequence
  ELANE RNA Guide
ucguccggggaggcugagccu

SEQ ID NO: 27794 - RNA, 21 nt, Artificial Sequence
  ELANE RNA Guide
ugagccucagggcucuacccc

SEQ ID NO: 27795 - RNA, 21 nt, Artificial Sequence
  ELANE RNA Guide
ugaggcucagccuccccggac

SEQ ID NO: 27796 - RNA, 21 nt, Artificial Sequence
  ELANE RNA Guide
uucguccggggaggcugagcc

SEQ ID NO: 27797 - RNA, 22 nt, Artificial Sequence
  ELANE RNA Guide
agagcccugaggcucagccucc

SEQ ID NO: 27798 - RNA, 22 nt, Artificial Sequence
  ELANE RNA Guide
agcccugaggcucagccucccc

SEQ ID NO: 27799 - RNA, 22 nt, Artificial Sequence
  ELANE RNA Guide
aggcaucgggguagagcccuga

SEQ ID NO: 27800 - RNA, 22 nt, Artificial Sequence
  ELANE RNA Guide
aggcucagccuccccggacgaa

SEQ ID NO: 27801 - RNA, 22 nt, Artificial Sequence
  ELANE RNA Guide
aggcugagccucagggcucuac

SEQ ID NO: 27802 - RNA, 22 nt, Artificial Sequence
  ELANE RNA Guide
aucgggguagagcccugaggcu

SEQ ID NO: 27803 - RNA, 22 nt, Artificial Sequence
  ELANE RNA Guide
cccugaggcucagccuccccgg

SEQ ID NO: 27804 - RNA, 22 nt, Artificial Sequence
  ELANE RNA Guide
ccggggaggcugagccucaggg

SEQ ID NO: 27805 - RNA, 22 nt, Artificial Sequence
  ELANE RNA Guide
ccuccuucguccggggaggcug

SEQ ID NO: 27806 - RNA, 22 nt, Artificial Sequence
  ELANE RNA Guide
ccugaggcucagccuccccgga

SEQ ID NO: 27807 - RNA, 22 nt, Artificial Sequence
  ELANE RNA Guide
ccuucguccggggaggcugagc

SEQ ID NO: 27808 - RNA, 22 nt, Artificial Sequence
  ELANE RNA Guide
cggggaggcugagccucagggc

SEQ ID NO: 27809 - RNA, 22 nt, Artificial Sequence
  ELANE RNA Guide
cgggguagagcccugaggcuca

SEQ ID NO: 27810 - RNA, 22 nt, Artificial Sequence
  ELANE RNA Guide
cguccggggaggcugagccuca

SEQ ID NO: 27811 - RNA, 22 nt, Artificial Sequence
  ELANE RNA Guide
cucagccuccccggacgaagga

SEQ ID NO: 27812 - RNA, 22 nt, Artificial Sequence
  ELANE RNA Guide
cuccuucguccggggaggcuga

SEQ ID NO: 27813 - RNA, 22 nt, Artificial Sequence
  ELANE RNA Guide
cugagccucagggcucuacccc

SEQ ID NO: 27814 - RNA, 22 nt, Artificial Sequence
  ELANE RNA Guide
cugaggcucagccuccccggac

SEQ ID NO: 27815 - RNA, 22 nt, Artificial Sequence
  ELANE RNA Guide
cuucguccggggaggcugagcc

SEQ ID NO: 27816 - RNA, 22 nt, Artificial Sequence
  ELANE RNA Guide
gagcccugaggcucagccuccc

SEQ ID NO: 27817 - RNA, 22 nt, Artificial Sequence
  ELANE RNA Guide
gagccucagggcucuaccccga

SEQ ID NO: 27818 - RNA, 22 nt, Artificial Sequence
  ELANE RNA Guide
gaggcucagccuccccggacga

SEQ ID NO: 27819 - RNA, 22 nt, Artificial Sequence
  ELANE RNA Guide
gaggcugagccucagggcucua

SEQ ID NO: 27820 - RNA, 22 nt, Artificial Sequence
  ELANE RNA Guide
gcaucgggguagagcccugagg

SEQ ID NO: 27821 - RNA, 22 nt, Artificial Sequence
  ELANE RNA Guide
gcccugaggcucagccuccccg

SEQ ID NO: 27822 - RNA, 22 nt, Artificial Sequence
  ELANE RNA Guide
gccuccuucguccggggaggcu

SEQ ID NO: 27823 - RNA, 22 nt, Artificial Sequence
  ELANE RNA Guide
gcucagccuccccggacgaagg

SEQ ID NO: 27824 - RNA, 22 nt, Artificial Sequence
  ELANE RNA Guide
gcugagccucagggcucuaccc

SEQ ID NO: 27825 - RNA, 22 nt, Artificial Sequence
  ELANE RNA Guide
ggaggcugagccucagggcucu

SEQ ID NO: 27826 - RNA, 22 nt, Artificial Sequence
  ELANE RNA Guide
ggcaucgggguagagcccugag

SEQ ID NO: 27827 - RNA, 22 nt, Artificial Sequence
  ELANE RNA Guide
ggcucagccuccccggacgaag

SEQ ID NO: 27828 - RNA, 22 nt, Artificial Sequence
  ELANE RNA Guide
ggcugagccucagggcucuacc

SEQ ID NO: 27829 - RNA, 22 nt, Artificial Sequence
  ELANE RNA Guide
gggaggcugagccucagggcuc

SEQ ID NO: 27830 - RNA, 22 nt, Artificial Sequence
  ELANE RNA Guide
ggggaggcugagccucagggcu

SEQ ID NO: 27831 - RNA, 22 nt, Artificial Sequence
  ELANE RNA Guide
gggguagagcccugaggcucag

SEQ ID NO: 27832 - RNA, 22 nt, Artificial Sequence
  ELANE RNA Guide
ggguagagcccugaggcucagc

SEQ ID NO: 27833 - RNA, 22 nt, Artificial Sequence
  ELANE RNA Guide
gguagagcccugaggcucagcc

SEQ ID NO: 27834 - RNA, 22 nt, Artificial Sequence
  ELANE RNA Guide
guagagcccugaggcucagccu

SEQ ID NO: 27835 - RNA, 22 nt, Artificial Sequence
  ELANE RNA Guide
guccggggaggcugagccucag

SEQ ID NO: 27836 - RNA, 22 nt, Artificial Sequence
  ELANE RNA Guide
uagagcccugaggcucagccuc

SEQ ID NO: 27837 - RNA, 22 nt, Artificial Sequence
  ELANE RNA Guide
uccggggaggcugagccucagg

SEQ ID NO: 27838 - RNA, 22 nt, Artificial Sequence
  ELANE RNA Guide
uccuucguccggggaggcugag

SEQ ID NO: 27839 - RNA, 22 nt, Artificial Sequence
  ELANE RNA Guide
ucgggguagagcccugaggcuc

SEQ ID NO: 27840 - RNA, 22 nt, Artificial Sequence
  ELANE RNA Guide
ucguccggggaggcugagccuc

SEQ ID NO: 27841 - RNA, 22 nt, Artificial Sequence
  ELANE RNA Guide
ugagccucagggcucuaccccg

SEQ ID NO: 27842 - RNA, 22 nt, Artificial Sequence
  ELANE RNA Guide
ugaggcucagccuccccggacg

SEQ ID NO: 27843 - RNA, 22 nt, Artificial Sequence
  ELANE RNA Guide
ugccuccuucguccggggaggc

SEQ ID NO: 27844 - RNA, 22 nt, Artificial Sequence
  ELANE RNA Guide
uucguccggggaggcugagccu

SEQ ID NO: 27845 - RNA, 20 nt, Artificial Sequence
  ELANE RNA Guide
aaaggcaucgggguagagcc

SEQ ID NO: 27846 - RNA, 20 nt, Artificial Sequence
  ELANE RNA Guide
aaggcaucgggguagagccc

SEQ ID NO: 27847 - RNA, 20 nt, Artificial Sequence
  ELANE RNA Guide
agagcccuuaggcgcagccu

SEQ ID NO: 27848 - RNA, 20 nt, Artificial Sequence
  ELANE RNA Guide
agcccuuaggcgcagccucc

SEQ ID NO: 27849 - RNA, 20 nt, Artificial Sequence
  ELANE RNA Guide
aggcaucgggguagagcccu

SEQ ID NO: 27850 - RNA, 20 nt, Artificial Sequence
  ELANE RNA Guide
aggcugcgccuaagggcucu

SEQ ID NO: 27851 - RNA, 20 nt, Artificial Sequence
  ELANE RNA Guide
aucgggguagagcccuuagg

SEQ ID NO: 27852 - RNA, 20 nt, Artificial Sequence
  ELANE RNA Guide
caaaggcaucgggguagagc

SEQ ID NO: 27853 - RNA, 20 nt, Artificial Sequence
  ELANE RNA Guide
caucgggguagagcccuuag

SEQ ID NO: 27854 - RNA, 20 nt, Artificial Sequence
  ELANE RNA Guide
cccuuaggcgcagccucccc

SEQ ID NO: 27855 - RNA, 20 nt, Artificial Sequence
  ELANE RNA Guide
ccggggaggcugcgccuaag

SEQ ID NO: 27856 - RNA, 20 nt, Artificial Sequence
  ELANE RNA Guide
ccuaagggcucuaccccgau

SEQ ID NO: 27857 - RNA, 20 nt, Artificial Sequence
  ELANE RNA Guide
ccuuaggcgcagccuccccg

SEQ ID NO: 27858 - RNA, 20 nt, Artificial Sequence
  ELANE RNA Guide
cgccuaagggcucuaccccg

SEQ ID NO: 27859 - RNA, 20 nt, Artificial Sequence
  ELANE RNA Guide
cggggaggcugcgccuaagg

SEQ ID NO: 27860 - RNA, 20 nt, Artificial Sequence
  ELANE RNA Guide
cgggguagagcccuuaggcg

SEQ ID NO: 27861 - RNA, 20 nt, Artificial Sequence
  ELANE RNA Guide
cguccggggaggcugcgccu

SEQ ID NO: 27862 - RNA, 20 nt, Artificial Sequence
  ELANE RNA Guide
cuaagggcucuaccccgaug

SEQ ID NO: 27863 - RNA, 20 nt, Artificial Sequence
  ELANE RNA Guide
cugcgccuaagggcucuacc

SEQ ID NO: 27864 - RNA, 20 nt, Artificial Sequence
  ELANE RNA Guide
cuuaggcgcagccuccccgg

SEQ ID NO: 27865 - RNA, 20 nt, Artificial Sequence
  ELANE RNA Guide
cuucguccggggaggcugcg

SEQ ID NO: 27866 - RNA, 20 nt, Artificial Sequence
  ELANE RNA Guide
gagcccuuaggcgcagccuc

SEQ ID NO: 27867 - RNA, 20 nt, Artificial Sequence
  ELANE RNA Guide
gaggcugcgccuaagggcuc

SEQ ID NO: 27868 - RNA, 20 nt, Artificial Sequence
  ELANE RNA Guide
gcaucgggguagagcccuua

SEQ ID NO: 27869 - RNA, 20 nt, Artificial Sequence
  ELANE RNA Guide
gcccuuaggcgcagccuccc

SEQ ID NO: 27870 - RNA, 20 nt, Artificial Sequence
  ELANE RNA Guide
gccuaagggcucuaccccga

SEQ ID NO: 27871 - RNA, 20 nt, Artificial Sequence
  ELANE RNA Guide
gcgccuaagggcucuacccc

SEQ ID NO: 27872 - RNA, 20 nt, Artificial Sequence
  ELANE RNA Guide
gcugcgccuaagggcucuac

SEQ ID NO: 27873 - RNA, 20 nt, Artificial Sequence
  ELANE RNA Guide
ggaggcugcgccuaagggcu

SEQ ID NO: 27874 - RNA, 20 nt, Artificial Sequence
  ELANE RNA Guide
ggcaucgggguagagcccuu

SEQ ID NO: 27875 - RNA, 20 nt, Artificial Sequence
  ELANE RNA Guide
ggcugcgccuaagggcucua

SEQ ID NO: 27876 - RNA, 20 nt, Artificial Sequence
  ELANE RNA Guide
gggaggcugcgccuaagggc

SEQ ID NO: 27877 - RNA, 20 nt, Artificial Sequence
  ELANE RNA Guide
ggggaggcugcgccuaaggg

SEQ ID NO: 27878 - RNA, 20 nt, Artificial Sequence
  ELANE RNA Guide
gggguagagcccuuaggcgc

SEQ ID NO: 27879 - RNA, 20 nt, Artificial Sequence
  ELANE RNA Guide
ggguagagcccuuaggcgca

SEQ ID NO: 27880 - RNA, 20 nt, Artificial Sequence
  ELANE RNA Guide
gguagagcccuuaggcgcag

SEQ ID NO: 27881 - RNA, 20 nt, Artificial Sequence
  ELANE RNA Guide
guagagcccuuaggcgcagc

SEQ ID NO: 27882 - RNA, 20 nt, Artificial Sequence
  ELANE RNA Guide
guccggggaggcugcgccua

SEQ ID NO: 27883 - RNA, 20 nt, Artificial Sequence
  ELANE RNA Guide
uaagggcucuaccccgaugc

SEQ ID NO: 27884 - RNA, 20 nt, Artificial Sequence
  ELANE RNA Guide
uagagcccuuaggcgcagcc

SEQ ID NO: 27885 - RNA, 20 nt, Artificial Sequence
  ELANE RNA Guide
uccggggaggcugcgccuaa

SEQ ID NO: 27886 - RNA, 20 nt, Artificial Sequence
  ELANE RNA Guide
ucgggguagagcccuuaggc

SEQ ID NO: 27887 - RNA, 20 nt, Artificial Sequence
  ELANE RNA Guide
ucguccggggaggcugcgcc

SEQ ID NO: 27888 - RNA, 20 nt, Artificial Sequence
  ELANE RNA Guide
ugcgccuaagggcucuaccc

SEQ ID NO: 27889 - RNA, 20 nt, Artificial Sequence
  ELANE RNA Guide
uuaggcgcagccuccccgga

SEQ ID NO: 27890 - RNA, 20 nt, Artificial Sequence
  ELANE RNA Guide
uucguccggggaggcugcgc

SEQ ID NO: 27891 - RNA, 21 nt, Artificial Sequence
  ELANE RNA Guide
aaaggcaucgggguagagccc

SEQ ID NO: 27892 - RNA, 21 nt, Artificial Sequence
  ELANE RNA Guide
aaggcaucgggguagagcccu

SEQ ID NO: 27893 - RNA, 21 nt, Artificial Sequence
  ELANE RNA Guide
agagcccuuaggcgcagccuc

SEQ ID NO: 27894 - RNA, 21 nt, Artificial Sequence
  ELANE RNA Guide
agcccuuaggcgcagccuccc

SEQ ID NO: 27895 - RNA, 21 nt, Artificial Sequence
  ELANE RNA Guide
aggcaucgggguagagcccuu

SEQ ID NO: 27896 - RNA, 21 nt, Artificial Sequence
  ELANE RNA Guide
aggcugcgccuaagggcucua

SEQ ID NO: 27897 - RNA, 21 nt, Artificial Sequence
  ELANE RNA Guide
aucgggguagagcccuuaggc

SEQ ID NO: 27898 - RNA, 21 nt, Artificial Sequence
  ELANE RNA Guide
caaaggcaucgggguagagcc

SEQ ID NO: 27899 - RNA, 21 nt, Artificial Sequence
  ELANE RNA Guide
caucgggguagagcccuuagg

SEQ ID NO: 27900 - RNA, 21 nt, Artificial Sequence
  ELANE RNA Guide
cccuuaggcgcagccuccccg

SEQ ID NO: 27901 - RNA, 21 nt, Artificial Sequence
  ELANE RNA Guide
ccggggaggcugcgccuaagg

SEQ ID NO: 27902 - RNA, 21 nt, Artificial Sequence
  ELANE RNA Guide
ccuaagggcucuaccccgaug

SEQ ID NO: 27903 - RNA, 21 nt, Artificial Sequence
  ELANE RNA Guide
ccuuaggcgcagccuccccgg

SEQ ID NO: 27904 - RNA, 21 nt, Artificial Sequence
  ELANE RNA Guide
ccuucguccggggaggcugcg

SEQ ID NO: 27905 - RNA, 21 nt, Artificial Sequence
  ELANE RNA Guide
cgccuaagggcucuaccccga

SEQ ID NO: 27906 - RNA, 21 nt, Artificial Sequence
  ELANE RNA Guide
cggggaggcugcgccuaaggg

SEQ ID NO: 27907 - RNA, 21 nt, Artificial Sequence
  ELANE RNA Guide
cgggguagagcccuuaggcgc

SEQ ID NO: 27908 - RNA, 21 nt, Artificial Sequence
  ELANE RNA Guide
cguccggggaggcugcgccua

SEQ ID NO: 27909 - RNA, 21 nt, Artificial Sequence
  ELANE RNA Guide
cuaagggcucuaccccgaugc

SEQ ID NO: 27910 - RNA, 21 nt, Artificial Sequence
  ELANE RNA Guide
cugcgccuaagggcucuaccc

SEQ ID NO: 27911 - RNA, 21 nt, Artificial Sequence
  ELANE RNA Guide
cuuaggcgcagccuccccgga

SEQ ID NO: 27912 - RNA, 21 nt, Artificial Sequence
  ELANE RNA Guide
cuucguccggggaggcugcgc

SEQ ID NO: 27913 - RNA, 21 nt, Artificial Sequence
  ELANE RNA Guide
gagcccuuaggcgcagccucc

SEQ ID NO: 27914 - RNA, 21 nt, Artificial Sequence
  ELANE RNA Guide
gaggcugcgccuaagggcucu

SEQ ID NO: 27915 - RNA, 21 nt, Artificial Sequence
  ELANE RNA Guide
gcaaaggcaucgggguagagc

SEQ ID NO: 27916 - RNA, 21 nt, Artificial Sequence
  ELANE RNA Guide
gcaucgggguagagcccuuag

SEQ ID NO: 27917 - RNA, 21 nt, Artificial Sequence
  ELANE RNA Guide
gcccuuaggcgcagccucccc

SEQ ID NO: 27918 - RNA, 21 nt, Artificial Sequence
  ELANE RNA Guide
gccuaagggcucuaccccgau

SEQ ID NO: 27919 - RNA, 21 nt, Artificial Sequence
  ELANE RNA Guide
gcgccuaagggcucuaccccg

SEQ ID NO: 27920 - RNA, 21 nt, Artificial Sequence
  ELANE RNA Guide
gcugcgccuaagggcucuacc

SEQ ID NO: 27921 - RNA, 21 nt, Artificial Sequence
  ELANE RNA Guide
ggaggcugcgccuaagggcuc

SEQ ID NO: 27922 - RNA, 21 nt, Artificial Sequence
  ELANE RNA Guide
ggcaucgggguagagcccuua

SEQ ID NO: 27923 - RNA, 21 nt, Artificial Sequence
  ELANE RNA Guide
ggcugcgccuaagggcucuac

SEQ ID NO: 27924 - RNA, 21 nt, Artificial Sequence
  ELANE RNA Guide
gggaggcugcgccuaagggcu

SEQ ID NO: 27925 - RNA, 21 nt, Artificial Sequence
  ELANE RNA Guide
ggggaggcugcgccuaagggc

SEQ ID NO: 27926 - RNA, 21 nt, Artificial Sequence
  ELANE RNA Guide
gggguagagcccuuaggcgca

SEQ ID NO: 27927 - RNA, 21 nt, Artificial Sequence
  ELANE RNA Guide
ggguagagcccuuaggcgcag

SEQ ID NO: 27928 - RNA, 21 nt, Artificial Sequence
  ELANE RNA Guide
gguagagcccuuaggcgcagc

SEQ ID NO: 27929 - RNA, 21 nt, Artificial Sequence
  ELANE RNA Guide
guagagcccuuaggcgcagcc

SEQ ID NO: 27930 - RNA, 21 nt, Artificial Sequence
  ELANE RNA Guide
guccggggaggcugcgccuaa

SEQ ID NO: 27931 - RNA, 21 nt, Artificial Sequence
  ELANE RNA Guide
uaagggcucuaccccgaugcc

SEQ ID NO: 27932 - RNA, 21 nt, Artificial Sequence
  ELANE RNA Guide
uagagcccuuaggcgcagccu

SEQ ID NO: 27933 - RNA, 21 nt, Artificial Sequence
  ELANE RNA Guide
uccggggaggcugcgccuaag

SEQ ID NO: 27934 - RNA, 21 nt, Artificial Sequence
  ELANE RNA Guide
ucgggguagagcccuuaggcg

SEQ ID NO: 27935 - RNA, 21 nt, Artificial Sequence
  ELANE RNA Guide
ucguccggggaggcugcgccu

SEQ ID NO: 27936 - RNA, 21 nt, Artificial Sequence
  ELANE RNA Guide
ugcgccuaagggcucuacccc

SEQ ID NO: 27937 - RNA, 21 nt, Artificial Sequence
  ELANE RNA Guide
uuaggcgcagccuccccggac

SEQ ID NO: 27938 - RNA, 21 nt, Artificial Sequence
  ELANE RNA Guide
uucguccggggaggcugcgcc

SEQ ID NO: 27939 - RNA, 22 nt, Artificial Sequence
  ELANE RNA Guide
aaaggcaucgggguagagcccu

SEQ ID NO: 27940 - RNA, 22 nt, Artificial Sequence
  ELANE RNA Guide
aaggcaucgggguagagcccuu

SEQ ID NO: 27941 - RNA, 22 nt, Artificial Sequence
  ELANE RNA Guide
agagcccuuaggcgcagccucc

SEQ ID NO: 27942 - RNA, 22 nt, Artificial Sequence
  ELANE RNA Guide
agcccuuaggcgcagccucccc

SEQ ID NO: 27943 - RNA, 22 nt, Artificial Sequence
  ELANE RNA Guide
aggcaucgggguagagcccuua

SEQ ID NO: 27944 - RNA, 22 nt, Artificial Sequence
  ELANE RNA Guide
aggcugcgccuaagggcucuac

SEQ ID NO: 27945 - RNA, 22 nt, Artificial Sequence
  ELANE RNA Guide
aucgggguagagcccuuaggcg

SEQ ID NO: 27946 - RNA, 22 nt, Artificial Sequence
  ELANE RNA Guide
caaaggcaucgggguagagccc

SEQ ID NO: 27947 - RNA, 22 nt, Artificial Sequence
  ELANE RNA Guide
caucgggguagagcccuuaggc

SEQ ID NO: 27948 - RNA, 22 nt, Artificial Sequence
  ELANE RNA Guide
cccuuaggcgcagccuccccgg

SEQ ID NO: 27949 - RNA, 22 nt, Artificial Sequence
  ELANE RNA Guide
ccggggaggcugcgccuaaggg

SEQ ID NO: 27950 - RNA, 22 nt, Artificial Sequence
  ELANE RNA Guide
ccuaagggcucuaccccgaugc

SEQ ID NO: 27951 - RNA, 22 nt, Artificial Sequence
  ELANE RNA Guide
ccuuaggcgcagccuccccgga

SEQ ID NO: 27952 - RNA, 22 nt, Artificial Sequence
  ELANE RNA Guide
ccuucguccggggaggcugcgc

SEQ ID NO: 27953 - RNA, 22 nt, Artificial Sequence
  ELANE RNA Guide
cgccuaagggcucuaccccgau

SEQ ID NO: 27954 - RNA, 22 nt, Artificial Sequence
  ELANE RNA Guide
cggggaggcugcgccuaagggc

SEQ ID NO: 27955 - RNA, 22 nt, Artificial Sequence
  ELANE RNA Guide
cgggguagagcccuuaggcgca

SEQ ID NO: 27956 - RNA, 22 nt, Artificial Sequence
  ELANE RNA Guide
cguccggggaggcugcgccuaa

SEQ ID NO: 27957 - RNA, 22 nt, Artificial Sequence
  ELANE RNA Guide
cuaagggcucuaccccgaugcc

SEQ ID NO: 27958 - RNA, 22 nt, Artificial Sequence
  ELANE RNA Guide
cugcgccuaagggcucuacccc

SEQ ID NO: 27959 - RNA, 22 nt, Artificial Sequence
  ELANE RNA Guide
cuuaggcgcagccuccccggac

SEQ ID NO: 27960 - RNA, 22 nt, Artificial Sequence
  ELANE RNA Guide
cuucguccggggaggcugcgcc

SEQ ID NO: 27961 - RNA, 22 nt, Artificial Sequence
  ELANE RNA Guide
gagcccuuaggcgcagccuccc

SEQ ID NO: 27962 - RNA, 22 nt, Artificial Sequence
  ELANE RNA Guide
gaggcugcgccuaagggcucua

SEQ ID NO: 27963 - RNA, 22 nt, Artificial Sequence
  ELANE RNA Guide
gcaaaggcaucgggguagagcc

SEQ ID NO: 27964 - RNA, 22 nt, Artificial Sequence
  ELANE RNA Guide
gcaucgggguagagcccuuagg

SEQ ID NO: 27965 - RNA, 22 nt, Artificial Sequence
  ELANE RNA Guide
gcccuuaggcgcagccuccccg

SEQ ID NO: 27966 - RNA, 22 nt, Artificial Sequence
  ELANE RNA Guide
gccuaagggcucuaccccgaug

SEQ ID NO: 27967 - RNA, 22 nt, Artificial Sequence
  ELANE RNA Guide
gcgccuaagggcucuaccccga

SEQ ID NO: 27968 - RNA, 22 nt, Artificial Sequence
  ELANE RNA Guide
gcugcgccuaagggcucuaccc

SEQ ID NO: 27969 - RNA, 22 nt, Artificial Sequence
  ELANE RNA Guide
ggaggcugcgccuaagggcucu

SEQ ID NO: 27970 - RNA, 22 nt, Artificial Sequence
  ELANE RNA Guide
ggcaaaggcaucgggguagagc

SEQ ID NO: 27971 - RNA, 22 nt, Artificial Sequence
  ELANE RNA Guide
ggcaucgggguagagcccuuag

SEQ ID NO: 27972 - RNA, 22 nt, Artificial Sequence
  ELANE RNA Guide
ggcugcgccuaagggcucuacc

SEQ ID NO: 27973 - RNA, 22 nt, Artificial Sequence
  ELANE RNA Guide
gggaggcugcgccuaagggcuc

SEQ ID NO: 27974 - RNA, 22 nt, Artificial Sequence
  ELANE RNA Guide
ggggaggcugcgccuaagggcu

SEQ ID NO: 27975 - RNA, 22 nt, Artificial Sequence
  ELANE RNA Guide
gggguagagcccuuaggcgcag

SEQ ID NO: 27976 - RNA, 22 nt, Artificial Sequence
  ELANE RNA Guide
ggguagagcccuuaggcgcagc

SEQ ID NO: 27977 - RNA, 22 nt, Artificial Sequence
  ELANE RNA Guide
gguagagcccuuaggcgcagcc

SEQ ID NO: 27978 - RNA, 22 nt, Artificial Sequence
  ELANE RNA Guide
guagagcccuuaggcgcagccu

SEQ ID NO: 27979 - RNA, 22 nt, Artificial Sequence
  ELANE RNA Guide
guccggggaggcugcgccuaag

SEQ ID NO: 27980 - RNA, 22 nt, Artificial Sequence
  ELANE RNA Guide
uaagggcucuaccccgaugccu

SEQ ID NO: 27981 - RNA, 22 nt, Artificial Sequence
  ELANE RNA Guide
uagagcccuuaggcgcagccuc

SEQ ID NO: 27982 - RNA, 22 nt, Artificial Sequence
  ELANE RNA Guide
uccggggaggcugcgccuaagg

SEQ ID NO: 27983 - RNA, 22 nt, Artificial Sequence
  ELANE RNA Guide
uccuucguccggggaggcugcg

SEQ ID NO: 27984 - RNA, 22 nt, Artificial Sequence
  ELANE RNA Guide
ucgggguagagcccuuaggcgc

SEQ ID NO: 27985 - RNA, 22 nt, Artificial Sequence
  ELANE RNA Guide
ucguccggggaggcugcgccua

SEQ ID NO: 27986 - RNA, 22 nt, Artificial Sequence
  ELANE RNA Guide
ugcgccuaagggcucuaccccg

SEQ ID NO: 27987 - RNA, 22 nt, Artificial Sequence
  ELANE RNA Guide
uuaggcgcagccuccccggacg

SEQ ID NO: 27988 - RNA, 22 nt, Artificial Sequence
  ELANE RNA Guide
uucguccggggaggcugcgccu

SEQ ID NO: 27989 - RNA, 20 nt, Artificial Sequence
  ELANE RNA Guide
aaggcaucgggguagagcca

SEQ ID NO: 27990 - RNA, 20 nt, Artificial Sequence
  ELANE RNA Guide
agagccaugaggcgcagccu

SEQ ID NO: 27991 - RNA, 20 nt, Artificial Sequence
  ELANE RNA Guide
agccaugaggcgcagccucc

SEQ ID NO: 27992 - RNA, 20 nt, Artificial Sequence
  ELANE RNA Guide
aggcaucgggguagagccau

SEQ ID NO: 27993 - RNA, 20 nt, Artificial Sequence
  ELANE RNA Guide
aggcugcgccucauggcucu

SEQ ID NO: 27994 - RNA, 20 nt, Artificial Sequence
  ELANE RNA Guide
aucgggguagagccaugagg

SEQ ID NO: 27995 - RNA, 20 nt, Artificial Sequence
  ELANE RNA Guide
auggcucuaccccgaugccu

SEQ ID NO: 27996 - RNA, 20 nt, Artificial Sequence
  ELANE RNA Guide
caucgggguagagccaugag

SEQ ID NO: 27997 - RNA, 20 nt, Artificial Sequence
  ELANE RNA Guide
caugaggcgcagccuccccg

SEQ ID NO: 27998 - RNA, 20 nt, Artificial Sequence
  ELANE RNA Guide
cauggcucuaccccgaugcc

SEQ ID NO: 27999 - RNA, 20 nt, Artificial Sequence
  ELANE RNA Guide
ccaugaggcgcagccucccc

SEQ ID NO: 28000 - RNA, 20 nt, Artificial Sequence
  ELANE RNA Guide
ccggggaggcugcgccucau

SEQ ID NO: 28001 - RNA, 20 nt, Artificial Sequence
  ELANE RNA Guide
ccucauggcucuaccccgau

SEQ ID NO: 28002 - RNA, 20 nt, Artificial Sequence
  ELANE RNA Guide
cgccucauggcucuaccccg

SEQ ID NO: 28003 - RNA, 20 nt, Artificial Sequence
  ELANE RNA Guide
cggggaggcugcgccucaug

SEQ ID NO: 28004 - RNA, 20 nt, Artificial Sequence
  ELANE RNA Guide
cgggguagagccaugaggcg

SEQ ID NO: 28005 - RNA, 20 nt, Artificial Sequence
  ELANE RNA Guide
cucauggcucuaccccgaug

SEQ ID NO: 28006 - RNA, 20 nt, Artificial Sequence
  ELANE RNA Guide
cugcgccucauggcucuacc

SEQ ID NO: 28007 - RNA, 20 nt, Artificial Sequence
  ELANE RNA Guide
gagccaugaggcgcagccuc

SEQ ID NO: 28008 - RNA, 20 nt, Artificial Sequence
  ELANE RNA Guide
gaggcugcgccucauggcuc

SEQ ID NO: 28009 - RNA, 20 nt, Artificial Sequence
  ELANE RNA Guide
gcaaaggcaucgggguagag

SEQ ID NO: 28010 - RNA, 20 nt, Artificial Sequence
  ELANE RNA Guide
gcaucgggguagagccauga

SEQ ID NO: 28011 - RNA, 20 nt, Artificial Sequence
  ELANE RNA Guide
gccaugaggcgcagccuccc

SEQ ID NO: 28012 - RNA, 20 nt, Artificial Sequence
  ELANE RNA Guide
gccucauggcucuaccccga

SEQ ID NO: 28013 - RNA, 20 nt, Artificial Sequence
  ELANE RNA Guide
gcgccucauggcucuacccc

SEQ ID NO: 28014 - RNA, 20 nt, Artificial Sequence
  ELANE RNA Guide
gcugcgccucauggcucuac

SEQ ID NO: 28015 - RNA, 20 nt, Artificial Sequence
  ELANE RNA Guide
ggaggcugcgccucauggcu

SEQ ID NO: 28016 - RNA, 20 nt, Artificial Sequence
  ELANE RNA Guide
ggcaaaggcaucgggguaga

SEQ ID NO: 28017 - RNA, 20 nt, Artificial Sequence
  ELANE RNA Guide
ggcaucgggguagagccaug

SEQ ID NO: 28018 - RNA, 20 nt, Artificial Sequence
  ELANE RNA Guide
ggcugcgccucauggcucua

SEQ ID NO: 28019 - RNA, 20 nt, Artificial Sequence
  ELANE RNA Guide
gggaggcugcgccucauggc

SEQ ID NO: 28020 - RNA, 20 nt, Artificial Sequence
  ELANE RNA Guide
ggggaggcugcgccucaugg

SEQ ID NO: 28021 - RNA, 20 nt, Artificial Sequence
  ELANE RNA Guide
gggguagagccaugaggcgc

SEQ ID NO: 28022 - RNA, 20 nt, Artificial Sequence
  ELANE RNA Guide
ggguagagccaugaggcgca

SEQ ID NO: 28023 - RNA, 20 nt, Artificial Sequence
  ELANE RNA Guide
gguagagccaugaggcgcag

SEQ ID NO: 28024 - RNA, 20 nt, Artificial Sequence
  ELANE RNA Guide
guagagccaugaggcgcagc

SEQ ID NO: 28025 - RNA, 20 nt, Artificial Sequence
  ELANE RNA Guide
guccggggaggcugcgccuc

SEQ ID NO: 28026 - RNA, 20 nt, Artificial Sequence
  ELANE RNA Guide
uagagccaugaggcgcagcc

SEQ ID NO: 28027 - RNA, 20 nt, Artificial Sequence
  ELANE RNA Guide
ucauggcucuaccccgaugc

SEQ ID NO: 28028 - RNA, 20 nt, Artificial Sequence
  ELANE RNA Guide
uccggggaggcugcgccuca

SEQ ID NO: 28029 - RNA, 20 nt, Artificial Sequence
  ELANE RNA Guide
ucgggguagagccaugaggc

SEQ ID NO: 28030 - RNA, 20 nt, Artificial Sequence
  ELANE RNA Guide
ugcgccucauggcucuaccc

SEQ ID NO: 28031 - RNA, 21 nt, Artificial Sequence
  ELANE RNA Guide
aaaggcaucgggguagagcca

SEQ ID NO: 28032 - RNA, 21 nt, Artificial Sequence
  ELANE RNA Guide
aaggcaucgggguagagccau

SEQ ID NO: 28033 - RNA, 21 nt, Artificial Sequence
  ELANE RNA Guide
agagccaugaggcgcagccuc

SEQ ID NO: 28034 - RNA, 21 nt, Artificial Sequence
  ELANE RNA Guide
agccaugaggcgcagccuccc

SEQ ID NO: 28035 - RNA, 21 nt, Artificial Sequence
  ELANE RNA Guide
aggcaucgggguagagccaug

SEQ ID NO: 28036 - RNA, 21 nt, Artificial Sequence
  ELANE RNA Guide
aggcugcgccucauggcucua

SEQ ID NO: 28037 - RNA, 21 nt, Artificial Sequence
  ELANE RNA Guide
aucgggguagagccaugaggc

SEQ ID NO: 28038 - RNA, 21 nt, Artificial Sequence
  ELANE RNA Guide
auggcucuaccccgaugccuu

SEQ ID NO: 28039 - RNA, 21 nt, Artificial Sequence
  ELANE RNA Guide
caucgggguagagccaugagg

SEQ ID NO: 28040 - RNA, 21 nt, Artificial Sequence
  ELANE RNA Guide
caugaggcgcagccuccccgg

SEQ ID NO: 28041 - RNA, 21 nt, Artificial Sequence
  ELANE RNA Guide
cauggcucuaccccgaugccu

SEQ ID NO: 28042 - RNA, 21 nt, Artificial Sequence
  ELANE RNA Guide
ccaugaggcgcagccuccccg

SEQ ID NO: 28043 - RNA, 21 nt, Artificial Sequence
  ELANE RNA Guide
ccggggaggcugcgccucaug

SEQ ID NO: 28044 - RNA, 21 nt, Artificial Sequence
  ELANE RNA Guide
ccucauggcucuaccccgaug

SEQ ID NO: 28045 - RNA, 21 nt, Artificial Sequence
  ELANE RNA Guide
cgccucauggcucuaccccga

SEQ ID NO: 28046 - RNA, 21 nt, Artificial Sequence
  ELANE RNA Guide
cggggaggcugcgccucaugg

SEQ ID NO: 28047 - RNA, 21 nt, Artificial Sequence
  ELANE RNA Guide
cgggguagagccaugaggcgc

SEQ ID NO: 28048 - RNA, 21 nt, Artificial Sequence
  ELANE RNA Guide
cucauggcucuaccccgaugc

SEQ ID NO: 28049 - RNA, 21 nt, Artificial Sequence
  ELANE RNA Guide
cugcgccucauggcucuaccc

SEQ ID NO: 28050 - RNA, 21 nt, Artificial Sequence
  ELANE RNA Guide
gagccaugaggcgcagccucc

SEQ ID NO: 28051 - RNA, 21 nt, Artificial Sequence
  ELANE RNA Guide
gaggcugcgccucauggcucu

SEQ ID NO: 28052 - RNA, 21 nt, Artificial Sequence
  ELANE RNA Guide
gcaucgggguagagccaugag

SEQ ID NO: 28053 - RNA, 21 nt, Artificial Sequence
  ELANE RNA Guide
gccaugaggcgcagccucccc

SEQ ID NO: 28054 - RNA, 21 nt, Artificial Sequence
  ELANE RNA Guide
gccucauggcucuaccccgau

SEQ ID NO: 28055 - RNA, 21 nt, Artificial Sequence
  ELANE RNA Guide
gcgccucauggcucuaccccg

SEQ ID NO: 28056 - RNA, 21 nt, Artificial Sequence
  ELANE RNA Guide
gcugcgccucauggcucuacc

SEQ ID NO: 28057 - RNA, 21 nt, Artificial Sequence
  ELANE RNA Guide
ggaggcugcgccucauggcuc

SEQ ID NO: 28058 - RNA, 21 nt, Artificial Sequence
  ELANE RNA Guide
ggcaaaggcaucgggguagag

SEQ ID NO: 28059 - RNA, 21 nt, Artificial Sequence
  ELANE RNA Guide
ggcaucgggguagagccauga

SEQ ID NO: 28060 - RNA, 21 nt, Artificial Sequence
  ELANE RNA Guide
ggcugcgccucauggcucuac

SEQ ID NO: 28061 - RNA, 21 nt, Artificial Sequence
  ELANE RNA Guide
gggaggcugcgccucauggcu

SEQ ID NO: 28062 - RNA, 21 nt, Artificial Sequence
  ELANE RNA Guide
gggcaaaggcaucgggguaga

SEQ ID NO: 28063 - RNA, 21 nt, Artificial Sequence
  ELANE RNA Guide
ggggaggcugcgccucauggc

SEQ ID NO: 28064 - RNA, 21 nt, Artificial Sequence
  ELANE RNA Guide
gggguagagccaugaggcgca

SEQ ID NO: 28065 - RNA, 21 nt, Artificial Sequence
  ELANE RNA Guide
ggguagagccaugaggcgcag

SEQ ID NO: 28066 - RNA, 21 nt, Artificial Sequence
  ELANE RNA Guide
gguagagccaugaggcgcagc

SEQ ID NO: 28067 - RNA, 21 nt, Artificial Sequence
  ELANE RNA Guide
guagagccaugaggcgcagcc

SEQ ID NO: 28068 - RNA, 21 nt, Artificial Sequence
  ELANE RNA Guide
guccggggaggcugcgccuca

SEQ ID NO: 28069 - RNA, 21 nt, Artificial Sequence
  ELANE RNA Guide
uagagccaugaggcgcagccu

SEQ ID NO: 28070 - RNA, 21 nt, Artificial Sequence
  ELANE RNA Guide
ucauggcucuaccccgaugcc

SEQ ID NO: 28071 - RNA, 21 nt, Artificial Sequence
  ELANE RNA Guide
uccggggaggcugcgccucau

SEQ ID NO: 28072 - RNA, 21 nt, Artificial Sequence
  ELANE RNA Guide
ucgggguagagccaugaggcg

SEQ ID NO: 28073 - RNA, 21 nt, Artificial Sequence
  ELANE RNA Guide
ugcgccucauggcucuacccc

SEQ ID NO: 28074 - RNA, 22 nt, Artificial Sequence
  ELANE RNA Guide
aaaggcaucgggguagagccau

SEQ ID NO: 28075 - RNA, 22 nt, Artificial Sequence
  ELANE RNA Guide
aaggcaucgggguagagccaug

SEQ ID NO: 28076 - RNA, 22 nt, Artificial Sequence
  ELANE RNA Guide
agagccaugaggcgcagccucc

SEQ ID NO: 28077 - RNA, 22 nt, Artificial Sequence
  ELANE RNA Guide
agccaugaggcgcagccucccc

SEQ ID NO: 28078 - RNA, 22 nt, Artificial Sequence
  ELANE RNA Guide
aggcaucgggguagagccauga

SEQ ID NO: 28079 - RNA, 22 nt, Artificial Sequence
  ELANE RNA Guide
aggcugcgccucauggcucuac

SEQ ID NO: 28080 - RNA, 22 nt, Artificial Sequence
  ELANE RNA Guide
aucgggguagagccaugaggcg

SEQ ID NO: 28081 - RNA, 22 nt, Artificial Sequence
  ELANE RNA Guide
auggcucuaccccgaugccuuu

SEQ ID NO: 28082 - RNA, 22 nt, Artificial Sequence
  ELANE RNA Guide
caaaggcaucgggguagagcca

SEQ ID NO: 28083 - RNA, 22 nt, Artificial Sequence
  ELANE RNA Guide
caucgggguagagccaugaggc

SEQ ID NO: 28084 - RNA, 22 nt, Artificial Sequence
  ELANE RNA Guide
caugaggcgcagccuccccgga

SEQ ID NO: 28085 - RNA, 22 nt, Artificial Sequence
  ELANE RNA Guide
cauggcucuaccccgaugccuu

SEQ ID NO: 28086 - RNA, 22 nt, Artificial Sequence
  ELANE RNA Guide
ccaugaggcgcagccuccccgg

SEQ ID NO: 28087 - RNA, 22 nt, Artificial Sequence
  ELANE RNA Guide
ccggggaggcugcgccucaugg

SEQ ID NO: 28088 - RNA, 22 nt, Artificial Sequence
  ELANE RNA Guide
ccucauggcucuaccccgaugc

SEQ ID NO: 28089 - RNA, 22 nt, Artificial Sequence
  ELANE RNA Guide
cgccucauggcucuaccccgau

SEQ ID NO: 28090 - RNA, 22 nt, Artificial Sequence
  ELANE RNA Guide
cggggaggcugcgccucauggc

SEQ ID NO: 28091 - RNA, 22 nt, Artificial Sequence
  ELANE RNA Guide
cgggguagagccaugaggcgca

SEQ ID NO: 28092 - RNA, 22 nt, Artificial Sequence
  ELANE RNA Guide
cguccggggaggcugcgccuca

SEQ ID NO: 28093 - RNA, 22 nt, Artificial Sequence
  ELANE RNA Guide
cucauggcucuaccccgaugcc

SEQ ID NO: 28094 - RNA, 22 nt, Artificial Sequence
  ELANE RNA Guide
cugcgccucauggcucuacccc

SEQ ID NO: 28095 - RNA, 22 nt, Artificial Sequence
  ELANE RNA Guide
gagccaugaggcgcagccuccc

SEQ ID NO: 28096 - RNA, 22 nt, Artificial Sequence
  ELANE RNA Guide
gaggcugcgccucauggcucua

SEQ ID NO: 28097 - RNA, 22 nt, Artificial Sequence
  ELANE RNA Guide
gcaucgggguagagccaugagg

SEQ ID NO: 28098 - RNA, 22 nt, Artificial Sequence
  ELANE RNA Guide
gccaugaggcgcagccuccccg

SEQ ID NO: 28099 - RNA, 22 nt, Artificial Sequence
  ELANE RNA Guide
gccucauggcucuaccccgaug

SEQ ID NO: 28100 - RNA, 22 nt, Artificial Sequence
  ELANE RNA Guide
gcgccucauggcucuaccccga

SEQ ID NO: 28101 - RNA, 22 nt, Artificial Sequence
  ELANE RNA Guide
gcugcgccucauggcucuaccc

SEQ ID NO: 28102 - RNA, 22 nt, Artificial Sequence
  ELANE RNA Guide
ggaggcugcgccucauggcucu

SEQ ID NO: 28103 - RNA, 22 nt, Artificial Sequence
  ELANE RNA Guide
ggcaucgggguagagccaugag

SEQ ID NO: 28104 - RNA, 22 nt, Artificial Sequence
  ELANE RNA Guide
ggcugcgccucauggcucuacc

SEQ ID NO: 28105 - RNA, 22 nt, Artificial Sequence
  ELANE RNA Guide
gggaggcugcgccucauggcuc

SEQ ID NO: 28106 - RNA, 22 nt, Artificial Sequence
  ELANE RNA Guide
gggcaaaggcaucgggguagag

SEQ ID NO: 28107 - RNA, 22 nt, Artificial Sequence
  ELANE RNA Guide
ggggaggcugcgccucauggcu

SEQ ID NO: 28108 - RNA, 22 nt, Artificial Sequence
  ELANE RNA Guide
ggggcaaaggcaucgggguaga

SEQ ID NO: 28109 - RNA, 22 nt, Artificial Sequence
  ELANE RNA Guide
gggguagagccaugaggcgcag

SEQ ID NO: 28110 - RNA, 22 nt, Artificial Sequence
  ELANE RNA Guide
ggguagagccaugaggcgcagc

SEQ ID NO: 28111 - RNA, 22 nt, Artificial Sequence
  ELANE RNA Guide
gguagagccaugaggcgcagcc

SEQ ID NO: 28112 - RNA, 22 nt, Artificial Sequence
  ELANE RNA Guide
guagagccaugaggcgcagccu

SEQ ID NO: 28113 - RNA, 22 nt, Artificial Sequence
  ELANE RNA Guide
guccggggaggcugcgccucau

SEQ ID NO: 28114 - RNA, 22 nt, Artificial Sequence
  ELANE RNA Guide
uagagccaugaggcgcagccuc

SEQ ID NO: 28115 - RNA, 22 nt, Artificial Sequence
  ELANE RNA Guide
ucauggcucuaccccgaugccu

SEQ ID NO: 28116 - RNA, 22 nt, Artificial Sequence
  ELANE RNA Guide
uccggggaggcugcgccucaug

SEQ ID NO: 28117 - RNA, 22 nt, Artificial Sequence
  ELANE RNA Guide
ucgggguagagccaugaggcgc

SEQ ID NO: 28118 - RNA, 22 nt, Artificial Sequence
  ELANE RNA Guide
ucguccggggaggcugcgccuc

SEQ ID NO: 28119 - RNA, 22 nt, Artificial Sequence
  ELANE RNA Guide
ugcgccucauggcucuaccccg

SEQ ID NO: 28120 - RNA, 20 nt, Artificial Sequence
  ELANE RNA Guide
aaaggcaucggguagagccc

SEQ ID NO: 28121 - RNA, 20 nt, Artificial Sequence
  ELANE RNA Guide
aaggcaucggguagagcccu

SEQ ID NO: 28122 - RNA, 20 nt, Artificial Sequence
  ELANE RNA Guide
accggggcaaaggcaucggg

SEQ ID NO: 28123 - RNA, 20 nt, Artificial Sequence
  ELANE RNA Guide
aggcaucggguagagcccug

SEQ ID NO: 28124 - RNA, 20 nt, Artificial Sequence
  ELANE RNA Guide
agggcucuacccgaugccuu

SEQ ID NO: 28125 - RNA, 20 nt, Artificial Sequence
  ELANE RNA Guide
aucggguagagcccugaggc

SEQ ID NO: 28126 - RNA, 20 nt, Artificial Sequence
  ELANE RNA Guide
caaaggcaucggguagagcc

SEQ ID NO: 28127 - RNA, 20 nt, Artificial Sequence
  ELANE RNA Guide
caccggggcaaaggcaucgg

SEQ ID NO: 28128 - RNA, 20 nt, Artificial Sequence
  ELANE RNA Guide
cagggcucuacccgaugccu

SEQ ID NO: 28129 - RNA, 20 nt, Artificial Sequence
  ELANE RNA Guide
caucggguagagcccugagg

SEQ ID NO: 28130 - RNA, 20 nt, Artificial Sequence
  ELANE RNA Guide
ccaccggggcaaaggcaucg

SEQ ID NO: 28131 - RNA, 20 nt, Artificial Sequence
  ELANE RNA Guide
ccggggcaaaggcaucgggu

SEQ ID NO: 28132 - RNA, 20 nt, Artificial Sequence
  ELANE RNA Guide
ccucagggcucuacccgaug

SEQ ID NO: 28133 - RNA, 20 nt, Artificial Sequence
  ELANE RNA Guide
cgccucagggcucuacccga

SEQ ID NO: 28134 - RNA, 20 nt, Artificial Sequence
  ELANE RNA Guide
cggggcaaaggcaucgggua

SEQ ID NO: 28135 - RNA, 20 nt, Artificial Sequence
  ELANE RNA Guide
cggguagagcccugaggcgc

SEQ ID NO: 28136 - RNA, 20 nt, Artificial Sequence
  ELANE RNA Guide
cuacccgaugccuuugcccc

SEQ ID NO: 28137 - RNA, 20 nt, Artificial Sequence
  ELANE RNA Guide
cucagggcucuacccgaugc

SEQ ID NO: 28138 - RNA, 20 nt, Artificial Sequence
  ELANE RNA Guide
cucuacccgaugccuuugcc

SEQ ID NO: 28139 - RNA, 20 nt, Artificial Sequence
  ELANE RNA Guide
cugcgccucagggcucuacc

SEQ ID NO: 28140 - RNA, 20 nt, Artificial Sequence
  ELANE RNA Guide
gcaaaggcaucggguagagc

SEQ ID NO: 28141 - RNA, 20 nt, Artificial Sequence
  ELANE RNA Guide
gcaucggguagagcccugag

SEQ ID NO: 28142 - RNA, 20 nt, Artificial Sequence
  ELANE RNA Guide
gccaccggggcaaaggcauc

SEQ ID NO: 28143 - RNA, 20 nt, Artificial Sequence
  ELANE RNA Guide
gccucagggcucuacccgau

SEQ ID NO: 28144 - RNA, 20 nt, Artificial Sequence
  ELANE RNA Guide
gcgccucagggcucuacccg

SEQ ID NO: 28145 - RNA, 20 nt, Artificial Sequence
  ELANE RNA Guide
gcucuacccgaugccuuugc

SEQ ID NO: 28146 - RNA, 20 nt, Artificial Sequence
  ELANE RNA Guide
gcugcgccucagggcucuac

SEQ ID NO: 28147 - RNA, 20 nt, Artificial Sequence
  ELANE RNA Guide
ggcaaaggcaucggguagag

SEQ ID NO: 28148 - RNA, 20 nt, Artificial Sequence
  ELANE RNA Guide
ggcaucggguagagcccuga

SEQ ID NO: 28149 - RNA, 20 nt, Artificial Sequence
  ELANE RNA Guide
ggcucuacccgaugccuuug

SEQ ID NO: 28150 - RNA, 20 nt, Artificial Sequence
  ELANE RNA Guide
ggcugcgccucagggcucua

SEQ ID NO: 28151 - RNA, 20 nt, Artificial Sequence
  ELANE RNA Guide
gggcaaaggcaucggguaga

SEQ ID NO: 28152 - RNA, 20 nt, Artificial Sequence
  ELANE RNA Guide
gggcucuacccgaugccuuu

SEQ ID NO: 28153 - RNA, 20 nt, Artificial Sequence
  ELANE RNA Guide
ggggcaaaggcaucggguag

SEQ ID NO: 28154 - RNA, 20 nt, Artificial Sequence
  ELANE RNA Guide
uacccgaugccuuugccccg

SEQ ID NO: 28155 - RNA, 20 nt, Artificial Sequence
  ELANE RNA Guide
ucagggcucuacccgaugcc

SEQ ID NO: 28156 - RNA, 20 nt, Artificial Sequence
  ELANE RNA Guide
ucggguagagcccugaggcg

SEQ ID NO: 28157 - RNA, 20 nt, Artificial Sequence
  ELANE RNA Guide
ucuacccgaugccuuugccc

SEQ ID NO: 28158 - RNA, 20 nt, Artificial Sequence
  ELANE RNA Guide
ugcgccucagggcucuaccc

SEQ ID NO: 28159 - RNA, 21 nt, Artificial Sequence
  ELANE RNA Guide
aaaggcaucggguagagcccu

SEQ ID NO: 28160 - RNA, 21 nt, Artificial Sequence
  ELANE RNA Guide
aaggcaucggguagagcccug

SEQ ID NO: 28161 - RNA, 21 nt, Artificial Sequence
  ELANE RNA Guide
accggggcaaaggcaucgggu

SEQ ID NO: 28162 - RNA, 21 nt, Artificial Sequence
  ELANE RNA Guide
aggcaucggguagagcccuga

SEQ ID NO: 28163 - RNA, 21 nt, Artificial Sequence
  ELANE RNA Guide
aggcugcgccucagggcucua

SEQ ID NO: 28164 - RNA, 21 nt, Artificial Sequence
  ELANE RNA Guide
agggcucuacccgaugccuuu

SEQ ID NO: 28165 - RNA, 21 nt, Artificial Sequence
  ELANE RNA Guide
aucggguagagcccugaggcg

SEQ ID NO: 28166 - RNA, 21 nt, Artificial Sequence
  ELANE RNA Guide
caaaggcaucggguagagccc

SEQ ID NO: 28167 - RNA, 21 nt, Artificial Sequence
  ELANE RNA Guide
caccggggcaaaggcaucggg

SEQ ID NO: 28168 - RNA, 21 nt, Artificial Sequence
  ELANE RNA Guide
cagggcucuacccgaugccuu

SEQ ID NO: 28169 - RNA, 21 nt, Artificial Sequence
  ELANE RNA Guide
caucggguagagcccugaggc

SEQ ID NO: 28170 - RNA, 21 nt, Artificial Sequence
  ELANE RNA Guide
ccaccggggcaaaggcaucgg

SEQ ID NO: 28171 - RNA, 21 nt, Artificial Sequence
  ELANE RNA Guide
ccggggcaaaggcaucgggua

SEQ ID NO: 28172 - RNA, 21 nt, Artificial Sequence
  ELANE RNA Guide
ccucagggcucuacccgaugc

SEQ ID NO: 28173 - RNA, 21 nt, Artificial Sequence
  ELANE RNA Guide
cgccucagggcucuacccgau

SEQ ID NO: 28174 - RNA, 21 nt, Artificial Sequence
  ELANE RNA Guide
cggggcaaaggcaucggguag

SEQ ID NO: 28175 - RNA, 21 nt, Artificial Sequence
  ELANE RNA Guide
cggguagagcccugaggcgca

SEQ ID NO: 28176 - RNA, 21 nt, Artificial Sequence
  ELANE RNA Guide
cuacccgaugccuuugccccg

SEQ ID NO: 28177 - RNA, 21 nt, Artificial Sequence
  ELANE RNA Guide
cucagggcucuacccgaugcc

SEQ ID NO: 28178 - RNA, 21 nt, Artificial Sequence
  ELANE RNA Guide
cucuacccgaugccuuugccc

SEQ ID NO: 28179 - RNA, 21 nt, Artificial Sequence
  ELANE RNA Guide
cugcgccucagggcucuaccc

SEQ ID NO: 28180 - RNA, 21 nt, Artificial Sequence
  ELANE RNA Guide
gcaaaggcaucggguagagcc

SEQ ID NO: 28181 - RNA, 21 nt, Artificial Sequence
  ELANE RNA Guide
gcaucggguagagcccugagg

SEQ ID NO: 28182 - RNA, 21 nt, Artificial Sequence
  ELANE RNA Guide
gccaccggggcaaaggcaucg

SEQ ID NO: 28183 - RNA, 21 nt, Artificial Sequence
  ELANE RNA Guide
gccucagggcucuacccgaug

SEQ ID NO: 28184 - RNA, 21 nt, Artificial Sequence
  ELANE RNA Guide
gcgccucagggcucuacccga

SEQ ID NO: 28185 - RNA, 21 nt, Artificial Sequence
  ELANE RNA Guide
gcucuacccgaugccuuugcc

SEQ ID NO: 28186 - RNA, 21 nt, Artificial Sequence
  ELANE RNA Guide
gcugcgccucagggcucuacc

SEQ ID NO: 28187 - RNA, 21 nt, Artificial Sequence
  ELANE RNA Guide
ggcaaaggcaucggguagagc

SEQ ID NO: 28188 - RNA, 21 nt, Artificial Sequence
  ELANE RNA Guide
ggcaucggguagagcccugag

SEQ ID NO: 28189 - RNA, 21 nt, Artificial Sequence
  ELANE RNA Guide
ggcucuacccgaugccuuugc

SEQ ID NO: 28190 - RNA, 21 nt, Artificial Sequence
  ELANE RNA Guide
ggcugcgccucagggcucuac

SEQ ID NO: 28191 - RNA, 21 nt, Artificial Sequence
  ELANE RNA Guide
gggcaaaggcaucggguagag

SEQ ID NO: 28192 - RNA, 21 nt, Artificial Sequence
  ELANE RNA Guide
gggcucuacccgaugccuuug

SEQ ID NO: 28193 - RNA, 21 nt, Artificial Sequence
  ELANE RNA Guide
ggggcaaaggcaucggguaga

SEQ ID NO: 28194 - RNA, 21 nt, Artificial Sequence
  ELANE RNA Guide
uacccgaugccuuugccccgg

SEQ ID NO: 28195 - RNA, 21 nt, Artificial Sequence
  ELANE RNA Guide
ucagggcucuacccgaugccu

SEQ ID NO: 28196 - RNA, 21 nt, Artificial Sequence
  ELANE RNA Guide
ucggguagagcccugaggcgc

SEQ ID NO: 28197 - RNA, 21 nt, Artificial Sequence
  ELANE RNA Guide
ucuacccgaugccuuugcccc

SEQ ID NO: 28198 - RNA, 21 nt, Artificial Sequence
  ELANE RNA Guide
ugccaccggggcaaaggcauc

SEQ ID NO: 28199 - RNA, 21 nt, Artificial Sequence
  ELANE RNA Guide
ugcgccucagggcucuacccg

SEQ ID NO: 28200 - RNA, 22 nt, Artificial Sequence
  ELANE RNA Guide
aaaggcaucggguagagcccug

SEQ ID NO: 28201 - RNA, 22 nt, Artificial Sequence
  ELANE RNA Guide
aaggcaucggguagagcccuga

SEQ ID NO: 28202 - RNA, 22 nt, Artificial Sequence
  ELANE RNA Guide
accggggcaaaggcaucgggua

SEQ ID NO: 28203 - RNA, 22 nt, Artificial Sequence
  ELANE RNA Guide
aggcaucggguagagcccugag

SEQ ID NO: 28204 - RNA, 22 nt, Artificial Sequence
  ELANE RNA Guide
aggcugcgccucagggcucuac

SEQ ID NO: 28205 - RNA, 22 nt, Artificial Sequence
  ELANE RNA Guide
agggcucuacccgaugccuuug

SEQ ID NO: 28206 - RNA, 22 nt, Artificial Sequence
  ELANE RNA Guide
aucggguagagcccugaggcgc

SEQ ID NO: 28207 - RNA, 22 nt, Artificial Sequence
  ELANE RNA Guide
caaaggcaucggguagagcccu

SEQ ID NO: 28208 - RNA, 22 nt, Artificial Sequence
  ELANE RNA Guide
caccggggcaaaggcaucgggu

SEQ ID NO: 28209 - RNA, 22 nt, Artificial Sequence
  ELANE RNA Guide
cagggcucuacccgaugccuuu

SEQ ID NO: 28210 - RNA, 22 nt, Artificial Sequence
  ELANE RNA Guide
caucggguagagcccugaggcg

SEQ ID NO: 28211 - RNA, 22 nt, Artificial Sequence
  ELANE RNA Guide
ccaccggggcaaaggcaucggg

SEQ ID NO: 28212 - RNA, 22 nt, Artificial Sequence
  ELANE RNA Guide
ccggggcaaaggcaucggguag

SEQ ID NO: 28213 - RNA, 22 nt, Artificial Sequence
  ELANE RNA Guide
ccucagggcucuacccgaugcc

SEQ ID NO: 28214 - RNA, 22 nt, Artificial Sequence
  ELANE RNA Guide
cgccucagggcucuacccgaug

SEQ ID NO: 28215 - RNA, 22 nt, Artificial Sequence
  ELANE RNA Guide
cggggcaaaggcaucggguaga

SEQ ID NO: 28216 - RNA, 22 nt, Artificial Sequence
  ELANE RNA Guide
cggguagagcccugaggcgcag

SEQ ID NO: 28217 - RNA, 22 nt, Artificial Sequence
  ELANE RNA Guide
cuacccgaugccuuugccccgg

SEQ ID NO: 28218 - RNA, 22 nt, Artificial Sequence
  ELANE RNA Guide
cucagggcucuacccgaugccu

SEQ ID NO: 28219 - RNA, 22 nt, Artificial Sequence
  ELANE RNA Guide
cucuacccgaugccuuugcccc

SEQ ID NO: 28220 - RNA, 22 nt, Artificial Sequence
  ELANE RNA Guide
cugcgccucagggcucuacccg

SEQ ID NO: 28221 - RNA, 22 nt, Artificial Sequence
  ELANE RNA Guide
gaggcugcgccucagggcucua

SEQ ID NO: 28222 - RNA, 22 nt, Artificial Sequence
  ELANE RNA Guide
gcaaaggcaucggguagagccc

SEQ ID NO: 28223 - RNA, 22 nt, Artificial Sequence
  ELANE RNA Guide
gcaucggguagagcccugaggc

SEQ ID NO: 28224 - RNA, 22 nt, Artificial Sequence
  ELANE RNA Guide
gccaccggggcaaaggcaucgg

SEQ ID NO: 28225 - RNA, 22 nt, Artificial Sequence
  ELANE RNA Guide
gccucagggcucuacccgaugc

SEQ ID NO: 28226 - RNA, 22 nt, Artificial Sequence
  ELANE RNA Guide
gcgccucagggcucuacccgau

SEQ ID NO: 28227 - RNA, 22 nt, Artificial Sequence
  ELANE RNA Guide
gcucuacccgaugccuuugccc

SEQ ID NO: 28228 - RNA, 22 nt, Artificial Sequence
  ELANE RNA Guide
gcugcgccucagggcucuaccc

SEQ ID NO: 28229 - RNA, 22 nt, Artificial Sequence
  ELANE RNA Guide
ggcaaaggcaucggguagagcc

SEQ ID NO: 28230 - RNA, 22 nt, Artificial Sequence
  ELANE RNA Guide
ggcaucggguagagcccugagg

SEQ ID NO: 28231 - RNA, 22 nt, Artificial Sequence
  ELANE RNA Guide
ggcucuacccgaugccuuugcc

SEQ ID NO: 28232 - RNA, 22 nt, Artificial Sequence
  ELANE RNA Guide
ggcugcgccucagggcucuacc

SEQ ID NO: 28233 - RNA, 22 nt, Artificial Sequence
  ELANE RNA Guide
gggcaaaggcaucggguagagc

SEQ ID NO: 28234 - RNA, 22 nt, Artificial Sequence
  ELANE RNA Guide
gggcucuacccgaugccuuugc

SEQ ID NO: 28235 - RNA, 22 nt, Artificial Sequence
  ELANE RNA Guide
ggggcaaaggcaucggguagag

SEQ ID NO: 28236 - RNA, 22 nt, Artificial Sequence
  ELANE RNA Guide
gugccaccggggcaaaggcauc

SEQ ID NO: 28237 - RNA, 22 nt, Artificial Sequence
  ELANE RNA Guide
uacccgaugccuuugccccggu

SEQ ID NO: 28238 - RNA, 22 nt, Artificial Sequence
  ELANE RNA Guide
ucagggcucuacccgaugccuu

SEQ ID NO: 28239 - RNA, 22 nt, Artificial Sequence
  ELANE RNA Guide
ucggguagagcccugaggcgca

SEQ ID NO: 28240 - RNA, 22 nt, Artificial Sequence
  ELANE RNA Guide
ucuacccgaugccuuugccccg

SEQ ID NO: 28241 - RNA, 22 nt, Artificial Sequence
  ELANE RNA Guide
ugccaccggggcaaaggcaucg

SEQ ID NO: 28242 - RNA, 22 nt, Artificial Sequence
  ELANE RNA Guide
ugcgccucagggcucuacccga

SEQ ID NO: 28243 - RNA, 20 nt, Artificial Sequence
  ELANE RNA Guide
aaaggcaucggguuagagcc

SEQ ID NO: 28244 - RNA, 20 nt, Artificial Sequence
  ELANE RNA Guide
aacccgaugccuuugccccg

SEQ ID NO: 28245 - RNA, 20 nt, Artificial Sequence
  ELANE RNA Guide
aaggcaucggguuagagccc

SEQ ID NO: 28246 - RNA, 20 nt, Artificial Sequence
  ELANE RNA Guide
aggcaucggguuagagcccu

SEQ ID NO: 28247 - RNA, 20 nt, Artificial Sequence
  ELANE RNA Guide
aggcugcgccucagggcucu

SEQ ID NO: 28248 - RNA, 20 nt, Artificial Sequence
  ELANE RNA Guide
agggcucuaacccgaugccu

SEQ ID NO: 28249 - RNA, 20 nt, Artificial Sequence
  ELANE RNA Guide
aucggguuagagcccugagg

SEQ ID NO: 28250 - RNA, 20 nt, Artificial Sequence
  ELANE RNA Guide
caaaggcaucggguuagagc

SEQ ID NO: 28251 - RNA, 20 nt, Artificial Sequence
  ELANE RNA Guide
cagggcucuaacccgaugcc

SEQ ID NO: 28252 - RNA, 20 nt, Artificial Sequence
  ELANE RNA Guide
caucggguuagagcccugag

SEQ ID NO: 28253 - RNA, 20 nt, Artificial Sequence
  ELANE RNA Guide
ccucagggcucuaacccgau

SEQ ID NO: 28254 - RNA, 20 nt, Artificial Sequence
  ELANE RNA Guide
cgccucagggcucuaacccg

SEQ ID NO: 28255 - RNA, 20 nt, Artificial Sequence
  ELANE RNA Guide
cggggcaaaggcaucggguu

SEQ ID NO: 28256 - RNA, 20 nt, Artificial Sequence
  ELANE RNA Guide
cggguuagagcccugaggcg

SEQ ID NO: 28257 - RNA, 20 nt, Artificial Sequence
  ELANE RNA Guide
cuaacccgaugccuuugccc

SEQ ID NO: 28258 - RNA, 20 nt, Artificial Sequence
  ELANE RNA Guide
cucagggcucuaacccgaug

SEQ ID NO: 28259 - RNA, 20 nt, Artificial Sequence
  ELANE RNA Guide
cucuaacccgaugccuuugc

SEQ ID NO: 28260 - RNA, 20 nt, Artificial Sequence
  ELANE RNA Guide
cugcgccucagggcucuaac

SEQ ID NO: 28261 - RNA, 20 nt, Artificial Sequence
  ELANE RNA Guide
gaggcugcgccucagggcuc

SEQ ID NO: 28262 - RNA, 20 nt, Artificial Sequence
  ELANE RNA Guide
gcaaaggcaucggguuagag

SEQ ID NO: 28263 - RNA, 20 nt, Artificial Sequence
  ELANE RNA Guide
gcaucggguuagagcccuga

SEQ ID NO: 28264 - RNA, 20 nt, Artificial Sequence
  ELANE RNA Guide
gccucagggcucuaacccga

SEQ ID NO: 28265 - RNA, 20 nt, Artificial Sequence
  ELANE RNA Guide
gcgccucagggcucuaaccc

SEQ ID NO: 28266 - RNA, 20 nt, Artificial Sequence
  ELANE RNA Guide
gcucuaacccgaugccuuug

SEQ ID NO: 28267 - RNA, 20 nt, Artificial Sequence
  ELANE RNA Guide
gcugcgccucagggcucuaa

SEQ ID NO: 28268 - RNA, 20 nt, Artificial Sequence
  ELANE RNA Guide
ggaggcugcgccucagggcu

SEQ ID NO: 28269 - RNA, 20 nt, Artificial Sequence
  ELANE RNA Guide
ggcaaaggcaucggguuaga

SEQ ID NO: 28270 - RNA, 20 nt, Artificial Sequence
  ELANE RNA Guide
ggcaucggguuagagcccug

SEQ ID NO: 28271 - RNA, 20 nt, Artificial Sequence
  ELANE RNA Guide
ggcucuaacccgaugccuuu

SEQ ID NO: 28272 - RNA, 20 nt, Artificial Sequence
  ELANE RNA Guide
gggcaaaggcaucggguuag

SEQ ID NO: 28273 - RNA, 20 nt, Artificial Sequence
  ELANE RNA Guide
gggcucuaacccgaugccuu

SEQ ID NO: 28274 - RNA, 20 nt, Artificial Sequence
  ELANE RNA Guide
ggggcaaaggcaucggguua

SEQ ID NO: 28275 - RNA, 20 nt, Artificial Sequence
  ELANE RNA Guide
ggguuagagcccugaggcgc

SEQ ID NO: 28276 - RNA, 20 nt, Artificial Sequence
  ELANE RNA Guide
gguuagagcccugaggcgca

SEQ ID NO: 28277 - RNA, 20 nt, Artificial Sequence
  ELANE RNA Guide
guuagagcccugaggcgcag

SEQ ID NO: 28278 - RNA, 20 nt, Artificial Sequence
  ELANE RNA Guide
uaacccgaugccuuugcccc

SEQ ID NO: 28279 - RNA, 20 nt, Artificial Sequence
  ELANE RNA Guide
ucagggcucuaacccgaugc

SEQ ID NO: 28280 - RNA, 20 nt, Artificial Sequence
  ELANE RNA Guide
ucggguuagagcccugaggc

SEQ ID NO: 28281 - RNA, 20 nt, Artificial Sequence
  ELANE RNA Guide
ucuaacccgaugccuuugcc

SEQ ID NO: 28282 - RNA, 20 nt, Artificial Sequence
  ELANE RNA Guide
ugcgccucagggcucuaacc

SEQ ID NO: 28283 - RNA, 21 nt, Artificial Sequence
  ELANE RNA Guide
aaaggcaucggguuagagccc

SEQ ID NO: 28284 - RNA, 21 nt, Artificial Sequence
  ELANE RNA Guide
aacccgaugccuuugccccgg

SEQ ID NO: 28285 - RNA, 21 nt, Artificial Sequence
  ELANE RNA Guide
aaggcaucggguuagagcccu

SEQ ID NO: 28286 - RNA, 21 nt, Artificial Sequence
  ELANE RNA Guide
aggcaucggguuagagcccug

SEQ ID NO: 28287 - RNA, 21 nt, Artificial Sequence
  ELANE RNA Guide
agggcucuaacccgaugccuu

SEQ ID NO: 28288 - RNA, 21 nt, Artificial Sequence
  ELANE RNA Guide
aucggguuagagcccugaggc

SEQ ID NO: 28289 - RNA, 21 nt, Artificial Sequence
  ELANE RNA Guide
caaaggcaucggguuagagcc

SEQ ID NO: 28290 - RNA, 21 nt, Artificial Sequence
  ELANE RNA Guide
cagggcucuaacccgaugccu

SEQ ID NO: 28291 - RNA, 21 nt, Artificial Sequence
  ELANE RNA Guide
caucggguuagagcccugagg

SEQ ID NO: 28292 - RNA, 21 nt, Artificial Sequence
  ELANE RNA Guide
ccggggcaaaggcaucggguu

SEQ ID NO: 28293 - RNA, 21 nt, Artificial Sequence
  ELANE RNA Guide
ccucagggcucuaacccgaug

SEQ ID NO: 28294 - RNA, 21 nt, Artificial Sequence
  ELANE RNA Guide
cgccucagggcucuaacccga

SEQ ID NO: 28295 - RNA, 21 nt, Artificial Sequence
  ELANE RNA Guide
cggggcaaaggcaucggguua

SEQ ID NO: 28296 - RNA, 21 nt, Artificial Sequence
  ELANE RNA Guide
cggguuagagcccugaggcgc

SEQ ID NO: 28297 - RNA, 21 nt, Artificial Sequence
  ELANE RNA Guide
cuaacccgaugccuuugcccc

SEQ ID NO: 28298 - RNA, 21 nt, Artificial Sequence
  ELANE RNA Guide
cucagggcucuaacccgaugc

SEQ ID NO: 28299 - RNA, 21 nt, Artificial Sequence
  ELANE RNA Guide
cucuaacccgaugccuuugcc

SEQ ID NO: 28300 - RNA, 21 nt, Artificial Sequence
  ELANE RNA Guide
cugcgccucagggcucuaacc

SEQ ID NO: 28301 - RNA, 21 nt, Artificial Sequence
  ELANE RNA Guide
gaggcugcgccucagggcucu

SEQ ID NO: 28302 - RNA, 21 nt, Artificial Sequence
  ELANE RNA Guide
gcaaaggcaucggguuagagc

SEQ ID NO: 28303 - RNA, 21 nt, Artificial Sequence
  ELANE RNA Guide
gcaucggguuagagcccugag

SEQ ID NO: 28304 - RNA, 21 nt, Artificial Sequence
  ELANE RNA Guide
gccucagggcucuaacccgau

SEQ ID NO: 28305 - RNA, 21 nt, Artificial Sequence
  ELANE RNA Guide
gcgccucagggcucuaacccg

SEQ ID NO: 28306 - RNA, 21 nt, Artificial Sequence
  ELANE RNA Guide
gcucuaacccgaugccuuugc

SEQ ID NO: 28307 - RNA, 21 nt, Artificial Sequence
  ELANE RNA Guide
gcugcgccucagggcucuaac

SEQ ID NO: 28308 - RNA, 21 nt, Artificial Sequence
  ELANE RNA Guide
ggaggcugcgccucagggcuc

SEQ ID NO: 28309 - RNA, 21 nt, Artificial Sequence
  ELANE RNA Guide
ggcaaaggcaucggguuagag

SEQ ID NO: 28310 - RNA, 21 nt, Artificial Sequence
  ELANE RNA Guide
ggcaucggguuagagcccuga

SEQ ID NO: 28311 - RNA, 21 nt, Artificial Sequence
  ELANE RNA Guide
ggcucuaacccgaugccuuug

SEQ ID NO: 28312 - RNA, 21 nt, Artificial Sequence
  ELANE RNA Guide
ggcugcgccucagggcucuaa

SEQ ID NO: 28313 - RNA, 21 nt, Artificial Sequence
  ELANE RNA Guide
gggaggcugcgccucagggcu

SEQ ID NO: 28314 - RNA, 21 nt, Artificial Sequence
  ELANE RNA Guide
gggcaaaggcaucggguuaga

SEQ ID NO: 28315 - RNA, 21 nt, Artificial Sequence
  ELANE RNA Guide
gggcucuaacccgaugccuuu

SEQ ID NO: 28316 - RNA, 21 nt, Artificial Sequence
  ELANE RNA Guide
ggggcaaaggcaucggguuag

SEQ ID NO: 28317 - RNA, 21 nt, Artificial Sequence
  ELANE RNA Guide
ggguuagagcccugaggcgca

SEQ ID NO: 28318 - RNA, 21 nt, Artificial Sequence
  ELANE RNA Guide
gguuagagcccugaggcgcag

SEQ ID NO: 28319 - RNA, 21 nt, Artificial Sequence
  ELANE RNA Guide
guuagagcccugaggcgcagc

SEQ ID NO: 28320 - RNA, 21 nt, Artificial Sequence
  ELANE RNA Guide
uaacccgaugccuuugccccg

SEQ ID NO: 28321 - RNA, 21 nt, Artificial Sequence
  ELANE RNA Guide
ucagggcucuaacccgaugcc

SEQ ID NO: 28322 - RNA, 21 nt, Artificial Sequence
  ELANE RNA Guide
ucggguuagagcccugaggcg

SEQ ID NO: 28323 - RNA, 21 nt, Artificial Sequence
  ELANE RNA Guide
ucuaacccgaugccuuugccc

SEQ ID NO: 28324 - RNA, 21 nt, Artificial Sequence
  ELANE RNA Guide
ugcgccucagggcucuaaccc

SEQ ID NO: 28325 - RNA, 22 nt, Artificial Sequence
  ELANE RNA Guide
aaaggcaucggguuagagcccu

SEQ ID NO: 28326 - RNA, 22 nt, Artificial Sequence
  ELANE RNA Guide
aacccgaugccuuugccccggu

SEQ ID NO: 28327 - RNA, 22 nt, Artificial Sequence
  ELANE RNA Guide
aaggcaucggguuagagcccug

SEQ ID NO: 28328 - RNA, 22 nt, Artificial Sequence
  ELANE RNA Guide
accggggcaaaggcaucggguu

SEQ ID NO: 28329 - RNA, 22 nt, Artificial Sequence
  ELANE RNA Guide
aggcaucggguuagagcccuga

SEQ ID NO: 28330 - RNA, 22 nt, Artificial Sequence
  ELANE RNA Guide
aggcugcgccucagggcucuaa

SEQ ID NO: 28331 - RNA, 22 nt, Artificial Sequence
  ELANE RNA Guide
agggcucuaacccgaugccuuu

SEQ ID NO: 28332 - RNA, 22 nt, Artificial Sequence
  ELANE RNA Guide
aucggguuagagcccugaggcg

SEQ ID NO: 28333 - RNA, 22 nt, Artificial Sequence
  ELANE RNA Guide
caaaggcaucggguuagagccc

SEQ ID NO: 28334 - RNA, 22 nt, Artificial Sequence
  ELANE RNA Guide
cagggcucuaacccgaugccuu

SEQ ID NO: 28335 - RNA, 22 nt, Artificial Sequence
  ELANE RNA Guide
caucggguuagagcccugaggc

SEQ ID NO: 28336 - RNA, 22 nt, Artificial Sequence
  ELANE RNA Guide
ccggggcaaaggcaucggguua

SEQ ID NO: 28337 - RNA, 22 nt, Artificial Sequence
  ELANE RNA Guide
ccucagggcucuaacccgaugc

SEQ ID NO: 28338 - RNA, 22 nt, Artificial Sequence
  ELANE RNA Guide
cgccucagggcucuaacccgau

SEQ ID NO: 28339 - RNA, 22 nt, Artificial Sequence
  ELANE RNA Guide
cggggcaaaggcaucggguuag

SEQ ID NO: 28340 - RNA, 22 nt, Artificial Sequence
  ELANE RNA Guide
cggguuagagcccugaggcgca

SEQ ID NO: 28341 - RNA, 22 nt, Artificial Sequence
  ELANE RNA Guide
cuaacccgaugccuuugccccg

SEQ ID NO: 28342 - RNA, 22 nt, Artificial Sequence
  ELANE RNA Guide
cucagggcucuaacccgaugcc

SEQ ID NO: 28343 - RNA, 22 nt, Artificial Sequence
  ELANE RNA Guide
cucuaacccgaugccuuugccc

SEQ ID NO: 28344 - RNA, 22 nt, Artificial Sequence
  ELANE RNA Guide
cugcgccucagggcucuaaccc

SEQ ID NO: 28345 - RNA, 22 nt, Artificial Sequence
  ELANE RNA Guide
gcaaaggcaucggguuagagcc

SEQ ID NO: 28346 - RNA, 22 nt, Artificial Sequence
  ELANE RNA Guide
gcaucggguuagagcccugagg

SEQ ID NO: 28347 - RNA, 22 nt, Artificial Sequence
  ELANE RNA Guide
gccucagggcucuaacccgaug

SEQ ID NO: 28348 - RNA, 22 nt, Artificial Sequence
  ELANE RNA Guide
gcgccucagggcucuaacccga

SEQ ID NO: 28349 - RNA, 22 nt, Artificial Sequence
  ELANE RNA Guide
gcucuaacccgaugccuuugcc

SEQ ID NO: 28350 - RNA, 22 nt, Artificial Sequence
  ELANE RNA Guide
gcugcgccucagggcucuaacc

SEQ ID NO: 28351 - RNA, 22 nt, Artificial Sequence
  ELANE RNA Guide
ggaggcugcgccucagggcucu

SEQ ID NO: 28352 - RNA, 22 nt, Artificial Sequence
  ELANE RNA Guide
ggcaaaggcaucggguuagagc

SEQ ID NO: 28353 - RNA, 22 nt, Artificial Sequence
  ELANE RNA Guide
ggcaucggguuagagcccugag

SEQ ID NO: 28354 - RNA, 22 nt, Artificial Sequence
  ELANE RNA Guide
ggcucuaacccgaugccuuugc

SEQ ID NO: 28355 - RNA, 22 nt, Artificial Sequence
  ELANE RNA Guide
ggcugcgccucagggcucuaac

SEQ ID NO: 28356 - RNA, 22 nt, Artificial Sequence
  ELANE RNA Guide
gggaggcugcgccucagggcuc

SEQ ID NO: 28357 - RNA, 22 nt, Artificial Sequence
  ELANE RNA Guide
gggcaaaggcaucggguuagag

SEQ ID NO: 28358 - RNA, 22 nt, Artificial Sequence
  ELANE RNA Guide
gggcucuaacccgaugccuuug

SEQ ID NO: 28359 - RNA, 22 nt, Artificial Sequence
  ELANE RNA Guide
ggggaggcugcgccucagggcu

SEQ ID NO: 28360 - RNA, 22 nt, Artificial Sequence
  ELANE RNA Guide
ggggcaaaggcaucggguuaga

SEQ ID NO: 28361 - RNA, 22 nt, Artificial Sequence
  ELANE RNA Guide
ggguuagagcccugaggcgcag

SEQ ID NO: 28362 - RNA, 22 nt, Artificial Sequence
  ELANE RNA Guide
gguuagagcccugaggcgcagc

SEQ ID NO: 28363 - RNA, 22 nt, Artificial Sequence
  ELANE RNA Guide
guuagagcccugaggcgcagcc

SEQ ID NO: 28364 - RNA, 22 nt, Artificial Sequence
  ELANE RNA Guide
uaacccgaugccuuugccccgg

SEQ ID NO: 28365 - RNA, 22 nt, Artificial Sequence
  ELANE RNA Guide
ucagggcucuaacccgaugccu

SEQ ID NO: 28366 - RNA, 22 nt, Artificial Sequence
  ELANE RNA Guide
ucggguuagagcccugaggcgc

SEQ ID NO: 28367 - RNA, 22 nt, Artificial Sequence
  ELANE RNA Guide
ucuaacccgaugccuuugcccc

SEQ ID NO: 28368 - RNA, 22 nt, Artificial Sequence
  ELANE RNA Guide
ugcgccucagggcucuaacccg

SEQ ID NO: 28369 - RNA, 20 nt, Artificial Sequence
  ELANE RNA Guide
aaaggcaucgggcuagagcc

SEQ ID NO: 28370 - RNA, 20 nt, Artificial Sequence
  ELANE RNA Guide
aaggcaucgggcuagagccc

SEQ ID NO: 28371 - RNA, 20 nt, Artificial Sequence
  ELANE RNA Guide
agcccgaugccuuugccccg

SEQ ID NO: 28372 - RNA, 20 nt, Artificial Sequence
  ELANE RNA Guide
aggcaucgggcuagagcccu

SEQ ID NO: 28373 - RNA, 20 nt, Artificial Sequence
  ELANE RNA Guide
agggcucuagcccgaugccu

SEQ ID NO: 28374 - RNA, 20 nt, Artificial Sequence
  ELANE RNA Guide
aucgggcuagagcccugagg

SEQ ID NO: 28375 - RNA, 20 nt, Artificial Sequence
  ELANE RNA Guide
caaaggcaucgggcuagagc

SEQ ID NO: 28376 - RNA, 20 nt, Artificial Sequence
  ELANE RNA Guide
cagggcucuagcccgaugcc

SEQ ID NO: 28377 - RNA, 20 nt, Artificial Sequence
  ELANE RNA Guide
caucgggcuagagcccugag

SEQ ID NO: 28378 - RNA, 20 nt, Artificial Sequence
  ELANE RNA Guide
ccggggcaaaggcaucgggc

SEQ ID NO: 28379 - RNA, 20 nt, Artificial Sequence
  ELANE RNA Guide
ccucagggcucuagcccgau

SEQ ID NO: 28380 - RNA, 20 nt, Artificial Sequence
  ELANE RNA Guide
cgccucagggcucuagcccg

SEQ ID NO: 28381 - RNA, 20 nt, Artificial Sequence
  ELANE RNA Guide
cgggcuagagcccugaggcg

SEQ ID NO: 28382 - RNA, 20 nt, Artificial Sequence
  ELANE RNA Guide
cggggcaaaggcaucgggcu

SEQ ID NO: 28383 - RNA, 20 nt, Artificial Sequence
  ELANE RNA Guide
cuagcccgaugccuuugccc

SEQ ID NO: 28384 - RNA, 20 nt, Artificial Sequence
  ELANE RNA Guide
cucagggcucuagcccgaug

SEQ ID NO: 28385 - RNA, 20 nt, Artificial Sequence
  ELANE RNA Guide
cucuagcccgaugccuuugc

SEQ ID NO: 28386 - RNA, 20 nt, Artificial Sequence
  ELANE RNA Guide
cugcgccucagggcucuagc

SEQ ID NO: 28387 - RNA, 20 nt, Artificial Sequence
  ELANE RNA Guide
gcaaaggcaucgggcuagag

SEQ ID NO: 28388 - RNA, 20 nt, Artificial Sequence
  ELANE RNA Guide
gcaucgggcuagagcccuga

SEQ ID NO: 28389 - RNA, 20 nt, Artificial Sequence
  ELANE RNA Guide
gccucagggcucuagcccga

SEQ ID NO: 28390 - RNA, 20 nt, Artificial Sequence
  ELANE RNA Guide
gcgccucagggcucuagccc

SEQ ID NO: 28391 - RNA, 20 nt, Artificial Sequence
  ELANE RNA Guide
gcuagagcccugaggcgcag

SEQ ID NO: 28392 - RNA, 20 nt, Artificial Sequence
  ELANE RNA Guide
gcucuagcccgaugccuuug

SEQ ID NO: 28393 - RNA, 20 nt, Artificial Sequence
  ELANE RNA Guide
gcugcgccucagggcucuag

SEQ ID NO: 28394 - RNA, 20 nt, Artificial Sequence
  ELANE RNA Guide
ggcaaaggcaucgggcuaga

SEQ ID NO: 28395 - RNA, 20 nt, Artificial Sequence
  ELANE RNA Guide
ggcaucgggcuagagcccug

SEQ ID NO: 28396 - RNA, 20 nt, Artificial Sequence
  ELANE RNA Guide
ggcuagagcccugaggcgca

SEQ ID NO: 28397 - RNA, 20 nt, Artificial Sequence
  ELANE RNA Guide
ggcucuagcccgaugccuuu

SEQ ID NO: 28398 - RNA, 20 nt, Artificial Sequence
  ELANE RNA Guide
gggcaaaggcaucgggcuag

SEQ ID NO: 28399 - RNA, 20 nt, Artificial Sequence
  ELANE RNA Guide
gggcuagagcccugaggcgc

SEQ ID NO: 28400 - RNA, 20 nt, Artificial Sequence
  ELANE RNA Guide
gggcucuagcccgaugccuu

SEQ ID NO: 28401 - RNA, 20 nt, Artificial Sequence
  ELANE RNA Guide
ggggcaaaggcaucgggcua

SEQ ID NO: 28402 - RNA, 20 nt, Artificial Sequence
  ELANE RNA Guide
uagcccgaugccuuugcccc

SEQ ID NO: 28403 - RNA, 20 nt, Artificial Sequence
  ELANE RNA Guide
ucagggcucuagcccgaugc

SEQ ID NO: 28404 - RNA, 20 nt, Artificial Sequence
  ELANE RNA Guide
ucgggcuagagcccugaggc

SEQ ID NO: 28405 - RNA, 20 nt, Artificial Sequence
  ELANE RNA Guide
ucuagcccgaugccuuugcc

SEQ ID NO: 28406 - RNA, 20 nt, Artificial Sequence
  ELANE RNA Guide
ugcgccucagggcucuagcc

SEQ ID NO: 28407 - RNA, 21 nt, Artificial Sequence
  ELANE RNA Guide
aaaggcaucgggcuagagccc

SEQ ID NO: 28408 - RNA, 21 nt, Artificial Sequence
  ELANE RNA Guide
aaggcaucgggcuagagcccu

SEQ ID NO: 28409 - RNA, 21 nt, Artificial Sequence
  ELANE RNA Guide
accggggcaaaggcaucgggc

SEQ ID NO: 28410 - RNA, 21 nt, Artificial Sequence
  ELANE RNA Guide
agcccgaugccuuugccccgg

SEQ ID NO: 28411 - RNA, 21 nt, Artificial Sequence
  ELANE RNA Guide
aggcaucgggcuagagcccug

SEQ ID NO: 28412 - RNA, 21 nt, Artificial Sequence
  ELANE RNA Guide
agggcucuagcccgaugccuu

SEQ ID NO: 28413 - RNA, 21 nt, Artificial Sequence
  ELANE RNA Guide
aucgggcuagagcccugaggc

SEQ ID NO: 28414 - RNA, 21 nt, Artificial Sequence
  ELANE RNA Guide
caaaggcaucgggcuagagcc

SEQ ID NO: 28415 - RNA, 21 nt, Artificial Sequence
  ELANE RNA Guide
cagggcucuagcccgaugccu

SEQ ID NO: 28416 - RNA, 21 nt, Artificial Sequence
  ELANE RNA Guide
caucgggcuagagcccugagg

SEQ ID NO: 28417 - RNA, 21 nt, Artificial Sequence
  ELANE RNA Guide
ccggggcaaaggcaucgggcu

SEQ ID NO: 28418 - RNA, 21 nt, Artificial Sequence
  ELANE RNA Guide
ccucagggcucuagcccgaug

SEQ ID NO: 28419 - RNA, 21 nt, Artificial Sequence
  ELANE RNA Guide
cgccucagggcucuagcccga

SEQ ID NO: 28420 - RNA, 21 nt, Artificial Sequence
  ELANE RNA Guide
cgggcuagagcccugaggcgc

SEQ ID NO: 28421 - RNA, 21 nt, Artificial Sequence
  ELANE RNA Guide
cggggcaaaggcaucgggcua

SEQ ID NO: 28422 - RNA, 21 nt, Artificial Sequence
  ELANE RNA Guide
cuagcccgaugccuuugcccc

SEQ ID NO: 28423 - RNA, 21 nt, Artificial Sequence
  ELANE RNA Guide
cucagggcucuagcccgaugc

SEQ ID NO: 28424 - RNA, 21 nt, Artificial Sequence
  ELANE RNA Guide
cucuagcccgaugccuuugcc

SEQ ID NO: 28425 - RNA, 21 nt, Artificial Sequence
  ELANE RNA Guide
cugcgccucagggcucuagcc

SEQ ID NO: 28426 - RNA, 21 nt, Artificial Sequence
  ELANE RNA Guide
gcaaaggcaucgggcuagagc

SEQ ID NO: 28427 - RNA, 21 nt, Artificial Sequence
  ELANE RNA Guide
gcaucgggcuagagcccugag

SEQ ID NO: 28428 - RNA, 21 nt, Artificial Sequence
  ELANE RNA Guide
gccucagggcucuagcccgau

SEQ ID NO: 28429 - RNA, 21 nt, Artificial Sequence
  ELANE RNA Guide
gcgccucagggcucuagcccg

SEQ ID NO: 28430 - RNA, 21 nt, Artificial Sequence
  ELANE RNA Guide
gcuagagcccugaggcgcagc

SEQ ID NO: 28431 - RNA, 21 nt, Artificial Sequence
  ELANE RNA Guide
gcucuagcccgaugccuuugc

SEQ ID NO: 28432 - RNA, 21 nt, Artificial Sequence
  ELANE RNA Guide
gcugcgccucagggcucuagc

SEQ ID NO: 28433 - RNA, 21 nt, Artificial Sequence
  ELANE RNA Guide
ggcaaaggcaucgggcuagag

SEQ ID NO: 28434 - RNA, 21 nt, Artificial Sequence
  ELANE RNA Guide
ggcaucgggcuagagcccuga

SEQ ID NO: 28435 - RNA, 21 nt, Artificial Sequence
  ELANE RNA Guide
ggcuagagcccugaggcgcag

SEQ ID NO: 28436 - RNA, 21 nt, Artificial Sequence
  ELANE RNA Guide
ggcucuagcccgaugccuuug

SEQ ID NO: 28437 - RNA, 21 nt, Artificial Sequence
  ELANE RNA Guide
ggcugcgccucagggcucuag

SEQ ID NO: 28438 - RNA, 21 nt, Artificial Sequence
  ELANE RNA Guide
gggcaaaggcaucgggcuaga

SEQ ID NO: 28439 - RNA, 21 nt, Artificial Sequence
  ELANE RNA Guide
gggcuagagcccugaggcgca

SEQ ID NO: 28440 - RNA, 21 nt, Artificial Sequence
  ELANE RNA Guide
gggcucuagcccgaugccuuu

SEQ ID NO: 28441 - RNA, 21 nt, Artificial Sequence
  ELANE RNA Guide
ggggcaaaggcaucgggcuag

SEQ ID NO: 28442 - RNA, 21 nt, Artificial Sequence
  ELANE RNA Guide
uagcccgaugccuuugccccg

SEQ ID NO: 28443 - RNA, 21 nt, Artificial Sequence
  ELANE RNA Guide
ucagggcucuagcccgaugcc

SEQ ID NO: 28444 - RNA, 21 nt, Artificial Sequence
  ELANE RNA Guide
ucgggcuagagcccugaggcg

SEQ ID NO: 28445 - RNA, 21 nt, Artificial Sequence
  ELANE RNA Guide
ucuagcccgaugccuuugccc

SEQ ID NO: 28446 - RNA, 21 nt, Artificial Sequence
  ELANE RNA Guide
ugcgccucagggcucuagccc

SEQ ID NO: 28447 - RNA, 22 nt, Artificial Sequence
  ELANE RNA Guide
aaaggcaucgggcuagagcccu

SEQ ID NO: 28448 - RNA, 22 nt, Artificial Sequence
  ELANE RNA Guide
aaggcaucgggcuagagcccug

SEQ ID NO: 28449 - RNA, 22 nt, Artificial Sequence
  ELANE RNA Guide
accggggcaaaggcaucgggcu

SEQ ID NO: 28450 - RNA, 22 nt, Artificial Sequence
  ELANE RNA Guide
agcccgaugccuuugccccggu

SEQ ID NO: 28451 - RNA, 22 nt, Artificial Sequence
  ELANE RNA Guide
aggcaucgggcuagagcccuga

SEQ ID NO: 28452 - RNA, 22 nt, Artificial Sequence
  ELANE RNA Guide
aggcugcgccucagggcucuag

SEQ ID NO: 28453 - RNA, 22 nt, Artificial Sequence
  ELANE RNA Guide
agggcucuagcccgaugccuuu

SEQ ID NO: 28454 - RNA, 22 nt, Artificial Sequence
  ELANE RNA Guide
aucgggcuagagcccugaggcg

SEQ ID NO: 28455 - RNA, 22 nt, Artificial Sequence
  ELANE RNA Guide
caaaggcaucgggcuagagccc

SEQ ID NO: 28456 - RNA, 22 nt, Artificial Sequence
  ELANE RNA Guide
caccggggcaaaggcaucgggc

SEQ ID NO: 28457 - RNA, 22 nt, Artificial Sequence
  ELANE RNA Guide
cagggcucuagcccgaugccuu

SEQ ID NO: 28458 - RNA, 22 nt, Artificial Sequence
  ELANE RNA Guide
caucgggcuagagcccugaggc

SEQ ID NO: 28459 - RNA, 22 nt, Artificial Sequence
  ELANE RNA Guide
ccggggcaaaggcaucgggcua

SEQ ID NO: 28460 - RNA, 22 nt, Artificial Sequence
  ELANE RNA Guide
ccucagggcucuagcccgaugc

SEQ ID NO: 28461 - RNA, 22 nt, Artificial Sequence
  ELANE RNA Guide
cgccucagggcucuagcccgau

SEQ ID NO: 28462 - RNA, 22 nt, Artificial Sequence
  ELANE RNA Guide
cgggcuagagcccugaggcgca

SEQ ID NO: 28463 - RNA, 22 nt, Artificial Sequence
  ELANE RNA Guide
cggggcaaaggcaucgggcuag

SEQ ID NO: 28464 - RNA, 22 nt, Artificial Sequence
  ELANE RNA Guide
cuagcccgaugccuuugccccg

SEQ ID NO: 28465 - RNA, 22 nt, Artificial Sequence
  ELANE RNA Guide
cucagggcucuagcccgaugcc

SEQ ID NO: 28466 - RNA, 22 nt, Artificial Sequence
  ELANE RNA Guide
cucuagcccgaugccuuugccc

SEQ ID NO: 28467 - RNA, 22 nt, Artificial Sequence
  ELANE RNA Guide
cugcgccucagggcucuagccc

SEQ ID NO: 28468 - RNA, 22 nt, Artificial Sequence
  ELANE RNA Guide
gcaaaggcaucgggcuagagcc

SEQ ID NO: 28469 - RNA, 22 nt, Artificial Sequence
  ELANE RNA Guide
gcaucgggcuagagcccugagg

SEQ ID NO: 28470 - RNA, 22 nt, Artificial Sequence
  ELANE RNA Guide
gccucagggcucuagcccgaug

SEQ ID NO: 28471 - RNA, 22 nt, Artificial Sequence
  ELANE RNA Guide
gcgccucagggcucuagcccga

SEQ ID NO: 28472 - RNA, 22 nt, Artificial Sequence
  ELANE RNA Guide
gcuagagcccugaggcgcagcc

SEQ ID NO: 28473 - RNA, 22 nt, Artificial Sequence
  ELANE RNA Guide
gcucuagcccgaugccuuugcc

SEQ ID NO: 28474 - RNA, 22 nt, Artificial Sequence
  ELANE RNA Guide
gcugcgccucagggcucuagcc

SEQ ID NO: 28475 - RNA, 22 nt, Artificial Sequence
  ELANE RNA Guide
ggcaaaggcaucgggcuagagc

SEQ ID NO: 28476 - RNA, 22 nt, Artificial Sequence
  ELANE RNA Guide
ggcaucgggcuagagcccugag

SEQ ID NO: 28477 - RNA, 22 nt, Artificial Sequence
  ELANE RNA Guide
ggcuagagcccugaggcgcagc

SEQ ID NO: 28478 - RNA, 22 nt, Artificial Sequence
  ELANE RNA Guide
ggcucuagcccgaugccuuugc

SEQ ID NO: 28479 - RNA, 22 nt, Artificial Sequence
  ELANE RNA Guide
ggcugcgccucagggcucuagc

SEQ ID NO: 28480 - RNA, 22 nt, Artificial Sequence
  ELANE RNA Guide
gggcaaaggcaucgggcuagag

SEQ ID NO: 28481 - RNA, 22 nt, Artificial Sequence
  ELANE RNA Guide
gggcuagagcccugaggcgcag

SEQ ID NO: 28482 - RNA, 22 nt, Artificial Sequence
  ELANE RNA Guide
gggcucuagcccgaugccuuug

SEQ ID NO: 28483 - RNA, 22 nt, Artificial Sequence
  ELANE RNA Guide
ggggcaaaggcaucgggcuaga

SEQ ID NO: 28484 - RNA, 22 nt, Artificial Sequence
  ELANE RNA Guide
uagcccgaugccuuugccccgg

SEQ ID NO: 28485 - RNA, 22 nt, Artificial Sequence
  ELANE RNA Guide
ucagggcucuagcccgaugccu

SEQ ID NO: 28486 - RNA, 22 nt, Artificial Sequence
  ELANE RNA Guide
ucgggcuagagcccugaggcgc

SEQ ID NO: 28487 - RNA, 22 nt, Artificial Sequence
  ELANE RNA Guide
ucuagcccgaugccuuugcccc

SEQ ID NO: 28488 - RNA, 22 nt, Artificial Sequence
  ELANE RNA Guide
ugcgccucagggcucuagcccg

SEQ ID NO: 28489 - RNA, 20 nt, Artificial Sequence
  ELANE RNA Guide
aaaggcaugggguagagccc

SEQ ID NO: 28490 - RNA, 20 nt, Artificial Sequence
  ELANE RNA Guide
aaggcaugggguagagcccu

SEQ ID NO: 28491 - RNA, 20 nt, Artificial Sequence
  ELANE RNA Guide
accccaugccuuugccccgg

SEQ ID NO: 28492 - RNA, 20 nt, Artificial Sequence
  ELANE RNA Guide
accggggcaaaggcaugggg

SEQ ID NO: 28493 - RNA, 20 nt, Artificial Sequence
  ELANE RNA Guide
aggcaugggguagagcccug

SEQ ID NO: 28494 - RNA, 20 nt, Artificial Sequence
  ELANE RNA Guide
agggcucuaccccaugccuu

SEQ ID NO: 28495 - RNA, 20 nt, Artificial Sequence
  ELANE RNA Guide
augggguagagcccugaggc

SEQ ID NO: 28496 - RNA, 20 nt, Artificial Sequence
  ELANE RNA Guide
caaaggcaugggguagagcc

SEQ ID NO: 28497 - RNA, 20 nt, Artificial Sequence
  ELANE RNA Guide
caccggggcaaaggcauggg

SEQ ID NO: 28498 - RNA, 20 nt, Artificial Sequence
  ELANE RNA Guide
cagggcucuaccccaugccu

SEQ ID NO: 28499 - RNA, 20 nt, Artificial Sequence
  ELANE RNA Guide
caugggguagagcccugagg

SEQ ID NO: 28500 - RNA, 20 nt, Artificial Sequence
  ELANE RNA Guide
ccaccggggcaaaggcaugg

SEQ ID NO: 28501 - RNA, 20 nt, Artificial Sequence
  ELANE RNA Guide
ccaugccuuugccccggugg

SEQ ID NO: 28502 - RNA, 20 nt, Artificial Sequence
  ELANE RNA Guide
cccaugccuuugccccggug

SEQ ID NO: 28503 - RNA, 20 nt, Artificial Sequence
  ELANE RNA Guide
ccccaugccuuugccccggu

SEQ ID NO: 28504 - RNA, 20 nt, Artificial Sequence
  ELANE RNA Guide
ccggggcaaaggcauggggu

SEQ ID NO: 28505 - RNA, 20 nt, Artificial Sequence
  ELANE RNA Guide
ccucagggcucuaccccaug

SEQ ID NO: 28506 - RNA, 20 nt, Artificial Sequence
  ELANE RNA Guide
cgccucagggcucuacccca

SEQ ID NO: 28507 - RNA, 20 nt, Artificial Sequence
  ELANE RNA Guide
cggggcaaaggcauggggua

SEQ ID NO: 28508 - RNA, 20 nt, Artificial Sequence
  ELANE RNA Guide
cuaccccaugccuuugcccc

SEQ ID NO: 28509 - RNA, 20 nt, Artificial Sequence
  ELANE RNA Guide
cucagggcucuaccccaugc

SEQ ID NO: 28510 - RNA, 20 nt, Artificial Sequence
  ELANE RNA Guide
cucuaccccaugccuuugcc

SEQ ID NO: 28511 - RNA, 20 nt, Artificial Sequence
  ELANE RNA Guide
cugugccaccggggcaaagg

SEQ ID NO: 28512 - RNA, 20 nt, Artificial Sequence
  ELANE RNA Guide
gcaaaggcaugggguagagc

SEQ ID NO: 28513 - RNA, 20 nt, Artificial Sequence
  ELANE RNA Guide
gcaugggguagagcccugag

SEQ ID NO: 28514 - RNA, 20 nt, Artificial Sequence
  ELANE RNA Guide
gccaccggggcaaaggcaug

SEQ ID NO: 28515 - RNA, 20 nt, Artificial Sequence
  ELANE RNA Guide
gccucagggcucuaccccau

SEQ ID NO: 28516 - RNA, 20 nt, Artificial Sequence
  ELANE RNA Guide
gcgccucagggcucuacccc

SEQ ID NO: 28517 - RNA, 20 nt, Artificial Sequence
  ELANE RNA Guide
gcucuaccccaugccuuugc

SEQ ID NO: 28518 - RNA, 20 nt, Artificial Sequence
  ELANE RNA Guide
ggcaaaggcaugggguagag

SEQ ID NO: 28519 - RNA, 20 nt, Artificial Sequence
  ELANE RNA Guide
ggcaugggguagagcccuga

SEQ ID NO: 28520 - RNA, 20 nt, Artificial Sequence
  ELANE RNA Guide
ggcucuaccccaugccuuug

SEQ ID NO: 28521 - RNA, 20 nt, Artificial Sequence
  ELANE RNA Guide
gggcaaaggcaugggguaga

SEQ ID NO: 28522 - RNA, 20 nt, Artificial Sequence
  ELANE RNA Guide
gggcucuaccccaugccuuu

SEQ ID NO: 28523 - RNA, 20 nt, Artificial Sequence
  ELANE RNA Guide
ggggcaaaggcaugggguag

SEQ ID NO: 28524 - RNA, 20 nt, Artificial Sequence
  ELANE RNA Guide
gugccaccggggcaaaggca

SEQ ID NO: 28525 - RNA, 20 nt, Artificial Sequence
  ELANE RNA Guide
uaccccaugccuuugccccg

SEQ ID NO: 28526 - RNA, 20 nt, Artificial Sequence
  ELANE RNA Guide
ucagggcucuaccccaugcc

SEQ ID NO: 28527 - RNA, 20 nt, Artificial Sequence
  ELANE RNA Guide
ucuaccccaugccuuugccc

SEQ ID NO: 28528 - RNA, 20 nt, Artificial Sequence
  ELANE RNA Guide
ugccaccggggcaaaggcau

SEQ ID NO: 28529 - RNA, 20 nt, Artificial Sequence
  ELANE RNA Guide
ugggguagagcccugaggcg

SEQ ID NO: 28530 - RNA, 20 nt, Artificial Sequence
  ELANE RNA Guide
ugugccaccggggcaaaggc

SEQ ID NO: 28531 - RNA, 21 nt, Artificial Sequence
  ELANE RNA Guide
aaaggcaugggguagagcccu

SEQ ID NO: 28532 - RNA, 21 nt, Artificial Sequence
  ELANE RNA Guide
aaggcaugggguagagcccug

SEQ ID NO: 28533 - RNA, 21 nt, Artificial Sequence
  ELANE RNA Guide
accccaugccuuugccccggu

SEQ ID NO: 28534 - RNA, 21 nt, Artificial Sequence
  ELANE RNA Guide
accggggcaaaggcauggggu

SEQ ID NO: 28535 - RNA, 21 nt, Artificial Sequence
  ELANE RNA Guide
acugugccaccggggcaaagg

SEQ ID NO: 28536 - RNA, 21 nt, Artificial Sequence
  ELANE RNA Guide
aggcaugggguagagcccuga

SEQ ID NO: 28537 - RNA, 21 nt, Artificial Sequence
  ELANE RNA Guide
agggcucuaccccaugccuuu

SEQ ID NO: 28538 - RNA, 21 nt, Artificial Sequence
  ELANE RNA Guide
augggguagagcccugaggcg

SEQ ID NO: 28539 - RNA, 21 nt, Artificial Sequence
  ELANE RNA Guide
caaaggcaugggguagagccc

SEQ ID NO: 28540 - RNA, 21 nt, Artificial Sequence
  ELANE RNA Guide
caccggggcaaaggcaugggg

SEQ ID NO: 28541 - RNA, 21 nt, Artificial Sequence
  ELANE RNA Guide
cagggcucuaccccaugccuu

SEQ ID NO: 28542 - RNA, 21 nt, Artificial Sequence
  ELANE RNA Guide
caugggguagagcccugaggc

SEQ ID NO: 28543 - RNA, 21 nt, Artificial Sequence
  ELANE RNA Guide
ccaccggggcaaaggcauggg

SEQ ID NO: 28544 - RNA, 21 nt, Artificial Sequence
  ELANE RNA Guide
ccaugccuuugccccgguggc

SEQ ID NO: 28545 - RNA, 21 nt, Artificial Sequence
  ELANE RNA Guide
cccaugccuuugccccggugg

SEQ ID NO: 28546 - RNA, 21 nt, Artificial Sequence
  ELANE RNA Guide
ccccaugccuuugccccggug

SEQ ID NO: 28547 - RNA, 21 nt, Artificial Sequence
  ELANE RNA Guide
ccggggcaaaggcauggggua

SEQ ID NO: 28548 - RNA, 21 nt, Artificial Sequence
  ELANE RNA Guide
ccucagggcucuaccccaugc

SEQ ID NO: 28549 - RNA, 21 nt, Artificial Sequence
  ELANE RNA Guide
cgccucagggcucuaccccau

SEQ ID NO: 28550 - RNA, 21 nt, Artificial Sequence
  ELANE RNA Guide
cggggcaaaggcaugggguag

SEQ ID NO: 28551 - RNA, 21 nt, Artificial Sequence
  ELANE RNA Guide
cuaccccaugccuuugccccg

SEQ ID NO: 28552 - RNA, 21 nt, Artificial Sequence
  ELANE RNA Guide
cucagggcucuaccccaugcc

SEQ ID NO: 28553 - RNA, 21 nt, Artificial Sequence
  ELANE RNA Guide
cucuaccccaugccuuugccc

SEQ ID NO: 28554 - RNA, 21 nt, Artificial Sequence
  ELANE RNA Guide
cugugccaccggggcaaaggc

SEQ ID NO: 28555 - RNA, 21 nt, Artificial Sequence
  ELANE RNA Guide
gcaaaggcaugggguagagcc

SEQ ID NO: 28556 - RNA, 21 nt, Artificial Sequence
  ELANE RNA Guide
gcaugggguagagcccugagg

SEQ ID NO: 28557 - RNA, 21 nt, Artificial Sequence
  ELANE RNA Guide
gccaccggggcaaaggcaugg

SEQ ID NO: 28558 - RNA, 21 nt, Artificial Sequence
  ELANE RNA Guide
gccucagggcucuaccccaug

SEQ ID NO: 28559 - RNA, 21 nt, Artificial Sequence
  ELANE RNA Guide
gcgccucagggcucuacccca

SEQ ID NO: 28560 - RNA, 21 nt, Artificial Sequence
  ELANE RNA Guide
gcucuaccccaugccuuugcc

SEQ ID NO: 28561 - RNA, 21 nt, Artificial Sequence
  ELANE RNA Guide
ggcaaaggcaugggguagagc

SEQ ID NO: 28562 - RNA, 21 nt, Artificial Sequence
  ELANE RNA Guide
ggcaugggguagagcccugag

SEQ ID NO: 28563 - RNA, 21 nt, Artificial Sequence
  ELANE RNA Guide
ggcucuaccccaugccuuugc

SEQ ID NO: 28564 - RNA, 21 nt, Artificial Sequence
  ELANE RNA Guide
gggcaaaggcaugggguagag

SEQ ID NO: 28565 - RNA, 21 nt, Artificial Sequence
  ELANE RNA Guide
gggcucuaccccaugccuuug

SEQ ID NO: 28566 - RNA, 21 nt, Artificial Sequence
  ELANE RNA Guide
ggggcaaaggcaugggguaga

SEQ ID NO: 28567 - RNA, 21 nt, Artificial Sequence
  ELANE RNA Guide
gugccaccggggcaaaggcau

SEQ ID NO: 28568 - RNA, 21 nt, Artificial Sequence
  ELANE RNA Guide
uaccccaugccuuugccccgg

SEQ ID NO: 28569 - RNA, 21 nt, Artificial Sequence
  ELANE RNA Guide
ucagggcucuaccccaugccu

SEQ ID NO: 28570 - RNA, 21 nt, Artificial Sequence
  ELANE RNA Guide
ucuaccccaugccuuugcccc

SEQ ID NO: 28571 - RNA, 21 nt, Artificial Sequence
  ELANE RNA Guide
ugccaccggggcaaaggcaug

SEQ ID NO: 28572 - RNA, 21 nt, Artificial Sequence
  ELANE RNA Guide
ugcgccucagggcucuacccc

SEQ ID NO: 28573 - RNA, 21 nt, Artificial Sequence
  ELANE RNA Guide
ugggguagagcccugaggcgc

SEQ ID NO: 28574 - RNA, 21 nt, Artificial Sequence
  ELANE RNA Guide
ugugccaccggggcaaaggca

SEQ ID NO: 28575 - RNA, 22 nt, Artificial Sequence
  ELANE RNA Guide
aaaggcaugggguagagcccug

SEQ ID NO: 28576 - RNA, 22 nt, Artificial Sequence
  ELANE RNA Guide
aacugugccaccggggcaaagg

SEQ ID NO: 28577 - RNA, 22 nt, Artificial Sequence
  ELANE RNA Guide
aaggcaugggguagagcccuga

SEQ ID NO: 28578 - RNA, 22 nt, Artificial Sequence
  ELANE RNA Guide
accccaugccuuugccccggug

SEQ ID NO: 28579 - RNA, 22 nt, Artificial Sequence
  ELANE RNA Guide
accggggcaaaggcauggggua

SEQ ID NO: 28580 - RNA, 22 nt, Artificial Sequence
  ELANE RNA Guide
acugugccaccggggcaaaggc

SEQ ID NO: 28581 - RNA, 22 nt, Artificial Sequence
  ELANE RNA Guide
aggcaugggguagagcccugag

SEQ ID NO: 28582 - RNA, 22 nt, Artificial Sequence
  ELANE RNA Guide
agggcucuaccccaugccuuug

SEQ ID NO: 28583 - RNA, 22 nt, Artificial Sequence
  ELANE RNA Guide
augggguagagcccugaggcgc

SEQ ID NO: 28584 - RNA, 22 nt, Artificial Sequence
  ELANE RNA Guide
caaaggcaugggguagagcccu

SEQ ID NO: 28585 - RNA, 22 nt, Artificial Sequence
  ELANE RNA Guide
caccggggcaaaggcauggggu

SEQ ID NO: 28586 - RNA, 22 nt, Artificial Sequence
  ELANE RNA Guide
cagggcucuaccccaugccuuu

SEQ ID NO: 28587 - RNA, 22 nt, Artificial Sequence
  ELANE RNA Guide
caugggguagagcccugaggcg

SEQ ID NO: 28588 - RNA, 22 nt, Artificial Sequence
  ELANE RNA Guide
ccaccggggcaaaggcaugggg

SEQ ID NO: 28589 - RNA, 22 nt, Artificial Sequence
  ELANE RNA Guide
ccaugccuuugccccgguggca

SEQ ID NO: 28590 - RNA, 22 nt, Artificial Sequence
  ELANE RNA Guide
cccaugccuuugccccgguggc

SEQ ID NO: 28591 - RNA, 22 nt, Artificial Sequence
  ELANE RNA Guide
ccccaugccuuugccccggugg

SEQ ID NO: 28592 - RNA, 22 nt, Artificial Sequence
  ELANE RNA Guide
ccggggcaaaggcaugggguag

SEQ ID NO: 28593 - RNA, 22 nt, Artificial Sequence
  ELANE RNA Guide
ccucagggcucuaccccaugcc

SEQ ID NO: 28594 - RNA, 22 nt, Artificial Sequence
  ELANE RNA Guide
cgccucagggcucuaccccaug

SEQ ID NO: 28595 - RNA, 22 nt, Artificial Sequence
  ELANE RNA Guide
cggggcaaaggcaugggguaga

SEQ ID NO: 28596 - RNA, 22 nt, Artificial Sequence
  ELANE RNA Guide
cuaccccaugccuuugccccgg

SEQ ID NO: 28597 - RNA, 22 nt, Artificial Sequence
  ELANE RNA Guide
cucagggcucuaccccaugccu

SEQ ID NO: 28598 - RNA, 22 nt, Artificial Sequence
  ELANE RNA Guide
cucuaccccaugccuuugcccc

SEQ ID NO: 28599 - RNA, 22 nt, Artificial Sequence
  ELANE RNA Guide
cugcgccucagggcucuacccc

SEQ ID NO: 28600 - RNA, 22 nt, Artificial Sequence
  ELANE RNA Guide
cugugccaccggggcaaaggca

SEQ ID NO: 28601 - RNA, 22 nt, Artificial Sequence
  ELANE RNA Guide
gcaaaggcaugggguagagccc

SEQ ID NO: 28602 - RNA, 22 nt, Artificial Sequence
  ELANE RNA Guide
gcaugggguagagcccugaggc

SEQ ID NO: 28603 - RNA, 22 nt, Artificial Sequence
  ELANE RNA Guide
gccaccggggcaaaggcauggg

SEQ ID NO: 28604 - RNA, 22 nt, Artificial Sequence
  ELANE RNA Guide
gccucagggcucuaccccaugc

SEQ ID NO: 28605 - RNA, 22 nt, Artificial Sequence
  ELANE RNA Guide
gcgccucagggcucuaccccau

SEQ ID NO: 28606 - RNA, 22 nt, Artificial Sequence
  ELANE RNA Guide
gcucuaccccaugccuuugccc

SEQ ID NO: 28607 - RNA, 22 nt, Artificial Sequence
  ELANE RNA Guide
ggcaaaggcaugggguagagcc

SEQ ID NO: 28608 - RNA, 22 nt, Artificial Sequence
  ELANE RNA Guide
ggcaugggguagagcccugagg

SEQ ID NO: 28609 - RNA, 22 nt, Artificial Sequence
  ELANE RNA Guide
ggcucuaccccaugccuuugcc

SEQ ID NO: 28610 - RNA, 22 nt, Artificial Sequence
  ELANE RNA Guide
gggcaaaggcaugggguagagc

SEQ ID NO: 28611 - RNA, 22 nt, Artificial Sequence
  ELANE RNA Guide
gggcucuaccccaugccuuugc

SEQ ID NO: 28612 - RNA, 22 nt, Artificial Sequence
  ELANE RNA Guide
ggggcaaaggcaugggguagag

SEQ ID NO: 28613 - RNA, 22 nt, Artificial Sequence
  ELANE RNA Guide
gugccaccggggcaaaggcaug

SEQ ID NO: 28614 - RNA, 22 nt, Artificial Sequence
  ELANE RNA Guide
uaccccaugccuuugccccggu

SEQ ID NO: 28615 - RNA, 22 nt, Artificial Sequence
  ELANE RNA Guide
ucagggcucuaccccaugccuu

SEQ ID NO: 28616 - RNA, 22 nt, Artificial Sequence
  ELANE RNA Guide
ucuaccccaugccuuugccccg

SEQ ID NO: 28617 - RNA, 22 nt, Artificial Sequence
  ELANE RNA Guide
ugccaccggggcaaaggcaugg

SEQ ID NO: 28618 - RNA, 22 nt, Artificial Sequence
  ELANE RNA Guide
ugcgccucagggcucuacccca

SEQ ID NO: 28619 - RNA, 22 nt, Artificial Sequence
  ELANE RNA Guide
ugggguagagcccugaggcgca

SEQ ID NO: 28620 - RNA, 22 nt, Artificial Sequence
  ELANE RNA Guide
ugugccaccggggcaaaggcau

SEQ ID NO: 28621 - RNA, 20 nt, Artificial Sequence
  ELANE RNA Guide
aaacugugccaccggggaaa

SEQ ID NO: 28622 - RNA, 20 nt, Artificial Sequence
  ELANE RNA Guide
aacugugccaccggggaaag

SEQ ID NO: 28623 - RNA, 20 nt, Artificial Sequence
  ELANE RNA Guide
acaaacugugccaccgggga

SEQ ID NO: 28624 - RNA, 20 nt, Artificial Sequence
  ELANE RNA Guide
accccgaugccuuuccccgg

SEQ ID NO: 28625 - RNA, 20 nt, Artificial Sequence
  ELANE RNA Guide
accggggaaaggcaucgggg

SEQ ID NO: 28626 - RNA, 20 nt, Artificial Sequence
  ELANE RNA Guide
acugugccaccggggaaagg

SEQ ID NO: 28627 - RNA, 20 nt, Artificial Sequence
  ELANE RNA Guide
agggcucuaccccgaugccu

SEQ ID NO: 28628 - RNA, 20 nt, Artificial Sequence
  ELANE RNA Guide
augccuuuccccgguggcac

SEQ ID NO: 28629 - RNA, 20 nt, Artificial Sequence
  ELANE RNA Guide
caaacugugccaccggggaa

SEQ ID NO: 28630 - RNA, 20 nt, Artificial Sequence
  ELANE RNA Guide
caccggggaaaggcaucggg

SEQ ID NO: 28631 - RNA, 20 nt, Artificial Sequence
  ELANE RNA Guide
cagggcucuaccccgaugcc

SEQ ID NO: 28632 - RNA, 20 nt, Artificial Sequence
  ELANE RNA Guide
ccaccggggaaaggcaucgg

SEQ ID NO: 28633 - RNA, 20 nt, Artificial Sequence
  ELANE RNA Guide
ccccgaugccuuuccccggu

SEQ ID NO: 28634 - RNA, 20 nt, Artificial Sequence
  ELANE RNA Guide
cccgaugccuuuccccggug

SEQ ID NO: 28635 - RNA, 20 nt, Artificial Sequence
  ELANE RNA Guide
ccgaugccuuuccccggugg

SEQ ID NO: 28636 - RNA, 20 nt, Artificial Sequence
  ELANE RNA Guide
ccggggaaaggcaucggggu

SEQ ID NO: 28637 - RNA, 20 nt, Artificial Sequence
  ELANE RNA Guide
ccuuuccccgguggcacagu

SEQ ID NO: 28638 - RNA, 20 nt, Artificial Sequence
  ELANE RNA Guide
cgaugccuuuccccgguggc

SEQ ID NO: 28639 - RNA, 20 nt, Artificial Sequence
  ELANE RNA Guide
cggggaaaggcaucggggua

SEQ ID NO: 28640 - RNA, 20 nt, Artificial Sequence
  ELANE RNA Guide
cuaccccgaugccuuucccc

SEQ ID NO: 28641 - RNA, 20 nt, Artificial Sequence
  ELANE RNA Guide
cucuaccccgaugccuuucc

SEQ ID NO: 28642 - RNA, 20 nt, Artificial Sequence
  ELANE RNA Guide
cugugccaccggggaaaggc

SEQ ID NO: 28643 - RNA, 20 nt, Artificial Sequence
  ELANE RNA Guide
cuuuccccgguggcacaguu

SEQ ID NO: 28644 - RNA, 20 nt, Artificial Sequence
  ELANE RNA Guide
gaaaggcaucgggguagagc

SEQ ID NO: 28645 - RNA, 20 nt, Artificial Sequence
  ELANE RNA Guide
gaugccuuuccccgguggca

SEQ ID NO: 28646 - RNA, 20 nt, Artificial Sequence
  ELANE RNA Guide
gccaccggggaaaggcaucg

SEQ ID NO: 28647 - RNA, 20 nt, Artificial Sequence
  ELANE RNA Guide
gccuuuccccgguggcacag

SEQ ID NO: 28648 - RNA, 20 nt, Artificial Sequence
  ELANE RNA Guide
gcucuaccccgaugccuuuc

SEQ ID NO: 28649 - RNA, 20 nt, Artificial Sequence
  ELANE RNA Guide
ggaaaggcaucgggguagag

SEQ ID NO: 28650 - RNA, 20 nt, Artificial Sequence
  ELANE RNA Guide
ggcucuaccccgaugccuuu

SEQ ID NO: 28651 - RNA, 20 nt, Artificial Sequence
  ELANE RNA Guide
gggaaaggcaucgggguaga

SEQ ID NO: 28652 - RNA, 20 nt, Artificial Sequence
  ELANE RNA Guide
gggcucuaccccgaugccuu

SEQ ID NO: 28653 - RNA, 20 nt, Artificial Sequence
  ELANE RNA Guide
ggggaaaggcaucgggguag

SEQ ID NO: 28654 - RNA, 20 nt, Artificial Sequence
  ELANE RNA Guide
gugccaccggggaaaggcau

SEQ ID NO: 28655 - RNA, 20 nt, Artificial Sequence
  ELANE RNA Guide
guuuacaaacugugccaccg

SEQ ID NO: 28656 - RNA, 20 nt, Artificial Sequence
  ELANE RNA Guide
uacaaacugugccaccgggg

SEQ ID NO: 28657 - RNA, 20 nt, Artificial Sequence
  ELANE RNA Guide
uaccccgaugccuuuccccg

SEQ ID NO: 28658 - RNA, 20 nt, Artificial Sequence
  ELANE RNA Guide
ucuaccccgaugccuuuccc

SEQ ID NO: 28659 - RNA, 20 nt, Artificial Sequence
  ELANE RNA Guide
ugccaccggggaaaggcauc

SEQ ID NO: 28660 - RNA, 20 nt, Artificial Sequence
  ELANE RNA Guide
ugccuuuccccgguggcaca

SEQ ID NO: 28661 - RNA, 20 nt, Artificial Sequence
  ELANE RNA Guide
ugugccaccggggaaaggca

SEQ ID NO: 28662 - RNA, 20 nt, Artificial Sequence
  ELANE RNA Guide
uuacaaacugugccaccggg

SEQ ID NO: 28663 - RNA, 20 nt, Artificial Sequence
  ELANE RNA Guide
uuccccgguggcacaguuug

SEQ ID NO: 28664 - RNA, 20 nt, Artificial Sequence
  ELANE RNA Guide
uuuacaaacugugccaccgg

SEQ ID NO: 28665 - RNA, 20 nt, Artificial Sequence
  ELANE RNA Guide
uuuccccgguggcacaguuu

SEQ ID NO: 28666 - RNA, 21 nt, Artificial Sequence
  ELANE RNA Guide
aaacugugccaccggggaaag

SEQ ID NO: 28667 - RNA, 21 nt, Artificial Sequence
  ELANE RNA Guide
aacugugccaccggggaaagg

SEQ ID NO: 28668 - RNA, 21 nt, Artificial Sequence
  ELANE RNA Guide
acaaacugugccaccggggaa

SEQ ID NO: 28669 - RNA, 21 nt, Artificial Sequence
  ELANE RNA Guide
accccgaugccuuuccccggu

SEQ ID NO: 28670 - RNA, 21 nt, Artificial Sequence
  ELANE RNA Guide
accggggaaaggcaucggggu

SEQ ID NO: 28671 - RNA, 21 nt, Artificial Sequence
  ELANE RNA Guide
acugugccaccggggaaaggc

SEQ ID NO: 28672 - RNA, 21 nt, Artificial Sequence
  ELANE RNA Guide
agggcucuaccccgaugccuu

SEQ ID NO: 28673 - RNA, 21 nt, Artificial Sequence
  ELANE RNA Guide
aguuuacaaacugugccaccg

SEQ ID NO: 28674 - RNA, 21 nt, Artificial Sequence
  ELANE RNA Guide
augccuuuccccgguggcaca

SEQ ID NO: 28675 - RNA, 21 nt, Artificial Sequence
  ELANE RNA Guide
caaacugugccaccggggaaa

SEQ ID NO: 28676 - RNA, 21 nt, Artificial Sequence
  ELANE RNA Guide
caccggggaaaggcaucgggg

SEQ ID NO: 28677 - RNA, 21 nt, Artificial Sequence
  ELANE RNA Guide
cagggcucuaccccgaugccu

SEQ ID NO: 28678 - RNA, 21 nt, Artificial Sequence
  ELANE RNA Guide
ccaccggggaaaggcaucggg

SEQ ID NO: 28679 - RNA, 21 nt, Artificial Sequence
  ELANE RNA Guide
ccccgaugccuuuccccggug

SEQ ID NO: 28680 - RNA, 21 nt, Artificial Sequence
  ELANE RNA Guide
cccgaugccuuuccccggugg

SEQ ID NO: 28681 - RNA, 21 nt, Artificial Sequence
  ELANE RNA Guide
ccgaugccuuuccccgguggc

SEQ ID NO: 28682 - RNA, 21 nt, Artificial Sequence
  ELANE RNA Guide
ccggggaaaggcaucggggua

SEQ ID NO: 28683 - RNA, 21 nt, Artificial Sequence
  ELANE RNA Guide
ccuuuccccgguggcacaguu

SEQ ID NO: 28684 - RNA, 21 nt, Artificial Sequence
  ELANE RNA Guide
cgaugccuuuccccgguggca

SEQ ID NO: 28685 - RNA, 21 nt, Artificial Sequence
  ELANE RNA Guide
cggggaaaggcaucgggguag

SEQ ID NO: 28686 - RNA, 21 nt, Artificial Sequence
  ELANE RNA Guide
cuaccccgaugccuuuccccg

SEQ ID NO: 28687 - RNA, 21 nt, Artificial Sequence
  ELANE RNA Guide
cucuaccccgaugccuuuccc

SEQ ID NO: 28688 - RNA, 21 nt, Artificial Sequence
  ELANE RNA Guide
cugugccaccggggaaaggca

SEQ ID NO: 28689 - RNA, 21 nt, Artificial Sequence
  ELANE RNA Guide
cuuuccccgguggcacaguuu

SEQ ID NO: 28690 - RNA, 21 nt, Artificial Sequence
  ELANE RNA Guide
gaaaggcaucgggguagagcc

SEQ ID NO: 28691 - RNA, 21 nt, Artificial Sequence
  ELANE RNA Guide
gaugccuuuccccgguggcac

SEQ ID NO: 28692 - RNA, 21 nt, Artificial Sequence
  ELANE RNA Guide
gccaccggggaaaggcaucgg

SEQ ID NO: 28693 - RNA, 21 nt, Artificial Sequence
  ELANE RNA Guide
gccuuuccccgguggcacagu

SEQ ID NO: 28694 - RNA, 21 nt, Artificial Sequence
  ELANE RNA Guide
gcucuaccccgaugccuuucc

SEQ ID NO: 28695 - RNA, 21 nt, Artificial Sequence
  ELANE RNA Guide
ggaaaggcaucgggguagagc

SEQ ID NO: 28696 - RNA, 21 nt, Artificial Sequence
  ELANE RNA Guide
ggcucuaccccgaugccuuuc

SEQ ID NO: 28697 - RNA, 21 nt, Artificial Sequence
  ELANE RNA Guide
gggaaaggcaucgggguagag

SEQ ID NO: 28698 - RNA, 21 nt, Artificial Sequence
  ELANE RNA Guide
gggcucuaccccgaugccuuu

SEQ ID NO: 28699 - RNA, 21 nt, Artificial Sequence
  ELANE RNA Guide
ggggaaaggcaucgggguaga

SEQ ID NO: 28700 - RNA, 21 nt, Artificial Sequence
  ELANE RNA Guide
gugccaccggggaaaggcauc

SEQ ID NO: 28701 - RNA, 21 nt, Artificial Sequence
  ELANE RNA Guide
guuuacaaacugugccaccgg

SEQ ID NO: 28702 - RNA, 21 nt, Artificial Sequence
  ELANE RNA Guide
uacaaacugugccaccgggga

SEQ ID NO: 28703 - RNA, 21 nt, Artificial Sequence
  ELANE RNA Guide
uaccccgaugccuuuccccgg

SEQ ID NO: 28704 - RNA, 21 nt, Artificial Sequence
  ELANE RNA Guide
ucagggcucuaccccgaugcc

SEQ ID NO: 28705 - RNA, 21 nt, Artificial Sequence
  ELANE RNA Guide
ucuaccccgaugccuuucccc

SEQ ID NO: 28706 - RNA, 21 nt, Artificial Sequence
  ELANE RNA Guide
ugccaccggggaaaggcaucg

SEQ ID NO: 28707 - RNA, 21 nt, Artificial Sequence
  ELANE RNA Guide
ugccuuuccccgguggcacag

SEQ ID NO: 28708 - RNA, 21 nt, Artificial Sequence
  ELANE RNA Guide
ugugccaccggggaaaggcau

SEQ ID NO: 28709 - RNA, 21 nt, Artificial Sequence
  ELANE RNA Guide
uuacaaacugugccaccgggg

SEQ ID NO: 28710 - RNA, 21 nt, Artificial Sequence
  ELANE RNA Guide
uuccccgguggcacaguuugu

SEQ ID NO: 28711 - RNA, 21 nt, Artificial Sequence
  ELANE RNA Guide
uuuacaaacugugccaccggg

SEQ ID NO: 28712 - RNA, 21 nt, Artificial Sequence
  ELANE RNA Guide
uuuccccgguggcacaguuug

SEQ ID NO: 28713 - RNA, 22 nt, Artificial Sequence
  ELANE RNA Guide
aaacugugccaccggggaaagg

SEQ ID NO: 28714 - RNA, 22 nt, Artificial Sequence
  ELANE RNA Guide
aacugugccaccggggaaaggc

SEQ ID NO: 28715 - RNA, 22 nt, Artificial Sequence
  ELANE RNA Guide
acaaacugugccaccggggaaa

SEQ ID NO: 28716 - RNA, 22 nt, Artificial Sequence
  ELANE RNA Guide
accccgaugccuuuccccggug

SEQ ID NO: 28717 - RNA, 22 nt, Artificial Sequence
  ELANE RNA Guide
accggggaaaggcaucggggua

SEQ ID NO: 28718 - RNA, 22 nt, Artificial Sequence
  ELANE RNA Guide
acugugccaccggggaaaggca

SEQ ID NO: 28719 - RNA, 22 nt, Artificial Sequence
  ELANE RNA Guide
agggcucuaccccgaugccuuu

SEQ ID NO: 28720 - RNA, 22 nt, Artificial Sequence
  ELANE RNA Guide
aguuuacaaacugugccaccgg

SEQ ID NO: 28721 - RNA, 22 nt, Artificial Sequence
  ELANE RNA Guide
augccuuuccccgguggcacag

SEQ ID NO: 28722 - RNA, 22 nt, Artificial Sequence
  ELANE RNA Guide
caaacugugccaccggggaaag

SEQ ID NO: 28723 - RNA, 22 nt, Artificial Sequence
  ELANE RNA Guide
caccggggaaaggcaucggggu

SEQ ID NO: 28724 - RNA, 22 nt, Artificial Sequence
  ELANE RNA Guide
cagggcucuaccccgaugccuu

SEQ ID NO: 28725 - RNA, 22 nt, Artificial Sequence
  ELANE RNA Guide
caguuuacaaacugugccaccg

SEQ ID NO: 28726 - RNA, 22 nt, Artificial Sequence
  ELANE RNA Guide
ccaccggggaaaggcaucgggg

SEQ ID NO: 28727 - RNA, 22 nt, Artificial Sequence
  ELANE RNA Guide
ccccgaugccuuuccccggugg

SEQ ID NO: 28728 - RNA, 22 nt, Artificial Sequence
  ELANE RNA Guide
cccgaugccuuuccccgguggc

SEQ ID NO: 28729 - RNA, 22 nt, Artificial Sequence
  ELANE RNA Guide
ccgaugccuuuccccgguggca

SEQ ID NO: 28730 - RNA, 22 nt, Artificial Sequence
  ELANE RNA Guide
ccggggaaaggcaucgggguag

SEQ ID NO: 28731 - RNA, 22 nt, Artificial Sequence
  ELANE RNA Guide
ccuuuccccgguggcacaguuu

SEQ ID NO: 28732 - RNA, 22 nt, Artificial Sequence
  ELANE RNA Guide
cgaugccuuuccccgguggcac

SEQ ID NO: 28733 - RNA, 22 nt, Artificial Sequence
  ELANE RNA Guide
cggggaaaggcaucgggguaga

SEQ ID NO: 28734 - RNA, 22 nt, Artificial Sequence
  ELANE RNA Guide
cuaccccgaugccuuuccccgg

SEQ ID NO: 28735 - RNA, 22 nt, Artificial Sequence
  ELANE RNA Guide
cucagggcucuaccccgaugcc

SEQ ID NO: 28736 - RNA, 22 nt, Artificial Sequence
  ELANE RNA Guide
cucuaccccgaugccuuucccc

SEQ ID NO: 28737 - RNA, 22 nt, Artificial Sequence
  ELANE RNA Guide
cugugccaccggggaaaggcau

SEQ ID NO: 28738 - RNA, 22 nt, Artificial Sequence
  ELANE RNA Guide
cuuuccccgguggcacaguuug

SEQ ID NO: 28739 - RNA, 22 nt, Artificial Sequence
  ELANE RNA Guide
gaaaggcaucgggguagagccc

SEQ ID NO: 28740 - RNA, 22 nt, Artificial Sequence
  ELANE RNA Guide
gaugccuuuccccgguggcaca

SEQ ID NO: 28741 - RNA, 22 nt, Artificial Sequence
  ELANE RNA Guide
gccaccggggaaaggcaucggg

SEQ ID NO: 28742 - RNA, 22 nt, Artificial Sequence
  ELANE RNA Guide
gccuuuccccgguggcacaguu

SEQ ID NO: 28743 - RNA, 22 nt, Artificial Sequence
  ELANE RNA Guide
gcucuaccccgaugccuuuccc

SEQ ID NO: 28744 - RNA, 22 nt, Artificial Sequence
  ELANE RNA Guide
ggaaaggcaucgggguagagcc

SEQ ID NO: 28745 - RNA, 22 nt, Artificial Sequence
  ELANE RNA Guide
ggcucuaccccgaugccuuucc

SEQ ID NO: 28746 - RNA, 22 nt, Artificial Sequence
  ELANE RNA Guide
gggaaaggcaucgggguagagc

SEQ ID NO: 28747 - RNA, 22 nt, Artificial Sequence
  ELANE RNA Guide
gggcucuaccccgaugccuuuc

SEQ ID NO: 28748 - RNA, 22 nt, Artificial Sequence
  ELANE RNA Guide
ggggaaaggcaucgggguagag

SEQ ID NO: 28749 - RNA, 22 nt, Artificial Sequence
  ELANE RNA Guide
gugccaccggggaaaggcaucg

SEQ ID NO: 28750 - RNA, 22 nt, Artificial Sequence
  ELANE RNA Guide
guuuacaaacugugccaccggg

SEQ ID NO: 28751 - RNA, 22 nt, Artificial Sequence
  ELANE RNA Guide
uacaaacugugccaccggggaa

SEQ ID NO: 28752 - RNA, 22 nt, Artificial Sequence
  ELANE RNA Guide
uaccccgaugccuuuccccggu

SEQ ID NO: 28753 - RNA, 22 nt, Artificial Sequence
  ELANE RNA Guide
ucagggcucuaccccgaugccu

SEQ ID NO: 28754 - RNA, 22 nt, Artificial Sequence
  ELANE RNA Guide
ucuaccccgaugccuuuccccg

SEQ ID NO: 28755 - RNA, 22 nt, Artificial Sequence
  ELANE RNA Guide
ugccaccggggaaaggcaucgg

SEQ ID NO: 28756 - RNA, 22 nt, Artificial Sequence
  ELANE RNA Guide
ugccuuuccccgguggcacagu

SEQ ID NO: 28757 - RNA, 22 nt, Artificial Sequence
  ELANE RNA Guide
ugugccaccggggaaaggcauc

SEQ ID NO: 28758 - RNA, 22 nt, Artificial Sequence
  ELANE RNA Guide
uuacaaacugugccaccgggga

SEQ ID NO: 28759 - RNA, 22 nt, Artificial Sequence
  ELANE RNA Guide
uuccccgguggcacaguuugua

SEQ ID NO: 28760 - RNA, 22 nt, Artificial Sequence
  ELANE RNA Guide
uuuacaaacugugccaccgggg

SEQ ID NO: 28761 - RNA, 22 nt, Artificial Sequence
  ELANE RNA Guide
uuuccccgguggcacaguuugu

SEQ ID NO: 28762 - RNA, 20 nt, Artificial Sequence
  ELANE RNA Guide
accccgaugccuuucccccc

SEQ ID NO: 28763 - RNA, 20 nt, Artificial Sequence
  ELANE RNA Guide
gggggaaaggcaucggggua

SEQ ID NO: 28764 - RNA, 20 nt, Artificial Sequence
  ELANE RNA Guide
ggggggaaaggcaucggggu

SEQ ID NO: 28765 - RNA, 20 nt, Artificial Sequence
  ELANE RNA Guide
uaccccgaugccuuuccccc

SEQ ID NO: 28766 - RNA, 21 nt, Artificial Sequence
  ELANE RNA Guide
cuaccccgaugccuuuccccc

SEQ ID NO: 28767 - RNA, 21 nt, Artificial Sequence
  ELANE RNA Guide
gggggaaaggcaucgggguag

SEQ ID NO: 28768 - RNA, 21 nt, Artificial Sequence
  ELANE RNA Guide
ggggggaaaggcaucggggua

SEQ ID NO: 28769 - RNA, 21 nt, Artificial Sequence
  ELANE RNA Guide
uaccccgaugccuuucccccc

SEQ ID NO: 28770 - RNA, 22 nt, Artificial Sequence
  ELANE RNA Guide
cuaccccgaugccuuucccccc

SEQ ID NO: 28771 - RNA, 22 nt, Artificial Sequence
  ELANE RNA Guide
gggggaaaggcaucgggguaga

SEQ ID NO: 28772 - RNA, 22 nt, Artificial Sequence
  ELANE RNA Guide
ggggggaaaggcaucgggguag

SEQ ID NO: 28773 - RNA, 22 nt, Artificial Sequence
  ELANE RNA Guide
ucuaccccgaugccuuuccccc

SEQ ID NO: 28774 - RNA, 20 nt, Artificial Sequence
  ELANE RNA Guide
aaacugugccaccgggcaaa

SEQ ID NO: 28775 - RNA, 20 nt, Artificial Sequence
  ELANE RNA Guide
aacugugccaccgggcaaag

SEQ ID NO: 28776 - RNA, 20 nt, Artificial Sequence
  ELANE RNA Guide
acaaacugugccaccgggca

SEQ ID NO: 28777 - RNA, 20 nt, Artificial Sequence
  ELANE RNA Guide
accccgaugccuuugcccgg

SEQ ID NO: 28778 - RNA, 20 nt, Artificial Sequence
  ELANE RNA Guide
accgggcaaaggcaucgggg

SEQ ID NO: 28779 - RNA, 20 nt, Artificial Sequence
  ELANE RNA Guide
acugugccaccgggcaaagg

SEQ ID NO: 28780 - RNA, 20 nt, Artificial Sequence
  ELANE RNA Guide
aguuuacaaacugugccacc

SEQ ID NO: 28781 - RNA, 20 nt, Artificial Sequence
  ELANE RNA Guide
augccuuugcccgguggcac

SEQ ID NO: 28782 - RNA, 20 nt, Artificial Sequence
  ELANE RNA Guide
caaacugugccaccgggcaa

SEQ ID NO: 28783 - RNA, 20 nt, Artificial Sequence
  ELANE RNA Guide
caccgggcaaaggcaucggg

SEQ ID NO: 28784 - RNA, 20 nt, Artificial Sequence
  ELANE RNA Guide
ccaccgggcaaaggcaucgg

SEQ ID NO: 28785 - RNA, 20 nt, Artificial Sequence
  ELANE RNA Guide
ccccgaugccuuugcccggu

SEQ ID NO: 28786 - RNA, 20 nt, Artificial Sequence
  ELANE RNA Guide
cccgaugccuuugcccggug

SEQ ID NO: 28787 - RNA, 20 nt, Artificial Sequence
  ELANE RNA Guide
ccgaugccuuugcccggugg

SEQ ID NO: 28788 - RNA, 20 nt, Artificial Sequence
  ELANE RNA Guide
ccgggcaaaggcaucggggu

SEQ ID NO: 28789 - RNA, 20 nt, Artificial Sequence
  ELANE RNA Guide
ccuuugcccgguggcacagu

SEQ ID NO: 28790 - RNA, 20 nt, Artificial Sequence
  ELANE RNA Guide
cgaugccuuugcccgguggc

SEQ ID NO: 28791 - RNA, 20 nt, Artificial Sequence
  ELANE RNA Guide
cgggcaaaggcaucggggua

SEQ ID NO: 28792 - RNA, 20 nt, Artificial Sequence
  ELANE RNA Guide
cuaccccgaugccuuugccc

SEQ ID NO: 28793 - RNA, 20 nt, Artificial Sequence
  ELANE RNA Guide
cucuaccccgaugccuuugc

SEQ ID NO: 28794 - RNA, 20 nt, Artificial Sequence
  ELANE RNA Guide
cugugccaccgggcaaaggc

SEQ ID NO: 28795 - RNA, 20 nt, Artificial Sequence
  ELANE RNA Guide
cuuugcccgguggcacaguu

SEQ ID NO: 28796 - RNA, 20 nt, Artificial Sequence
  ELANE RNA Guide
gaugccuuugcccgguggca

SEQ ID NO: 28797 - RNA, 20 nt, Artificial Sequence
  ELANE RNA Guide
gccaccgggcaaaggcaucg

SEQ ID NO: 28798 - RNA, 20 nt, Artificial Sequence
  ELANE RNA Guide
gccuuugcccgguggcacag

SEQ ID NO: 28799 - RNA, 20 nt, Artificial Sequence
  ELANE RNA Guide
gcucuaccccgaugccuuug

SEQ ID NO: 28800 - RNA, 20 nt, Artificial Sequence
  ELANE RNA Guide
gugccaccgggcaaaggcau

SEQ ID NO: 28801 - RNA, 20 nt, Artificial Sequence
  ELANE RNA Guide
uacaaacugugccaccgggc

SEQ ID NO: 28802 - RNA, 20 nt, Artificial Sequence
  ELANE RNA Guide
uaccccgaugccuuugcccg

SEQ ID NO: 28803 - RNA, 20 nt, Artificial Sequence
  ELANE RNA Guide
ucuaccccgaugccuuugcc

SEQ ID NO: 28804 - RNA, 20 nt, Artificial Sequence
  ELANE RNA Guide
ugccaccgggcaaaggcauc

SEQ ID NO: 28805 - RNA, 20 nt, Artificial Sequence
  ELANE RNA Guide
ugcccgguggcacaguuugu

SEQ ID NO: 28806 - RNA, 20 nt, Artificial Sequence
  ELANE RNA Guide
ugccuuugcccgguggcaca

SEQ ID NO: 28807 - RNA, 20 nt, Artificial Sequence
  ELANE RNA Guide
ugugccaccgggcaaaggca

SEQ ID NO: 28808 - RNA, 20 nt, Artificial Sequence
  ELANE RNA Guide
uugcccgguggcacaguuug

SEQ ID NO: 28809 - RNA, 20 nt, Artificial Sequence
  ELANE RNA Guide
uuugcccgguggcacaguuu

SEQ ID NO: 28810 - RNA, 21 nt, Artificial Sequence
  ELANE RNA Guide
aaacugugccaccgggcaaag

SEQ ID NO: 28811 - RNA, 21 nt, Artificial Sequence
  ELANE RNA Guide
aacugugccaccgggcaaagg

SEQ ID NO: 28812 - RNA, 21 nt, Artificial Sequence
  ELANE RNA Guide
acaaacugugccaccgggcaa

SEQ ID NO: 28813 - RNA, 21 nt, Artificial Sequence
  ELANE RNA Guide
accccgaugccuuugcccggu

SEQ ID NO: 28814 - RNA, 21 nt, Artificial Sequence
  ELANE RNA Guide
accgggcaaaggcaucggggu

SEQ ID NO: 28815 - RNA, 21 nt, Artificial Sequence
  ELANE RNA Guide
acugugccaccgggcaaaggc

SEQ ID NO: 28816 - RNA, 21 nt, Artificial Sequence
  ELANE RNA Guide
augccuuugcccgguggcaca

SEQ ID NO: 28817 - RNA, 21 nt, Artificial Sequence
  ELANE RNA Guide
caaacugugccaccgggcaaa

SEQ ID NO: 28818 - RNA, 21 nt, Artificial Sequence
  ELANE RNA Guide
caccgggcaaaggcaucgggg

SEQ ID NO: 28819 - RNA, 21 nt, Artificial Sequence
  ELANE RNA Guide
caguuuacaaacugugccacc

SEQ ID NO: 28820 - RNA, 21 nt, Artificial Sequence
  ELANE RNA Guide
ccaccgggcaaaggcaucggg

SEQ ID NO: 28821 - RNA, 21 nt, Artificial Sequence
  ELANE RNA Guide
ccccgaugccuuugcccggug

SEQ ID NO: 28822 - RNA, 21 nt, Artificial Sequence
  ELANE RNA Guide
cccgaugccuuugcccggugg

SEQ ID NO: 28823 - RNA, 21 nt, Artificial Sequence
  ELANE RNA Guide
ccgaugccuuugcccgguggc

SEQ ID NO: 28824 - RNA, 21 nt, Artificial Sequence
  ELANE RNA Guide
ccgggcaaaggcaucggggua

SEQ ID NO: 28825 - RNA, 21 nt, Artificial Sequence
  ELANE RNA Guide
ccuuugcccgguggcacaguu

SEQ ID NO: 28826 - RNA, 21 nt, Artificial Sequence
  ELANE RNA Guide
cgaugccuuugcccgguggca

SEQ ID NO: 28827 - RNA, 21 nt, Artificial Sequence
  ELANE RNA Guide
cgggcaaaggcaucgggguag

SEQ ID NO: 28828 - RNA, 21 nt, Artificial Sequence
  ELANE RNA Guide
cuaccccgaugccuuugcccg

SEQ ID NO: 28829 - RNA, 21 nt, Artificial Sequence
  ELANE RNA Guide
cucuaccccgaugccuuugcc

SEQ ID NO: 28830 - RNA, 21 nt, Artificial Sequence
  ELANE RNA Guide
cugugccaccgggcaaaggca

SEQ ID NO: 28831 - RNA, 21 nt, Artificial Sequence
  ELANE RNA Guide
cuuugcccgguggcacaguuu

SEQ ID NO: 28832 - RNA, 21 nt, Artificial Sequence
  ELANE RNA Guide
gaugccuuugcccgguggcac

SEQ ID NO: 28833 - RNA, 21 nt, Artificial Sequence
  ELANE RNA Guide
gccaccgggcaaaggcaucgg

SEQ ID NO: 28834 - RNA, 21 nt, Artificial Sequence
  ELANE RNA Guide
gccuuugcccgguggcacagu

SEQ ID NO: 28835 - RNA, 21 nt, Artificial Sequence
  ELANE RNA Guide
gcucuaccccgaugccuuugc

SEQ ID NO: 28836 - RNA, 21 nt, Artificial Sequence
  ELANE RNA Guide
ggcucuaccccgaugccuuug

SEQ ID NO: 28837 - RNA, 21 nt, Artificial Sequence
  ELANE RNA Guide
gugccaccgggcaaaggcauc

SEQ ID NO: 28838 - RNA, 21 nt, Artificial Sequence
  ELANE RNA Guide
uacaaacugugccaccgggca

SEQ ID NO: 28839 - RNA, 21 nt, Artificial Sequence
  ELANE RNA Guide
uaccccgaugccuuugcccgg

SEQ ID NO: 28840 - RNA, 21 nt, Artificial Sequence
  ELANE RNA Guide
ucuaccccgaugccuuugccc

SEQ ID NO: 28841 - RNA, 21 nt, Artificial Sequence
  ELANE RNA Guide
ugccaccgggcaaaggcaucg

SEQ ID NO: 28842 - RNA, 21 nt, Artificial Sequence
  ELANE RNA Guide
ugcccgguggcacaguuugua

SEQ ID NO: 28843 - RNA, 21 nt, Artificial Sequence
  ELANE RNA Guide
ugccuuugcccgguggcacag

SEQ ID NO: 28844 - RNA, 21 nt, Artificial Sequence
  ELANE RNA Guide
ugugccaccgggcaaaggcau

SEQ ID NO: 28845 - RNA, 21 nt, Artificial Sequence
  ELANE RNA Guide
uuacaaacugugccaccgggc

SEQ ID NO: 28846 - RNA, 21 nt, Artificial Sequence
  ELANE RNA Guide
uugcccgguggcacaguuugu

SEQ ID NO: 28847 - RNA, 21 nt, Artificial Sequence
  ELANE RNA Guide
uuugcccgguggcacaguuug

SEQ ID NO: 28848 - RNA, 22 nt, Artificial Sequence
  ELANE RNA Guide
aaacugugccaccgggcaaagg

SEQ ID NO: 28849 - RNA, 22 nt, Artificial Sequence
  ELANE RNA Guide
aacugugccaccgggcaaaggc

SEQ ID NO: 28850 - RNA, 22 nt, Artificial Sequence
  ELANE RNA Guide
acaaacugugccaccgggcaaa

SEQ ID NO: 28851 - RNA, 22 nt, Artificial Sequence
  ELANE RNA Guide
accccgaugccuuugcccggug

SEQ ID NO: 28852 - RNA, 22 nt, Artificial Sequence
  ELANE RNA Guide
accgggcaaaggcaucggggua

SEQ ID NO: 28853 - RNA, 22 nt, Artificial Sequence
  ELANE RNA Guide
acugugccaccgggcaaaggca

SEQ ID NO: 28854 - RNA, 22 nt, Artificial Sequence
  ELANE RNA Guide
augccuuugcccgguggcacag

SEQ ID NO: 28855 - RNA, 22 nt, Artificial Sequence
  ELANE RNA Guide
caaacugugccaccgggcaaag

SEQ ID NO: 28856 - RNA, 22 nt, Artificial Sequence
  ELANE RNA Guide
caccgggcaaaggcaucggggu

SEQ ID NO: 28857 - RNA, 22 nt, Artificial Sequence
  ELANE RNA Guide
ccaccgggcaaaggcaucgggg

SEQ ID NO: 28858 - RNA, 22 nt, Artificial Sequence
  ELANE RNA Guide
ccaguuuacaaacugugccacc

SEQ ID NO: 28859 - RNA, 22 nt, Artificial Sequence
  ELANE RNA Guide
ccccgaugccuuugcccggugg

SEQ ID NO: 28860 - RNA, 22 nt, Artificial Sequence
  ELANE RNA Guide
cccgaugccuuugcccgguggc

SEQ ID NO: 28861 - RNA, 22 nt, Artificial Sequence
  ELANE RNA Guide
ccgaugccuuugcccgguggca

SEQ ID NO: 28862 - RNA, 22 nt, Artificial Sequence
  ELANE RNA Guide
ccgggcaaaggcaucgggguag

SEQ ID NO: 28863 - RNA, 22 nt, Artificial Sequence
  ELANE RNA Guide
ccuuugcccgguggcacaguuu

SEQ ID NO: 28864 - RNA, 22 nt, Artificial Sequence
  ELANE RNA Guide
cgaugccuuugcccgguggcac

SEQ ID NO: 28865 - RNA, 22 nt, Artificial Sequence
  ELANE RNA Guide
cgggcaaaggcaucgggguaga

SEQ ID NO: 28866 - RNA, 22 nt, Artificial Sequence
  ELANE RNA Guide
cuaccccgaugccuuugcccgg

SEQ ID NO: 28867 - RNA, 22 nt, Artificial Sequence
  ELANE RNA Guide
cucuaccccgaugccuuugccc

SEQ ID NO: 28868 - RNA, 22 nt, Artificial Sequence
  ELANE RNA Guide
cugugccaccgggcaaaggcau

SEQ ID NO: 28869 - RNA, 22 nt, Artificial Sequence
  ELANE RNA Guide
cuuugcccgguggcacaguuug

SEQ ID NO: 28870 - RNA, 22 nt, Artificial Sequence
  ELANE RNA Guide
gaugccuuugcccgguggcaca

SEQ ID NO: 28871 - RNA, 22 nt, Artificial Sequence
  ELANE RNA Guide
gccaccgggcaaaggcaucggg

SEQ ID NO: 28872 - RNA, 22 nt, Artificial Sequence
  ELANE RNA Guide
gccuuugcccgguggcacaguu

SEQ ID NO: 28873 - RNA, 22 nt, Artificial Sequence
  ELANE RNA Guide
gcucuaccccgaugccuuugcc

SEQ ID NO: 28874 - RNA, 22 nt, Artificial Sequence
  ELANE RNA Guide
ggcucuaccccgaugccuuugc

SEQ ID NO: 28875 - RNA, 22 nt, Artificial Sequence
  ELANE RNA Guide
gggcucuaccccgaugccuuug

SEQ ID NO: 28876 - RNA, 22 nt, Artificial Sequence
  ELANE RNA Guide
gugccaccgggcaaaggcaucg

SEQ ID NO: 28877 - RNA, 22 nt, Artificial Sequence
  ELANE RNA Guide
uacaaacugugccaccgggcaa

SEQ ID NO: 28878 - RNA, 22 nt, Artificial Sequence
  ELANE RNA Guide
uaccccgaugccuuugcccggu

SEQ ID NO: 28879 - RNA, 22 nt, Artificial Sequence
  ELANE RNA Guide
ucuaccccgaugccuuugcccg

SEQ ID NO: 28880 - RNA, 22 nt, Artificial Sequence
  ELANE RNA Guide
ugccaccgggcaaaggcaucgg

SEQ ID NO: 28881 - RNA, 22 nt, Artificial Sequence
  ELANE RNA Guide
ugcccgguggcacaguuuguaa

SEQ ID NO: 28882 - RNA, 22 nt, Artificial Sequence
  ELANE RNA Guide
ugccuuugcccgguggcacagu

SEQ ID NO: 28883 - RNA, 22 nt, Artificial Sequence
  ELANE RNA Guide
ugugccaccgggcaaaggcauc

SEQ ID NO: 28884 - RNA, 22 nt, Artificial Sequence
  ELANE RNA Guide
uuacaaacugugccaccgggca

SEQ ID NO: 28885 - RNA, 22 nt, Artificial Sequence
  ELANE RNA Guide
uugcccgguggcacaguuugua

SEQ ID NO: 28886 - RNA, 22 nt, Artificial Sequence
  ELANE RNA Guide
uuuacaaacugugccaccgggc

SEQ ID NO: 28887 - RNA, 22 nt, Artificial Sequence
  ELANE RNA Guide
uuugcccgguggcacaguuugu

SEQ ID NO: 28888 - RNA, 20 nt, Artificial Sequence
  ELANE RNA Guide
aaacugugccaccgggggaa

SEQ ID NO: 28889 - RNA, 20 nt, Artificial Sequence
  ELANE RNA Guide
aacugugccaccgggggaaa

SEQ ID NO: 28890 - RNA, 20 nt, Artificial Sequence
  ELANE RNA Guide
acaaacugugccaccggggg

SEQ ID NO: 28891 - RNA, 20 nt, Artificial Sequence
  ELANE RNA Guide
accccgaugccuuucccccg

SEQ ID NO: 28892 - RNA, 20 nt, Artificial Sequence
  ELANE RNA Guide
accgggggaaaggcaucggg

SEQ ID NO: 28893 - RNA, 20 nt, Artificial Sequence
  ELANE RNA Guide
acugugccaccgggggaaag

SEQ ID NO: 28894 - RNA, 20 nt, Artificial Sequence
  ELANE RNA Guide
augccuuucccccgguggca

SEQ ID NO: 28895 - RNA, 20 nt, Artificial Sequence
  ELANE RNA Guide
caaacugugccaccggggga

SEQ ID NO: 28896 - RNA, 20 nt, Artificial Sequence
  ELANE RNA Guide
caccgggggaaaggcaucgg

SEQ ID NO: 28897 - RNA, 20 nt, Artificial Sequence
  ELANE RNA Guide
ccaccgggggaaaggcaucg

SEQ ID NO: 28898 - RNA, 20 nt, Artificial Sequence
  ELANE RNA Guide
ccccgaugccuuucccccgg

SEQ ID NO: 28899 - RNA, 20 nt, Artificial Sequence
  ELANE RNA Guide
cccgaugccuuucccccggu

SEQ ID NO: 28900 - RNA, 20 nt, Artificial Sequence
  ELANE RNA Guide
ccgaugccuuucccccggug

SEQ ID NO: 28901 - RNA, 20 nt, Artificial Sequence
  ELANE RNA Guide
ccgggggaaaggcaucgggg

SEQ ID NO: 28902 - RNA, 20 nt, Artificial Sequence
  ELANE RNA Guide
ccuuucccccgguggcacag

SEQ ID NO: 28903 - RNA, 20 nt, Artificial Sequence
  ELANE RNA Guide
cgaugccuuucccccggugg

SEQ ID NO: 28904 - RNA, 20 nt, Artificial Sequence
  ELANE RNA Guide
cgggggaaaggcaucggggu

SEQ ID NO: 28905 - RNA, 20 nt, Artificial Sequence
  ELANE RNA Guide
cugugccaccgggggaaagg

SEQ ID NO: 28906 - RNA, 20 nt, Artificial Sequence
  ELANE RNA Guide
cuuucccccgguggcacagu

SEQ ID NO: 28907 - RNA, 20 nt, Artificial Sequence
  ELANE RNA Guide
gaugccuuucccccgguggc

SEQ ID NO: 28908 - RNA, 20 nt, Artificial Sequence
  ELANE RNA Guide
gccaccgggggaaaggcauc

SEQ ID NO: 28909 - RNA, 20 nt, Artificial Sequence
  ELANE RNA Guide
gccuuucccccgguggcaca

SEQ ID NO: 28910 - RNA, 20 nt, Artificial Sequence
  ELANE RNA Guide
gugccaccgggggaaaggca

SEQ ID NO: 28911 - RNA, 20 nt, Artificial Sequence
  ELANE RNA Guide
ucccccgguggcacaguuug

SEQ ID NO: 28912 - RNA, 20 nt, Artificial Sequence
  ELANE RNA Guide
ugccaccgggggaaaggcau

SEQ ID NO: 28913 - RNA, 20 nt, Artificial Sequence
  ELANE RNA Guide
ugccuuucccccgguggcac

SEQ ID NO: 28914 - RNA, 20 nt, Artificial Sequence
  ELANE RNA Guide
ugugccaccgggggaaaggc

SEQ ID NO: 28915 - RNA, 20 nt, Artificial Sequence
  ELANE RNA Guide
uucccccgguggcacaguuu

SEQ ID NO: 28916 - RNA, 20 nt, Artificial Sequence
  ELANE RNA Guide
uuucccccgguggcacaguu

SEQ ID NO: 28917 - RNA, 21 nt, Artificial Sequence
  ELANE RNA Guide
aaacugugccaccgggggaaa

SEQ ID NO: 28918 - RNA, 21 nt, Artificial Sequence
  ELANE RNA Guide
aacugugccaccgggggaaag

SEQ ID NO: 28919 - RNA, 21 nt, Artificial Sequence
  ELANE RNA Guide
acaaacugugccaccggggga

SEQ ID NO: 28920 - RNA, 21 nt, Artificial Sequence
  ELANE RNA Guide
accccgaugccuuucccccgg

SEQ ID NO: 28921 - RNA, 21 nt, Artificial Sequence
  ELANE RNA Guide
accgggggaaaggcaucgggg

SEQ ID NO: 28922 - RNA, 21 nt, Artificial Sequence
  ELANE RNA Guide
acugugccaccgggggaaagg

SEQ ID NO: 28923 - RNA, 21 nt, Artificial Sequence
  ELANE RNA Guide
augccuuucccccgguggcac

SEQ ID NO: 28924 - RNA, 21 nt, Artificial Sequence
  ELANE RNA Guide
caaacugugccaccgggggaa

SEQ ID NO: 28925 - RNA, 21 nt, Artificial Sequence
  ELANE RNA Guide
caccgggggaaaggcaucggg

SEQ ID NO: 28926 - RNA, 21 nt, Artificial Sequence
  ELANE RNA Guide
ccaccgggggaaaggcaucgg

SEQ ID NO: 28927 - RNA, 21 nt, Artificial Sequence
  ELANE RNA Guide
ccccgaugccuuucccccggu

SEQ ID NO: 28928 - RNA, 21 nt, Artificial Sequence
  ELANE RNA Guide
cccgaugccuuucccccggug

SEQ ID NO: 28929 - RNA, 21 nt, Artificial Sequence
  ELANE RNA Guide
ccgaugccuuucccccggugg

SEQ ID NO: 28930 - RNA, 21 nt, Artificial Sequence
  ELANE RNA Guide
ccgggggaaaggcaucggggu

SEQ ID NO: 28931 - RNA, 21 nt, Artificial Sequence
  ELANE RNA Guide
ccuuucccccgguggcacagu

SEQ ID NO: 28932 - RNA, 21 nt, Artificial Sequence
  ELANE RNA Guide
cgaugccuuucccccgguggc

SEQ ID NO: 28933 - RNA, 21 nt, Artificial Sequence
  ELANE RNA Guide
cgggggaaaggcaucggggua

SEQ ID NO: 28934 - RNA, 21 nt, Artificial Sequence
  ELANE RNA Guide
cugugccaccgggggaaaggc

SEQ ID NO: 28935 - RNA, 21 nt, Artificial Sequence
  ELANE RNA Guide
cuuucccccgguggcacaguu

SEQ ID NO: 28936 - RNA, 21 nt, Artificial Sequence
  ELANE RNA Guide
gaugccuuucccccgguggca

SEQ ID NO: 28937 - RNA, 21 nt, Artificial Sequence
  ELANE RNA Guide
gccaccgggggaaaggcaucg

SEQ ID NO: 28938 - RNA, 21 nt, Artificial Sequence
  ELANE RNA Guide
gccuuucccccgguggcacag

SEQ ID NO: 28939 - RNA, 21 nt, Artificial Sequence
  ELANE RNA Guide
gugccaccgggggaaaggcau

SEQ ID NO: 28940 - RNA, 21 nt, Artificial Sequence
  ELANE RNA Guide
uacaaacugugccaccggggg

SEQ ID NO: 28941 - RNA, 21 nt, Artificial Sequence
  ELANE RNA Guide
uaccccgaugccuuucccccg

SEQ ID NO: 28942 - RNA, 21 nt, Artificial Sequence
  ELANE RNA Guide
ucccccgguggcacaguuugu

SEQ ID NO: 28943 - RNA, 21 nt, Artificial Sequence
  ELANE RNA Guide
ugccaccgggggaaaggcauc

SEQ ID NO: 28944 - RNA, 21 nt, Artificial Sequence
  ELANE RNA Guide
ugccuuucccccgguggcaca

SEQ ID NO: 28945 - RNA, 21 nt, Artificial Sequence
  ELANE RNA Guide
ugugccaccgggggaaaggca

SEQ ID NO: 28946 - RNA, 21 nt, Artificial Sequence
  ELANE RNA Guide
uucccccgguggcacaguuug

SEQ ID NO: 28947 - RNA, 21 nt, Artificial Sequence
  ELANE RNA Guide
uuucccccgguggcacaguuu

SEQ ID NO: 28948 - RNA, 22 nt, Artificial Sequence
  ELANE RNA Guide
aaacugugccaccgggggaaag

SEQ ID NO: 28949 - RNA, 22 nt, Artificial Sequence
  ELANE RNA Guide
aacugugccaccgggggaaagg

SEQ ID NO: 28950 - RNA, 22 nt, Artificial Sequence
  ELANE RNA Guide
acaaacugugccaccgggggaa

SEQ ID NO: 28951 - RNA, 22 nt, Artificial Sequence
  ELANE RNA Guide
accccgaugccuuucccccggu

SEQ ID NO: 28952 - RNA, 22 nt, Artificial Sequence
  ELANE RNA Guide
accgggggaaaggcaucggggu

SEQ ID NO: 28953 - RNA, 22 nt, Artificial Sequence
  ELANE RNA Guide
acugugccaccgggggaaaggc

SEQ ID NO: 28954 - RNA, 22 nt, Artificial Sequence
  ELANE RNA Guide
augccuuucccccgguggcaca

SEQ ID NO: 28955 - RNA, 22 nt, Artificial Sequence
  ELANE RNA Guide
caaacugugccaccgggggaaa

SEQ ID NO: 28956 - RNA, 22 nt, Artificial Sequence
  ELANE RNA Guide
caccgggggaaaggcaucgggg

SEQ ID NO: 28957 - RNA, 22 nt, Artificial Sequence
  ELANE RNA Guide
ccaccgggggaaaggcaucggg

SEQ ID NO: 28958 - RNA, 22 nt, Artificial Sequence
  ELANE RNA Guide
ccccgaugccuuucccccggug

SEQ ID NO: 28959 - RNA, 22 nt, Artificial Sequence
  ELANE RNA Guide
cccgaugccuuucccccggugg

SEQ ID NO: 28960 - RNA, 22 nt, Artificial Sequence
  ELANE RNA Guide
ccgaugccuuucccccgguggc

SEQ ID NO: 28961 - RNA, 22 nt, Artificial Sequence
  ELANE RNA Guide
ccgggggaaaggcaucggggua

SEQ ID NO: 28962 - RNA, 22 nt, Artificial Sequence
  ELANE RNA Guide
ccuuucccccgguggcacaguu

SEQ ID NO: 28963 - RNA, 22 nt, Artificial Sequence
  ELANE RNA Guide
cgaugccuuucccccgguggca

SEQ ID NO: 28964 - RNA, 22 nt, Artificial Sequence
  ELANE RNA Guide
cgggggaaaggcaucgggguag

SEQ ID NO: 28965 - RNA, 22 nt, Artificial Sequence
  ELANE RNA Guide
cuaccccgaugccuuucccccg

SEQ ID NO: 28966 - RNA, 22 nt, Artificial Sequence
  ELANE RNA Guide
cugugccaccgggggaaaggca

SEQ ID NO: 28967 - RNA, 22 nt, Artificial Sequence
  ELANE RNA Guide
cuuucccccgguggcacaguuu

SEQ ID NO: 28968 - RNA, 22 nt, Artificial Sequence
  ELANE RNA Guide
gaugccuuucccccgguggcac

SEQ ID NO: 28969 - RNA, 22 nt, Artificial Sequence
  ELANE RNA Guide
gccaccgggggaaaggcaucgg

SEQ ID NO: 28970 - RNA, 22 nt, Artificial Sequence
  ELANE RNA Guide
gccuuucccccgguggcacagu

SEQ ID NO: 28971 - RNA, 22 nt, Artificial Sequence
  ELANE RNA Guide
gugccaccgggggaaaggcauc

SEQ ID NO: 28972 - RNA, 22 nt, Artificial Sequence
  ELANE RNA Guide
uacaaacugugccaccggggga

SEQ ID NO: 28973 - RNA, 22 nt, Artificial Sequence
  ELANE RNA Guide
uaccccgaugccuuucccccgg

SEQ ID NO: 28974 - RNA, 22 nt, Artificial Sequence
  ELANE RNA Guide
ucccccgguggcacaguuugua

SEQ ID NO: 28975 - RNA, 22 nt, Artificial Sequence
  ELANE RNA Guide
ugccaccgggggaaaggcaucg

SEQ ID NO: 28976 - RNA, 22 nt, Artificial Sequence
  ELANE RNA Guide
ugccuuucccccgguggcacag

SEQ ID NO: 28977 - RNA, 22 nt, Artificial Sequence
  ELANE RNA Guide
ugugccaccgggggaaaggcau

SEQ ID NO: 28978 - RNA, 22 nt, Artificial Sequence
  ELANE RNA Guide
uuacaaacugugccaccggggg

SEQ ID NO: 28979 - RNA, 22 nt, Artificial Sequence
  ELANE RNA Guide
uucccccgguggcacaguuugu

SEQ ID NO: 28980 - RNA, 22 nt, Artificial Sequence
  ELANE RNA Guide
uuucccccgguggcacaguuug

SEQ ID NO: 28981 - RNA, 20 nt, Artificial Sequence
  ELANE RNA Guide
aaacugugccacggggcaaa

SEQ ID NO: 28982 - RNA, 20 nt, Artificial Sequence
  ELANE RNA Guide
aacugugccacggggcaaag

SEQ ID NO: 28983 - RNA, 20 nt, Artificial Sequence
  ELANE RNA Guide
acaaacugugccacggggca

SEQ ID NO: 28984 - RNA, 20 nt, Artificial Sequence
  ELANE RNA Guide
accccgaugccuuugccccg

SEQ ID NO: 28985 - RNA, 20 nt, Artificial Sequence
  ELANE RNA Guide
acggggcaaaggcaucgggg

SEQ ID NO: 28986 - RNA, 20 nt, Artificial Sequence
  ELANE RNA Guide
acugugccacggggcaaagg

SEQ ID NO: 28987 - RNA, 20 nt, Artificial Sequence
  ELANE RNA Guide
aguuuacaaacugugccacg

SEQ ID NO: 28988 - RNA, 20 nt, Artificial Sequence
  ELANE RNA Guide
auccaguuuacaaacugugc

SEQ ID NO: 28989 - RNA, 20 nt, Artificial Sequence
  ELANE RNA Guide
augccuuugccccguggcac

SEQ ID NO: 28990 - RNA, 20 nt, Artificial Sequence
  ELANE RNA Guide
caaacugugccacggggcaa

SEQ ID NO: 28991 - RNA, 20 nt, Artificial Sequence
  ELANE RNA Guide
cacggggcaaaggcaucggg

SEQ ID NO: 28992 - RNA, 20 nt, Artificial Sequence
  ELANE RNA Guide
caguuuacaaacugugccac

SEQ ID NO: 28993 - RNA, 20 nt, Artificial Sequence
  ELANE RNA Guide
ccacggggcaaaggcaucgg

SEQ ID NO: 28994 - RNA, 20 nt, Artificial Sequence
  ELANE RNA Guide
ccaguuuacaaacugugcca

SEQ ID NO: 28995 - RNA, 20 nt, Artificial Sequence
  ELANE RNA Guide
ccccgaugccuuugccccgu

SEQ ID NO: 28996 - RNA, 20 nt, Artificial Sequence
  ELANE RNA Guide
ccccguggcacaguuuguaa

SEQ ID NO: 28997 - RNA, 20 nt, Artificial Sequence
  ELANE RNA Guide
cccgaugccuuugccccgug

SEQ ID NO: 28998 - RNA, 20 nt, Artificial Sequence
  ELANE RNA Guide
cccguggcacaguuuguaaa

SEQ ID NO: 28999 - RNA, 20 nt, Artificial Sequence
  ELANE RNA Guide
ccgaugccuuugccccgugg

SEQ ID NO: 29000 - RNA, 20 nt, Artificial Sequence
  ELANE RNA Guide
ccguggcacaguuuguaaac

SEQ ID NO: 29001 - RNA, 20 nt, Artificial Sequence
  ELANE RNA Guide
ccuuugccccguggcacagu

SEQ ID NO: 29002 - RNA, 20 nt, Artificial Sequence
  ELANE RNA Guide
cgaugccuuugccccguggc

SEQ ID NO: 29003 - RNA, 20 nt, Artificial Sequence
  ELANE RNA Guide
cugugccacggggcaaaggc

SEQ ID NO: 29004 - RNA, 20 nt, Artificial Sequence
  ELANE RNA Guide
cuuugccccguggcacaguu

SEQ ID NO: 29005 - RNA, 20 nt, Artificial Sequence
  ELANE RNA Guide
gaugccuuugccccguggca

SEQ ID NO: 29006 - RNA, 20 nt, Artificial Sequence
  ELANE RNA Guide
gccacggggcaaaggcaucg

SEQ ID NO: 29007 - RNA, 20 nt, Artificial Sequence
  ELANE RNA Guide
gccccguggcacaguuugua

SEQ ID NO: 29008 - RNA, 20 nt, Artificial Sequence
  ELANE RNA Guide
gccuuugccccguggcacag

SEQ ID NO: 29009 - RNA, 20 nt, Artificial Sequence
  ELANE RNA Guide
gugccacggggcaaaggcau

SEQ ID NO: 29010 - RNA, 20 nt, Artificial Sequence
  ELANE RNA Guide
guuuacaaacugugccacgg

SEQ ID NO: 29011 - RNA, 20 nt, Artificial Sequence
  ELANE RNA Guide
uacaaacugugccacggggc

SEQ ID NO: 29012 - RNA, 20 nt, Artificial Sequence
  ELANE RNA Guide
uaccccgaugccuuugcccc

SEQ ID NO: 29013 - RNA, 20 nt, Artificial Sequence
  ELANE RNA Guide
uccaguuuacaaacugugcc

SEQ ID NO: 29014 - RNA, 20 nt, Artificial Sequence
  ELANE RNA Guide
ugccacggggcaaaggcauc

SEQ ID NO: 29015 - RNA, 20 nt, Artificial Sequence
  ELANE RNA Guide
ugccccguggcacaguuugu

SEQ ID NO: 29016 - RNA, 20 nt, Artificial Sequence
  ELANE RNA Guide
ugccuuugccccguggcaca

SEQ ID NO: 29017 - RNA, 20 nt, Artificial Sequence
  ELANE RNA Guide
ugugccacggggcaaaggca

SEQ ID NO: 29018 - RNA, 20 nt, Artificial Sequence
  ELANE RNA Guide
uuacaaacugugccacgggg

SEQ ID NO: 29019 - RNA, 20 nt, Artificial Sequence
  ELANE RNA Guide
uugccccguggcacaguuug

SEQ ID NO: 29020 - RNA, 20 nt, Artificial Sequence
  ELANE RNA Guide
uuuacaaacugugccacggg

SEQ ID NO: 29021 - RNA, 20 nt, Artificial Sequence
  ELANE RNA Guide
uuugccccguggcacaguuu

SEQ ID NO: 29022 - RNA, 21 nt, Artificial Sequence
  ELANE RNA Guide
aaacugugccacggggcaaag

SEQ ID NO: 29023 - RNA, 21 nt, Artificial Sequence
  ELANE RNA Guide
aacugugccacggggcaaagg

SEQ ID NO: 29024 - RNA, 21 nt, Artificial Sequence
  ELANE RNA Guide
acaaacugugccacggggcaa

SEQ ID NO: 29025 - RNA, 21 nt, Artificial Sequence
  ELANE RNA Guide
accccgaugccuuugccccgu

SEQ ID NO: 29026 - RNA, 21 nt, Artificial Sequence
  ELANE RNA Guide
acggggcaaaggcaucggggu

SEQ ID NO: 29027 - RNA, 21 nt, Artificial Sequence
  ELANE RNA Guide
acugugccacggggcaaaggc

SEQ ID NO: 29028 - RNA, 21 nt, Artificial Sequence
  ELANE RNA Guide
aguuuacaaacugugccacgg

SEQ ID NO: 29029 - RNA, 21 nt, Artificial Sequence
  ELANE RNA Guide
auccaguuuacaaacugugcc

SEQ ID NO: 29030 - RNA, 21 nt, Artificial Sequence
  ELANE RNA Guide
augccuuugccccguggcaca

SEQ ID NO: 29031 - RNA, 21 nt, Artificial Sequence
  ELANE RNA Guide
caaacugugccacggggcaaa

SEQ ID NO: 29032 - RNA, 21 nt, Artificial Sequence
  ELANE RNA Guide
cacggggcaaaggcaucgggg

SEQ ID NO: 29033 - RNA, 21 nt, Artificial Sequence
  ELANE RNA Guide
caguuuacaaacugugccacg

SEQ ID NO: 29034 - RNA, 21 nt, Artificial Sequence
  ELANE RNA Guide
ccacggggcaaaggcaucggg

SEQ ID NO: 29035 - RNA, 21 nt, Artificial Sequence
  ELANE RNA Guide
ccaguuuacaaacugugccac

SEQ ID NO: 29036 - RNA, 21 nt, Artificial Sequence
  ELANE RNA Guide
ccccgaugccuuugccccgug

SEQ ID NO: 29037 - RNA, 21 nt, Artificial Sequence
  ELANE RNA Guide
ccccguggcacaguuuguaaa

SEQ ID NO: 29038 - RNA, 21 nt, Artificial Sequence
  ELANE RNA Guide
cccgaugccuuugccccgugg

SEQ ID NO: 29039 - RNA, 21 nt, Artificial Sequence
  ELANE RNA Guide
cccguggcacaguuuguaaac

SEQ ID NO: 29040 - RNA, 21 nt, Artificial Sequence
  ELANE RNA Guide
ccgaugccuuugccccguggc

SEQ ID NO: 29041 - RNA, 21 nt, Artificial Sequence
  ELANE RNA Guide
ccguggcacaguuuguaaacu

SEQ ID NO: 29042 - RNA, 21 nt, Artificial Sequence
  ELANE RNA Guide
ccuuugccccguggcacaguu

SEQ ID NO: 29043 - RNA, 21 nt, Artificial Sequence
  ELANE RNA Guide
cgaugccuuugccccguggca

SEQ ID NO: 29044 - RNA, 21 nt, Artificial Sequence
  ELANE RNA Guide
cuaccccgaugccuuugcccc

SEQ ID NO: 29045 - RNA, 21 nt, Artificial Sequence
  ELANE RNA Guide
cugugccacggggcaaaggca

SEQ ID NO: 29046 - RNA, 21 nt, Artificial Sequence
  ELANE RNA Guide
cuuugccccguggcacaguuu

SEQ ID NO: 29047 - RNA, 21 nt, Artificial Sequence
  ELANE RNA Guide
gauccaguuuacaaacugugc

SEQ ID NO: 29048 - RNA, 21 nt, Artificial Sequence
  ELANE RNA Guide
gaugccuuugccccguggcac

SEQ ID NO: 29049 - RNA, 21 nt, Artificial Sequence
  ELANE RNA Guide
gccacggggcaaaggcaucgg

SEQ ID NO: 29050 - RNA, 21 nt, Artificial Sequence
  ELANE RNA Guide
gccccguggcacaguuuguaa

SEQ ID NO: 29051 - RNA, 21 nt, Artificial Sequence
  ELANE RNA Guide
gccuuugccccguggcacagu

SEQ ID NO: 29052 - RNA, 21 nt, Artificial Sequence
  ELANE RNA Guide
gugccacggggcaaaggcauc

SEQ ID NO: 29053 - RNA, 21 nt, Artificial Sequence
  ELANE RNA Guide
guuuacaaacugugccacggg

SEQ ID NO: 29054 - RNA, 21 nt, Artificial Sequence
  ELANE RNA Guide
uacaaacugugccacggggca

SEQ ID NO: 29055 - RNA, 21 nt, Artificial Sequence
  ELANE RNA Guide
uaccccgaugccuuugccccg

SEQ ID NO: 29056 - RNA, 21 nt, Artificial Sequence
  ELANE RNA Guide
uccaguuuacaaacugugcca

SEQ ID NO: 29057 - RNA, 21 nt, Artificial Sequence
  ELANE RNA Guide
ugccacggggcaaaggcaucg

SEQ ID NO: 29058 - RNA, 21 nt, Artificial Sequence
  ELANE RNA Guide
ugccccguggcacaguuugua

SEQ ID NO: 29059 - RNA, 21 nt, Artificial Sequence
  ELANE RNA Guide
ugccuuugccccguggcacag

SEQ ID NO: 29060 - RNA, 21 nt, Artificial Sequence
  ELANE RNA Guide
ugugccacggggcaaaggcau

SEQ ID NO: 29061 - RNA, 21 nt, Artificial Sequence
  ELANE RNA Guide
uuacaaacugugccacggggc

SEQ ID NO: 29062 - RNA, 21 nt, Artificial Sequence
  ELANE RNA Guide
uugccccguggcacaguuugu

SEQ ID NO: 29063 - RNA, 21 nt, Artificial Sequence
  ELANE RNA Guide
uuuacaaacugugccacgggg

SEQ ID NO: 29064 - RNA, 21 nt, Artificial Sequence
  ELANE RNA Guide
uuugccccguggcacaguuug

SEQ ID NO: 29065 - RNA, 22 nt, Artificial Sequence
  ELANE RNA Guide
aaacugugccacggggcaaagg

SEQ ID NO: 29066 - RNA, 22 nt, Artificial Sequence
  ELANE RNA Guide
aacugugccacggggcaaaggc

SEQ ID NO: 29067 - RNA, 22 nt, Artificial Sequence
  ELANE RNA Guide
acaaacugugccacggggcaaa

SEQ ID NO: 29068 - RNA, 22 nt, Artificial Sequence
  ELANE RNA Guide
accccgaugccuuugccccgug

SEQ ID NO: 29069 - RNA, 22 nt, Artificial Sequence
  ELANE RNA Guide
acggggcaaaggcaucggggua

SEQ ID NO: 29070 - RNA, 22 nt, Artificial Sequence
  ELANE RNA Guide
acugugccacggggcaaaggca

SEQ ID NO: 29071 - RNA, 22 nt, Artificial Sequence
  ELANE RNA Guide
aguuuacaaacugugccacggg

SEQ ID NO: 29072 - RNA, 22 nt, Artificial Sequence
  ELANE RNA Guide
auccaguuuacaaacugugcca

SEQ ID NO: 29073 - RNA, 22 nt, Artificial Sequence
  ELANE RNA Guide
augccuuugccccguggcacag

SEQ ID NO: 29074 - RNA, 22 nt, Artificial Sequence
  ELANE RNA Guide
caaacugugccacggggcaaag

SEQ ID NO: 29075 - RNA, 22 nt, Artificial Sequence
  ELANE RNA Guide
cacggggcaaaggcaucggggu

SEQ ID NO: 29076 - RNA, 22 nt, Artificial Sequence
  ELANE RNA Guide
caguuuacaaacugugccacgg

SEQ ID NO: 29077 - RNA, 22 nt, Artificial Sequence
  ELANE RNA Guide
ccacggggcaaaggcaucgggg

SEQ ID NO: 29078 - RNA, 22 nt, Artificial Sequence
  ELANE RNA Guide
ccaguuuacaaacugugccacg

SEQ ID NO: 29079 - RNA, 22 nt, Artificial Sequence
  ELANE RNA Guide
ccccgaugccuuugccccgugg

SEQ ID NO: 29080 - RNA, 22 nt, Artificial Sequence
  ELANE RNA Guide
ccccguggcacaguuuguaaac

SEQ ID NO: 29081 - RNA, 22 nt, Artificial Sequence
  ELANE RNA Guide
cccgaugccuuugccccguggc

SEQ ID NO: 29082 - RNA, 22 nt, Artificial Sequence
  ELANE RNA Guide
cccguggcacaguuuguaaacu

SEQ ID NO: 29083 - RNA, 22 nt, Artificial Sequence
  ELANE RNA Guide
ccgaugccuuugccccguggca

SEQ ID NO: 29084 - RNA, 22 nt, Artificial Sequence
  ELANE RNA Guide
ccguggcacaguuuguaaacug

SEQ ID NO: 29085 - RNA, 22 nt, Artificial Sequence
  ELANE RNA Guide
ccuuugccccguggcacaguuu

SEQ ID NO: 29086 - RNA, 22 nt, Artificial Sequence
  ELANE RNA Guide
cgauccaguuuacaaacugugc

SEQ ID NO: 29087 - RNA, 22 nt, Artificial Sequence
  ELANE RNA Guide
cgaugccuuugccccguggcac

SEQ ID NO: 29088 - RNA, 22 nt, Artificial Sequence
  ELANE RNA Guide
cuaccccgaugccuuugccccg

SEQ ID NO: 29089 - RNA, 22 nt, Artificial Sequence
  ELANE RNA Guide
cugugccacggggcaaaggcau

SEQ ID NO: 29090 - RNA, 22 nt, Artificial Sequence
  ELANE RNA Guide
cuuugccccguggcacaguuug

SEQ ID NO: 29091 - RNA, 22 nt, Artificial Sequence
  ELANE RNA Guide
gauccaguuuacaaacugugcc

SEQ ID NO: 29092 - RNA, 22 nt, Artificial Sequence
  ELANE RNA Guide
gaugccuuugccccguggcaca

SEQ ID NO: 29093 - RNA, 22 nt, Artificial Sequence
  ELANE RNA Guide
gccacggggcaaaggcaucggg

SEQ ID NO: 29094 - RNA, 22 nt, Artificial Sequence
  ELANE RNA Guide
gccccguggcacaguuuguaaa

SEQ ID NO: 29095 - RNA, 22 nt, Artificial Sequence
  ELANE RNA Guide
gccuuugccccguggcacaguu

SEQ ID NO: 29096 - RNA, 22 nt, Artificial Sequence
  ELANE RNA Guide
gugccacggggcaaaggcaucg

SEQ ID NO: 29097 - RNA, 22 nt, Artificial Sequence
  ELANE RNA Guide
guuuacaaacugugccacgggg

SEQ ID NO: 29098 - RNA, 22 nt, Artificial Sequence
  ELANE RNA Guide
uacaaacugugccacggggcaa

SEQ ID NO: 29099 - RNA, 22 nt, Artificial Sequence
  ELANE RNA Guide
uaccccgaugccuuugccccgu

SEQ ID NO: 29100 - RNA, 22 nt, Artificial Sequence
  ELANE RNA Guide
uccaguuuacaaacugugccac

SEQ ID NO: 29101 - RNA, 22 nt, Artificial Sequence
  ELANE RNA Guide
ucuaccccgaugccuuugcccc

SEQ ID NO: 29102 - RNA, 22 nt, Artificial Sequence
  ELANE RNA Guide
ugccacggggcaaaggcaucgg

SEQ ID NO: 29103 - RNA, 22 nt, Artificial Sequence
  ELANE RNA Guide
ugccccguggcacaguuuguaa

SEQ ID NO: 29104 - RNA, 22 nt, Artificial Sequence
  ELANE RNA Guide
ugccuuugccccguggcacagu

SEQ ID NO: 29105 - RNA, 22 nt, Artificial Sequence
  ELANE RNA Guide
ugugccacggggcaaaggcauc

SEQ ID NO: 29106 - RNA, 22 nt, Artificial Sequence
  ELANE RNA Guide
uuacaaacugugccacggggca

SEQ ID NO: 29107 - RNA, 22 nt, Artificial Sequence
  ELANE RNA Guide
uugccccguggcacaguuugua

SEQ ID NO: 29108 - RNA, 22 nt, Artificial Sequence
  ELANE RNA Guide
uuuacaaacugugccacggggc

SEQ ID NO: 29109 - RNA, 22 nt, Artificial Sequence
  ELANE RNA Guide
uuugccccguggcacaguuugu

SEQ ID NO: 29110 - RNA, 20 nt, Artificial Sequence
  ELANE RNA Guide
aaacugugccuccggggcaa

SEQ ID NO: 29111 - RNA, 20 nt, Artificial Sequence
  ELANE RNA Guide
aacugugccuccggggcaaa

SEQ ID NO: 29112 - RNA, 20 nt, Artificial Sequence
  ELANE RNA Guide
acaaacugugccuccggggc

SEQ ID NO: 29113 - RNA, 20 nt, Artificial Sequence
  ELANE RNA Guide
acugugccuccggggcaaag

SEQ ID NO: 29114 - RNA, 20 nt, Artificial Sequence
  ELANE RNA Guide
aguuuacaaacugugccucc

SEQ ID NO: 29115 - RNA, 20 nt, Artificial Sequence
  ELANE RNA Guide
augccuuugccccggaggca

SEQ ID NO: 29116 - RNA, 20 nt, Artificial Sequence
  ELANE RNA Guide
caaacugugccuccggggca

SEQ ID NO: 29117 - RNA, 20 nt, Artificial Sequence
  ELANE RNA Guide
caguuuacaaacugugccuc

SEQ ID NO: 29118 - RNA, 20 nt, Artificial Sequence
  ELANE RNA Guide
ccaguuuacaaacugugccu

SEQ ID NO: 29119 - RNA, 20 nt, Artificial Sequence
  ELANE RNA Guide
ccccgaugccuuugccccgg

SEQ ID NO: 29120 - RNA, 20 nt, Artificial Sequence
  ELANE RNA Guide
ccccggaggcacaguuugua

SEQ ID NO: 29121 - RNA, 20 nt, Artificial Sequence
  ELANE RNA Guide
cccgaugccuuugccccgga

SEQ ID NO: 29122 - RNA, 20 nt, Artificial Sequence
  ELANE RNA Guide
cccggaggcacaguuuguaa

SEQ ID NO: 29123 - RNA, 20 nt, Artificial Sequence
  ELANE RNA Guide
ccgaugccuuugccccggag

SEQ ID NO: 29124 - RNA, 20 nt, Artificial Sequence
  ELANE RNA Guide
ccggaggcacaguuuguaaa

SEQ ID NO: 29125 - RNA, 20 nt, Artificial Sequence
  ELANE RNA Guide
ccuccggggcaaaggcaucg

SEQ ID NO: 29126 - RNA, 20 nt, Artificial Sequence
  ELANE RNA Guide
ccuuugccccggaggcacag

SEQ ID NO: 29127 - RNA, 20 nt, Artificial Sequence
  ELANE RNA Guide
cgauccaguuuacaaacugu

SEQ ID NO: 29128 - RNA, 20 nt, Artificial Sequence
  ELANE RNA Guide
cgaugccuuugccccggagg

SEQ ID NO: 29129 - RNA, 20 nt, Artificial Sequence
  ELANE RNA Guide
cggaggcacaguuuguaaac

SEQ ID NO: 29130 - RNA, 20 nt, Artificial Sequence
  ELANE RNA Guide
cuccggggcaaaggcaucgg

SEQ ID NO: 29131 - RNA, 20 nt, Artificial Sequence
  ELANE RNA Guide
cugugccuccggggcaaagg

SEQ ID NO: 29132 - RNA, 20 nt, Artificial Sequence
  ELANE RNA Guide
cuuugccccggaggcacagu

SEQ ID NO: 29133 - RNA, 20 nt, Artificial Sequence
  ELANE RNA Guide
gaggcacaguuuguaaacug

SEQ ID NO: 29134 - RNA, 20 nt, Artificial Sequence
  ELANE RNA Guide
gauccaguuuacaaacugug

SEQ ID NO: 29135 - RNA, 20 nt, Artificial Sequence
  ELANE RNA Guide
gaugccuuugccccggaggc

SEQ ID NO: 29136 - RNA, 20 nt, Artificial Sequence
  ELANE RNA Guide
gccccggaggcacaguuugu

SEQ ID NO: 29137 - RNA, 20 nt, Artificial Sequence
  ELANE RNA Guide
gccuccggggcaaaggcauc

SEQ ID NO: 29138 - RNA, 20 nt, Artificial Sequence
  ELANE RNA Guide
gccuuugccccggaggcaca

SEQ ID NO: 29139 - RNA, 20 nt, Artificial Sequence
  ELANE RNA Guide
ggaggcacaguuuguaaacu

SEQ ID NO: 29140 - RNA, 20 nt, Artificial Sequence
  ELANE RNA Guide
gugccuccggggcaaaggca

SEQ ID NO: 29141 - RNA, 20 nt, Artificial Sequence
  ELANE RNA Guide
guuuacaaacugugccuccg

SEQ ID NO: 29142 - RNA, 20 nt, Artificial Sequence
  ELANE RNA Guide
uacaaacugugccuccgggg

SEQ ID NO: 29143 - RNA, 20 nt, Artificial Sequence
  ELANE RNA Guide
ugccccggaggcacaguuug

SEQ ID NO: 29144 - RNA, 20 nt, Artificial Sequence
  ELANE RNA Guide
ugccuccggggcaaaggcau

SEQ ID NO: 29145 - RNA, 20 nt, Artificial Sequence
  ELANE RNA Guide
ugccuuugccccggaggcac

SEQ ID NO: 29146 - RNA, 20 nt, Artificial Sequence
  ELANE RNA Guide
ugugccuccggggcaaaggc

SEQ ID NO: 29147 - RNA, 20 nt, Artificial Sequence
  ELANE RNA Guide
uuacaaacugugccuccggg

SEQ ID NO: 29148 - RNA, 20 nt, Artificial Sequence
  ELANE RNA Guide
uugccccggaggcacaguuu

SEQ ID NO: 29149 - RNA, 20 nt, Artificial Sequence
  ELANE RNA Guide
uuuacaaacugugccuccgg

SEQ ID NO: 29150 - RNA, 20 nt, Artificial Sequence
  ELANE RNA Guide
uuugccccggaggcacaguu

SEQ ID NO: 29151 - RNA, 21 nt, Artificial Sequence
  ELANE RNA Guide
aaacugugccuccggggcaaa

SEQ ID NO: 29152 - RNA, 21 nt, Artificial Sequence
  ELANE RNA Guide
aacugugccuccggggcaaag

SEQ ID NO: 29153 - RNA, 21 nt, Artificial Sequence
  ELANE RNA Guide
acaaacugugccuccggggca

SEQ ID NO: 29154 - RNA, 21 nt, Artificial Sequence
  ELANE RNA Guide
accccgaugccuuugccccgg

SEQ ID NO: 29155 - RNA, 21 nt, Artificial Sequence
  ELANE RNA Guide
acugugccuccggggcaaagg

SEQ ID NO: 29156 - RNA, 21 nt, Artificial Sequence
  ELANE RNA Guide
aguuuacaaacugugccuccg

SEQ ID NO: 29157 - RNA, 21 nt, Artificial Sequence
  ELANE RNA Guide
augccuuugccccggaggcac

SEQ ID NO: 29158 - RNA, 21 nt, Artificial Sequence
  ELANE RNA Guide
caaacugugccuccggggcaa

SEQ ID NO: 29159 - RNA, 21 nt, Artificial Sequence
  ELANE RNA Guide
caguuuacaaacugugccucc

SEQ ID NO: 29160 - RNA, 21 nt, Artificial Sequence
  ELANE RNA Guide
ccaguuuacaaacugugccuc

SEQ ID NO: 29161 - RNA, 21 nt, Artificial Sequence
  ELANE RNA Guide
ccccgaugccuuugccccgga

SEQ ID NO: 29162 - RNA, 21 nt, Artificial Sequence
  ELANE RNA Guide
ccccggaggcacaguuuguaa

SEQ ID NO: 29163 - RNA, 21 nt, Artificial Sequence
  ELANE RNA Guide
cccgaugccuuugccccggag

SEQ ID NO: 29164 - RNA, 21 nt, Artificial Sequence
  ELANE RNA Guide
cccggaggcacaguuuguaaa

SEQ ID NO: 29165 - RNA, 21 nt, Artificial Sequence
  ELANE RNA Guide
ccgaugccuuugccccggagg

SEQ ID NO: 29166 - RNA, 21 nt, Artificial Sequence
  ELANE RNA Guide
ccggaggcacaguuuguaaac

SEQ ID NO: 29167 - RNA, 21 nt, Artificial Sequence
  ELANE RNA Guide
ccuccggggcaaaggcaucgg

SEQ ID NO: 29168 - RNA, 21 nt, Artificial Sequence
  ELANE RNA Guide
ccuuugccccggaggcacagu

SEQ ID NO: 29169 - RNA, 21 nt, Artificial Sequence
  ELANE RNA Guide
cgauccaguuuacaaacugug

SEQ ID NO: 29170 - RNA, 21 nt, Artificial Sequence
  ELANE RNA Guide
cgaugccuuugccccggaggc

SEQ ID NO: 29171 - RNA, 21 nt, Artificial Sequence
  ELANE RNA Guide
cggaggcacaguuuguaaacu

SEQ ID NO: 29172 - RNA, 21 nt, Artificial Sequence
  ELANE RNA Guide
cuccggggcaaaggcaucggg

SEQ ID NO: 29173 - RNA, 21 nt, Artificial Sequence
  ELANE RNA Guide
cugugccuccggggcaaaggc

SEQ ID NO: 29174 - RNA, 21 nt, Artificial Sequence
  ELANE RNA Guide
cuuugccccggaggcacaguu

SEQ ID NO: 29175 - RNA, 21 nt, Artificial Sequence
  ELANE RNA Guide
gaggcacaguuuguaaacugg

SEQ ID NO: 29176 - RNA, 21 nt, Artificial Sequence
  ELANE RNA Guide
gaugccuuugccccggaggca

SEQ ID NO: 29177 - RNA, 21 nt, Artificial Sequence
  ELANE RNA Guide
gccccggaggcacaguuugua

SEQ ID NO: 29178 - RNA, 21 nt, Artificial Sequence
  ELANE RNA Guide
gccuccggggcaaaggcaucg

SEQ ID NO: 29179 - RNA, 21 nt, Artificial Sequence
  ELANE RNA Guide
gccuuugccccggaggcacag

SEQ ID NO: 29180 - RNA, 21 nt, Artificial Sequence
  ELANE RNA Guide
ggaggcacaguuuguaaacug

SEQ ID NO: 29181 - RNA, 21 nt, Artificial Sequence
  ELANE RNA Guide
gugccuccggggcaaaggcau

SEQ ID NO: 29182 - RNA, 21 nt, Artificial Sequence
  ELANE RNA Guide
guuuacaaacugugccuccgg

SEQ ID NO: 29183 - RNA, 21 nt, Artificial Sequence
  ELANE RNA Guide
uacaaacugugccuccggggc

SEQ ID NO: 29184 - RNA, 21 nt, Artificial Sequence
  ELANE RNA Guide
uccaguuuacaaacugugccu

SEQ ID NO: 29185 - RNA, 21 nt, Artificial Sequence
  ELANE RNA Guide
ucgauccaguuuacaaacugu

SEQ ID NO: 29186 - RNA, 21 nt, Artificial Sequence
  ELANE RNA Guide
ugccccggaggcacaguuugu

SEQ ID NO: 29187 - RNA, 21 nt, Artificial Sequence
  ELANE RNA Guide
ugccuccggggcaaaggcauc

SEQ ID NO: 29188 - RNA, 21 nt, Artificial Sequence
  ELANE RNA Guide
ugccuuugccccggaggcaca

SEQ ID NO: 29189 - RNA, 21 nt, Artificial Sequence
  ELANE RNA Guide
ugugccuccggggcaaaggca

SEQ ID NO: 29190 - RNA, 21 nt, Artificial Sequence
  ELANE RNA Guide
uuacaaacugugccuccgggg

SEQ ID NO: 29191 - RNA, 21 nt, Artificial Sequence
  ELANE RNA Guide
uugccccggaggcacaguuug

SEQ ID NO: 29192 - RNA, 21 nt, Artificial Sequence
  ELANE RNA Guide
uuuacaaacugugccuccggg

SEQ ID NO: 29193 - RNA, 21 nt, Artificial Sequence
  ELANE RNA Guide
uuugccccggaggcacaguuu

SEQ ID NO: 29194 - RNA, 22 nt, Artificial Sequence
  ELANE RNA Guide
aaacugugccuccggggcaaag

SEQ ID NO: 29195 - RNA, 22 nt, Artificial Sequence
  ELANE RNA Guide
aacugugccuccggggcaaagg

SEQ ID NO: 29196 - RNA, 22 nt, Artificial Sequence
  ELANE RNA Guide
acaaacugugccuccggggcaa

SEQ ID NO: 29197 - RNA, 22 nt, Artificial Sequence
  ELANE RNA Guide
accccgaugccuuugccccgga

SEQ ID NO: 29198 - RNA, 22 nt, Artificial Sequence
  ELANE RNA Guide
acugugccuccggggcaaaggc

SEQ ID NO: 29199 - RNA, 22 nt, Artificial Sequence
  ELANE RNA Guide
aguuuacaaacugugccuccgg

SEQ ID NO: 29200 - RNA, 22 nt, Artificial Sequence
  ELANE RNA Guide
auccaguuuacaaacugugccu

SEQ ID NO: 29201 - RNA, 22 nt, Artificial Sequence
  ELANE RNA Guide
augccuuugccccggaggcaca

SEQ ID NO: 29202 - RNA, 22 nt, Artificial Sequence
  ELANE RNA Guide
caaacugugccuccggggcaaa

SEQ ID NO: 29203 - RNA, 22 nt, Artificial Sequence
  ELANE RNA Guide
caguuuacaaacugugccuccg

SEQ ID NO: 29204 - RNA, 22 nt, Artificial Sequence
  ELANE RNA Guide
ccaguuuacaaacugugccucc

SEQ ID NO: 29205 - RNA, 22 nt, Artificial Sequence
  ELANE RNA Guide
ccccgaugccuuugccccggag

SEQ ID NO: 29206 - RNA, 22 nt, Artificial Sequence
  ELANE RNA Guide
ccccggaggcacaguuuguaaa

SEQ ID NO: 29207 - RNA, 22 nt, Artificial Sequence
  ELANE RNA Guide
cccgaugccuuugccccggagg

SEQ ID NO: 29208 - RNA, 22 nt, Artificial Sequence
  ELANE RNA Guide
cccggaggcacaguuuguaaac

SEQ ID NO: 29209 - RNA, 22 nt, Artificial Sequence
  ELANE RNA Guide
ccgaugccuuugccccggaggc

SEQ ID NO: 29210 - RNA, 22 nt, Artificial Sequence
  ELANE RNA Guide
ccggaggcacaguuuguaaacu

SEQ ID NO: 29211 - RNA, 22 nt, Artificial Sequence
  ELANE RNA Guide
ccuccggggcaaaggcaucggg

SEQ ID NO: 29212 - RNA, 22 nt, Artificial Sequence
  ELANE RNA Guide
ccuuugccccggaggcacaguu

SEQ ID NO: 29213 - RNA, 22 nt, Artificial Sequence
  ELANE RNA Guide
cgaugccuuugccccggaggca

SEQ ID NO: 29214 - RNA, 22 nt, Artificial Sequence
  ELANE RNA Guide
cggaggcacaguuuguaaacug

SEQ ID NO: 29215 - RNA, 22 nt, Artificial Sequence
  ELANE RNA Guide
cuccggggcaaaggcaucgggg

SEQ ID NO: 29216 - RNA, 22 nt, Artificial Sequence
  ELANE RNA Guide
cugugccuccggggcaaaggca

SEQ ID NO: 29217 - RNA, 22 nt, Artificial Sequence
  ELANE RNA Guide
cuuugccccggaggcacaguuu

SEQ ID NO: 29218 - RNA, 22 nt, Artificial Sequence
  ELANE RNA Guide
gaggcacaguuuguaaacugga

SEQ ID NO: 29219 - RNA, 22 nt, Artificial Sequence
  ELANE RNA Guide
gaugccuuugccccggaggcac

SEQ ID NO: 29220 - RNA, 22 nt, Artificial Sequence
  ELANE RNA Guide
gccccggaggcacaguuuguaa

SEQ ID NO: 29221 - RNA, 22 nt, Artificial Sequence
  ELANE RNA Guide
gccuccggggcaaaggcaucgg

SEQ ID NO: 29222 - RNA, 22 nt, Artificial Sequence
  ELANE RNA Guide
gccuuugccccggaggcacagu

SEQ ID NO: 29223 - RNA, 22 nt, Artificial Sequence
  ELANE RNA Guide
ggaggcacaguuuguaaacugg

SEQ ID NO: 29224 - RNA, 22 nt, Artificial Sequence
  ELANE RNA Guide
gucgauccaguuuacaaacugu

SEQ ID NO: 29225 - RNA, 22 nt, Artificial Sequence
  ELANE RNA Guide
gugccuccggggcaaaggcauc

SEQ ID NO: 29226 - RNA, 22 nt, Artificial Sequence
  ELANE RNA Guide
guuuacaaacugugccuccggg

SEQ ID NO: 29227 - RNA, 22 nt, Artificial Sequence
  ELANE RNA Guide
uacaaacugugccuccggggca

SEQ ID NO: 29228 - RNA, 22 nt, Artificial Sequence
  ELANE RNA Guide
uaccccgaugccuuugccccgg

SEQ ID NO: 29229 - RNA, 22 nt, Artificial Sequence
  ELANE RNA Guide
uccaguuuacaaacugugccuc

SEQ ID NO: 29230 - RNA, 22 nt, Artificial Sequence
  ELANE RNA Guide
ucgauccaguuuacaaacugug

SEQ ID NO: 29231 - RNA, 22 nt, Artificial Sequence
  ELANE RNA Guide
ugccccggaggcacaguuugua

SEQ ID NO: 29232 - RNA, 22 nt, Artificial Sequence
  ELANE RNA Guide
ugccuccggggcaaaggcaucg

SEQ ID NO: 29233 - RNA, 22 nt, Artificial Sequence
  ELANE RNA Guide
ugccuuugccccggaggcacag

SEQ ID NO: 29234 - RNA, 22 nt, Artificial Sequence
  ELANE RNA Guide
ugugccuccggggcaaaggcau

SEQ ID NO: 29235 - RNA, 22 nt, Artificial Sequence
  ELANE RNA Guide
uuacaaacugugccuccggggc

SEQ ID NO: 29236 - RNA, 22 nt, Artificial Sequence
  ELANE RNA Guide
uugccccggaggcacaguuugu

SEQ ID NO: 29237 - RNA, 22 nt, Artificial Sequence
  ELANE RNA Guide
uuuacaaacugugccuccgggg

SEQ ID NO: 29238 - RNA, 22 nt, Artificial Sequence
  ELANE RNA Guide
uuugccccggaggcacaguuug

SEQ ID NO: 29239 - RNA, 20 nt, Artificial Sequence
  ELANE RNA Guide
aaacugugcccccggggcaa

SEQ ID NO: 29240 - RNA, 20 nt, Artificial Sequence
  ELANE RNA Guide
aacugugcccccggggcaaa

SEQ ID NO: 29241 - RNA, 20 nt, Artificial Sequence
  ELANE RNA Guide
acaaacugugcccccggggc

SEQ ID NO: 29242 - RNA, 20 nt, Artificial Sequence
  ELANE RNA Guide
acugugcccccggggcaaag

SEQ ID NO: 29243 - RNA, 20 nt, Artificial Sequence
  ELANE RNA Guide
aguuuacaaacugugccccc

SEQ ID NO: 29244 - RNA, 20 nt, Artificial Sequence
  ELANE RNA Guide
augccuuugccccgggggca

SEQ ID NO: 29245 - RNA, 20 nt, Artificial Sequence
  ELANE RNA Guide
caaacugugcccccggggca

SEQ ID NO: 29246 - RNA, 20 nt, Artificial Sequence
  ELANE RNA Guide
caguuuacaaacugugcccc

SEQ ID NO: 29247 - RNA, 20 nt, Artificial Sequence
  ELANE RNA Guide
ccaguuuacaaacugugccc

SEQ ID NO: 29248 - RNA, 20 nt, Artificial Sequence
  ELANE RNA Guide
cccccggggcaaaggcaucg

SEQ ID NO: 29249 - RNA, 20 nt, Artificial Sequence
  ELANE RNA Guide
ccccggggcaaaggcaucgg

SEQ ID NO: 29250 - RNA, 20 nt, Artificial Sequence
  ELANE RNA Guide
ccccgggggcacaguuugua

SEQ ID NO: 29251 - RNA, 20 nt, Artificial Sequence
  ELANE RNA Guide
cccgaugccuuugccccggg

SEQ ID NO: 29252 - RNA, 20 nt, Artificial Sequence
  ELANE RNA Guide
cccgggggcacaguuuguaa

SEQ ID NO: 29253 - RNA, 20 nt, Artificial Sequence
  ELANE RNA Guide
ccgaugccuuugccccgggg

SEQ ID NO: 29254 - RNA, 20 nt, Artificial Sequence
  ELANE RNA Guide
ccgggggcacaguuuguaaa

SEQ ID NO: 29255 - RNA, 20 nt, Artificial Sequence
  ELANE RNA Guide
ccuuugccccgggggcacag

SEQ ID NO: 29256 - RNA, 20 nt, Artificial Sequence
  ELANE RNA Guide
cgaugccuuugccccggggg

SEQ ID NO: 29257 - RNA, 20 nt, Artificial Sequence
  ELANE RNA Guide
cgggggcacaguuuguaaac

SEQ ID NO: 29258 - RNA, 20 nt, Artificial Sequence
  ELANE RNA Guide
cugugcccccggggcaaagg

SEQ ID NO: 29259 - RNA, 20 nt, Artificial Sequence
  ELANE RNA Guide
cuuugccccgggggcacagu

SEQ ID NO: 29260 - RNA, 20 nt, Artificial Sequence
  ELANE RNA Guide
gaugccuuugccccgggggc

SEQ ID NO: 29261 - RNA, 20 nt, Artificial Sequence
  ELANE RNA Guide
gcccccggggcaaaggcauc

SEQ ID NO: 29262 - RNA, 20 nt, Artificial Sequence
  ELANE RNA Guide
gccccgggggcacaguuugu

SEQ ID NO: 29263 - RNA, 20 nt, Artificial Sequence
  ELANE RNA Guide
gccuuugccccgggggcaca

SEQ ID NO: 29264 - RNA, 20 nt, Artificial Sequence
  ELANE RNA Guide
ggggcacaguuuguaaacug

SEQ ID NO: 29265 - RNA, 20 nt, Artificial Sequence
  ELANE RNA Guide
gggggcacaguuuguaaacu

SEQ ID NO: 29266 - RNA, 20 nt, Artificial Sequence
  ELANE RNA Guide
gugcccccggggcaaaggca

SEQ ID NO: 29267 - RNA, 20 nt, Artificial Sequence
  ELANE RNA Guide
guuuacaaacugugcccccg

SEQ ID NO: 29268 - RNA, 20 nt, Artificial Sequence
  ELANE RNA Guide
uacaaacugugcccccgggg

SEQ ID NO: 29269 - RNA, 20 nt, Artificial Sequence
  ELANE RNA Guide
ugcccccggggcaaaggcau

SEQ ID NO: 29270 - RNA, 20 nt, Artificial Sequence
  ELANE RNA Guide
ugccccgggggcacaguuug

SEQ ID NO: 29271 - RNA, 20 nt, Artificial Sequence
  ELANE RNA Guide
ugccuuugccccgggggcac

SEQ ID NO: 29272 - RNA, 20 nt, Artificial Sequence
  ELANE RNA Guide
ugugcccccggggcaaaggc

SEQ ID NO: 29273 - RNA, 20 nt, Artificial Sequence
  ELANE RNA Guide
uuacaaacugugcccccggg

SEQ ID NO: 29274 - RNA, 20 nt, Artificial Sequence
  ELANE RNA Guide
uugccccgggggcacaguuu

SEQ ID NO: 29275 - RNA, 20 nt, Artificial Sequence
  ELANE RNA Guide
uuuacaaacugugcccccgg

SEQ ID NO: 29276 - RNA, 20 nt, Artificial Sequence
  ELANE RNA Guide
uuugccccgggggcacaguu

SEQ ID NO: 29277 - RNA, 21 nt, Artificial Sequence
  ELANE RNA Guide
aaacugugcccccggggcaaa

SEQ ID NO: 29278 - RNA, 21 nt, Artificial Sequence
  ELANE RNA Guide
aacugugcccccggggcaaag

SEQ ID NO: 29279 - RNA, 21 nt, Artificial Sequence
  ELANE RNA Guide
acaaacugugcccccggggca

SEQ ID NO: 29280 - RNA, 21 nt, Artificial Sequence
  ELANE RNA Guide
acugugcccccggggcaaagg

SEQ ID NO: 29281 - RNA, 21 nt, Artificial Sequence
  ELANE RNA Guide
aguuuacaaacugugcccccg

SEQ ID NO: 29282 - RNA, 21 nt, Artificial Sequence
  ELANE RNA Guide
augccuuugccccgggggcac

SEQ ID NO: 29283 - RNA, 21 nt, Artificial Sequence
  ELANE RNA Guide
caaacugugcccccggggcaa

SEQ ID NO: 29284 - RNA, 21 nt, Artificial Sequence
  ELANE RNA Guide
caguuuacaaacugugccccc

SEQ ID NO: 29285 - RNA, 21 nt, Artificial Sequence
  ELANE RNA Guide
ccaguuuacaaacugugcccc

SEQ ID NO: 29286 - RNA, 21 nt, Artificial Sequence
  ELANE RNA Guide
cccccggggcaaaggcaucgg

SEQ ID NO: 29287 - RNA, 21 nt, Artificial Sequence
  ELANE RNA Guide
ccccgaugccuuugccccggg

SEQ ID NO: 29288 - RNA, 21 nt, Artificial Sequence
  ELANE RNA Guide
ccccggggcaaaggcaucggg

SEQ ID NO: 29289 - RNA, 21 nt, Artificial Sequence
  ELANE RNA Guide
ccccgggggcacaguuuguaa

SEQ ID NO: 29290 - RNA, 21 nt, Artificial Sequence
  ELANE RNA Guide
cccgaugccuuugccccgggg

SEQ ID NO: 29291 - RNA, 21 nt, Artificial Sequence
  ELANE RNA Guide
cccgggggcacaguuuguaaa

SEQ ID NO: 29292 - RNA, 21 nt, Artificial Sequence
  ELANE RNA Guide
ccgaugccuuugccccggggg

SEQ ID NO: 29293 - RNA, 21 nt, Artificial Sequence
  ELANE RNA Guide
ccgggggcacaguuuguaaac

SEQ ID NO: 29294 - RNA, 21 nt, Artificial Sequence
  ELANE RNA Guide
ccuuugccccgggggcacagu

SEQ ID NO: 29295 - RNA, 21 nt, Artificial Sequence
  ELANE RNA Guide
cgaugccuuugccccgggggc

SEQ ID NO: 29296 - RNA, 21 nt, Artificial Sequence
  ELANE RNA Guide
cgggggcacaguuuguaaacu

SEQ ID NO: 29297 - RNA, 21 nt, Artificial Sequence
  ELANE RNA Guide
cugugcccccggggcaaaggc

SEQ ID NO: 29298 - RNA, 21 nt, Artificial Sequence
  ELANE RNA Guide
cuuugccccgggggcacaguu

SEQ ID NO: 29299 - RNA, 21 nt, Artificial Sequence
  ELANE RNA Guide
gaugccuuugccccgggggca

SEQ ID NO: 29300 - RNA, 21 nt, Artificial Sequence
  ELANE RNA Guide
gcccccggggcaaaggcaucg

SEQ ID NO: 29301 - RNA, 21 nt, Artificial Sequence
  ELANE RNA Guide
gccccgggggcacaguuugua

SEQ ID NO: 29302 - RNA, 21 nt, Artificial Sequence
  ELANE RNA Guide
gccuuugccccgggggcacag

SEQ ID NO: 29303 - RNA, 21 nt, Artificial Sequence
  ELANE RNA Guide
ggggcacaguuuguaaacugg

SEQ ID NO: 29304 - RNA, 21 nt, Artificial Sequence
  ELANE RNA Guide
gggggcacaguuuguaaacug

SEQ ID NO: 29305 - RNA, 21 nt, Artificial Sequence
  ELANE RNA Guide
gugcccccggggcaaaggcau

SEQ ID NO: 29306 - RNA, 21 nt, Artificial Sequence
  ELANE RNA Guide
guuuacaaacugugcccccgg

SEQ ID NO: 29307 - RNA, 21 nt, Artificial Sequence
  ELANE RNA Guide
uacaaacugugcccccggggc

SEQ ID NO: 29308 - RNA, 21 nt, Artificial Sequence
  ELANE RNA Guide
uccaguuuacaaacugugccc

SEQ ID NO: 29309 - RNA, 21 nt, Artificial Sequence
  ELANE RNA Guide
ugcccccggggcaaaggcauc

SEQ ID NO: 29310 - RNA, 21 nt, Artificial Sequence
  ELANE RNA Guide
ugccccgggggcacaguuugu

SEQ ID NO: 29311 - RNA, 21 nt, Artificial Sequence
  ELANE RNA Guide
ugccuuugccccgggggcaca

SEQ ID NO: 29312 - RNA, 21 nt, Artificial Sequence
  ELANE RNA Guide
ugugcccccggggcaaaggca

SEQ ID NO: 29313 - RNA, 21 nt, Artificial Sequence
  ELANE RNA Guide
uuacaaacugugcccccgggg

SEQ ID NO: 29314 - RNA, 21 nt, Artificial Sequence
  ELANE RNA Guide
uugccccgggggcacaguuug

SEQ ID NO: 29315 - RNA, 21 nt, Artificial Sequence
  ELANE RNA Guide
uuuacaaacugugcccccggg

SEQ ID NO: 29316 - RNA, 21 nt, Artificial Sequence
  ELANE RNA Guide
uuugccccgggggcacaguuu

SEQ ID NO: 29317 - RNA, 22 nt, Artificial Sequence
  ELANE RNA Guide
aaacugugcccccggggcaaag

SEQ ID NO: 29318 - RNA, 22 nt, Artificial Sequence
  ELANE RNA Guide
aacugugcccccggggcaaagg

SEQ ID NO: 29319 - RNA, 22 nt, Artificial Sequence
  ELANE RNA Guide
acaaacugugcccccggggcaa

SEQ ID NO: 29320 - RNA, 22 nt, Artificial Sequence
  ELANE RNA Guide
accccgaugccuuugccccggg

SEQ ID NO: 29321 - RNA, 22 nt, Artificial Sequence
  ELANE RNA Guide
acugugcccccggggcaaaggc

SEQ ID NO: 29322 - RNA, 22 nt, Artificial Sequence
  ELANE RNA Guide
aguuuacaaacugugcccccgg

SEQ ID NO: 29323 - RNA, 22 nt, Artificial Sequence
  ELANE RNA Guide
auccaguuuacaaacugugccc

SEQ ID NO: 29324 - RNA, 22 nt, Artificial Sequence
  ELANE RNA Guide
augccuuugccccgggggcaca

SEQ ID NO: 29325 - RNA, 22 nt, Artificial Sequence
  ELANE RNA Guide
caaacugugcccccggggcaaa

SEQ ID NO: 29326 - RNA, 22 nt, Artificial Sequence
  ELANE RNA Guide
caguuuacaaacugugcccccg

SEQ ID NO: 29327 - RNA, 22 nt, Artificial Sequence
  ELANE RNA Guide
ccaguuuacaaacugugccccc

SEQ ID NO: 29328 - RNA, 22 nt, Artificial Sequence
  ELANE RNA Guide
cccccggggcaaaggcaucggg

SEQ ID NO: 29329 - RNA, 22 nt, Artificial Sequence
  ELANE RNA Guide
ccccgaugccuuugccccgggg

SEQ ID NO: 29330 - RNA, 22 nt, Artificial Sequence
  ELANE RNA Guide
ccccggggcaaaggcaucgggg

SEQ ID NO: 29331 - RNA, 22 nt, Artificial Sequence
  ELANE RNA Guide
ccccgggggcacaguuuguaaa

SEQ ID NO: 29332 - RNA, 22 nt, Artificial Sequence
  ELANE RNA Guide
cccgaugccuuugccccggggg

SEQ ID NO: 29333 - RNA, 22 nt, Artificial Sequence
  ELANE RNA Guide
cccgggggcacaguuuguaaac

SEQ ID NO: 29334 - RNA, 22 nt, Artificial Sequence
  ELANE RNA Guide
ccgaugccuuugccccgggggc

SEQ ID NO: 29335 - RNA, 22 nt, Artificial Sequence
  ELANE RNA Guide
ccgggggcacaguuuguaaacu

SEQ ID NO: 29336 - RNA, 22 nt, Artificial Sequence
  ELANE RNA Guide
ccuuugccccgggggcacaguu

SEQ ID NO: 29337 - RNA, 22 nt, Artificial Sequence
  ELANE RNA Guide
cgaugccuuugccccgggggca

SEQ ID NO: 29338 - RNA, 22 nt, Artificial Sequence
  ELANE RNA Guide
cgggggcacaguuuguaaacug

SEQ ID NO: 29339 - RNA, 22 nt, Artificial Sequence
  ELANE RNA Guide
cugugcccccggggcaaaggca

SEQ ID NO: 29340 - RNA, 22 nt, Artificial Sequence
  ELANE RNA Guide
cuuugccccgggggcacaguuu

SEQ ID NO: 29341 - RNA, 22 nt, Artificial Sequence
  ELANE RNA Guide
gaugccuuugccccgggggcac

SEQ ID NO: 29342 - RNA, 22 nt, Artificial Sequence
  ELANE RNA Guide
gcccccggggcaaaggcaucgg

SEQ ID NO: 29343 - RNA, 22 nt, Artificial Sequence
  ELANE RNA Guide
gccccgggggcacaguuuguaa

SEQ ID NO: 29344 - RNA, 22 nt, Artificial Sequence
  ELANE RNA Guide
gccuuugccccgggggcacagu

SEQ ID NO: 29345 - RNA, 22 nt, Artificial Sequence
  ELANE RNA Guide
ggggcacaguuuguaaacugga

SEQ ID NO: 29346 - RNA, 22 nt, Artificial Sequence
  ELANE RNA Guide
gggggcacaguuuguaaacugg

SEQ ID NO: 29347 - RNA, 22 nt, Artificial Sequence
  ELANE RNA Guide
gugcccccggggcaaaggcauc

SEQ ID NO: 29348 - RNA, 22 nt, Artificial Sequence
  ELANE RNA Guide
guuuacaaacugugcccccggg

SEQ ID NO: 29349 - RNA, 22 nt, Artificial Sequence
  ELANE RNA Guide
uacaaacugugcccccggggca

SEQ ID NO: 29350 - RNA, 22 nt, Artificial Sequence
  ELANE RNA Guide
uccaguuuacaaacugugcccc

SEQ ID NO: 29351 - RNA, 22 nt, Artificial Sequence
  ELANE RNA Guide
ugcccccggggcaaaggcaucg

SEQ ID NO: 29352 - RNA, 22 nt, Artificial Sequence
  ELANE RNA Guide
ugccccgggggcacaguuugua

SEQ ID NO: 29353 - RNA, 22 nt, Artificial Sequence
  ELANE RNA Guide
ugccuuugccccgggggcacag

SEQ ID NO: 29354 - RNA, 22 nt, Artificial Sequence
  ELANE RNA Guide
ugugcccccggggcaaaggcau

SEQ ID NO: 29355 - RNA, 22 nt, Artificial Sequence
  ELANE RNA Guide
uuacaaacugugcccccggggc

SEQ ID NO: 29356 - RNA, 22 nt, Artificial Sequence
  ELANE RNA Guide
uugccccgggggcacaguuugu

SEQ ID NO: 29357 - RNA, 22 nt, Artificial Sequence
  ELANE RNA Guide
uuuacaaacugugcccccgggg

SEQ ID NO: 29358 - RNA, 22 nt, Artificial Sequence
  ELANE RNA Guide
uuugccccgggggcacaguuug

SEQ ID NO: 29359 - RNA, 20 nt, Artificial Sequence
  ELANE RNA Guide
aaacgugccaccggggcaaa

SEQ ID NO: 29360 - RNA, 20 nt, Artificial Sequence
  ELANE RNA Guide
aacgugccaccggggcaaag

SEQ ID NO: 29361 - RNA, 20 nt, Artificial Sequence
  ELANE RNA Guide
acaaacgugccaccggggca

SEQ ID NO: 29362 - RNA, 20 nt, Artificial Sequence
  ELANE RNA Guide
acgugccaccggggcaaagg

SEQ ID NO: 29363 - RNA, 20 nt, Artificial Sequence
  ELANE RNA Guide
acguuuguaaacuggaucga

SEQ ID NO: 29364 - RNA, 20 nt, Artificial Sequence
  ELANE RNA Guide
agagucgauccaguuuacaa

SEQ ID NO: 29365 - RNA, 20 nt, Artificial Sequence
  ELANE RNA Guide
agucgauccaguuuacaaac

SEQ ID NO: 29366 - RNA, 20 nt, Artificial Sequence
  ELANE RNA Guide
aguuuacaaacgugccaccg

SEQ ID NO: 29367 - RNA, 20 nt, Artificial Sequence
  ELANE RNA Guide
auccaguuuacaaacgugcc

SEQ ID NO: 29368 - RNA, 20 nt, Artificial Sequence
  ELANE RNA Guide
augccuuugccccgguggca

SEQ ID NO: 29369 - RNA, 20 nt, Artificial Sequence
  ELANE RNA Guide
caaacgugccaccggggcaa

SEQ ID NO: 29370 - RNA, 20 nt, Artificial Sequence
  ELANE RNA Guide
cacguuuguaaacuggaucg

SEQ ID NO: 29371 - RNA, 20 nt, Artificial Sequence
  ELANE RNA Guide
caguuuacaaacgugccacc

SEQ ID NO: 29372 - RNA, 20 nt, Artificial Sequence
  ELANE RNA Guide
ccaguuuacaaacgugccac

SEQ ID NO: 29373 - RNA, 20 nt, Artificial Sequence
  ELANE RNA Guide
ccccgguggcacguuuguaa

SEQ ID NO: 29374 - RNA, 20 nt, Artificial Sequence
  ELANE RNA Guide
cccgguggcacguuuguaaa

SEQ ID NO: 29375 - RNA, 20 nt, Artificial Sequence
  ELANE RNA Guide
ccgguggcacguuuguaaac

SEQ ID NO: 29376 - RNA, 20 nt, Artificial Sequence
  ELANE RNA Guide
ccuuugccccgguggcacgu

SEQ ID NO: 29377 - RNA, 20 nt, Artificial Sequence
  ELANE RNA Guide
cgauccaguuuacaaacgug

SEQ ID NO: 29378 - RNA, 20 nt, Artificial Sequence
  ELANE RNA Guide
cgaugccuuugccccggugg

SEQ ID NO: 29379 - RNA, 20 nt, Artificial Sequence
  ELANE RNA Guide
cgguggcacguuuguaaacu

SEQ ID NO: 29380 - RNA, 20 nt, Artificial Sequence
  ELANE RNA Guide
cgugccaccggggcaaaggc

SEQ ID NO: 29381 - RNA, 20 nt, Artificial Sequence
  ELANE RNA Guide
cuuugccccgguggcacguu

SEQ ID NO: 29382 - RNA, 20 nt, Artificial Sequence
  ELANE RNA Guide
gagucgauccaguuuacaaa

SEQ ID NO: 29383 - RNA, 20 nt, Artificial Sequence
  ELANE RNA Guide
gauccaguuuacaaacgugc

SEQ ID NO: 29384 - RNA, 20 nt, Artificial Sequence
  ELANE RNA Guide
gaugccuuugccccgguggc

SEQ ID NO: 29385 - RNA, 20 nt, Artificial Sequence
  ELANE RNA Guide
gcacguuuguaaacuggauc

SEQ ID NO: 29386 - RNA, 20 nt, Artificial Sequence
  ELANE RNA Guide
gccccgguggcacguuugua

SEQ ID NO: 29387 - RNA, 20 nt, Artificial Sequence
  ELANE RNA Guide
gccuuugccccgguggcacg

SEQ ID NO: 29388 - RNA, 20 nt, Artificial Sequence
  ELANE RNA Guide
ggcacguuuguaaacuggau

SEQ ID NO: 29389 - RNA, 20 nt, Artificial Sequence
  ELANE RNA Guide
gguggcacguuuguaaacug

SEQ ID NO: 29390 - RNA, 20 nt, Artificial Sequence
  ELANE RNA Guide
gucgauccaguuuacaaacg

SEQ ID NO: 29391 - RNA, 20 nt, Artificial Sequence
  ELANE RNA Guide
guggcacguuuguaaacugg

SEQ ID NO: 29392 - RNA, 20 nt, Artificial Sequence
  ELANE RNA Guide
guuuacaaacgugccaccgg

SEQ ID NO: 29393 - RNA, 20 nt, Artificial Sequence
  ELANE RNA Guide
uacaaacgugccaccggggc

SEQ ID NO: 29394 - RNA, 20 nt, Artificial Sequence
  ELANE RNA Guide
uagagucgauccaguuuaca

SEQ ID NO: 29395 - RNA, 20 nt, Artificial Sequence
  ELANE RNA Guide
uccaguuuacaaacgugcca

SEQ ID NO: 29396 - RNA, 20 nt, Artificial Sequence
  ELANE RNA Guide
ucgauccaguuuacaaacgu

SEQ ID NO: 29397 - RNA, 20 nt, Artificial Sequence
  ELANE RNA Guide
ugccccgguggcacguuugu

SEQ ID NO: 29398 - RNA, 20 nt, Artificial Sequence
  ELANE RNA Guide
ugccuuugccccgguggcac

SEQ ID NO: 29399 - RNA, 20 nt, Artificial Sequence
  ELANE RNA Guide
uggcacguuuguaaacugga

SEQ ID NO: 29400 - RNA, 20 nt, Artificial Sequence
  ELANE RNA Guide
uuacaaacgugccaccgggg

SEQ ID NO: 29401 - RNA, 20 nt, Artificial Sequence
  ELANE RNA Guide
uugccccgguggcacguuug

SEQ ID NO: 29402 - RNA, 20 nt, Artificial Sequence
  ELANE RNA Guide
uuuacaaacgugccaccggg

SEQ ID NO: 29403 - RNA, 20 nt, Artificial Sequence
  ELANE RNA Guide
uuugccccgguggcacguuu

SEQ ID NO: 29404 - RNA, 21 nt, Artificial Sequence
  ELANE RNA Guide
aaacgugccaccggggcaaag

SEQ ID NO: 29405 - RNA, 21 nt, Artificial Sequence
  ELANE RNA Guide
aacgugccaccggggcaaagg

SEQ ID NO: 29406 - RNA, 21 nt, Artificial Sequence
  ELANE RNA Guide
acaaacgugccaccggggcaa

SEQ ID NO: 29407 - RNA, 21 nt, Artificial Sequence
  ELANE RNA Guide
acgugccaccggggcaaaggc

SEQ ID NO: 29408 - RNA, 21 nt, Artificial Sequence
  ELANE RNA Guide
acguuuguaaacuggaucgac

SEQ ID NO: 29409 - RNA, 21 nt, Artificial Sequence
  ELANE RNA Guide
agagucgauccaguuuacaaa

SEQ ID NO: 29410 - RNA, 21 nt, Artificial Sequence
  ELANE RNA Guide
agucgauccaguuuacaaacg

SEQ ID NO: 29411 - RNA, 21 nt, Artificial Sequence
  ELANE RNA Guide
aguuuacaaacgugccaccgg

SEQ ID NO: 29412 - RNA, 21 nt, Artificial Sequence
  ELANE RNA Guide
auagagucgauccaguuuaca

SEQ ID NO: 29413 - RNA, 21 nt, Artificial Sequence
  ELANE RNA Guide
auccaguuuacaaacgugcca

SEQ ID NO: 29414 - RNA, 21 nt, Artificial Sequence
  ELANE RNA Guide
augccuuugccccgguggcac

SEQ ID NO: 29415 - RNA, 21 nt, Artificial Sequence
  ELANE RNA Guide
caaacgugccaccggggcaaa

SEQ ID NO: 29416 - RNA, 21 nt, Artificial Sequence
  ELANE RNA Guide
cacguuuguaaacuggaucga

SEQ ID NO: 29417 - RNA, 21 nt, Artificial Sequence
  ELANE RNA Guide
caguuuacaaacgugccaccg

SEQ ID NO: 29418 - RNA, 21 nt, Artificial Sequence
  ELANE RNA Guide
ccaguuuacaaacgugccacc

SEQ ID NO: 29419 - RNA, 21 nt, Artificial Sequence
  ELANE RNA Guide
ccccgguggcacguuuguaaa

SEQ ID NO: 29420 - RNA, 21 nt, Artificial Sequence
  ELANE RNA Guide
cccgguggcacguuuguaaac

SEQ ID NO: 29421 - RNA, 21 nt, Artificial Sequence
  ELANE RNA Guide
ccgaugccuuugccccggugg

SEQ ID NO: 29422 - RNA, 21 nt, Artificial Sequence
  ELANE RNA Guide
ccgguggcacguuuguaaacu

SEQ ID NO: 29423 - RNA, 21 nt, Artificial Sequence
  ELANE RNA Guide
ccuuugccccgguggcacguu

SEQ ID NO: 29424 - RNA, 21 nt, Artificial Sequence
  ELANE RNA Guide
cgauccaguuuacaaacgugc

SEQ ID NO: 29425 - RNA, 21 nt, Artificial Sequence
  ELANE RNA Guide
cgaugccuuugccccgguggc

SEQ ID NO: 29426 - RNA, 21 nt, Artificial Sequence
  ELANE RNA Guide
cgguggcacguuuguaaacug

SEQ ID NO: 29427 - RNA, 21 nt, Artificial Sequence
  ELANE RNA Guide
cgugccaccggggcaaaggca

SEQ ID NO: 29428 - RNA, 21 nt, Artificial Sequence
  ELANE RNA Guide
cuuugccccgguggcacguuu

SEQ ID NO: 29429 - RNA, 21 nt, Artificial Sequence
  ELANE RNA Guide
gagucgauccaguuuacaaac

SEQ ID NO: 29430 - RNA, 21 nt, Artificial Sequence
  ELANE RNA Guide
gauccaguuuacaaacgugcc

SEQ ID NO: 29431 - RNA, 21 nt, Artificial Sequence
  ELANE RNA Guide
gaugccuuugccccgguggca

SEQ ID NO: 29432 - RNA, 21 nt, Artificial Sequence
  ELANE RNA Guide
gcacguuuguaaacuggaucg

SEQ ID NO: 29433 - RNA, 21 nt, Artificial Sequence
  ELANE RNA Guide
gccccgguggcacguuuguaa

SEQ ID NO: 29434 - RNA, 21 nt, Artificial Sequence
  ELANE RNA Guide
gccuuugccccgguggcacgu

SEQ ID NO: 29435 - RNA, 21 nt, Artificial Sequence
  ELANE RNA Guide
ggcacguuuguaaacuggauc

SEQ ID NO: 29436 - RNA, 21 nt, Artificial Sequence
  ELANE RNA Guide
gguggcacguuuguaaacugg

SEQ ID NO: 29437 - RNA, 21 nt, Artificial Sequence
  ELANE RNA Guide
gucgauccaguuuacaaacgu

SEQ ID NO: 29438 - RNA, 21 nt, Artificial Sequence
  ELANE RNA Guide
guggcacguuuguaaacugga

SEQ ID NO: 29439 - RNA, 21 nt, Artificial Sequence
  ELANE RNA Guide
guuuacaaacgugccaccggg

SEQ ID NO: 29440 - RNA, 21 nt, Artificial Sequence
  ELANE RNA Guide
uacaaacgugccaccggggca

SEQ ID NO: 29441 - RNA, 21 nt, Artificial Sequence
  ELANE RNA Guide
uagagucgauccaguuuacaa

SEQ ID NO: 29442 - RNA, 21 nt, Artificial Sequence
  ELANE RNA Guide
uccaguuuacaaacgugccac

SEQ ID NO: 29443 - RNA, 21 nt, Artificial Sequence
  ELANE RNA Guide
ucgauccaguuuacaaacgug

SEQ ID NO: 29444 - RNA, 21 nt, Artificial Sequence
  ELANE RNA Guide
ugccccgguggcacguuugua

SEQ ID NO: 29445 - RNA, 21 nt, Artificial Sequence
  ELANE RNA Guide
ugccuuugccccgguggcacg

SEQ ID NO: 29446 - RNA, 21 nt, Artificial Sequence
  ELANE RNA Guide
uggcacguuuguaaacuggau

SEQ ID NO: 29447 - RNA, 21 nt, Artificial Sequence
  ELANE RNA Guide
uuacaaacgugccaccggggc

SEQ ID NO: 29448 - RNA, 21 nt, Artificial Sequence
  ELANE RNA Guide
uugccccgguggcacguuugu

SEQ ID NO: 29449 - RNA, 21 nt, Artificial Sequence
  ELANE RNA Guide
uuuacaaacgugccaccgggg

SEQ ID NO: 29450 - RNA, 21 nt, Artificial Sequence
  ELANE RNA Guide
uuugccccgguggcacguuug

SEQ ID NO: 29451 - RNA, 22 nt, Artificial Sequence
  ELANE RNA Guide
aaacgugccaccggggcaaagg

SEQ ID NO: 29452 - RNA, 22 nt, Artificial Sequence
  ELANE RNA Guide
aacgugccaccggggcaaaggc

SEQ ID NO: 29453 - RNA, 22 nt, Artificial Sequence
  ELANE RNA Guide
acaaacgugccaccggggcaaa

SEQ ID NO: 29454 - RNA, 22 nt, Artificial Sequence
  ELANE RNA Guide
acgugccaccggggcaaaggca

SEQ ID NO: 29455 - RNA, 22 nt, Artificial Sequence
  ELANE RNA Guide
acguuuguaaacuggaucgacu

SEQ ID NO: 29456 - RNA, 22 nt, Artificial Sequence
  ELANE RNA Guide
agagucgauccaguuuacaaac

SEQ ID NO: 29457 - RNA, 22 nt, Artificial Sequence
  ELANE RNA Guide
agucgauccaguuuacaaacgu

SEQ ID NO: 29458 - RNA, 22 nt, Artificial Sequence
  ELANE RNA Guide
aguuuacaaacgugccaccggg

SEQ ID NO: 29459 - RNA, 22 nt, Artificial Sequence
  ELANE RNA Guide
auagagucgauccaguuuacaa

SEQ ID NO: 29460 - RNA, 22 nt, Artificial Sequence
  ELANE RNA Guide
auccaguuuacaaacgugccac

SEQ ID NO: 29461 - RNA, 22 nt, Artificial Sequence
  ELANE RNA Guide
augccuuugccccgguggcacg

SEQ ID NO: 29462 - RNA, 22 nt, Artificial Sequence
  ELANE RNA Guide
caaacgugccaccggggcaaag

SEQ ID NO: 29463 - RNA, 22 nt, Artificial Sequence
  ELANE RNA Guide
cacguuuguaaacuggaucgac

SEQ ID NO: 29464 - RNA, 22 nt, Artificial Sequence
  ELANE RNA Guide
caguuuacaaacgugccaccgg

SEQ ID NO: 29465 - RNA, 22 nt, Artificial Sequence
  ELANE RNA Guide
ccaguuuacaaacgugccaccg

SEQ ID NO: 29466 - RNA, 22 nt, Artificial Sequence
  ELANE RNA Guide
ccccgguggcacguuuguaaac

SEQ ID NO: 29467 - RNA, 22 nt, Artificial Sequence
  ELANE RNA Guide
cccgaugccuuugccccggugg

SEQ ID NO: 29468 - RNA, 22 nt, Artificial Sequence
  ELANE RNA Guide
cccgguggcacguuuguaaacu

SEQ ID NO: 29469 - RNA, 22 nt, Artificial Sequence
  ELANE RNA Guide
ccgaugccuuugccccgguggc

SEQ ID NO: 29470 - RNA, 22 nt, Artificial Sequence
  ELANE RNA Guide
ccgguggcacguuuguaaacug

SEQ ID NO: 29471 - RNA, 22 nt, Artificial Sequence
  ELANE RNA Guide
ccuuugccccgguggcacguuu

SEQ ID NO: 29472 - RNA, 22 nt, Artificial Sequence
  ELANE RNA Guide
cgauccaguuuacaaacgugcc

SEQ ID NO: 29473 - RNA, 22 nt, Artificial Sequence
  ELANE RNA Guide
cgaugccuuugccccgguggca

SEQ ID NO: 29474 - RNA, 22 nt, Artificial Sequence
  ELANE RNA Guide
cgguggcacguuuguaaacugg

SEQ ID NO: 29475 - RNA, 22 nt, Artificial Sequence
  ELANE RNA Guide
cgugccaccggggcaaaggcau

SEQ ID NO: 29476 - RNA, 22 nt, Artificial Sequence
  ELANE RNA Guide
cuuugccccgguggcacguuug

SEQ ID NO: 29477 - RNA, 22 nt, Artificial Sequence
  ELANE RNA Guide
gagucgauccaguuuacaaacg

SEQ ID NO: 29478 - RNA, 22 nt, Artificial Sequence
  ELANE RNA Guide
gauagagucgauccaguuuaca

SEQ ID NO: 29479 - RNA, 22 nt, Artificial Sequence
  ELANE RNA Guide
gauccaguuuacaaacgugcca

SEQ ID NO: 29480 - RNA, 22 nt, Artificial Sequence
  ELANE RNA Guide
gaugccuuugccccgguggcac

SEQ ID NO: 29481 - RNA, 22 nt, Artificial Sequence
  ELANE RNA Guide
gcacguuuguaaacuggaucga

SEQ ID NO: 29482 - RNA, 22 nt, Artificial Sequence
  ELANE RNA Guide
gccccgguggcacguuuguaaa

SEQ ID NO: 29483 - RNA, 22 nt, Artificial Sequence
  ELANE RNA Guide
gccuuugccccgguggcacguu

SEQ ID NO: 29484 - RNA, 22 nt, Artificial Sequence
  ELANE RNA Guide
ggcacguuuguaaacuggaucg

SEQ ID NO: 29485 - RNA, 22 nt, Artificial Sequence
  ELANE RNA Guide
gguggcacguuuguaaacugga

SEQ ID NO: 29486 - RNA, 22 nt, Artificial Sequence
  ELANE RNA Guide
gucgauccaguuuacaaacgug

SEQ ID NO: 29487 - RNA, 22 nt, Artificial Sequence
  ELANE RNA Guide
guggcacguuuguaaacuggau

SEQ ID NO: 29488 - RNA, 22 nt, Artificial Sequence
  ELANE RNA Guide
guuuacaaacgugccaccgggg

SEQ ID NO: 29489 - RNA, 22 nt, Artificial Sequence
  ELANE RNA Guide
uacaaacgugccaccggggcaa

SEQ ID NO: 29490 - RNA, 22 nt, Artificial Sequence
  ELANE RNA Guide
uagagucgauccaguuuacaaa

SEQ ID NO: 29491 - RNA, 22 nt, Artificial Sequence
  ELANE RNA Guide
uccaguuuacaaacgugccacc

SEQ ID NO: 29492 - RNA, 22 nt, Artificial Sequence
  ELANE RNA Guide
ucgauccaguuuacaaacgugc

SEQ ID NO: 29493 - RNA, 22 nt, Artificial Sequence
  ELANE RNA Guide
ugccccgguggcacguuuguaa

SEQ ID NO: 29494 - RNA, 22 nt, Artificial Sequence
  ELANE RNA Guide
ugccuuugccccgguggcacgu

SEQ ID NO: 29495 - RNA, 22 nt, Artificial Sequence
  ELANE RNA Guide
uggcacguuuguaaacuggauc

SEQ ID NO: 29496 - RNA, 22 nt, Artificial Sequence
  ELANE RNA Guide
uuacaaacgugccaccggggca

SEQ ID NO: 29497 - RNA, 22 nt, Artificial Sequence
  ELANE RNA Guide
uugccccgguggcacguuugua

SEQ ID NO: 29498 - RNA, 22 nt, Artificial Sequence
  ELANE RNA Guide
uuuacaaacgugccaccggggc

SEQ ID NO: 29499 - RNA, 22 nt, Artificial Sequence
  ELANE RNA Guide
uuugccccgguggcacguuugu

SEQ ID NO: 29500 - RNA, 20 nt, Artificial Sequence
  ELANE RNA Guide
aaacuaugccaccggggcaa

SEQ ID NO: 29501 - RNA, 20 nt, Artificial Sequence
  ELANE RNA Guide
aacuaugccaccggggcaaa

SEQ ID NO: 29502 - RNA, 20 nt, Artificial Sequence
  ELANE RNA Guide
acaaacuaugccaccggggc

SEQ ID NO: 29503 - RNA, 20 nt, Artificial Sequence
  ELANE RNA Guide
acuaugccaccggggcaaag

SEQ ID NO: 29504 - RNA, 20 nt, Artificial Sequence
  ELANE RNA Guide
aguuuacaaacuaugccacc

SEQ ID NO: 29505 - RNA, 20 nt, Artificial Sequence
  ELANE RNA Guide
auaguuuguaaacuggaucg

SEQ ID NO: 29506 - RNA, 20 nt, Artificial Sequence
  ELANE RNA Guide
auccaguuuacaaacuaugc

SEQ ID NO: 29507 - RNA, 20 nt, Artificial Sequence
  ELANE RNA Guide
caaacuaugccaccggggca

SEQ ID NO: 29508 - RNA, 20 nt, Artificial Sequence
  ELANE RNA Guide
caguuuacaaacuaugccac

SEQ ID NO: 29509 - RNA, 20 nt, Artificial Sequence
  ELANE RNA Guide
cauaguuuguaaacuggauc

SEQ ID NO: 29510 - RNA, 20 nt, Artificial Sequence
  ELANE RNA Guide
ccaguuuacaaacuaugcca

SEQ ID NO: 29511 - RNA, 20 nt, Artificial Sequence
  ELANE RNA Guide
ccccgguggcauaguuugua

SEQ ID NO: 29512 - RNA, 20 nt, Artificial Sequence
  ELANE RNA Guide
cccgguggcauaguuuguaa

SEQ ID NO: 29513 - RNA, 20 nt, Artificial Sequence
  ELANE RNA Guide
ccgaugccuuugccccggug

SEQ ID NO: 29514 - RNA, 20 nt, Artificial Sequence
  ELANE RNA Guide
ccgguggcauaguuuguaaa

SEQ ID NO: 29515 - RNA, 20 nt, Artificial Sequence
  ELANE RNA Guide
ccuuugccccgguggcauag

SEQ ID NO: 29516 - RNA, 20 nt, Artificial Sequence
  ELANE RNA Guide
cgauccaguuuacaaacuau

SEQ ID NO: 29517 - RNA, 20 nt, Artificial Sequence
  ELANE RNA Guide
cgguggcauaguuuguaaac

SEQ ID NO: 29518 - RNA, 20 nt, Artificial Sequence
  ELANE RNA Guide
cuaugccaccggggcaaagg

SEQ ID NO: 29519 - RNA, 20 nt, Artificial Sequence
  ELANE RNA Guide
cuuugccccgguggcauagu

SEQ ID NO: 29520 - RNA, 20 nt, Artificial Sequence
  ELANE RNA Guide
gauccaguuuacaaacuaug

SEQ ID NO: 29521 - RNA, 20 nt, Artificial Sequence
  ELANE RNA Guide
gcauaguuuguaaacuggau

SEQ ID NO: 29522 - RNA, 20 nt, Artificial Sequence
  ELANE RNA Guide
gccccgguggcauaguuugu

SEQ ID NO: 29523 - RNA, 20 nt, Artificial Sequence
  ELANE RNA Guide
gccuuugccccgguggcaua

SEQ ID NO: 29524 - RNA, 20 nt, Artificial Sequence
  ELANE RNA Guide
ggcauaguuuguaaacugga

SEQ ID NO: 29525 - RNA, 20 nt, Artificial Sequence
  ELANE RNA Guide
gguggcauaguuuguaaacu

SEQ ID NO: 29526 - RNA, 20 nt, Artificial Sequence
  ELANE RNA Guide
gucgauccaguuuacaaacu

SEQ ID NO: 29527 - RNA, 20 nt, Artificial Sequence
  ELANE RNA Guide
guggcauaguuuguaaacug

SEQ ID NO: 29528 - RNA, 20 nt, Artificial Sequence
  ELANE RNA Guide
guuuacaaacuaugccaccg

SEQ ID NO: 29529 - RNA, 20 nt, Artificial Sequence
  ELANE RNA Guide
uacaaacuaugccaccgggg

SEQ ID NO: 29530 - RNA, 20 nt, Artificial Sequence
  ELANE RNA Guide
uaugccaccggggcaaaggc

SEQ ID NO: 29531 - RNA, 20 nt, Artificial Sequence
  ELANE RNA Guide
uccaguuuacaaacuaugcc

SEQ ID NO: 29532 - RNA, 20 nt, Artificial Sequence
  ELANE RNA Guide
ucgauccaguuuacaaacua

SEQ ID NO: 29533 - RNA, 20 nt, Artificial Sequence
  ELANE RNA Guide
ugccccgguggcauaguuug

SEQ ID NO: 29534 - RNA, 20 nt, Artificial Sequence
  ELANE RNA Guide
ugccuuugccccgguggcau

SEQ ID NO: 29535 - RNA, 20 nt, Artificial Sequence
  ELANE RNA Guide
uggcauaguuuguaaacugg

SEQ ID NO: 29536 - RNA, 20 nt, Artificial Sequence
  ELANE RNA Guide
uuacaaacuaugccaccggg

SEQ ID NO: 29537 - RNA, 20 nt, Artificial Sequence
  ELANE RNA Guide
uugccccgguggcauaguuu

SEQ ID NO: 29538 - RNA, 20 nt, Artificial Sequence
  ELANE RNA Guide
uuuacaaacuaugccaccgg

SEQ ID NO: 29539 - RNA, 20 nt, Artificial Sequence
  ELANE RNA Guide
uuugccccgguggcauaguu

SEQ ID NO: 29540 - RNA, 21 nt, Artificial Sequence
  ELANE RNA Guide
aaacuaugccaccggggcaaa

SEQ ID NO: 29541 - RNA, 21 nt, Artificial Sequence
  ELANE RNA Guide
aacuaugccaccggggcaaag

SEQ ID NO: 29542 - RNA, 21 nt, Artificial Sequence
  ELANE RNA Guide
acaaacuaugccaccggggca

SEQ ID NO: 29543 - RNA, 21 nt, Artificial Sequence
  ELANE RNA Guide
acuaugccaccggggcaaagg

SEQ ID NO: 29544 - RNA, 21 nt, Artificial Sequence
  ELANE RNA Guide
agucgauccaguuuacaaacu

SEQ ID NO: 29545 - RNA, 21 nt, Artificial Sequence
  ELANE RNA Guide
aguuuacaaacuaugccaccg

SEQ ID NO: 29546 - RNA, 21 nt, Artificial Sequence
  ELANE RNA Guide
auaguuuguaaacuggaucga

SEQ ID NO: 29547 - RNA, 21 nt, Artificial Sequence
  ELANE RNA Guide
auccaguuuacaaacuaugcc

SEQ ID NO: 29548 - RNA, 21 nt, Artificial Sequence
  ELANE RNA Guide
augccuuugccccgguggcau

SEQ ID NO: 29549 - RNA, 21 nt, Artificial Sequence
  ELANE RNA Guide
caaacuaugccaccggggcaa

SEQ ID NO: 29550 - RNA, 21 nt, Artificial Sequence
  ELANE RNA Guide
caguuuacaaacuaugccacc

SEQ ID NO: 29551 - RNA, 21 nt, Artificial Sequence
  ELANE RNA Guide
cauaguuuguaaacuggaucg

SEQ ID NO: 29552 - RNA, 21 nt, Artificial Sequence
  ELANE RNA Guide
ccaguuuacaaacuaugccac

SEQ ID NO: 29553 - RNA, 21 nt, Artificial Sequence
  ELANE RNA Guide
ccccgguggcauaguuuguaa

SEQ ID NO: 29554 - RNA, 21 nt, Artificial Sequence
  ELANE RNA Guide
cccgaugccuuugccccggug

SEQ ID NO: 29555 - RNA, 21 nt, Artificial Sequence
  ELANE RNA Guide
cccgguggcauaguuuguaaa

SEQ ID NO: 29556 - RNA, 21 nt, Artificial Sequence
  ELANE RNA Guide
ccgguggcauaguuuguaaac

SEQ ID NO: 29557 - RNA, 21 nt, Artificial Sequence
  ELANE RNA Guide
ccuuugccccgguggcauagu

SEQ ID NO: 29558 - RNA, 21 nt, Artificial Sequence
  ELANE RNA Guide
cgauccaguuuacaaacuaug

SEQ ID NO: 29559 - RNA, 21 nt, Artificial Sequence
  ELANE RNA Guide
cgguggcauaguuuguaaacu

SEQ ID NO: 29560 - RNA, 21 nt, Artificial Sequence
  ELANE RNA Guide
cuaugccaccggggcaaaggc

SEQ ID NO: 29561 - RNA, 21 nt, Artificial Sequence
  ELANE RNA Guide
cuuugccccgguggcauaguu

SEQ ID NO: 29562 - RNA, 21 nt, Artificial Sequence
  ELANE RNA Guide
gauccaguuuacaaacuaugc

SEQ ID NO: 29563 - RNA, 21 nt, Artificial Sequence
  ELANE RNA Guide
gcauaguuuguaaacuggauc

SEQ ID NO: 29564 - RNA, 21 nt, Artificial Sequence
  ELANE RNA Guide
gccccgguggcauaguuugua

SEQ ID NO: 29565 - RNA, 21 nt, Artificial Sequence
  ELANE RNA Guide
gccuuugccccgguggcauag

SEQ ID NO: 29566 - RNA, 21 nt, Artificial Sequence
  ELANE RNA Guide
ggcauaguuuguaaacuggau

SEQ ID NO: 29567 - RNA, 21 nt, Artificial Sequence
  ELANE RNA Guide
gguggcauaguuuguaaacug

SEQ ID NO: 29568 - RNA, 21 nt, Artificial Sequence
  ELANE RNA Guide
gucgauccaguuuacaaacua

SEQ ID NO: 29569 - RNA, 21 nt, Artificial Sequence
  ELANE RNA Guide
guggcauaguuuguaaacugg

SEQ ID NO: 29570 - RNA, 21 nt, Artificial Sequence
  ELANE RNA Guide
guuuacaaacuaugccaccgg

SEQ ID NO: 29571 - RNA, 21 nt, Artificial Sequence
  ELANE RNA Guide
uacaaacuaugccaccggggc

SEQ ID NO: 29572 - RNA, 21 nt, Artificial Sequence
  ELANE RNA Guide
uaugccaccggggcaaaggca

SEQ ID NO: 29573 - RNA, 21 nt, Artificial Sequence
  ELANE RNA Guide
uccaguuuacaaacuaugcca

SEQ ID NO: 29574 - RNA, 21 nt, Artificial Sequence
  ELANE RNA Guide
ucgauccaguuuacaaacuau

SEQ ID NO: 29575 - RNA, 21 nt, Artificial Sequence
  ELANE RNA Guide
ugccccgguggcauaguuugu

SEQ ID NO: 29576 - RNA, 21 nt, Artificial Sequence
  ELANE RNA Guide
ugccuuugccccgguggcaua

SEQ ID NO: 29577 - RNA, 21 nt, Artificial Sequence
  ELANE RNA Guide
uggcauaguuuguaaacugga

SEQ ID NO: 29578 - RNA, 21 nt, Artificial Sequence
  ELANE RNA Guide
uuacaaacuaugccaccgggg

SEQ ID NO: 29579 - RNA, 21 nt, Artificial Sequence
  ELANE RNA Guide
uugccccgguggcauaguuug

SEQ ID NO: 29580 - RNA, 21 nt, Artificial Sequence
  ELANE RNA Guide
uuuacaaacuaugccaccggg

SEQ ID NO: 29581 - RNA, 21 nt, Artificial Sequence
  ELANE RNA Guide
uuugccccgguggcauaguuu

SEQ ID NO: 29582 - RNA, 22 nt, Artificial Sequence
  ELANE RNA Guide
aaacuaugccaccggggcaaag

SEQ ID NO: 29583 - RNA, 22 nt, Artificial Sequence
  ELANE RNA Guide
aacuaugccaccggggcaaagg

SEQ ID NO: 29584 - RNA, 22 nt, Artificial Sequence
  ELANE RNA Guide
acaaacuaugccaccggggcaa

SEQ ID NO: 29585 - RNA, 22 nt, Artificial Sequence
  ELANE RNA Guide
acuaugccaccggggcaaaggc

SEQ ID NO: 29586 - RNA, 22 nt, Artificial Sequence
  ELANE RNA Guide
agucgauccaguuuacaaacua

SEQ ID NO: 29587 - RNA, 22 nt, Artificial Sequence
  ELANE RNA Guide
aguuuacaaacuaugccaccgg

SEQ ID NO: 29588 - RNA, 22 nt, Artificial Sequence
  ELANE RNA Guide
auaguuuguaaacuggaucgac

SEQ ID NO: 29589 - RNA, 22 nt, Artificial Sequence
  ELANE RNA Guide
auccaguuuacaaacuaugcca

SEQ ID NO: 29590 - RNA, 22 nt, Artificial Sequence
  ELANE RNA Guide
augccuuugccccgguggcaua

SEQ ID NO: 29591 - RNA, 22 nt, Artificial Sequence
  ELANE RNA Guide
caaacuaugccaccggggcaaa

SEQ ID NO: 29592 - RNA, 22 nt, Artificial Sequence
  ELANE RNA Guide
caguuuacaaacuaugccaccg

SEQ ID NO: 29593 - RNA, 22 nt, Artificial Sequence
  ELANE RNA Guide
cauaguuuguaaacuggaucga

SEQ ID NO: 29594 - RNA, 22 nt, Artificial Sequence
  ELANE RNA Guide
ccaguuuacaaacuaugccacc

SEQ ID NO: 29595 - RNA, 22 nt, Artificial Sequence
  ELANE RNA Guide
ccccgaugccuuugccccggug

SEQ ID NO: 29596 - RNA, 22 nt, Artificial Sequence
  ELANE RNA Guide
ccccgguggcauaguuuguaaa

SEQ ID NO: 29597 - RNA, 22 nt, Artificial Sequence
  ELANE RNA Guide
cccgguggcauaguuuguaaac

SEQ ID NO: 29598 - RNA, 22 nt, Artificial Sequence
  ELANE RNA Guide
ccgguggcauaguuuguaaacu

SEQ ID NO: 29599 - RNA, 22 nt, Artificial Sequence
  ELANE RNA Guide
ccuuugccccgguggcauaguu

SEQ ID NO: 29600 - RNA, 22 nt, Artificial Sequence
  ELANE RNA Guide
cgauccaguuuacaaacuaugc

SEQ ID NO: 29601 - RNA, 22 nt, Artificial Sequence
  ELANE RNA Guide
cgguggcauaguuuguaaacug

SEQ ID NO: 29602 - RNA, 22 nt, Artificial Sequence
  ELANE RNA Guide
cuaugccaccggggcaaaggca

SEQ ID NO: 29603 - RNA, 22 nt, Artificial Sequence
  ELANE RNA Guide
cuuugccccgguggcauaguuu

SEQ ID NO: 29604 - RNA, 22 nt, Artificial Sequence
  ELANE RNA Guide
gagucgauccaguuuacaaacu

SEQ ID NO: 29605 - RNA, 22 nt, Artificial Sequence
  ELANE RNA Guide
gauccaguuuacaaacuaugcc

SEQ ID NO: 29606 - RNA, 22 nt, Artificial Sequence
  ELANE RNA Guide
gaugccuuugccccgguggcau

SEQ ID NO: 29607 - RNA, 22 nt, Artificial Sequence
  ELANE RNA Guide
gcauaguuuguaaacuggaucg

SEQ ID NO: 29608 - RNA, 22 nt, Artificial Sequence
  ELANE RNA Guide
gccccgguggcauaguuuguaa

SEQ ID NO: 29609 - RNA, 22 nt, Artificial Sequence
  ELANE RNA Guide
gccuuugccccgguggcauagu

SEQ ID NO: 29610 - RNA, 22 nt, Artificial Sequence
  ELANE RNA Guide
ggcauaguuuguaaacuggauc

SEQ ID NO: 29611 - RNA, 22 nt, Artificial Sequence
  ELANE RNA Guide
gguggcauaguuuguaaacugg

SEQ ID NO: 29612 - RNA, 22 nt, Artificial Sequence
  ELANE RNA Guide
gucgauccaguuuacaaacuau

SEQ ID NO: 29613 - RNA, 22 nt, Artificial Sequence
  ELANE RNA Guide
guggcauaguuuguaaacugga

SEQ ID NO: 29614 - RNA, 22 nt, Artificial Sequence
  ELANE RNA Guide
guuuacaaacuaugccaccggg

SEQ ID NO: 29615 - RNA, 22 nt, Artificial Sequence
  ELANE RNA Guide
uacaaacuaugccaccggggca

SEQ ID NO: 29616 - RNA, 22 nt, Artificial Sequence
  ELANE RNA Guide
uaugccaccggggcaaaggcau

SEQ ID NO: 29617 - RNA, 22 nt, Artificial Sequence
  ELANE RNA Guide
uccaguuuacaaacuaugccac

SEQ ID NO: 29618 - RNA, 22 nt, Artificial Sequence
  ELANE RNA Guide
ucgauccaguuuacaaacuaug

SEQ ID NO: 29619 - RNA, 22 nt, Artificial Sequence
  ELANE RNA Guide
ugccccgguggcauaguuugua

SEQ ID NO: 29620 - RNA, 22 nt, Artificial Sequence
  ELANE RNA Guide
ugccuuugccccgguggcauag

SEQ ID NO: 29621 - RNA, 22 nt, Artificial Sequence
  ELANE RNA Guide
uggcauaguuuguaaacuggau

SEQ ID NO: 29622 - RNA, 22 nt, Artificial Sequence
  ELANE RNA Guide
uuacaaacuaugccaccggggc

SEQ ID NO: 29623 - RNA, 22 nt, Artificial Sequence
  ELANE RNA Guide
uugccccgguggcauaguuugu

SEQ ID NO: 29624 - RNA, 22 nt, Artificial Sequence
  ELANE RNA Guide
uuuacaaacuaugccaccgggg

SEQ ID NO: 29625 - RNA, 22 nt, Artificial Sequence
  ELANE RNA Guide
uuugccccgguggcauaguuug

SEQ ID NO: 29626 - RNA, 20 nt, Artificial Sequence
  ELANE RNA Guide
aaaccggaucgacucuauca

SEQ ID NO: 29627 - RNA, 20 nt, Artificial Sequence
  ELANE RNA Guide
aaccggaucgacucuaucau

SEQ ID NO: 29628 - RNA, 20 nt, Artificial Sequence
  ELANE RNA Guide
acaguuuguaaaccggaucg

SEQ ID NO: 29629 - RNA, 20 nt, Artificial Sequence
  ELANE RNA Guide
accggaucgacucuaucauc

SEQ ID NO: 29630 - RNA, 20 nt, Artificial Sequence
  ELANE RNA Guide
agagucgauccgguuuacaa

SEQ ID NO: 29631 - RNA, 20 nt, Artificial Sequence
  ELANE RNA Guide
agucgauccgguuuacaaac

SEQ ID NO: 29632 - RNA, 20 nt, Artificial Sequence
  ELANE RNA Guide
aguuuguaaaccggaucgac

SEQ ID NO: 29633 - RNA, 20 nt, Artificial Sequence
  ELANE RNA Guide
auagagucgauccgguuuac

SEQ ID NO: 29634 - RNA, 20 nt, Artificial Sequence
  ELANE RNA Guide
auccgguuuacaaacugugc

SEQ ID NO: 29635 - RNA, 20 nt, Artificial Sequence
  ELANE RNA Guide
augauagagucgauccgguu

SEQ ID NO: 29636 - RNA, 20 nt, Artificial Sequence
  ELANE RNA Guide
cacaguuuguaaaccggauc

SEQ ID NO: 29637 - RNA, 20 nt, Artificial Sequence
  ELANE RNA Guide
caguuuguaaaccggaucga

SEQ ID NO: 29638 - RNA, 20 nt, Artificial Sequence
  ELANE RNA Guide
ccccgguggcacaguuugua

SEQ ID NO: 29639 - RNA, 20 nt, Artificial Sequence
  ELANE RNA Guide
cccgguggcacaguuuguaa

SEQ ID NO: 29640 - RNA, 20 nt, Artificial Sequence
  ELANE RNA Guide
ccggaucgacucuaucaucc

SEQ ID NO: 29641 - RNA, 20 nt, Artificial Sequence
  ELANE RNA Guide
ccgguggcacaguuuguaaa

SEQ ID NO: 29642 - RNA, 20 nt, Artificial Sequence
  ELANE RNA Guide
ccgguuuacaaacugugcca

SEQ ID NO: 29643 - RNA, 20 nt, Artificial Sequence
  ELANE RNA Guide
cgauccgguuuacaaacugu

SEQ ID NO: 29644 - RNA, 20 nt, Artificial Sequence
  ELANE RNA Guide
cgguggcacaguuuguaaac

SEQ ID NO: 29645 - RNA, 20 nt, Artificial Sequence
  ELANE RNA Guide
cgguuuacaaacugugccac

SEQ ID NO: 29646 - RNA, 20 nt, Artificial Sequence
  ELANE RNA Guide
cguuggaugauagagucgau

SEQ ID NO: 29647 - RNA, 20 nt, Artificial Sequence
  ELANE RNA Guide
gagucgauccgguuuacaaa

SEQ ID NO: 29648 - RNA, 20 nt, Artificial Sequence
  ELANE RNA Guide
gauagagucgauccgguuua

SEQ ID NO: 29649 - RNA, 20 nt, Artificial Sequence
  ELANE RNA Guide
gauccgguuuacaaacugug

SEQ ID NO: 29650 - RNA, 20 nt, Artificial Sequence
  ELANE RNA Guide
gaugauagagucgauccggu

SEQ ID NO: 29651 - RNA, 20 nt, Artificial Sequence
  ELANE RNA Guide
gcacaguuuguaaaccggau

SEQ ID NO: 29652 - RNA, 20 nt, Artificial Sequence
  ELANE RNA Guide
gcguuggaugauagagucga

SEQ ID NO: 29653 - RNA, 20 nt, Artificial Sequence
  ELANE RNA Guide
ggaugauagagucgauccgg

SEQ ID NO: 29654 - RNA, 20 nt, Artificial Sequence
  ELANE RNA Guide
ggcacaguuuguaaaccgga

SEQ ID NO: 29655 - RNA, 20 nt, Artificial Sequence
  ELANE RNA Guide
gguggcacaguuuguaaacc

SEQ ID NO: 29656 - RNA, 20 nt, Artificial Sequence
  ELANE RNA Guide
guaaaccggaucgacucuau

SEQ ID NO: 29657 - RNA, 20 nt, Artificial Sequence
  ELANE RNA Guide
gucgauccgguuuacaaacu

SEQ ID NO: 29658 - RNA, 20 nt, Artificial Sequence
  ELANE RNA Guide
guggcacaguuuguaaaccg

SEQ ID NO: 29659 - RNA, 20 nt, Artificial Sequence
  ELANE RNA Guide
guuggaugauagagucgauc

SEQ ID NO: 29660 - RNA, 20 nt, Artificial Sequence
  ELANE RNA Guide
guuuguaaaccggaucgacu

SEQ ID NO: 29661 - RNA, 20 nt, Artificial Sequence
  ELANE RNA Guide
uaaaccggaucgacucuauc

SEQ ID NO: 29662 - RNA, 20 nt, Artificial Sequence
  ELANE RNA Guide
uagagucgauccgguuuaca

SEQ ID NO: 29663 - RNA, 20 nt, Artificial Sequence
  ELANE RNA Guide
uccgguuuacaaacugugcc

SEQ ID NO: 29664 - RNA, 20 nt, Artificial Sequence
  ELANE RNA Guide
ucgauccgguuuacaaacug

SEQ ID NO: 29665 - RNA, 20 nt, Artificial Sequence
  ELANE RNA Guide
ugauagagucgauccgguuu

SEQ ID NO: 29666 - RNA, 20 nt, Artificial Sequence
  ELANE RNA Guide
uggaugauagagucgauccg

SEQ ID NO: 29667 - RNA, 20 nt, Artificial Sequence
  ELANE RNA Guide
uggcacaguuuguaaaccgg

SEQ ID NO: 29668 - RNA, 20 nt, Artificial Sequence
  ELANE RNA Guide
uguaaaccggaucgacucua

SEQ ID NO: 29669 - RNA, 20 nt, Artificial Sequence
  ELANE RNA Guide
uuggaugauagagucgaucc

SEQ ID NO: 29670 - RNA, 20 nt, Artificial Sequence
  ELANE RNA Guide
uuguaaaccggaucgacucu

SEQ ID NO: 29671 - RNA, 20 nt, Artificial Sequence
  ELANE RNA Guide
uuuguaaaccggaucgacuc

SEQ ID NO: 29672 - RNA, 21 nt, Artificial Sequence
  ELANE RNA Guide
aaaccggaucgacucuaucau

SEQ ID NO: 29673 - RNA, 21 nt, Artificial Sequence
  ELANE RNA Guide
aaccggaucgacucuaucauc

SEQ ID NO: 29674 - RNA, 21 nt, Artificial Sequence
  ELANE RNA Guide
acaguuuguaaaccggaucga

SEQ ID NO: 29675 - RNA, 21 nt, Artificial Sequence
  ELANE RNA Guide
accggaucgacucuaucaucc

SEQ ID NO: 29676 - RNA, 21 nt, Artificial Sequence
  ELANE RNA Guide
agagucgauccgguuuacaaa

SEQ ID NO: 29677 - RNA, 21 nt, Artificial Sequence
  ELANE RNA Guide
agcguuggaugauagagucga

SEQ ID NO: 29678 - RNA, 21 nt, Artificial Sequence
  ELANE RNA Guide
agucgauccgguuuacaaacu

SEQ ID NO: 29679 - RNA, 21 nt, Artificial Sequence
  ELANE RNA Guide
aguuuguaaaccggaucgacu

SEQ ID NO: 29680 - RNA, 21 nt, Artificial Sequence
  ELANE RNA Guide
auagagucgauccgguuuaca

SEQ ID NO: 29681 - RNA, 21 nt, Artificial Sequence
  ELANE RNA Guide
auccgguuuacaaacugugcc

SEQ ID NO: 29682 - RNA, 21 nt, Artificial Sequence
  ELANE RNA Guide
augauagagucgauccgguuu

SEQ ID NO: 29683 - RNA, 21 nt, Artificial Sequence
  ELANE RNA Guide
cacaguuuguaaaccggaucg

SEQ ID NO: 29684 - RNA, 21 nt, Artificial Sequence
  ELANE RNA Guide
caguuuguaaaccggaucgac

SEQ ID NO: 29685 - RNA, 21 nt, Artificial Sequence
  ELANE RNA Guide
ccccgguggcacaguuuguaa

SEQ ID NO: 29686 - RNA, 21 nt, Artificial Sequence
  ELANE RNA Guide
cccgguggcacaguuuguaaa

SEQ ID NO: 29687 - RNA, 21 nt, Artificial Sequence
  ELANE RNA Guide
ccggaucgacucuaucaucca

SEQ ID NO: 29688 - RNA, 21 nt, Artificial Sequence
  ELANE RNA Guide
ccgguggcacaguuuguaaac

SEQ ID NO: 29689 - RNA, 21 nt, Artificial Sequence
  ELANE RNA Guide
ccgguuuacaaacugugccac

SEQ ID NO: 29690 - RNA, 21 nt, Artificial Sequence
  ELANE RNA Guide
cgauccgguuuacaaacugug

SEQ ID NO: 29691 - RNA, 21 nt, Artificial Sequence
  ELANE RNA Guide
cgguggcacaguuuguaaacc

SEQ ID NO: 29692 - RNA, 21 nt, Artificial Sequence
  ELANE RNA Guide
cgguuuacaaacugugccacc

SEQ ID NO: 29693 - RNA, 21 nt, Artificial Sequence
  ELANE RNA Guide
cguuggaugauagagucgauc

SEQ ID NO: 29694 - RNA, 21 nt, Artificial Sequence
  ELANE RNA Guide
gagucgauccgguuuacaaac

SEQ ID NO: 29695 - RNA, 21 nt, Artificial Sequence
  ELANE RNA Guide
gauagagucgauccgguuuac

SEQ ID NO: 29696 - RNA, 21 nt, Artificial Sequence
  ELANE RNA Guide
gauccgguuuacaaacugugc

SEQ ID NO: 29697 - RNA, 21 nt, Artificial Sequence
  ELANE RNA Guide
gaugauagagucgauccgguu

SEQ ID NO: 29698 - RNA, 21 nt, Artificial Sequence
  ELANE RNA Guide
gcacaguuuguaaaccggauc

SEQ ID NO: 29699 - RNA, 21 nt, Artificial Sequence
  ELANE RNA Guide
gccccgguggcacaguuugua

SEQ ID NO: 29700 - RNA, 21 nt, Artificial Sequence
  ELANE RNA Guide
gcguuggaugauagagucgau

SEQ ID NO: 29701 - RNA, 21 nt, Artificial Sequence
  ELANE RNA Guide
ggaugauagagucgauccggu

SEQ ID NO: 29702 - RNA, 21 nt, Artificial Sequence
  ELANE RNA Guide
ggcacaguuuguaaaccggau

SEQ ID NO: 29703 - RNA, 21 nt, Artificial Sequence
  ELANE RNA Guide
gguggcacaguuuguaaaccg

SEQ ID NO: 29704 - RNA, 21 nt, Artificial Sequence
  ELANE RNA Guide
guaaaccggaucgacucuauc

SEQ ID NO: 29705 - RNA, 21 nt, Artificial Sequence
  ELANE RNA Guide
gucgauccgguuuacaaacug

SEQ ID NO: 29706 - RNA, 21 nt, Artificial Sequence
  ELANE RNA Guide
guggcacaguuuguaaaccgg

SEQ ID NO: 29707 - RNA, 21 nt, Artificial Sequence
  ELANE RNA Guide
guuggaugauagagucgaucc

SEQ ID NO: 29708 - RNA, 21 nt, Artificial Sequence
  ELANE RNA Guide
guuuguaaaccggaucgacuc

SEQ ID NO: 29709 - RNA, 21 nt, Artificial Sequence
  ELANE RNA Guide
uaaaccggaucgacucuauca

SEQ ID NO: 29710 - RNA, 21 nt, Artificial Sequence
  ELANE RNA Guide
uagagucgauccgguuuacaa

SEQ ID NO: 29711 - RNA, 21 nt, Artificial Sequence
  ELANE RNA Guide
uccgguuuacaaacugugcca

SEQ ID NO: 29712 - RNA, 21 nt, Artificial Sequence
  ELANE RNA Guide
ucgauccgguuuacaaacugu

SEQ ID NO: 29713 - RNA, 21 nt, Artificial Sequence
  ELANE RNA Guide
ugauagagucgauccgguuua

SEQ ID NO: 29714 - RNA, 21 nt, Artificial Sequence
  ELANE RNA Guide
uggaugauagagucgauccgg

SEQ ID NO: 29715 - RNA, 21 nt, Artificial Sequence
  ELANE RNA Guide
uggcacaguuuguaaaccgga

SEQ ID NO: 29716 - RNA, 21 nt, Artificial Sequence
  ELANE RNA Guide
uguaaaccggaucgacucuau

SEQ ID NO: 29717 - RNA, 21 nt, Artificial Sequence
  ELANE RNA Guide
uuggaugauagagucgauccg

SEQ ID NO: 29718 - RNA, 21 nt, Artificial Sequence
  ELANE RNA Guide
uuguaaaccggaucgacucua

SEQ ID NO: 29719 - RNA, 21 nt, Artificial Sequence
  ELANE RNA Guide
uuuguaaaccggaucgacucu

SEQ ID NO: 29720 - RNA, 22 nt, Artificial Sequence
  ELANE RNA Guide
aaaccggaucgacucuaucauc

SEQ ID NO: 29721 - RNA, 22 nt, Artificial Sequence
  ELANE RNA Guide
aaccggaucgacucuaucaucc

SEQ ID NO: 29722 - RNA, 22 nt, Artificial Sequence
  ELANE RNA Guide
acaguuuguaaaccggaucgac

SEQ ID NO: 29723 - RNA, 22 nt, Artificial Sequence
  ELANE RNA Guide
accggaucgacucuaucaucca

SEQ ID NO: 29724 - RNA, 22 nt, Artificial Sequence
  ELANE RNA Guide
agagucgauccgguuuacaaac

SEQ ID NO: 29725 - RNA, 22 nt, Artificial Sequence
  ELANE RNA Guide
agcguuggaugauagagucgau

SEQ ID NO: 29726 - RNA, 22 nt, Artificial Sequence
  ELANE RNA Guide
agucgauccgguuuacaaacug

SEQ ID NO: 29727 - RNA, 22 nt, Artificial Sequence
  ELANE RNA Guide
aguuuguaaaccggaucgacuc

SEQ ID NO: 29728 - RNA, 22 nt, Artificial Sequence
  ELANE RNA Guide
auagagucgauccgguuuacaa

SEQ ID NO: 29729 - RNA, 22 nt, Artificial Sequence
  ELANE RNA Guide
auccgguuuacaaacugugcca

SEQ ID NO: 29730 - RNA, 22 nt, Artificial Sequence
  ELANE RNA Guide
augauagagucgauccgguuua

SEQ ID NO: 29731 - RNA, 22 nt, Artificial Sequence
  ELANE RNA Guide
cacaguuuguaaaccggaucga

SEQ ID NO: 29732 - RNA, 22 nt, Artificial Sequence
  ELANE RNA Guide
caguuuguaaaccggaucgacu

SEQ ID NO: 29733 - RNA, 22 nt, Artificial Sequence
  ELANE RNA Guide
ccccgguggcacaguuuguaaa

SEQ ID NO: 29734 - RNA, 22 nt, Artificial Sequence
  ELANE RNA Guide
cccgguggcacaguuuguaaac

SEQ ID NO: 29735 - RNA, 22 nt, Artificial Sequence
  ELANE RNA Guide
ccggaucgacucuaucauccaa

SEQ ID NO: 29736 - RNA, 22 nt, Artificial Sequence
  ELANE RNA Guide
ccgguggcacaguuuguaaacc

SEQ ID NO: 29737 - RNA, 22 nt, Artificial Sequence
  ELANE RNA Guide
ccgguuuacaaacugugccacc

SEQ ID NO: 29738 - RNA, 22 nt, Artificial Sequence
  ELANE RNA Guide
cgauccgguuuacaaacugugc

SEQ ID NO: 29739 - RNA, 22 nt, Artificial Sequence
  ELANE RNA Guide
cgguggcacaguuuguaaaccg

SEQ ID NO: 29740 - RNA, 22 nt, Artificial Sequence
  ELANE RNA Guide
cgguuuacaaacugugccaccg

SEQ ID NO: 29741 - RNA, 22 nt, Artificial Sequence
  ELANE RNA Guide
cguuggaugauagagucgaucc

SEQ ID NO: 29742 - RNA, 22 nt, Artificial Sequence
  ELANE RNA Guide
gagcguuggaugauagagucga

SEQ ID NO: 29743 - RNA, 22 nt, Artificial Sequence
  ELANE RNA Guide
gagucgauccgguuuacaaacu

SEQ ID NO: 29744 - RNA, 22 nt, Artificial Sequence
  ELANE RNA Guide
gauagagucgauccgguuuaca

SEQ ID NO: 29745 - RNA, 22 nt, Artificial Sequence
  ELANE RNA Guide
gauccgguuuacaaacugugcc

SEQ ID NO: 29746 - RNA, 22 nt, Artificial Sequence
  ELANE RNA Guide
gaugauagagucgauccgguuu

SEQ ID NO: 29747 - RNA, 22 nt, Artificial Sequence
  ELANE RNA Guide
gcacaguuuguaaaccggaucg

SEQ ID NO: 29748 - RNA, 22 nt, Artificial Sequence
  ELANE RNA Guide
gccccgguggcacaguuuguaa

SEQ ID NO: 29749 - RNA, 22 nt, Artificial Sequence
  ELANE RNA Guide
gcguuggaugauagagucgauc

SEQ ID NO: 29750 - RNA, 22 nt, Artificial Sequence
  ELANE RNA Guide
ggaugauagagucgauccgguu

SEQ ID NO: 29751 - RNA, 22 nt, Artificial Sequence
  ELANE RNA Guide
ggcacaguuuguaaaccggauc

SEQ ID NO: 29752 - RNA, 22 nt, Artificial Sequence
  ELANE RNA Guide
gguggcacaguuuguaaaccgg

SEQ ID NO: 29753 - RNA, 22 nt, Artificial Sequence
  ELANE RNA Guide
guaaaccggaucgacucuauca

SEQ ID NO: 29754 - RNA, 22 nt, Artificial Sequence
  ELANE RNA Guide
gucgauccgguuuacaaacugu

SEQ ID NO: 29755 - RNA, 22 nt, Artificial Sequence
  ELANE RNA Guide
guggcacaguuuguaaaccgga

SEQ ID NO: 29756 - RNA, 22 nt, Artificial Sequence
  ELANE RNA Guide
guuggaugauagagucgauccg

SEQ ID NO: 29757 - RNA, 22 nt, Artificial Sequence
  ELANE RNA Guide
guuuguaaaccggaucgacucu

SEQ ID NO: 29758 - RNA, 22 nt, Artificial Sequence
  ELANE RNA Guide
uaaaccggaucgacucuaucau

SEQ ID NO: 29759 - RNA, 22 nt, Artificial Sequence
  ELANE RNA Guide
uagagucgauccgguuuacaaa

SEQ ID NO: 29760 - RNA, 22 nt, Artificial Sequence
  ELANE RNA Guide
uccgguuuacaaacugugccac

SEQ ID NO: 29761 - RNA, 22 nt, Artificial Sequence
  ELANE RNA Guide
ucgauccgguuuacaaacugug

SEQ ID NO: 29762 - RNA, 22 nt, Artificial Sequence
  ELANE RNA Guide
ugauagagucgauccgguuuac

SEQ ID NO: 29763 - RNA, 22 nt, Artificial Sequence
  ELANE RNA Guide
ugccccgguggcacaguuugua

SEQ ID NO: 29764 - RNA, 22 nt, Artificial Sequence
  ELANE RNA Guide
uggaugauagagucgauccggu

SEQ ID NO: 29765 - RNA, 22 nt, Artificial Sequence
  ELANE RNA Guide
uggcacaguuuguaaaccggau

SEQ ID NO: 29766 - RNA, 22 nt, Artificial Sequence
  ELANE RNA Guide
uguaaaccggaucgacucuauc

SEQ ID NO: 29767 - RNA, 22 nt, Artificial Sequence
  ELANE RNA Guide
uuggaugauagagucgauccgg

SEQ ID NO: 29768 - RNA, 22 nt, Artificial Sequence
  ELANE RNA Guide
uuguaaaccggaucgacucuau

SEQ ID NO: 29769 - RNA, 22 nt, Artificial Sequence
  ELANE RNA Guide
uuuguaaaccggaucgacucua

SEQ ID NO: 29770 - RNA, 20 nt, Artificial Sequence
  ELANE RNA Guide
aaacgggaucgacucuauca

SEQ ID NO: 29771 - RNA, 20 nt, Artificial Sequence
  ELANE RNA Guide
aacgggaucgacucuaucau

SEQ ID NO: 29772 - RNA, 20 nt, Artificial Sequence
  ELANE RNA Guide
acaguuuguaaacgggaucg

SEQ ID NO: 29773 - RNA, 20 nt, Artificial Sequence
  ELANE RNA Guide
acgggaucgacucuaucauc

SEQ ID NO: 29774 - RNA, 20 nt, Artificial Sequence
  ELANE RNA Guide
agagucgaucccguuuacaa

SEQ ID NO: 29775 - RNA, 20 nt, Artificial Sequence
  ELANE RNA Guide
agucgaucccguuuacaaac

SEQ ID NO: 29776 - RNA, 20 nt, Artificial Sequence
  ELANE RNA Guide
aguuuguaaacgggaucgac

SEQ ID NO: 29777 - RNA, 20 nt, Artificial Sequence
  ELANE RNA Guide
auagagucgaucccguuuac

SEQ ID NO: 29778 - RNA, 20 nt, Artificial Sequence
  ELANE RNA Guide
aucccguuuacaaacugugc

SEQ ID NO: 29779 - RNA, 20 nt, Artificial Sequence
  ELANE RNA Guide
augauagagucgaucccguu

SEQ ID NO: 29780 - RNA, 20 nt, Artificial Sequence
  ELANE RNA Guide
cacaguuuguaaacgggauc

SEQ ID NO: 29781 - RNA, 20 nt, Artificial Sequence
  ELANE RNA Guide
caguuuguaaacgggaucga

SEQ ID NO: 29782 - RNA, 20 nt, Artificial Sequence
  ELANE RNA Guide
cccguuuacaaacugugcca

SEQ ID NO: 29783 - RNA, 20 nt, Artificial Sequence
  ELANE RNA Guide
ccguuuacaaacugugccac

SEQ ID NO: 29784 - RNA, 20 nt, Artificial Sequence
  ELANE RNA Guide
cgaucccguuuacaaacugu

SEQ ID NO: 29785 - RNA, 20 nt, Artificial Sequence
  ELANE RNA Guide
cgggaucgacucuaucaucc

SEQ ID NO: 29786 - RNA, 20 nt, Artificial Sequence
  ELANE RNA Guide
gagucgaucccguuuacaaa

SEQ ID NO: 29787 - RNA, 20 nt, Artificial Sequence
  ELANE RNA Guide
gauagagucgaucccguuua

SEQ ID NO: 29788 - RNA, 20 nt, Artificial Sequence
  ELANE RNA Guide
gaucccguuuacaaacugug

SEQ ID NO: 29789 - RNA, 20 nt, Artificial Sequence
  ELANE RNA Guide
gaugauagagucgaucccgu

SEQ ID NO: 29790 - RNA, 20 nt, Artificial Sequence
  ELANE RNA Guide
gcacaguuuguaaacgggau

SEQ ID NO: 29791 - RNA, 20 nt, Artificial Sequence
  ELANE RNA Guide
ggaugauagagucgaucccg

SEQ ID NO: 29792 - RNA, 20 nt, Artificial Sequence
  ELANE RNA Guide
ggcacaguuuguaaacggga

SEQ ID NO: 29793 - RNA, 20 nt, Artificial Sequence
  ELANE RNA Guide
gguggcacaguuuguaaacg

SEQ ID NO: 29794 - RNA, 20 nt, Artificial Sequence
  ELANE RNA Guide
guaaacgggaucgacucuau

SEQ ID NO: 29795 - RNA, 20 nt, Artificial Sequence
  ELANE RNA Guide
gucgaucccguuuacaaacu

SEQ ID NO: 29796 - RNA, 20 nt, Artificial Sequence
  ELANE RNA Guide
guggcacaguuuguaaacgg

SEQ ID NO: 29797 - RNA, 20 nt, Artificial Sequence
  ELANE RNA Guide
guuuguaaacgggaucgacu

SEQ ID NO: 29798 - RNA, 20 nt, Artificial Sequence
  ELANE RNA Guide
uaaacgggaucgacucuauc

SEQ ID NO: 29799 - RNA, 20 nt, Artificial Sequence
  ELANE RNA Guide
uagagucgaucccguuuaca

SEQ ID NO: 29800 - RNA, 20 nt, Artificial Sequence
  ELANE RNA Guide
ucccguuuacaaacugugcc

SEQ ID NO: 29801 - RNA, 20 nt, Artificial Sequence
  ELANE RNA Guide
ucgaucccguuuacaaacug

SEQ ID NO: 29802 - RNA, 20 nt, Artificial Sequence
  ELANE RNA Guide
ugauagagucgaucccguuu

SEQ ID NO: 29803 - RNA, 20 nt, Artificial Sequence
  ELANE RNA Guide
uggaugauagagucgauccc

SEQ ID NO: 29804 - RNA, 20 nt, Artificial Sequence
  ELANE RNA Guide
uggcacaguuuguaaacggg

SEQ ID NO: 29805 - RNA, 20 nt, Artificial Sequence
  ELANE RNA Guide
uguaaacgggaucgacucua

SEQ ID NO: 29806 - RNA, 20 nt, Artificial Sequence
  ELANE RNA Guide
uuguaaacgggaucgacucu

SEQ ID NO: 29807 - RNA, 20 nt, Artificial Sequence
  ELANE RNA Guide
uuuguaaacgggaucgacuc

SEQ ID NO: 29808 - RNA, 21 nt, Artificial Sequence
  ELANE RNA Guide
aaacgggaucgacucuaucau

SEQ ID NO: 29809 - RNA, 21 nt, Artificial Sequence
  ELANE RNA Guide
aacgggaucgacucuaucauc

SEQ ID NO: 29810 - RNA, 21 nt, Artificial Sequence
  ELANE RNA Guide
acaguuuguaaacgggaucga

SEQ ID NO: 29811 - RNA, 21 nt, Artificial Sequence
  ELANE RNA Guide
acgggaucgacucuaucaucc

SEQ ID NO: 29812 - RNA, 21 nt, Artificial Sequence
  ELANE RNA Guide
agagucgaucccguuuacaaa

SEQ ID NO: 29813 - RNA, 21 nt, Artificial Sequence
  ELANE RNA Guide
agucgaucccguuuacaaacu

SEQ ID NO: 29814 - RNA, 21 nt, Artificial Sequence
  ELANE RNA Guide
aguuuguaaacgggaucgacu

SEQ ID NO: 29815 - RNA, 21 nt, Artificial Sequence
  ELANE RNA Guide
auagagucgaucccguuuaca

SEQ ID NO: 29816 - RNA, 21 nt, Artificial Sequence
  ELANE RNA Guide
aucccguuuacaaacugugcc

SEQ ID NO: 29817 - RNA, 21 nt, Artificial Sequence
  ELANE RNA Guide
augauagagucgaucccguuu

SEQ ID NO: 29818 - RNA, 21 nt, Artificial Sequence
  ELANE RNA Guide
cacaguuuguaaacgggaucg

SEQ ID NO: 29819 - RNA, 21 nt, Artificial Sequence
  ELANE RNA Guide
caguuuguaaacgggaucgac

SEQ ID NO: 29820 - RNA, 21 nt, Artificial Sequence
  ELANE RNA Guide
cccguuuacaaacugugccac

SEQ ID NO: 29821 - RNA, 21 nt, Artificial Sequence
  ELANE RNA Guide
ccguuuacaaacugugccacc

SEQ ID NO: 29822 - RNA, 21 nt, Artificial Sequence
  ELANE RNA Guide
cgaucccguuuacaaacugug

SEQ ID NO: 29823 - RNA, 21 nt, Artificial Sequence
  ELANE RNA Guide
cgggaucgacucuaucaucca

SEQ ID NO: 29824 - RNA, 21 nt, Artificial Sequence
  ELANE RNA Guide
cgguggcacaguuuguaaacg

SEQ ID NO: 29825 - RNA, 21 nt, Artificial Sequence
  ELANE RNA Guide
gagucgaucccguuuacaaac

SEQ ID NO: 29826 - RNA, 21 nt, Artificial Sequence
  ELANE RNA Guide
gauagagucgaucccguuuac

SEQ ID NO: 29827 - RNA, 21 nt, Artificial Sequence
  ELANE RNA Guide
gaucccguuuacaaacugugc

SEQ ID NO: 29828 - RNA, 21 nt, Artificial Sequence
  ELANE RNA Guide
gaugauagagucgaucccguu

SEQ ID NO: 29829 - RNA, 21 nt, Artificial Sequence
  ELANE RNA Guide
gcacaguuuguaaacgggauc

SEQ ID NO: 29830 - RNA, 21 nt, Artificial Sequence
  ELANE RNA Guide
ggaugauagagucgaucccgu

SEQ ID NO: 29831 - RNA, 21 nt, Artificial Sequence
  ELANE RNA Guide
ggcacaguuuguaaacgggau

SEQ ID NO: 29832 - RNA, 21 nt, Artificial Sequence
  ELANE RNA Guide
gguggcacaguuuguaaacgg

SEQ ID NO: 29833 - RNA, 21 nt, Artificial Sequence
  ELANE RNA Guide
guaaacgggaucgacucuauc

SEQ ID NO: 29834 - RNA, 21 nt, Artificial Sequence
  ELANE RNA Guide
gucgaucccguuuacaaacug

SEQ ID NO: 29835 - RNA, 21 nt, Artificial Sequence
  ELANE RNA Guide
guggcacaguuuguaaacggg

SEQ ID NO: 29836 - RNA, 21 nt, Artificial Sequence
  ELANE RNA Guide
guuuguaaacgggaucgacuc

SEQ ID NO: 29837 - RNA, 21 nt, Artificial Sequence
  ELANE RNA Guide
uaaacgggaucgacucuauca

SEQ ID NO: 29838 - RNA, 21 nt, Artificial Sequence
  ELANE RNA Guide
uagagucgaucccguuuacaa

SEQ ID NO: 29839 - RNA, 21 nt, Artificial Sequence
  ELANE RNA Guide
ucccguuuacaaacugugcca

SEQ ID NO: 29840 - RNA, 21 nt, Artificial Sequence
  ELANE RNA Guide
ucgaucccguuuacaaacugu

SEQ ID NO: 29841 - RNA, 21 nt, Artificial Sequence
  ELANE RNA Guide
ugauagagucgaucccguuua

SEQ ID NO: 29842 - RNA, 21 nt, Artificial Sequence
  ELANE RNA Guide
uggaugauagagucgaucccg

SEQ ID NO: 29843 - RNA, 21 nt, Artificial Sequence
  ELANE RNA Guide
uggcacaguuuguaaacggga

SEQ ID NO: 29844 - RNA, 21 nt, Artificial Sequence
  ELANE RNA Guide
uguaaacgggaucgacucuau

SEQ ID NO: 29845 - RNA, 21 nt, Artificial Sequence
  ELANE RNA Guide
uuggaugauagagucgauccc

SEQ ID NO: 29846 - RNA, 21 nt, Artificial Sequence
  ELANE RNA Guide
uuguaaacgggaucgacucua

SEQ ID NO: 29847 - RNA, 21 nt, Artificial Sequence
  ELANE RNA Guide
uuuguaaacgggaucgacucu

SEQ ID NO: 29848 - RNA, 22 nt, Artificial Sequence
  ELANE RNA Guide
aaacgggaucgacucuaucauc

SEQ ID NO: 29849 - RNA, 22 nt, Artificial Sequence
  ELANE RNA Guide
aacgggaucgacucuaucaucc

SEQ ID NO: 29850 - RNA, 22 nt, Artificial Sequence
  ELANE RNA Guide
acaguuuguaaacgggaucgac

SEQ ID NO: 29851 - RNA, 22 nt, Artificial Sequence
  ELANE RNA Guide
acgggaucgacucuaucaucca

SEQ ID NO: 29852 - RNA, 22 nt, Artificial Sequence
  ELANE RNA Guide
agagucgaucccguuuacaaac

SEQ ID NO: 29853 - RNA, 22 nt, Artificial Sequence
  ELANE RNA Guide
agucgaucccguuuacaaacug

SEQ ID NO: 29854 - RNA, 22 nt, Artificial Sequence
  ELANE RNA Guide
aguuuguaaacgggaucgacuc

SEQ ID NO: 29855 - RNA, 22 nt, Artificial Sequence
  ELANE RNA Guide
auagagucgaucccguuuacaa

SEQ ID NO: 29856 - RNA, 22 nt, Artificial Sequence
  ELANE RNA Guide
aucccguuuacaaacugugcca

SEQ ID NO: 29857 - RNA, 22 nt, Artificial Sequence
  ELANE RNA Guide
augauagagucgaucccguuua

SEQ ID NO: 29858 - RNA, 22 nt, Artificial Sequence
  ELANE RNA Guide
cacaguuuguaaacgggaucga

SEQ ID NO: 29859 - RNA, 22 nt, Artificial Sequence
  ELANE RNA Guide
caguuuguaaacgggaucgacu

SEQ ID NO: 29860 - RNA, 22 nt, Artificial Sequence
  ELANE RNA Guide
cccguuuacaaacugugccacc

SEQ ID NO: 29861 - RNA, 22 nt, Artificial Sequence
  ELANE RNA Guide
ccgguggcacaguuuguaaacg

SEQ ID NO: 29862 - RNA, 22 nt, Artificial Sequence
  ELANE RNA Guide
ccguuuacaaacugugccaccg

SEQ ID NO: 29863 - RNA, 22 nt, Artificial Sequence
  ELANE RNA Guide
cgaucccguuuacaaacugugc

SEQ ID NO: 29864 - RNA, 22 nt, Artificial Sequence
  ELANE RNA Guide
cgggaucgacucuaucauccaa

SEQ ID NO: 29865 - RNA, 22 nt, Artificial Sequence
  ELANE RNA Guide
cgguggcacaguuuguaaacgg

SEQ ID NO: 29866 - RNA, 22 nt, Artificial Sequence
  ELANE RNA Guide
gagucgaucccguuuacaaacu

SEQ ID NO: 29867 - RNA, 22 nt, Artificial Sequence
  ELANE RNA Guide
gauagagucgaucccguuuaca

SEQ ID NO: 29868 - RNA, 22 nt, Artificial Sequence
  ELANE RNA Guide
gaucccguuuacaaacugugcc

SEQ ID NO: 29869 - RNA, 22 nt, Artificial Sequence
  ELANE RNA Guide
gaugauagagucgaucccguuu

SEQ ID NO: 29870 - RNA, 22 nt, Artificial Sequence
  ELANE RNA Guide
gcacaguuuguaaacgggaucg

SEQ ID NO: 29871 - RNA, 22 nt, Artificial Sequence
  ELANE RNA Guide
ggaugauagagucgaucccguu

SEQ ID NO: 29872 - RNA, 22 nt, Artificial Sequence
  ELANE RNA Guide
ggcacaguuuguaaacgggauc

SEQ ID NO: 29873 - RNA, 22 nt, Artificial Sequence
  ELANE RNA Guide
gguggcacaguuuguaaacggg

SEQ ID NO: 29874 - RNA, 22 nt, Artificial Sequence
  ELANE RNA Guide
guaaacgggaucgacucuauca

SEQ ID NO: 29875 - RNA, 22 nt, Artificial Sequence
  ELANE RNA Guide
gucgaucccguuuacaaacugu

SEQ ID NO: 29876 - RNA, 22 nt, Artificial Sequence
  ELANE RNA Guide
guggcacaguuuguaaacggga

SEQ ID NO: 29877 - RNA, 22 nt, Artificial Sequence
  ELANE RNA Guide
guuggaugauagagucgauccc

SEQ ID NO: 29878 - RNA, 22 nt, Artificial Sequence
  ELANE RNA Guide
guuuguaaacgggaucgacucu

SEQ ID NO: 29879 - RNA, 22 nt, Artificial Sequence
  ELANE RNA Guide
uaaacgggaucgacucuaucau

SEQ ID NO: 29880 - RNA, 22 nt, Artificial Sequence
  ELANE RNA Guide
uagagucgaucccguuuacaaa

SEQ ID NO: 29881 - RNA, 22 nt, Artificial Sequence
  ELANE RNA Guide
ucccguuuacaaacugugccac

SEQ ID NO: 29882 - RNA, 22 nt, Artificial Sequence
  ELANE RNA Guide
ucgaucccguuuacaaacugug

SEQ ID NO: 29883 - RNA, 22 nt, Artificial Sequence
  ELANE RNA Guide
ugauagagucgaucccguuuac

SEQ ID NO: 29884 - RNA, 22 nt, Artificial Sequence
  ELANE RNA Guide
uggaugauagagucgaucccgu

SEQ ID NO: 29885 - RNA, 22 nt, Artificial Sequence
  ELANE RNA Guide
uggcacaguuuguaaacgggau

SEQ ID NO: 29886 - RNA, 22 nt, Artificial Sequence
  ELANE RNA Guide
uguaaacgggaucgacucuauc

SEQ ID NO: 29887 - RNA, 22 nt, Artificial Sequence
  ELANE RNA Guide
uuggaugauagagucgaucccg

SEQ ID NO: 29888 - RNA, 22 nt, Artificial Sequence
  ELANE RNA Guide
uuguaaacgggaucgacucuau

SEQ ID NO: 29889 - RNA, 22 nt, Artificial Sequence
  ELANE RNA Guide
uuuguaaacgggaucgacucua

SEQ ID NO: 29890 - RNA, 20 nt, Artificial Sequence
  ELANE RNA Guide
aaacugaaucgacucuauca

SEQ ID NO: 29891 - RNA, 20 nt, Artificial Sequence
  ELANE RNA Guide
aacugaaucgacucuaucau

SEQ ID NO: 29892 - RNA, 20 nt, Artificial Sequence
  ELANE RNA Guide
acaguuuguaaacugaaucg

SEQ ID NO: 29893 - RNA, 20 nt, Artificial Sequence
  ELANE RNA Guide
acugaaucgacucuaucauc

SEQ ID NO: 29894 - RNA, 20 nt, Artificial Sequence
  ELANE RNA Guide
agagucgauucaguuuacaa

SEQ ID NO: 29895 - RNA, 20 nt, Artificial Sequence
  ELANE RNA Guide
agcguuggaugauagagucg

SEQ ID NO: 29896 - RNA, 20 nt, Artificial Sequence
  ELANE RNA Guide
agucgauucaguuuacaaac

SEQ ID NO: 29897 - RNA, 20 nt, Artificial Sequence
  ELANE RNA Guide
aguuuguaaacugaaucgac

SEQ ID NO: 29898 - RNA, 20 nt, Artificial Sequence
  ELANE RNA Guide
auagagucgauucaguuuac

SEQ ID NO: 29899 - RNA, 20 nt, Artificial Sequence
  ELANE RNA Guide
augauagagucgauucaguu

SEQ ID NO: 29900 - RNA, 20 nt, Artificial Sequence
  ELANE RNA Guide
auucaguuuacaaacugugc

SEQ ID NO: 29901 - RNA, 20 nt, Artificial Sequence
  ELANE RNA Guide
cacaguuuguaaacugaauc

SEQ ID NO: 29902 - RNA, 20 nt, Artificial Sequence
  ELANE RNA Guide
caguuuguaaacugaaucga

SEQ ID NO: 29903 - RNA, 20 nt, Artificial Sequence
  ELANE RNA Guide
cgauucaguuuacaaacugu

SEQ ID NO: 29904 - RNA, 20 nt, Artificial Sequence
  ELANE RNA Guide
cugaaucgacucuaucaucc

SEQ ID NO: 29905 - RNA, 20 nt, Artificial Sequence
  ELANE RNA Guide
gaaucgacucuaucauccaa

SEQ ID NO: 29906 - RNA, 20 nt, Artificial Sequence
  ELANE RNA Guide
gagcguuggaugauagaguc

SEQ ID NO: 29907 - RNA, 20 nt, Artificial Sequence
  ELANE RNA Guide
gagucgauucaguuuacaaa

SEQ ID NO: 29908 - RNA, 20 nt, Artificial Sequence
  ELANE RNA Guide
gauagagucgauucaguuua

SEQ ID NO: 29909 - RNA, 20 nt, Artificial Sequence
  ELANE RNA Guide
gaugauagagucgauucagu

SEQ ID NO: 29910 - RNA, 20 nt, Artificial Sequence
  ELANE RNA Guide
gauucaguuuacaaacugug

SEQ ID NO: 29911 - RNA, 20 nt, Artificial Sequence
  ELANE RNA Guide
gcacaguuuguaaacugaau

SEQ ID NO: 29912 - RNA, 20 nt, Artificial Sequence
  ELANE RNA Guide
ggaugauagagucgauucag

SEQ ID NO: 29913 - RNA, 20 nt, Artificial Sequence
  ELANE RNA Guide
ggcacaguuuguaaacugaa

SEQ ID NO: 29914 - RNA, 20 nt, Artificial Sequence
  ELANE RNA Guide
gguggcacaguuuguaaacu

SEQ ID NO: 29915 - RNA, 20 nt, Artificial Sequence
  ELANE RNA Guide
guaaacugaaucgacucuau

SEQ ID NO: 29916 - RNA, 20 nt, Artificial Sequence
  ELANE RNA Guide
gucgauucaguuuacaaacu

SEQ ID NO: 29917 - RNA, 20 nt, Artificial Sequence
  ELANE RNA Guide
guggcacaguuuguaaacug

SEQ ID NO: 29918 - RNA, 20 nt, Artificial Sequence
  ELANE RNA Guide
guuggaugauagagucgauu

SEQ ID NO: 29919 - RNA, 20 nt, Artificial Sequence
  ELANE RNA Guide
guuuguaaacugaaucgacu

SEQ ID NO: 29920 - RNA, 20 nt, Artificial Sequence
  ELANE RNA Guide
uaaacugaaucgacucuauc

SEQ ID NO: 29921 - RNA, 20 nt, Artificial Sequence
  ELANE RNA Guide
uagagucgauucaguuuaca

SEQ ID NO: 29922 - RNA, 20 nt, Artificial Sequence
  ELANE RNA Guide
ucgauucaguuuacaaacug

SEQ ID NO: 29923 - RNA, 20 nt, Artificial Sequence
  ELANE RNA Guide
ugaaucgacucuaucaucca

SEQ ID NO: 29924 - RNA, 20 nt, Artificial Sequence
  ELANE RNA Guide
ugauagagucgauucaguuu

SEQ ID NO: 29925 - RNA, 20 nt, Artificial Sequence
  ELANE RNA Guide
uggaugauagagucgauuca

SEQ ID NO: 29926 - RNA, 20 nt, Artificial Sequence
  ELANE RNA Guide
uggcacaguuuguaaacuga

SEQ ID NO: 29927 - RNA, 20 nt, Artificial Sequence
  ELANE RNA Guide
uguaaacugaaucgacucua

SEQ ID NO: 29928 - RNA, 20 nt, Artificial Sequence
  ELANE RNA Guide
uucaguuuacaaacugugcc

SEQ ID NO: 29929 - RNA, 20 nt, Artificial Sequence
  ELANE RNA Guide
uuggaugauagagucgauuc

SEQ ID NO: 29930 - RNA, 20 nt, Artificial Sequence
  ELANE RNA Guide
uuguaaacugaaucgacucu

SEQ ID NO: 29931 - RNA, 20 nt, Artificial Sequence
  ELANE RNA Guide
uuuguaaacugaaucgacuc

SEQ ID NO: 29932 - RNA, 21 nt, Artificial Sequence
  ELANE RNA Guide
aaacugaaucgacucuaucau

SEQ ID NO: 29933 - RNA, 21 nt, Artificial Sequence
  ELANE RNA Guide
aacugaaucgacucuaucauc

SEQ ID NO: 29934 - RNA, 21 nt, Artificial Sequence
  ELANE RNA Guide
acaguuuguaaacugaaucga

SEQ ID NO: 29935 - RNA, 21 nt, Artificial Sequence
  ELANE RNA Guide
acugaaucgacucuaucaucc

SEQ ID NO: 29936 - RNA, 21 nt, Artificial Sequence
  ELANE RNA Guide
agagucgauucaguuuacaaa

SEQ ID NO: 29937 - RNA, 21 nt, Artificial Sequence
  ELANE RNA Guide
agucgauucaguuuacaaacu

SEQ ID NO: 29938 - RNA, 21 nt, Artificial Sequence
  ELANE RNA Guide
aguuuguaaacugaaucgacu

SEQ ID NO: 29939 - RNA, 21 nt, Artificial Sequence
  ELANE RNA Guide
auagagucgauucaguuuaca

SEQ ID NO: 29940 - RNA, 21 nt, Artificial Sequence
  ELANE RNA Guide
augauagagucgauucaguuu

SEQ ID NO: 29941 - RNA, 21 nt, Artificial Sequence
  ELANE RNA Guide
auucaguuuacaaacugugcc

SEQ ID NO: 29942 - RNA, 21 nt, Artificial Sequence
  ELANE RNA Guide
cacaguuuguaaacugaaucg

SEQ ID NO: 29943 - RNA, 21 nt, Artificial Sequence
  ELANE RNA Guide
caguuuguaaacugaaucgac

SEQ ID NO: 29944 - RNA, 21 nt, Artificial Sequence
  ELANE RNA Guide
cgauucaguuuacaaacugug

SEQ ID NO: 29945 - RNA, 21 nt, Artificial Sequence
  ELANE RNA Guide
cgguggcacaguuuguaaacu

SEQ ID NO: 29946 - RNA, 21 nt, Artificial Sequence
  ELANE RNA Guide
cguuggaugauagagucgauu

SEQ ID NO: 29947 - RNA, 21 nt, Artificial Sequence
  ELANE RNA Guide
cugaaucgacucuaucaucca

SEQ ID NO: 29948 - RNA, 21 nt, Artificial Sequence
  ELANE RNA Guide
gaaucgacucuaucauccaac

SEQ ID NO: 29949 - RNA, 21 nt, Artificial Sequence
  ELANE RNA Guide
gagcguuggaugauagagucg

SEQ ID NO: 29950 - RNA, 21 nt, Artificial Sequence
  ELANE RNA Guide
gagucgauucaguuuacaaac

SEQ ID NO: 29951 - RNA, 21 nt, Artificial Sequence
  ELANE RNA Guide
gauagagucgauucaguuuac

SEQ ID NO: 29952 - RNA, 21 nt, Artificial Sequence
  ELANE RNA Guide
gaugauagagucgauucaguu

SEQ ID NO: 29953 - RNA, 21 nt, Artificial Sequence
  ELANE RNA Guide
gauucaguuuacaaacugugc

SEQ ID NO: 29954 - RNA, 21 nt, Artificial Sequence
  ELANE RNA Guide
gcacaguuuguaaacugaauc

SEQ ID NO: 29955 - RNA, 21 nt, Artificial Sequence
  ELANE RNA Guide
ggagcguuggaugauagaguc

SEQ ID NO: 29956 - RNA, 21 nt, Artificial Sequence
  ELANE RNA Guide
ggaugauagagucgauucagu

SEQ ID NO: 29957 - RNA, 21 nt, Artificial Sequence
  ELANE RNA Guide
ggcacaguuuguaaacugaau

SEQ ID NO: 29958 - RNA, 21 nt, Artificial Sequence
  ELANE RNA Guide
gguggcacaguuuguaaacug

SEQ ID NO: 29959 - RNA, 21 nt, Artificial Sequence
  ELANE RNA Guide
guaaacugaaucgacucuauc

SEQ ID NO: 29960 - RNA, 21 nt, Artificial Sequence
  ELANE RNA Guide
gucgauucaguuuacaaacug

SEQ ID NO: 29961 - RNA, 21 nt, Artificial Sequence
  ELANE RNA Guide
guggcacaguuuguaaacuga

SEQ ID NO: 29962 - RNA, 21 nt, Artificial Sequence
  ELANE RNA Guide
guuggaugauagagucgauuc

SEQ ID NO: 29963 - RNA, 21 nt, Artificial Sequence
  ELANE RNA Guide
guuuguaaacugaaucgacuc

SEQ ID NO: 29964 - RNA, 21 nt, Artificial Sequence
  ELANE RNA Guide
uaaacugaaucgacucuauca

SEQ ID NO: 29965 - RNA, 21 nt, Artificial Sequence
  ELANE RNA Guide
uagagucgauucaguuuacaa

SEQ ID NO: 29966 - RNA, 21 nt, Artificial Sequence
  ELANE RNA Guide
ucgauucaguuuacaaacugu

SEQ ID NO: 29967 - RNA, 21 nt, Artificial Sequence
  ELANE RNA Guide
ugaaucgacucuaucauccaa

SEQ ID NO: 29968 - RNA, 21 nt, Artificial Sequence
  ELANE RNA Guide
ugauagagucgauucaguuua

SEQ ID NO: 29969 - RNA, 21 nt, Artificial Sequence
  ELANE RNA Guide
uggaugauagagucgauucag

SEQ ID NO: 29970 - RNA, 21 nt, Artificial Sequence
  ELANE RNA Guide
uggcacaguuuguaaacugaa

SEQ ID NO: 29971 - RNA, 21 nt, Artificial Sequence
  ELANE RNA Guide
uguaaacugaaucgacucuau

SEQ ID NO: 29972 - RNA, 21 nt, Artificial Sequence
  ELANE RNA Guide
uucaguuuacaaacugugcca

SEQ ID NO: 29973 - RNA, 21 nt, Artificial Sequence
  ELANE RNA Guide
uuggaugauagagucgauuca

SEQ ID NO: 29974 - RNA, 21 nt, Artificial Sequence
  ELANE RNA Guide
uuguaaacugaaucgacucua

SEQ ID NO: 29975 - RNA, 21 nt, Artificial Sequence
  ELANE RNA Guide
uuuguaaacugaaucgacucu

SEQ ID NO: 29976 - RNA, 22 nt, Artificial Sequence
  ELANE RNA Guide
aaacugaaucgacucuaucauc

SEQ ID NO: 29977 - RNA, 22 nt, Artificial Sequence
  ELANE RNA Guide
aacugaaucgacucuaucaucc

SEQ ID NO: 29978 - RNA, 22 nt, Artificial Sequence
  ELANE RNA Guide
acaguuuguaaacugaaucgac

SEQ ID NO: 29979 - RNA, 22 nt, Artificial Sequence
  ELANE RNA Guide
acugaaucgacucuaucaucca

SEQ ID NO: 29980 - RNA, 22 nt, Artificial Sequence
  ELANE RNA Guide
agagucgauucaguuuacaaac

SEQ ID NO: 29981 - RNA, 22 nt, Artificial Sequence
  ELANE RNA Guide
agucgauucaguuuacaaacug

SEQ ID NO: 29982 - RNA, 22 nt, Artificial Sequence
  ELANE RNA Guide
aguuuguaaacugaaucgacuc

SEQ ID NO: 29983 - RNA, 22 nt, Artificial Sequence
  ELANE RNA Guide
auagagucgauucaguuuacaa

SEQ ID NO: 29984 - RNA, 22 nt, Artificial Sequence
  ELANE RNA Guide
augauagagucgauucaguuua

SEQ ID NO: 29985 - RNA, 22 nt, Artificial Sequence
  ELANE RNA Guide
auucaguuuacaaacugugcca

SEQ ID NO: 29986 - RNA, 22 nt, Artificial Sequence
  ELANE RNA Guide
cacaguuuguaaacugaaucga

SEQ ID NO: 29987 - RNA, 22 nt, Artificial Sequence
  ELANE RNA Guide
caguuuguaaacugaaucgacu

SEQ ID NO: 29988 - RNA, 22 nt, Artificial Sequence
  ELANE RNA Guide
ccgguggcacaguuuguaaacu

SEQ ID NO: 29989 - RNA, 22 nt, Artificial Sequence
  ELANE RNA Guide
cgauucaguuuacaaacugugc

SEQ ID NO: 29990 - RNA, 22 nt, Artificial Sequence
  ELANE RNA Guide
cggagcguuggaugauagaguc

SEQ ID NO: 29991 - RNA, 22 nt, Artificial Sequence
  ELANE RNA Guide
cgguggcacaguuuguaaacug

SEQ ID NO: 29992 - RNA, 22 nt, Artificial Sequence
  ELANE RNA Guide
cguuggaugauagagucgauuc

SEQ ID NO: 29993 - RNA, 22 nt, Artificial Sequence
  ELANE RNA Guide
cugaaucgacucuaucauccaa

SEQ ID NO: 29994 - RNA, 22 nt, Artificial Sequence
  ELANE RNA Guide
gaaucgacucuaucauccaacg

SEQ ID NO: 29995 - RNA, 22 nt, Artificial Sequence
  ELANE RNA Guide
gagucgauucaguuuacaaacu

SEQ ID NO: 29996 - RNA, 22 nt, Artificial Sequence
  ELANE RNA Guide
gauagagucgauucaguuuaca

SEQ ID NO: 29997 - RNA, 22 nt, Artificial Sequence
  ELANE RNA Guide
gaugauagagucgauucaguuu

SEQ ID NO: 29998 - RNA, 22 nt, Artificial Sequence
  ELANE RNA Guide
gauucaguuuacaaacugugcc

SEQ ID NO: 29999 - RNA, 22 nt, Artificial Sequence
  ELANE RNA Guide
gcacaguuuguaaacugaaucg

SEQ ID NO: 30000 - RNA, 22 nt, Artificial Sequence
  ELANE RNA Guide
gcguuggaugauagagucgauu

SEQ ID NO: 30001 - RNA, 22 nt, Artificial Sequence
  ELANE RNA Guide
ggagcguuggaugauagagucg

SEQ ID NO: 30002 - RNA, 22 nt, Artificial Sequence
  ELANE RNA Guide
ggaugauagagucgauucaguu

SEQ ID NO: 30003 - RNA, 22 nt, Artificial Sequence
  ELANE RNA Guide
ggcacaguuuguaaacugaauc

SEQ ID NO: 30004 - RNA, 22 nt, Artificial Sequence
  ELANE RNA Guide
gguggcacaguuuguaaacuga

SEQ ID NO: 30005 - RNA, 22 nt, Artificial Sequence
  ELANE RNA Guide
guaaacugaaucgacucuauca

SEQ ID NO: 30006 - RNA, 22 nt, Artificial Sequence
  ELANE RNA Guide
gucgauucaguuuacaaacugu

SEQ ID NO: 30007 - RNA, 22 nt, Artificial Sequence
  ELANE RNA Guide
guggcacaguuuguaaacugaa

SEQ ID NO: 30008 - RNA, 22 nt, Artificial Sequence
  ELANE RNA Guide
guuggaugauagagucgauuca

SEQ ID NO: 30009 - RNA, 22 nt, Artificial Sequence
  ELANE RNA Guide
guuuguaaacugaaucgacucu

SEQ ID NO: 30010 - RNA, 22 nt, Artificial Sequence
  ELANE RNA Guide
uaaacugaaucgacucuaucau

SEQ ID NO: 30011 - RNA, 22 nt, Artificial Sequence
  ELANE RNA Guide
uagagucgauucaguuuacaaa

SEQ ID NO: 30012 - RNA, 22 nt, Artificial Sequence
  ELANE RNA Guide
ucgauucaguuuacaaacugug

SEQ ID NO: 30013 - RNA, 22 nt, Artificial Sequence
  ELANE RNA Guide
ugaaucgacucuaucauccaac

SEQ ID NO: 30014 - RNA, 22 nt, Artificial Sequence
  ELANE RNA Guide
ugauagagucgauucaguuuac

SEQ ID NO: 30015 - RNA, 22 nt, Artificial Sequence
  ELANE RNA Guide
uggaugauagagucgauucagu

SEQ ID NO: 30016 - RNA, 22 nt, Artificial Sequence
  ELANE RNA Guide
uggcacaguuuguaaacugaau

SEQ ID NO: 30017 - RNA, 22 nt, Artificial Sequence
  ELANE RNA Guide
uguaaacugaaucgacucuauc

SEQ ID NO: 30018 - RNA, 22 nt, Artificial Sequence
  ELANE RNA Guide
uucaguuuacaaacugugccac

SEQ ID NO: 30019 - RNA, 22 nt, Artificial Sequence
  ELANE RNA Guide
uuggaugauagagucgauucag

SEQ ID NO: 30020 - RNA, 22 nt, Artificial Sequence
  ELANE RNA Guide
uuguaaacugaaucgacucuau

SEQ ID NO: 30021 - RNA, 22 nt, Artificial Sequence
  ELANE RNA Guide
uuuguaaacugaaucgacucua

SEQ ID NO: 30022 - RNA, 20 nt, Artificial Sequence
  ELANE RNA Guide
aaacugcaucgacucuauca

SEQ ID NO: 30023 - RNA, 20 nt, Artificial Sequence
  ELANE RNA Guide
aacugcaucgacucuaucau

SEQ ID NO: 30024 - RNA, 20 nt, Artificial Sequence
  ELANE RNA Guide
acaguuuguaaacugcaucg

SEQ ID NO: 30025 - RNA, 20 nt, Artificial Sequence
  ELANE RNA Guide
acugcaucgacucuaucauc

SEQ ID NO: 30026 - RNA, 20 nt, Artificial Sequence
  ELANE RNA Guide
agagucgaugcaguuuacaa

SEQ ID NO: 30027 - RNA, 20 nt, Artificial Sequence
  ELANE RNA Guide
agucgaugcaguuuacaaac

SEQ ID NO: 30028 - RNA, 20 nt, Artificial Sequence
  ELANE RNA Guide
aguuuguaaacugcaucgac

SEQ ID NO: 30029 - RNA, 20 nt, Artificial Sequence
  ELANE RNA Guide
auagagucgaugcaguuuac

SEQ ID NO: 30030 - RNA, 20 nt, Artificial Sequence
  ELANE RNA Guide
augauagagucgaugcaguu

SEQ ID NO: 30031 - RNA, 20 nt, Artificial Sequence
  ELANE RNA Guide
augcaguuuacaaacugugc

SEQ ID NO: 30032 - RNA, 20 nt, Artificial Sequence
  ELANE RNA Guide
cacaguuuguaaacugcauc

SEQ ID NO: 30033 - RNA, 20 nt, Artificial Sequence
  ELANE RNA Guide
caguuuguaaacugcaucga

SEQ ID NO: 30034 - RNA, 20 nt, Artificial Sequence
  ELANE RNA Guide
cgaugcaguuuacaaacugu

SEQ ID NO: 30035 - RNA, 20 nt, Artificial Sequence
  ELANE RNA Guide
cugcaucgacucuaucaucc

SEQ ID NO: 30036 - RNA, 20 nt, Artificial Sequence
  ELANE RNA Guide
gagucgaugcaguuuacaaa

SEQ ID NO: 30037 - RNA, 20 nt, Artificial Sequence
  ELANE RNA Guide
gauagagucgaugcaguuua

SEQ ID NO: 30038 - RNA, 20 nt, Artificial Sequence
  ELANE RNA Guide
gaugauagagucgaugcagu

SEQ ID NO: 30039 - RNA, 20 nt, Artificial Sequence
  ELANE RNA Guide
gaugcaguuuacaaacugug

SEQ ID NO: 30040 - RNA, 20 nt, Artificial Sequence
  ELANE RNA Guide
gcacaguuuguaaacugcau

SEQ ID NO: 30041 - RNA, 20 nt, Artificial Sequence
  ELANE RNA Guide
gcaucgacucuaucauccaa

SEQ ID NO: 30042 - RNA, 20 nt, Artificial Sequence
  ELANE RNA Guide
ggaugauagagucgaugcag

SEQ ID NO: 30043 - RNA, 20 nt, Artificial Sequence
  ELANE RNA Guide
ggcacaguuuguaaacugca

SEQ ID NO: 30044 - RNA, 20 nt, Artificial Sequence
  ELANE RNA Guide
guaaacugcaucgacucuau

SEQ ID NO: 30045 - RNA, 20 nt, Artificial Sequence
  ELANE RNA Guide
gucgaugcaguuuacaaacu

SEQ ID NO: 30046 - RNA, 20 nt, Artificial Sequence
  ELANE RNA Guide
guuggaugauagagucgaug

SEQ ID NO: 30047 - RNA, 20 nt, Artificial Sequence
  ELANE RNA Guide
guuuguaaacugcaucgacu

SEQ ID NO: 30048 - RNA, 20 nt, Artificial Sequence
  ELANE RNA Guide
uaaacugcaucgacucuauc

SEQ ID NO: 30049 - RNA, 20 nt, Artificial Sequence
  ELANE RNA Guide
uagagucgaugcaguuuaca

SEQ ID NO: 30050 - RNA, 20 nt, Artificial Sequence
  ELANE RNA Guide
ucgaugcaguuuacaaacug

SEQ ID NO: 30051 - RNA, 20 nt, Artificial Sequence
  ELANE RNA Guide
ugauagagucgaugcaguuu

SEQ ID NO: 30052 - RNA, 20 nt, Artificial Sequence
  ELANE RNA Guide
ugcaguuuacaaacugugcc

SEQ ID NO: 30053 - RNA, 20 nt, Artificial Sequence
  ELANE RNA Guide
ugcaucgacucuaucaucca

SEQ ID NO: 30054 - RNA, 20 nt, Artificial Sequence
  ELANE RNA Guide
uggaugauagagucgaugca

SEQ ID NO: 30055 - RNA, 20 nt, Artificial Sequence
  ELANE RNA Guide
uggcacaguuuguaaacugc

SEQ ID NO: 30056 - RNA, 20 nt, Artificial Sequence
  ELANE RNA Guide
uguaaacugcaucgacucua

SEQ ID NO: 30057 - RNA, 20 nt, Artificial Sequence
  ELANE RNA Guide
uuggaugauagagucgaugc

SEQ ID NO: 30058 - RNA, 20 nt, Artificial Sequence
  ELANE RNA Guide
uuguaaacugcaucgacucu

SEQ ID NO: 30059 - RNA, 20 nt, Artificial Sequence
  ELANE RNA Guide
uuuguaaacugcaucgacuc

SEQ ID NO: 30060 - RNA, 21 nt, Artificial Sequence
  ELANE RNA Guide
aaacugcaucgacucuaucau

SEQ ID NO: 30061 - RNA, 21 nt, Artificial Sequence
  ELANE RNA Guide
aacugcaucgacucuaucauc

SEQ ID NO: 30062 - RNA, 21 nt, Artificial Sequence
  ELANE RNA Guide
acaguuuguaaacugcaucga

SEQ ID NO: 30063 - RNA, 21 nt, Artificial Sequence
  ELANE RNA Guide
acugcaucgacucuaucaucc

SEQ ID NO: 30064 - RNA, 21 nt, Artificial Sequence
  ELANE RNA Guide
agagucgaugcaguuuacaaa

SEQ ID NO: 30065 - RNA, 21 nt, Artificial Sequence
  ELANE RNA Guide
agucgaugcaguuuacaaacu

SEQ ID NO: 30066 - RNA, 21 nt, Artificial Sequence
  ELANE RNA Guide
aguuuguaaacugcaucgacu

SEQ ID NO: 30067 - RNA, 21 nt, Artificial Sequence
  ELANE RNA Guide
auagagucgaugcaguuuaca

SEQ ID NO: 30068 - RNA, 21 nt, Artificial Sequence
  ELANE RNA Guide
augauagagucgaugcaguuu

SEQ ID NO: 30069 - RNA, 21 nt, Artificial Sequence
  ELANE RNA Guide
augcaguuuacaaacugugcc

SEQ ID NO: 30070 - RNA, 21 nt, Artificial Sequence
  ELANE RNA Guide
cacaguuuguaaacugcaucg

SEQ ID NO: 30071 - RNA, 21 nt, Artificial Sequence
  ELANE RNA Guide
caguuuguaaacugcaucgac

SEQ ID NO: 30072 - RNA, 21 nt, Artificial Sequence
  ELANE RNA Guide
cgaugcaguuuacaaacugug

SEQ ID NO: 30073 - RNA, 21 nt, Artificial Sequence
  ELANE RNA Guide
cguuggaugauagagucgaug

SEQ ID NO: 30074 - RNA, 21 nt, Artificial Sequence
  ELANE RNA Guide
cugcaucgacucuaucaucca

SEQ ID NO: 30075 - RNA, 21 nt, Artificial Sequence
  ELANE RNA Guide
gagucgaugcaguuuacaaac

SEQ ID NO: 30076 - RNA, 21 nt, Artificial Sequence
  ELANE RNA Guide
gauagagucgaugcaguuuac

SEQ ID NO: 30077 - RNA, 21 nt, Artificial Sequence
  ELANE RNA Guide
gaugauagagucgaugcaguu

SEQ ID NO: 30078 - RNA, 21 nt, Artificial Sequence
  ELANE RNA Guide
gaugcaguuuacaaacugugc

SEQ ID NO: 30079 - RNA, 21 nt, Artificial Sequence
  ELANE RNA Guide
gcacaguuuguaaacugcauc

SEQ ID NO: 30080 - RNA, 21 nt, Artificial Sequence
  ELANE RNA Guide
gcaucgacucuaucauccaac

SEQ ID NO: 30081 - RNA, 21 nt, Artificial Sequence
  ELANE RNA Guide
ggaugauagagucgaugcagu

SEQ ID NO: 30082 - RNA, 21 nt, Artificial Sequence
  ELANE RNA Guide
ggcacaguuuguaaacugcau

SEQ ID NO: 30083 - RNA, 21 nt, Artificial Sequence
  ELANE RNA Guide
guaaacugcaucgacucuauc

SEQ ID NO: 30084 - RNA, 21 nt, Artificial Sequence
  ELANE RNA Guide
gucgaugcaguuuacaaacug

SEQ ID NO: 30085 - RNA, 21 nt, Artificial Sequence
  ELANE RNA Guide
guggcacaguuuguaaacugc

SEQ ID NO: 30086 - RNA, 21 nt, Artificial Sequence
  ELANE RNA Guide
guuggaugauagagucgaugc

SEQ ID NO: 30087 - RNA, 21 nt, Artificial Sequence
  ELANE RNA Guide
guuuguaaacugcaucgacuc

SEQ ID NO: 30088 - RNA, 21 nt, Artificial Sequence
  ELANE RNA Guide
uaaacugcaucgacucuauca

SEQ ID NO: 30089 - RNA, 21 nt, Artificial Sequence
  ELANE RNA Guide
uagagucgaugcaguuuacaa

SEQ ID NO: 30090 - RNA, 21 nt, Artificial Sequence
  ELANE RNA Guide
ucgaugcaguuuacaaacugu

SEQ ID NO: 30091 - RNA, 21 nt, Artificial Sequence
  ELANE RNA Guide
ugauagagucgaugcaguuua

SEQ ID NO: 30092 - RNA, 21 nt, Artificial Sequence
  ELANE RNA Guide
ugcaguuuacaaacugugcca

SEQ ID NO: 30093 - RNA, 21 nt, Artificial Sequence
  ELANE RNA Guide
ugcaucgacucuaucauccaa

SEQ ID NO: 30094 - RNA, 21 nt, Artificial Sequence
  ELANE RNA Guide
uggaugauagagucgaugcag

SEQ ID NO: 30095 - RNA, 21 nt, Artificial Sequence
  ELANE RNA Guide
uggcacaguuuguaaacugca

SEQ ID NO: 30096 - RNA, 21 nt, Artificial Sequence
  ELANE RNA Guide
uguaaacugcaucgacucuau

SEQ ID NO: 30097 - RNA, 21 nt, Artificial Sequence
  ELANE RNA Guide
uuggaugauagagucgaugca

SEQ ID NO: 30098 - RNA, 21 nt, Artificial Sequence
  ELANE RNA Guide
uuguaaacugcaucgacucua

SEQ ID NO: 30099 - RNA, 21 nt, Artificial Sequence
  ELANE RNA Guide
uuuguaaacugcaucgacucu

SEQ ID NO: 30100 - RNA, 22 nt, Artificial Sequence
  ELANE RNA Guide
aaacugcaucgacucuaucauc

SEQ ID NO: 30101 - RNA, 22 nt, Artificial Sequence
  ELANE RNA Guide
aacugcaucgacucuaucaucc

SEQ ID NO: 30102 - RNA, 22 nt, Artificial Sequence
  ELANE RNA Guide
acaguuuguaaacugcaucgac

SEQ ID NO: 30103 - RNA, 22 nt, Artificial Sequence
  ELANE RNA Guide
acugcaucgacucuaucaucca

SEQ ID NO: 30104 - RNA, 22 nt, Artificial Sequence
  ELANE RNA Guide
agagucgaugcaguuuacaaac

SEQ ID NO: 30105 - RNA, 22 nt, Artificial Sequence
  ELANE RNA Guide
agucgaugcaguuuacaaacug

SEQ ID NO: 30106 - RNA, 22 nt, Artificial Sequence
  ELANE RNA Guide
aguuuguaaacugcaucgacuc

SEQ ID NO: 30107 - RNA, 22 nt, Artificial Sequence
  ELANE RNA Guide
auagagucgaugcaguuuacaa

SEQ ID NO: 30108 - RNA, 22 nt, Artificial Sequence
  ELANE RNA Guide
augauagagucgaugcaguuua

SEQ ID NO: 30109 - RNA, 22 nt, Artificial Sequence
  ELANE RNA Guide
augcaguuuacaaacugugcca

SEQ ID NO: 30110 - RNA, 22 nt, Artificial Sequence
  ELANE RNA Guide
cacaguuuguaaacugcaucga

SEQ ID NO: 30111 - RNA, 22 nt, Artificial Sequence
  ELANE RNA Guide
caguuuguaaacugcaucgacu

SEQ ID NO: 30112 - RNA, 22 nt, Artificial Sequence
  ELANE RNA Guide
cgaugcaguuuacaaacugugc

SEQ ID NO: 30113 - RNA, 22 nt, Artificial Sequence
  ELANE RNA Guide
cguuggaugauagagucgaugc

SEQ ID NO: 30114 - RNA, 22 nt, Artificial Sequence
  ELANE RNA Guide
cugcaucgacucuaucauccaa

SEQ ID NO: 30115 - RNA, 22 nt, Artificial Sequence
  ELANE RNA Guide
gagucgaugcaguuuacaaacu

SEQ ID NO: 30116 - RNA, 22 nt, Artificial Sequence
  ELANE RNA Guide
gauagagucgaugcaguuuaca

SEQ ID NO: 30117 - RNA, 22 nt, Artificial Sequence
  ELANE RNA Guide
gaugauagagucgaugcaguuu

SEQ ID NO: 30118 - RNA, 22 nt, Artificial Sequence
  ELANE RNA Guide
gaugcaguuuacaaacugugcc

SEQ ID NO: 30119 - RNA, 22 nt, Artificial Sequence
  ELANE RNA Guide
gcacaguuuguaaacugcaucg

SEQ ID NO: 30120 - RNA, 22 nt, Artificial Sequence
  ELANE RNA Guide
gcaucgacucuaucauccaacg

SEQ ID NO: 30121 - RNA, 22 nt, Artificial Sequence
  ELANE RNA Guide
gcguuggaugauagagucgaug

SEQ ID NO: 30122 - RNA, 22 nt, Artificial Sequence
  ELANE RNA Guide
ggaugauagagucgaugcaguu

SEQ ID NO: 30123 - RNA, 22 nt, Artificial Sequence
  ELANE RNA Guide
ggcacaguuuguaaacugcauc

SEQ ID NO: 30124 - RNA, 22 nt, Artificial Sequence
  ELANE RNA Guide
gguggcacaguuuguaaacugc

SEQ ID NO: 30125 - RNA, 22 nt, Artificial Sequence
  ELANE RNA Guide
guaaacugcaucgacucuauca

SEQ ID NO: 30126 - RNA, 22 nt, Artificial Sequence
  ELANE RNA Guide
gucgaugcaguuuacaaacugu

SEQ ID NO: 30127 - RNA, 22 nt, Artificial Sequence
  ELANE RNA Guide
guggcacaguuuguaaacugca

SEQ ID NO: 30128 - RNA, 22 nt, Artificial Sequence
  ELANE RNA Guide
guuggaugauagagucgaugca

SEQ ID NO: 30129 - RNA, 22 nt, Artificial Sequence
  ELANE RNA Guide
guuuguaaacugcaucgacucu

SEQ ID NO: 30130 - RNA, 22 nt, Artificial Sequence
  ELANE RNA Guide
uaaacugcaucgacucuaucau

SEQ ID NO: 30131 - RNA, 22 nt, Artificial Sequence
  ELANE RNA Guide
uagagucgaugcaguuuacaaa

SEQ ID NO: 30132 - RNA, 22 nt, Artificial Sequence
  ELANE RNA Guide
ucgaugcaguuuacaaacugug

SEQ ID NO: 30133 - RNA, 22 nt, Artificial Sequence
  ELANE RNA Guide
ugauagagucgaugcaguuuac

SEQ ID NO: 30134 - RNA, 22 nt, Artificial Sequence
  ELANE RNA Guide
ugcaguuuacaaacugugccac

SEQ ID NO: 30135 - RNA, 22 nt, Artificial Sequence
  ELANE RNA Guide
ugcaucgacucuaucauccaac

SEQ ID NO: 30136 - RNA, 22 nt, Artificial Sequence
  ELANE RNA Guide
uggaugauagagucgaugcagu

SEQ ID NO: 30137 - RNA, 22 nt, Artificial Sequence
  ELANE RNA Guide
uggcacaguuuguaaacugcau

SEQ ID NO: 30138 - RNA, 22 nt, Artificial Sequence
  ELANE RNA Guide
uguaaacugcaucgacucuauc

SEQ ID NO: 30139 - RNA, 22 nt, Artificial Sequence
  ELANE RNA Guide
uuggaugauagagucgaugcag

SEQ ID NO: 30140 - RNA, 22 nt, Artificial Sequence
  ELANE RNA Guide
uuguaaacugcaucgacucuau

SEQ ID NO: 30141 - RNA, 22 nt, Artificial Sequence
  ELANE RNA Guide
uuuguaaacugcaucgacucua

SEQ ID NO: 30142 - RNA, 20 nt, Artificial Sequence
  ELANE RNA Guide
aaacugguucgacucuauca

SEQ ID NO: 30143 - RNA, 20 nt, Artificial Sequence
  ELANE RNA Guide
aaccaguuuacaaacugugc

SEQ ID NO: 30144 - RNA, 20 nt, Artificial Sequence
  ELANE RNA Guide
aacugguucgacucuaucau

SEQ ID NO: 30145 - RNA, 20 nt, Artificial Sequence
  ELANE RNA Guide
acaguuuguaaacugguucg

SEQ ID NO: 30146 - RNA, 20 nt, Artificial Sequence
  ELANE RNA Guide
acugguucgacucuaucauc

SEQ ID NO: 30147 - RNA, 20 nt, Artificial Sequence
  ELANE RNA Guide
agagucgaaccaguuuacaa

SEQ ID NO: 30148 - RNA, 20 nt, Artificial Sequence
  ELANE RNA Guide
agucgaaccaguuuacaaac

SEQ ID NO: 30149 - RNA, 20 nt, Artificial Sequence
  ELANE RNA Guide
aguuuguaaacugguucgac

SEQ ID NO: 30150 - RNA, 20 nt, Artificial Sequence
  ELANE RNA Guide
auagagucgaaccaguuuac

SEQ ID NO: 30151 - RNA, 20 nt, Artificial Sequence
  ELANE RNA Guide
augauagagucgaaccaguu

SEQ ID NO: 30152 - RNA, 20 nt, Artificial Sequence
  ELANE RNA Guide
cacaguuuguaaacugguuc

SEQ ID NO: 30153 - RNA, 20 nt, Artificial Sequence
  ELANE RNA Guide
caguuuguaaacugguucga

SEQ ID NO: 30154 - RNA, 20 nt, Artificial Sequence
  ELANE RNA Guide
cgaaccaguuuacaaacugu

SEQ ID NO: 30155 - RNA, 20 nt, Artificial Sequence
  ELANE RNA Guide
cguuggaugauagagucgaa

SEQ ID NO: 30156 - RNA, 20 nt, Artificial Sequence
  ELANE RNA Guide
cugguucgacucuaucaucc

SEQ ID NO: 30157 - RNA, 20 nt, Artificial Sequence
  ELANE RNA Guide
gaaccaguuuacaaacugug

SEQ ID NO: 30158 - RNA, 20 nt, Artificial Sequence
  ELANE RNA Guide
gagucgaaccaguuuacaaa

SEQ ID NO: 30159 - RNA, 20 nt, Artificial Sequence
  ELANE RNA Guide
gauagagucgaaccaguuua

SEQ ID NO: 30160 - RNA, 20 nt, Artificial Sequence
  ELANE RNA Guide
gaugauagagucgaaccagu

SEQ ID NO: 30161 - RNA, 20 nt, Artificial Sequence
  ELANE RNA Guide
gcacaguuuguaaacugguu

SEQ ID NO: 30162 - RNA, 20 nt, Artificial Sequence
  ELANE RNA Guide
ggagcguuggaugauagagu

SEQ ID NO: 30163 - RNA, 20 nt, Artificial Sequence
  ELANE RNA Guide
ggaugauagagucgaaccag

SEQ ID NO: 30164 - RNA, 20 nt, Artificial Sequence
  ELANE RNA Guide
ggcacaguuuguaaacuggu

SEQ ID NO: 30165 - RNA, 20 nt, Artificial Sequence
  ELANE RNA Guide
gguucgacucuaucauccaa

SEQ ID NO: 30166 - RNA, 20 nt, Artificial Sequence
  ELANE RNA Guide
guaaacugguucgacucuau

SEQ ID NO: 30167 - RNA, 20 nt, Artificial Sequence
  ELANE RNA Guide
gucgaaccaguuuacaaacu

SEQ ID NO: 30168 - RNA, 20 nt, Artificial Sequence
  ELANE RNA Guide
guucgacucuaucauccaac

SEQ ID NO: 30169 - RNA, 20 nt, Artificial Sequence
  ELANE RNA Guide
guuggaugauagagucgaac

SEQ ID NO: 30170 - RNA, 20 nt, Artificial Sequence
  ELANE RNA Guide
guuuguaaacugguucgacu

SEQ ID NO: 30171 - RNA, 20 nt, Artificial Sequence
  ELANE RNA Guide
uaaacugguucgacucuauc

SEQ ID NO: 30172 - RNA, 20 nt, Artificial Sequence
  ELANE RNA Guide
uagagucgaaccaguuuaca

SEQ ID NO: 30173 - RNA, 20 nt, Artificial Sequence
  ELANE RNA Guide
ucgaaccaguuuacaaacug

SEQ ID NO: 30174 - RNA, 20 nt, Artificial Sequence
  ELANE RNA Guide
ugauagagucgaaccaguuu

SEQ ID NO: 30175 - RNA, 20 nt, Artificial Sequence
  ELANE RNA Guide
uggaugauagagucgaacca

SEQ ID NO: 30176 - RNA, 20 nt, Artificial Sequence
  ELANE RNA Guide
uggcacaguuuguaaacugg

SEQ ID NO: 30177 - RNA, 20 nt, Artificial Sequence
  ELANE RNA Guide
ugguucgacucuaucaucca

SEQ ID NO: 30178 - RNA, 20 nt, Artificial Sequence
  ELANE RNA Guide
uguaaacugguucgacucua

SEQ ID NO: 30179 - RNA, 20 nt, Artificial Sequence
  ELANE RNA Guide
uuggaugauagagucgaacc

SEQ ID NO: 30180 - RNA, 20 nt, Artificial Sequence
  ELANE RNA Guide
uuguaaacugguucgacucu

SEQ ID NO: 30181 - RNA, 20 nt, Artificial Sequence
  ELANE RNA Guide
uuuguaaacugguucgacuc

SEQ ID NO: 30182 - RNA, 21 nt, Artificial Sequence
  ELANE RNA Guide
aaacugguucgacucuaucau

SEQ ID NO: 30183 - RNA, 21 nt, Artificial Sequence
  ELANE RNA Guide
aaccaguuuacaaacugugcc

SEQ ID NO: 30184 - RNA, 21 nt, Artificial Sequence
  ELANE RNA Guide
aacugguucgacucuaucauc

SEQ ID NO: 30185 - RNA, 21 nt, Artificial Sequence
  ELANE RNA Guide
acaguuuguaaacugguucga

SEQ ID NO: 30186 - RNA, 21 nt, Artificial Sequence
  ELANE RNA Guide
acugguucgacucuaucaucc

SEQ ID NO: 30187 - RNA, 21 nt, Artificial Sequence
  ELANE RNA Guide
agagucgaaccaguuuacaaa

SEQ ID NO: 30188 - RNA, 21 nt, Artificial Sequence
  ELANE RNA Guide
agucgaaccaguuuacaaacu

SEQ ID NO: 30189 - RNA, 21 nt, Artificial Sequence
  ELANE RNA Guide
aguuuguaaacugguucgacu

SEQ ID NO: 30190 - RNA, 21 nt, Artificial Sequence
  ELANE RNA Guide
auagagucgaaccaguuuaca

SEQ ID NO: 30191 - RNA, 21 nt, Artificial Sequence
  ELANE RNA Guide
augauagagucgaaccaguuu

SEQ ID NO: 30192 - RNA, 21 nt, Artificial Sequence
  ELANE RNA Guide
cacaguuuguaaacugguucg

SEQ ID NO: 30193 - RNA, 21 nt, Artificial Sequence
  ELANE RNA Guide
caguuuguaaacugguucgac

SEQ ID NO: 30194 - RNA, 21 nt, Artificial Sequence
  ELANE RNA Guide
cgaaccaguuuacaaacugug

SEQ ID NO: 30195 - RNA, 21 nt, Artificial Sequence
  ELANE RNA Guide
cggagcguuggaugauagagu

SEQ ID NO: 30196 - RNA, 21 nt, Artificial Sequence
  ELANE RNA Guide
cguuggaugauagagucgaac

SEQ ID NO: 30197 - RNA, 21 nt, Artificial Sequence
  ELANE RNA Guide
cugguucgacucuaucaucca

SEQ ID NO: 30198 - RNA, 21 nt, Artificial Sequence
  ELANE RNA Guide
gaaccaguuuacaaacugugc

SEQ ID NO: 30199 - RNA, 21 nt, Artificial Sequence
  ELANE RNA Guide
gagucgaaccaguuuacaaac

SEQ ID NO: 30200 - RNA, 21 nt, Artificial Sequence
  ELANE RNA Guide
gauagagucgaaccaguuuac

SEQ ID NO: 30201 - RNA, 21 nt, Artificial Sequence
  ELANE RNA Guide
gaugauagagucgaaccaguu

SEQ ID NO: 30202 - RNA, 21 nt, Artificial Sequence
  ELANE RNA Guide
gcacaguuuguaaacugguuc

SEQ ID NO: 30203 - RNA, 21 nt, Artificial Sequence
  ELANE RNA Guide
gcguuggaugauagagucgaa

SEQ ID NO: 30204 - RNA, 21 nt, Artificial Sequence
  ELANE RNA Guide
ggaugauagagucgaaccagu

SEQ ID NO: 30205 - RNA, 21 nt, Artificial Sequence
  ELANE RNA Guide
ggcacaguuuguaaacugguu

SEQ ID NO: 30206 - RNA, 21 nt, Artificial Sequence
  ELANE RNA Guide
gguucgacucuaucauccaac

SEQ ID NO: 30207 - RNA, 21 nt, Artificial Sequence
  ELANE RNA Guide
guaaacugguucgacucuauc

SEQ ID NO: 30208 - RNA, 21 nt, Artificial Sequence
  ELANE RNA Guide
gucgaaccaguuuacaaacug

SEQ ID NO: 30209 - RNA, 21 nt, Artificial Sequence
  ELANE RNA Guide
guggcacaguuuguaaacugg

SEQ ID NO: 30210 - RNA, 21 nt, Artificial Sequence
  ELANE RNA Guide
guucgacucuaucauccaacg

SEQ ID NO: 30211 - RNA, 21 nt, Artificial Sequence
  ELANE RNA Guide
guuggaugauagagucgaacc

SEQ ID NO: 30212 - RNA, 21 nt, Artificial Sequence
  ELANE RNA Guide
guuuguaaacugguucgacuc

SEQ ID NO: 30213 - RNA, 21 nt, Artificial Sequence
  ELANE RNA Guide
uaaacugguucgacucuauca

SEQ ID NO: 30214 - RNA, 21 nt, Artificial Sequence
  ELANE RNA Guide
uagagucgaaccaguuuacaa

SEQ ID NO: 30215 - RNA, 21 nt, Artificial Sequence
  ELANE RNA Guide
ucgaaccaguuuacaaacugu

SEQ ID NO: 30216 - RNA, 21 nt, Artificial Sequence
  ELANE RNA Guide
ugauagagucgaaccaguuua

SEQ ID NO: 30217 - RNA, 21 nt, Artificial Sequence
  ELANE RNA Guide
uggaugauagagucgaaccag

SEQ ID NO: 30218 - RNA, 21 nt, Artificial Sequence
  ELANE RNA Guide
uggcacaguuuguaaacuggu

SEQ ID NO: 30219 - RNA, 21 nt, Artificial Sequence
  ELANE RNA Guide
ugguucgacucuaucauccaa

SEQ ID NO: 30220 - RNA, 21 nt, Artificial Sequence
  ELANE RNA Guide
uguaaacugguucgacucuau

SEQ ID NO: 30221 - RNA, 21 nt, Artificial Sequence
  ELANE RNA Guide
uuggaugauagagucgaacca

SEQ ID NO: 30222 - RNA, 21 nt, Artificial Sequence
  ELANE RNA Guide
uuguaaacugguucgacucua

SEQ ID NO: 30223 - RNA, 21 nt, Artificial Sequence
  ELANE RNA Guide
uuuguaaacugguucgacucu

SEQ ID NO: 30224 - RNA, 22 nt, Artificial Sequence
  ELANE RNA Guide
aaacugguucgacucuaucauc

SEQ ID NO: 30225 - RNA, 22 nt, Artificial Sequence
  ELANE RNA Guide
aaccaguuuacaaacugugcca

SEQ ID NO: 30226 - RNA, 22 nt, Artificial Sequence
  ELANE RNA Guide
aacugguucgacucuaucaucc

SEQ ID NO: 30227 - RNA, 22 nt, Artificial Sequence
  ELANE RNA Guide
acaguuuguaaacugguucgac

SEQ ID NO: 30228 - RNA, 22 nt, Artificial Sequence
  ELANE RNA Guide
acugguucgacucuaucaucca

SEQ ID NO: 30229 - RNA, 22 nt, Artificial Sequence
  ELANE RNA Guide
agagucgaaccaguuuacaaac

SEQ ID NO: 30230 - RNA, 22 nt, Artificial Sequence
  ELANE RNA Guide
agcguuggaugauagagucgaa

SEQ ID NO: 30231 - RNA, 22 nt, Artificial Sequence
  ELANE RNA Guide
agucgaaccaguuuacaaacug

SEQ ID NO: 30232 - RNA, 22 nt, Artificial Sequence
  ELANE RNA Guide
aguuuguaaacugguucgacuc

SEQ ID NO: 30233 - RNA, 22 nt, Artificial Sequence
  ELANE RNA Guide
auagagucgaaccaguuuacaa

SEQ ID NO: 30234 - RNA, 22 nt, Artificial Sequence
  ELANE RNA Guide
augauagagucgaaccaguuua

SEQ ID NO: 30235 - RNA, 22 nt, Artificial Sequence
  ELANE RNA Guide
cacaguuuguaaacugguucga

SEQ ID NO: 30236 - RNA, 22 nt, Artificial Sequence
  ELANE RNA Guide
caguuuguaaacugguucgacu

SEQ ID NO: 30237 - RNA, 22 nt, Artificial Sequence
  ELANE RNA Guide
cgaaccaguuuacaaacugugc

SEQ ID NO: 30238 - RNA, 22 nt, Artificial Sequence
  ELANE RNA Guide
cguuggaugauagagucgaacc

SEQ ID NO: 30239 - RNA, 22 nt, Artificial Sequence
  ELANE RNA Guide
cugguucgacucuaucauccaa

SEQ ID NO: 30240 - RNA, 22 nt, Artificial Sequence
  ELANE RNA Guide
gaaccaguuuacaaacugugcc

SEQ ID NO: 30241 - RNA, 22 nt, Artificial Sequence
  ELANE RNA Guide
gagucgaaccaguuuacaaacu

SEQ ID NO: 30242 - RNA, 22 nt, Artificial Sequence
  ELANE RNA Guide
gauagagucgaaccaguuuaca

SEQ ID NO: 30243 - RNA, 22 nt, Artificial Sequence
  ELANE RNA Guide
gaugauagagucgaaccaguuu

SEQ ID NO: 30244 - RNA, 22 nt, Artificial Sequence
  ELANE RNA Guide
gcacaguuuguaaacugguucg

SEQ ID NO: 30245 - RNA, 22 nt, Artificial Sequence
  ELANE RNA Guide
gcguuggaugauagagucgaac

SEQ ID NO: 30246 - RNA, 22 nt, Artificial Sequence
  ELANE RNA Guide
ggaugauagagucgaaccaguu

SEQ ID NO: 30247 - RNA, 22 nt, Artificial Sequence
  ELANE RNA Guide
ggcacaguuuguaaacugguuc

SEQ ID NO: 30248 - RNA, 22 nt, Artificial Sequence
  ELANE RNA Guide
gguggcacaguuuguaaacugg

SEQ ID NO: 30249 - RNA, 22 nt, Artificial Sequence
  ELANE RNA Guide
gguucgacucuaucauccaacg

SEQ ID NO: 30250 - RNA, 22 nt, Artificial Sequence
  ELANE RNA Guide
guaaacugguucgacucuauca

SEQ ID NO: 30251 - RNA, 22 nt, Artificial Sequence
  ELANE RNA Guide
gucgaaccaguuuacaaacugu

SEQ ID NO: 30252 - RNA, 22 nt, Artificial Sequence
  ELANE RNA Guide
guggcacaguuuguaaacuggu

SEQ ID NO: 30253 - RNA, 22 nt, Artificial Sequence
  ELANE RNA Guide
guucgacucuaucauccaacgc

SEQ ID NO: 30254 - RNA, 22 nt, Artificial Sequence
  ELANE RNA Guide
guuggaugauagagucgaacca

SEQ ID NO: 30255 - RNA, 22 nt, Artificial Sequence
  ELANE RNA Guide
guuuguaaacugguucgacucu

SEQ ID NO: 30256 - RNA, 22 nt, Artificial Sequence
  ELANE RNA Guide
uaaacugguucgacucuaucau

SEQ ID NO: 30257 - RNA, 22 nt, Artificial Sequence
  ELANE RNA Guide
uagagucgaaccaguuuacaaa

SEQ ID NO: 30258 - RNA, 22 nt, Artificial Sequence
  ELANE RNA Guide
ucgaaccaguuuacaaacugug

SEQ ID NO: 30259 - RNA, 22 nt, Artificial Sequence
  ELANE RNA Guide
ucggagcguuggaugauagagu

SEQ ID NO: 30260 - RNA, 22 nt, Artificial Sequence
  ELANE RNA Guide
ugauagagucgaaccaguuuac

SEQ ID NO: 30261 - RNA, 22 nt, Artificial Sequence
  ELANE RNA Guide
uggaugauagagucgaaccagu

SEQ ID NO: 30262 - RNA, 22 nt, Artificial Sequence
  ELANE RNA Guide
uggcacaguuuguaaacugguu

SEQ ID NO: 30263 - RNA, 22 nt, Artificial Sequence
  ELANE RNA Guide
ugguucgacucuaucauccaac

SEQ ID NO: 30264 - RNA, 22 nt, Artificial Sequence
  ELANE RNA Guide
uguaaacugguucgacucuauc

SEQ ID NO: 30265 - RNA, 22 nt, Artificial Sequence
  ELANE RNA Guide
uuggaugauagagucgaaccag

SEQ ID NO: 30266 - RNA, 22 nt, Artificial Sequence
  ELANE RNA Guide
uuguaaacugguucgacucuau

SEQ ID NO: 30267 - RNA, 22 nt, Artificial Sequence
  ELANE RNA Guide
uuuguaaacugguucgacucua

SEQ ID NO: 30268 - RNA, 20 nt, Artificial Sequence
  ELANE RNA Guide
aaacuggaacgacucuauca

SEQ ID NO: 30269 - RNA, 20 nt, Artificial Sequence
  ELANE RNA Guide
aacgacucuaucauccaacg

SEQ ID NO: 30270 - RNA, 20 nt, Artificial Sequence
  ELANE RNA Guide
aacuggaacgacucuaucau

SEQ ID NO: 30271 - RNA, 20 nt, Artificial Sequence
  ELANE RNA Guide
acaguuuguaaacuggaacg

SEQ ID NO: 30272 - RNA, 20 nt, Artificial Sequence
  ELANE RNA Guide
acuggaacgacucuaucauc

SEQ ID NO: 30273 - RNA, 20 nt, Artificial Sequence
  ELANE RNA Guide
agagucguuccaguuuacaa

SEQ ID NO: 30274 - RNA, 20 nt, Artificial Sequence
  ELANE RNA Guide
agucguuccaguuuacaaac

SEQ ID NO: 30275 - RNA, 20 nt, Artificial Sequence
  ELANE RNA Guide
aguuuguaaacuggaacgac

SEQ ID NO: 30276 - RNA, 20 nt, Artificial Sequence
  ELANE RNA Guide
auagagucguuccaguuuac

SEQ ID NO: 30277 - RNA, 20 nt, Artificial Sequence
  ELANE RNA Guide
augauagagucguuccaguu

SEQ ID NO: 30278 - RNA, 20 nt, Artificial Sequence
  ELANE RNA Guide
cacaguuuguaaacuggaac

SEQ ID NO: 30279 - RNA, 20 nt, Artificial Sequence
  ELANE RNA Guide
caguuuguaaacuggaacga

SEQ ID NO: 30280 - RNA, 20 nt, Artificial Sequence
  ELANE RNA Guide
cggagcguuggaugauagag

SEQ ID NO: 30281 - RNA, 20 nt, Artificial Sequence
  ELANE RNA Guide
cguuccaguuuacaaacugu

SEQ ID NO: 30282 - RNA, 20 nt, Artificial Sequence
  ELANE RNA Guide
cguuggaugauagagucguu

SEQ ID NO: 30283 - RNA, 20 nt, Artificial Sequence
  ELANE RNA Guide
cuggaacgacucuaucaucc

SEQ ID NO: 30284 - RNA, 20 nt, Artificial Sequence
  ELANE RNA Guide
gaacgacucuaucauccaac

SEQ ID NO: 30285 - RNA, 20 nt, Artificial Sequence
  ELANE RNA Guide
gagucguuccaguuuacaaa

SEQ ID NO: 30286 - RNA, 20 nt, Artificial Sequence
  ELANE RNA Guide
gauagagucguuccaguuua

SEQ ID NO: 30287 - RNA, 20 nt, Artificial Sequence
  ELANE RNA Guide
gaugauagagucguuccagu

SEQ ID NO: 30288 - RNA, 20 nt, Artificial Sequence
  ELANE RNA Guide
gcacaguuuguaaacuggaa

SEQ ID NO: 30289 - RNA, 20 nt, Artificial Sequence
  ELANE RNA Guide
gcguuggaugauagagucgu

SEQ ID NO: 30290 - RNA, 20 nt, Artificial Sequence
  ELANE RNA Guide
ggaacgacucuaucauccaa

SEQ ID NO: 30291 - RNA, 20 nt, Artificial Sequence
  ELANE RNA Guide
ggaugauagagucguuccag

SEQ ID NO: 30292 - RNA, 20 nt, Artificial Sequence
  ELANE RNA Guide
ggcacaguuuguaaacugga

SEQ ID NO: 30293 - RNA, 20 nt, Artificial Sequence
  ELANE RNA Guide
guaaacuggaacgacucuau

SEQ ID NO: 30294 - RNA, 20 nt, Artificial Sequence
  ELANE RNA Guide
gucguuccaguuuacaaacu

SEQ ID NO: 30295 - RNA, 20 nt, Artificial Sequence
  ELANE RNA Guide
guuccaguuuacaaacugug

SEQ ID NO: 30296 - RNA, 20 nt, Artificial Sequence
  ELANE RNA Guide
guuggaugauagagucguuc

SEQ ID NO: 30297 - RNA, 20 nt, Artificial Sequence
  ELANE RNA Guide
guuuguaaacuggaacgacu

SEQ ID NO: 30298 - RNA, 20 nt, Artificial Sequence
  ELANE RNA Guide
uaaacuggaacgacucuauc

SEQ ID NO: 30299 - RNA, 20 nt, Artificial Sequence
  ELANE RNA Guide
uagagucguuccaguuuaca

SEQ ID NO: 30300 - RNA, 20 nt, Artificial Sequence
  ELANE RNA Guide
ucguuccaguuuacaaacug

SEQ ID NO: 30301 - RNA, 20 nt, Artificial Sequence
  ELANE RNA Guide
ugauagagucguuccaguuu

SEQ ID NO: 30302 - RNA, 20 nt, Artificial Sequence
  ELANE RNA Guide
uggaacgacucuaucaucca

SEQ ID NO: 30303 - RNA, 20 nt, Artificial Sequence
  ELANE RNA Guide
uggaugauagagucguucca

SEQ ID NO: 30304 - RNA, 20 nt, Artificial Sequence
  ELANE RNA Guide
uguaaacuggaacgacucua

SEQ ID NO: 30305 - RNA, 20 nt, Artificial Sequence
  ELANE RNA Guide
uuggaugauagagucguucc

SEQ ID NO: 30306 - RNA, 20 nt, Artificial Sequence
  ELANE RNA Guide
uuguaaacuggaacgacucu

SEQ ID NO: 30307 - RNA, 20 nt, Artificial Sequence
  ELANE RNA Guide
uuuguaaacuggaacgacuc

SEQ ID NO: 30308 - RNA, 21 nt, Artificial Sequence
  ELANE RNA Guide
aaacuggaacgacucuaucau

SEQ ID NO: 30309 - RNA, 21 nt, Artificial Sequence
  ELANE RNA Guide
aacgacucuaucauccaacgc

SEQ ID NO: 30310 - RNA, 21 nt, Artificial Sequence
  ELANE RNA Guide
aacuggaacgacucuaucauc

SEQ ID NO: 30311 - RNA, 21 nt, Artificial Sequence
  ELANE RNA Guide
acaguuuguaaacuggaacga

SEQ ID NO: 30312 - RNA, 21 nt, Artificial Sequence
  ELANE RNA Guide
acuggaacgacucuaucaucc

SEQ ID NO: 30313 - RNA, 21 nt, Artificial Sequence
  ELANE RNA Guide
agagucguuccaguuuacaaa

SEQ ID NO: 30314 - RNA, 21 nt, Artificial Sequence
  ELANE RNA Guide
agcguuggaugauagagucgu

SEQ ID NO: 30315 - RNA, 21 nt, Artificial Sequence
  ELANE RNA Guide
agucguuccaguuuacaaacu

SEQ ID NO: 30316 - RNA, 21 nt, Artificial Sequence
  ELANE RNA Guide
aguuuguaaacuggaacgacu

SEQ ID NO: 30317 - RNA, 21 nt, Artificial Sequence
  ELANE RNA Guide
auagagucguuccaguuuaca

SEQ ID NO: 30318 - RNA, 21 nt, Artificial Sequence
  ELANE RNA Guide
augauagagucguuccaguuu

SEQ ID NO: 30319 - RNA, 21 nt, Artificial Sequence
  ELANE RNA Guide
cacaguuuguaaacuggaacg

SEQ ID NO: 30320 - RNA, 21 nt, Artificial Sequence
  ELANE RNA Guide
caguuuguaaacuggaacgac

SEQ ID NO: 30321 - RNA, 21 nt, Artificial Sequence
  ELANE RNA Guide
cguuccaguuuacaaacugug

SEQ ID NO: 30322 - RNA, 21 nt, Artificial Sequence
  ELANE RNA Guide
cguuggaugauagagucguuc

SEQ ID NO: 30323 - RNA, 21 nt, Artificial Sequence
  ELANE RNA Guide
cuggaacgacucuaucaucca

SEQ ID NO: 30324 - RNA, 21 nt, Artificial Sequence
  ELANE RNA Guide
gaacgacucuaucauccaacg

SEQ ID NO: 30325 - RNA, 21 nt, Artificial Sequence
  ELANE RNA Guide
gagucguuccaguuuacaaac

SEQ ID NO: 30326 - RNA, 21 nt, Artificial Sequence
  ELANE RNA Guide
gauagagucguuccaguuuac

SEQ ID NO: 30327 - RNA, 21 nt, Artificial Sequence
  ELANE RNA Guide
gaugauagagucguuccaguu

SEQ ID NO: 30328 - RNA, 21 nt, Artificial Sequence
  ELANE RNA Guide
gcacaguuuguaaacuggaac

SEQ ID NO: 30329 - RNA, 21 nt, Artificial Sequence
  ELANE RNA Guide
gcguuggaugauagagucguu

SEQ ID NO: 30330 - RNA, 21 nt, Artificial Sequence
  ELANE RNA Guide
ggaacgacucuaucauccaac

SEQ ID NO: 30331 - RNA, 21 nt, Artificial Sequence
  ELANE RNA Guide
ggaugauagagucguuccagu

SEQ ID NO: 30332 - RNA, 21 nt, Artificial Sequence
  ELANE RNA Guide
ggcacaguuuguaaacuggaa

SEQ ID NO: 30333 - RNA, 21 nt, Artificial Sequence
  ELANE RNA Guide
guaaacuggaacgacucuauc

SEQ ID NO: 30334 - RNA, 21 nt, Artificial Sequence
  ELANE RNA Guide
gucguuccaguuuacaaacug

SEQ ID NO: 30335 - RNA, 21 nt, Artificial Sequence
  ELANE RNA Guide
guuccaguuuacaaacugugc

SEQ ID NO: 30336 - RNA, 21 nt, Artificial Sequence
  ELANE RNA Guide
guuggaugauagagucguucc

SEQ ID NO: 30337 - RNA, 21 nt, Artificial Sequence
  ELANE RNA Guide
guuuguaaacuggaacgacuc

SEQ ID NO: 30338 - RNA, 21 nt, Artificial Sequence
  ELANE RNA Guide
uaaacuggaacgacucuauca

SEQ ID NO: 30339 - RNA, 21 nt, Artificial Sequence
  ELANE RNA Guide
uagagucguuccaguuuacaa

SEQ ID NO: 30340 - RNA, 21 nt, Artificial Sequence
  ELANE RNA Guide
ucggagcguuggaugauagag

SEQ ID NO: 30341 - RNA, 21 nt, Artificial Sequence
  ELANE RNA Guide
ucguuccaguuuacaaacugu

SEQ ID NO: 30342 - RNA, 21 nt, Artificial Sequence
  ELANE RNA Guide
ugauagagucguuccaguuua

SEQ ID NO: 30343 - RNA, 21 nt, Artificial Sequence
  ELANE RNA Guide
uggaacgacucuaucauccaa

SEQ ID NO: 30344 - RNA, 21 nt, Artificial Sequence
  ELANE RNA Guide
uggaugauagagucguuccag

SEQ ID NO: 30345 - RNA, 21 nt, Artificial Sequence
  ELANE RNA Guide
uggcacaguuuguaaacugga

SEQ ID NO: 30346 - RNA, 21 nt, Artificial Sequence
  ELANE RNA Guide
uguaaacuggaacgacucuau

SEQ ID NO: 30347 - RNA, 21 nt, Artificial Sequence
  ELANE RNA Guide
uuggaugauagagucguucca

SEQ ID NO: 30348 - RNA, 21 nt, Artificial Sequence
  ELANE RNA Guide
uuguaaacuggaacgacucua

SEQ ID NO: 30349 - RNA, 21 nt, Artificial Sequence
  ELANE RNA Guide
uuuguaaacuggaacgacucu

SEQ ID NO: 30350 - RNA, 22 nt, Artificial Sequence
  ELANE RNA Guide
aaacuggaacgacucuaucauc

SEQ ID NO: 30351 - RNA, 22 nt, Artificial Sequence
  ELANE RNA Guide
aacgacucuaucauccaacgcu

SEQ ID NO: 30352 - RNA, 22 nt, Artificial Sequence
  ELANE RNA Guide
aacuggaacgacucuaucaucc

SEQ ID NO: 30353 - RNA, 22 nt, Artificial Sequence
  ELANE RNA Guide
acaguuuguaaacuggaacgac

SEQ ID NO: 30354 - RNA, 22 nt, Artificial Sequence
  ELANE RNA Guide
acuggaacgacucuaucaucca

SEQ ID NO: 30355 - RNA, 22 nt, Artificial Sequence
  ELANE RNA Guide
agagucguuccaguuuacaaac

SEQ ID NO: 30356 - RNA, 22 nt, Artificial Sequence
  ELANE RNA Guide
agcguuggaugauagagucguu

SEQ ID NO: 30357 - RNA, 22 nt, Artificial Sequence
  ELANE RNA Guide
agucguuccaguuuacaaacug

SEQ ID NO: 30358 - RNA, 22 nt, Artificial Sequence
  ELANE RNA Guide
aguuuguaaacuggaacgacuc

SEQ ID NO: 30359 - RNA, 22 nt, Artificial Sequence
  ELANE RNA Guide
auagagucguuccaguuuacaa

SEQ ID NO: 30360 - RNA, 22 nt, Artificial Sequence
  ELANE RNA Guide
augauagagucguuccaguuua

SEQ ID NO: 30361 - RNA, 22 nt, Artificial Sequence
  ELANE RNA Guide
cacaguuuguaaacuggaacga

SEQ ID NO: 30362 - RNA, 22 nt, Artificial Sequence
  ELANE RNA Guide
caguuuguaaacuggaacgacu

SEQ ID NO: 30363 - RNA, 22 nt, Artificial Sequence
  ELANE RNA Guide
cguuccaguuuacaaacugugc

SEQ ID NO: 30364 - RNA, 22 nt, Artificial Sequence
  ELANE RNA Guide
cguuggaugauagagucguucc

SEQ ID NO: 30365 - RNA, 22 nt, Artificial Sequence
  ELANE RNA Guide
cucggagcguuggaugauagag

SEQ ID NO: 30366 - RNA, 22 nt, Artificial Sequence
  ELANE RNA Guide
cuggaacgacucuaucauccaa

SEQ ID NO: 30367 - RNA, 22 nt, Artificial Sequence
  ELANE RNA Guide
gaacgacucuaucauccaacgc

SEQ ID NO: 30368 - RNA, 22 nt, Artificial Sequence
  ELANE RNA Guide
gagcguuggaugauagagucgu

SEQ ID NO: 30369 - RNA, 22 nt, Artificial Sequence
  ELANE RNA Guide
gagucguuccaguuuacaaacu

SEQ ID NO: 30370 - RNA, 22 nt, Artificial Sequence
  ELANE RNA Guide
gauagagucguuccaguuuaca

SEQ ID NO: 30371 - RNA, 22 nt, Artificial Sequence
  ELANE RNA Guide
gaugauagagucguuccaguuu

SEQ ID NO: 30372 - RNA, 22 nt, Artificial Sequence
  ELANE RNA Guide
gcacaguuuguaaacuggaacg

SEQ ID NO: 30373 - RNA, 22 nt, Artificial Sequence
  ELANE RNA Guide
gcguuggaugauagagucguuc

SEQ ID NO: 30374 - RNA, 22 nt, Artificial Sequence
  ELANE RNA Guide
ggaacgacucuaucauccaacg

SEQ ID NO: 30375 - RNA, 22 nt, Artificial Sequence
  ELANE RNA Guide
ggaugauagagucguuccaguu

SEQ ID NO: 30376 - RNA, 22 nt, Artificial Sequence
  ELANE RNA Guide
ggcacaguuuguaaacuggaac

SEQ ID NO: 30377 - RNA, 22 nt, Artificial Sequence
  ELANE RNA Guide
guaaacuggaacgacucuauca

SEQ ID NO: 30378 - RNA, 22 nt, Artificial Sequence
  ELANE RNA Guide
gucguuccaguuuacaaacugu

SEQ ID NO: 30379 - RNA, 22 nt, Artificial Sequence
  ELANE RNA Guide
guggcacaguuuguaaacugga

SEQ ID NO: 30380 - RNA, 22 nt, Artificial Sequence
  ELANE RNA Guide
guuccaguuuacaaacugugcc

SEQ ID NO: 30381 - RNA, 22 nt, Artificial Sequence
  ELANE RNA Guide
guuggaugauagagucguucca

SEQ ID NO: 30382 - RNA, 22 nt, Artificial Sequence
  ELANE RNA Guide
guuuguaaacuggaacgacucu

SEQ ID NO: 30383 - RNA, 22 nt, Artificial Sequence
  ELANE RNA Guide
uaaacuggaacgacucuaucau

SEQ ID NO: 30384 - RNA, 22 nt, Artificial Sequence
  ELANE RNA Guide
uagagucguuccaguuuacaaa

SEQ ID NO: 30385 - RNA, 22 nt, Artificial Sequence
  ELANE RNA Guide
ucguuccaguuuacaaacugug

SEQ ID NO: 30386 - RNA, 22 nt, Artificial Sequence
  ELANE RNA Guide
ugauagagucguuccaguuuac

SEQ ID NO: 30387 - RNA, 22 nt, Artificial Sequence
  ELANE RNA Guide
uggaacgacucuaucauccaac

SEQ ID NO: 30388 - RNA, 22 nt, Artificial Sequence
  ELANE RNA Guide
uggaugauagagucguuccagu

SEQ ID NO: 30389 - RNA, 22 nt, Artificial Sequence
  ELANE RNA Guide
uggcacaguuuguaaacuggaa

SEQ ID NO: 30390 - RNA, 22 nt, Artificial Sequence
  ELANE RNA Guide
uguaaacuggaacgacucuauc

SEQ ID NO: 30391 - RNA, 22 nt, Artificial Sequence
  ELANE RNA Guide
uuggaugauagagucguuccag

SEQ ID NO: 30392 - RNA, 22 nt, Artificial Sequence
  ELANE RNA Guide
uuguaaacuggaacgacucuau

SEQ ID NO: 30393 - RNA, 22 nt, Artificial Sequence
  ELANE RNA Guide
uuuguaaacuggaacgacucua

SEQ ID NO: 30394 - RNA, 20 nt, Artificial Sequence
  ELANE RNA Guide
aaacuggaucuacucuauca

SEQ ID NO: 30395 - RNA, 20 nt, Artificial Sequence
  ELANE RNA Guide
aacuggaucuacucuaucau

SEQ ID NO: 30396 - RNA, 20 nt, Artificial Sequence
  ELANE RNA Guide
acaguuuguaaacuggaucu

SEQ ID NO: 30397 - RNA, 20 nt, Artificial Sequence
  ELANE RNA Guide
acuggaucuacucuaucauc

SEQ ID NO: 30398 - RNA, 20 nt, Artificial Sequence
  ELANE RNA Guide
agaguagauccaguuuacaa

SEQ ID NO: 30399 - RNA, 20 nt, Artificial Sequence
  ELANE RNA Guide
agcguuggaugauagaguag

SEQ ID NO: 30400 - RNA, 20 nt, Artificial Sequence
  ELANE RNA Guide
aguagauccaguuuacaaac

SEQ ID NO: 30401 - RNA, 20 nt, Artificial Sequence
  ELANE RNA Guide
aguuuguaaacuggaucuac

SEQ ID NO: 30402 - RNA, 20 nt, Artificial Sequence
  ELANE RNA Guide
auagaguagauccaguuuac

SEQ ID NO: 30403 - RNA, 20 nt, Artificial Sequence
  ELANE RNA Guide
aucuacucuaucauccaacg

SEQ ID NO: 30404 - RNA, 20 nt, Artificial Sequence
  ELANE RNA Guide
augauagaguagauccaguu

SEQ ID NO: 30405 - RNA, 20 nt, Artificial Sequence
  ELANE RNA Guide
cacaguuuguaaacuggauc

SEQ ID NO: 30406 - RNA, 20 nt, Artificial Sequence
  ELANE RNA Guide
caguuuguaaacuggaucua

SEQ ID NO: 30407 - RNA, 20 nt, Artificial Sequence
  ELANE RNA Guide
cguuggaugauagaguagau

SEQ ID NO: 30408 - RNA, 20 nt, Artificial Sequence
  ELANE RNA Guide
cuacucuaucauccaacgcu

SEQ ID NO: 30409 - RNA, 20 nt, Artificial Sequence
  ELANE RNA Guide
cucggagcguuggaugauag

SEQ ID NO: 30410 - RNA, 20 nt, Artificial Sequence
  ELANE RNA Guide
cuggaucuacucuaucaucc

SEQ ID NO: 30411 - RNA, 20 nt, Artificial Sequence
  ELANE RNA Guide
gagcguuggaugauagagua

SEQ ID NO: 30412 - RNA, 20 nt, Artificial Sequence
  ELANE RNA Guide
gaguagauccaguuuacaaa

SEQ ID NO: 30413 - RNA, 20 nt, Artificial Sequence
  ELANE RNA Guide
gauagaguagauccaguuua

SEQ ID NO: 30414 - RNA, 20 nt, Artificial Sequence
  ELANE RNA Guide
gaucuacucuaucauccaac

SEQ ID NO: 30415 - RNA, 20 nt, Artificial Sequence
  ELANE RNA Guide
gaugauagaguagauccagu

SEQ ID NO: 30416 - RNA, 20 nt, Artificial Sequence
  ELANE RNA Guide
gcacaguuuguaaacuggau

SEQ ID NO: 30417 - RNA, 20 nt, Artificial Sequence
  ELANE RNA Guide
gcguuggaugauagaguaga

SEQ ID NO: 30418 - RNA, 20 nt, Artificial Sequence
  ELANE RNA Guide
ggaucuacucuaucauccaa

SEQ ID NO: 30419 - RNA, 20 nt, Artificial Sequence
  ELANE RNA Guide
ggaugauagaguagauccag

SEQ ID NO: 30420 - RNA, 20 nt, Artificial Sequence
  ELANE RNA Guide
guaaacuggaucuacucuau

SEQ ID NO: 30421 - RNA, 20 nt, Artificial Sequence
  ELANE RNA Guide
guagauccaguuuacaaacu

SEQ ID NO: 30422 - RNA, 20 nt, Artificial Sequence
  ELANE RNA Guide
guuggaugauagaguagauc

SEQ ID NO: 30423 - RNA, 20 nt, Artificial Sequence
  ELANE RNA Guide
guuuguaaacuggaucuacu

SEQ ID NO: 30424 - RNA, 20 nt, Artificial Sequence
  ELANE RNA Guide
uaaacuggaucuacucuauc

SEQ ID NO: 30425 - RNA, 20 nt, Artificial Sequence
  ELANE RNA Guide
uagaguagauccaguuuaca

SEQ ID NO: 30426 - RNA, 20 nt, Artificial Sequence
  ELANE RNA Guide
uagauccaguuuacaaacug

SEQ ID NO: 30427 - RNA, 20 nt, Artificial Sequence
  ELANE RNA Guide
ucggagcguuggaugauaga

SEQ ID NO: 30428 - RNA, 20 nt, Artificial Sequence
  ELANE RNA Guide
ucuacucuaucauccaacgc

SEQ ID NO: 30429 - RNA, 20 nt, Artificial Sequence
  ELANE RNA Guide
ugauagaguagauccaguuu

SEQ ID NO: 30430 - RNA, 20 nt, Artificial Sequence
  ELANE RNA Guide
uggaucuacucuaucaucca

SEQ ID NO: 30431 - RNA, 20 nt, Artificial Sequence
  ELANE RNA Guide
uggaugauagaguagaucca

SEQ ID NO: 30432 - RNA, 20 nt, Artificial Sequence
  ELANE RNA Guide
uguaaacuggaucuacucua

SEQ ID NO: 30433 - RNA, 20 nt, Artificial Sequence
  ELANE RNA Guide
uuggaugauagaguagaucc

SEQ ID NO: 30434 - RNA, 20 nt, Artificial Sequence
  ELANE RNA Guide
uuguaaacuggaucuacucu

SEQ ID NO: 30435 - RNA, 20 nt, Artificial Sequence
  ELANE RNA Guide
uuuguaaacuggaucuacuc

SEQ ID NO: 30436 - RNA, 21 nt, Artificial Sequence
  ELANE RNA Guide
aaacuggaucuacucuaucau

SEQ ID NO: 30437 - RNA, 21 nt, Artificial Sequence
  ELANE RNA Guide
aacuggaucuacucuaucauc

SEQ ID NO: 30438 - RNA, 21 nt, Artificial Sequence
  ELANE RNA Guide
acaguuuguaaacuggaucua

SEQ ID NO: 30439 - RNA, 21 nt, Artificial Sequence
  ELANE RNA Guide
acuggaucuacucuaucaucc

SEQ ID NO: 30440 - RNA, 21 nt, Artificial Sequence
  ELANE RNA Guide
agaguagauccaguuuacaaa

SEQ ID NO: 30441 - RNA, 21 nt, Artificial Sequence
  ELANE RNA Guide
agcguuggaugauagaguaga

SEQ ID NO: 30442 - RNA, 21 nt, Artificial Sequence
  ELANE RNA Guide
aguagauccaguuuacaaacu

SEQ ID NO: 30443 - RNA, 21 nt, Artificial Sequence
  ELANE RNA Guide
aguuuguaaacuggaucuacu

SEQ ID NO: 30444 - RNA, 21 nt, Artificial Sequence
  ELANE RNA Guide
auagaguagauccaguuuaca

SEQ ID NO: 30445 - RNA, 21 nt, Artificial Sequence
  ELANE RNA Guide
aucuacucuaucauccaacgc

SEQ ID NO: 30446 - RNA, 21 nt, Artificial Sequence
  ELANE RNA Guide
augauagaguagauccaguuu

SEQ ID NO: 30447 - RNA, 21 nt, Artificial Sequence
  ELANE RNA Guide
cacaguuuguaaacuggaucu

SEQ ID NO: 30448 - RNA, 21 nt, Artificial Sequence
  ELANE RNA Guide
caguuuguaaacuggaucuac

SEQ ID NO: 30449 - RNA, 21 nt, Artificial Sequence
  ELANE RNA Guide
ccucggagcguuggaugauag

SEQ ID NO: 30450 - RNA, 21 nt, Artificial Sequence
  ELANE RNA Guide
cguuggaugauagaguagauc

SEQ ID NO: 30451 - RNA, 21 nt, Artificial Sequence
  ELANE RNA Guide
cuacucuaucauccaacgcuc

SEQ ID NO: 30452 - RNA, 21 nt, Artificial Sequence
  ELANE RNA Guide
cucggagcguuggaugauaga

SEQ ID NO: 30453 - RNA, 21 nt, Artificial Sequence
  ELANE RNA Guide
cuggaucuacucuaucaucca

SEQ ID NO: 30454 - RNA, 21 nt, Artificial Sequence
  ELANE RNA Guide
gagcguuggaugauagaguag

SEQ ID NO: 30455 - RNA, 21 nt, Artificial Sequence
  ELANE RNA Guide
gaguagauccaguuuacaaac

SEQ ID NO: 30456 - RNA, 21 nt, Artificial Sequence
  ELANE RNA Guide
gauagaguagauccaguuuac

SEQ ID NO: 30457 - RNA, 21 nt, Artificial Sequence
  ELANE RNA Guide
gaucuacucuaucauccaacg

SEQ ID NO: 30458 - RNA, 21 nt, Artificial Sequence
  ELANE RNA Guide
gaugauagaguagauccaguu

SEQ ID NO: 30459 - RNA, 21 nt, Artificial Sequence
  ELANE RNA Guide
gcacaguuuguaaacuggauc

SEQ ID NO: 30460 - RNA, 21 nt, Artificial Sequence
  ELANE RNA Guide
gcguuggaugauagaguagau

SEQ ID NO: 30461 - RNA, 21 nt, Artificial Sequence
  ELANE RNA Guide
ggagcguuggaugauagagua

SEQ ID NO: 30462 - RNA, 21 nt, Artificial Sequence
  ELANE RNA Guide
ggaucuacucuaucauccaac

SEQ ID NO: 30463 - RNA, 21 nt, Artificial Sequence
  ELANE RNA Guide
ggaugauagaguagauccagu

SEQ ID NO: 30464 - RNA, 21 nt, Artificial Sequence
  ELANE RNA Guide
ggcacaguuuguaaacuggau

SEQ ID NO: 30465 - RNA, 21 nt, Artificial Sequence
  ELANE RNA Guide
guaaacuggaucuacucuauc

SEQ ID NO: 30466 - RNA, 21 nt, Artificial Sequence
  ELANE RNA Guide
guagauccaguuuacaaacug

SEQ ID NO: 30467 - RNA, 21 nt, Artificial Sequence
  ELANE RNA Guide
guuggaugauagaguagaucc

SEQ ID NO: 30468 - RNA, 21 nt, Artificial Sequence
  ELANE RNA Guide
guuuguaaacuggaucuacuc

SEQ ID NO: 30469 - RNA, 21 nt, Artificial Sequence
  ELANE RNA Guide
uaaacuggaucuacucuauca

SEQ ID NO: 30470 - RNA, 21 nt, Artificial Sequence
  ELANE RNA Guide
uagaguagauccaguuuacaa

SEQ ID NO: 30471 - RNA, 21 nt, Artificial Sequence
  ELANE RNA Guide
uagauccaguuuacaaacugu

SEQ ID NO: 30472 - RNA, 21 nt, Artificial Sequence
  ELANE RNA Guide
ucuacucuaucauccaacgcu

SEQ ID NO: 30473 - RNA, 21 nt, Artificial Sequence
  ELANE RNA Guide
ugauagaguagauccaguuua

SEQ ID NO: 30474 - RNA, 21 nt, Artificial Sequence
  ELANE RNA Guide
uggaucuacucuaucauccaa

SEQ ID NO: 30475 - RNA, 21 nt, Artificial Sequence
  ELANE RNA Guide
uggaugauagaguagauccag

SEQ ID NO: 30476 - RNA, 21 nt, Artificial Sequence
  ELANE RNA Guide
uguaaacuggaucuacucuau

SEQ ID NO: 30477 - RNA, 21 nt, Artificial Sequence
  ELANE RNA Guide
uuggaugauagaguagaucca

SEQ ID NO: 30478 - RNA, 21 nt, Artificial Sequence
  ELANE RNA Guide
uuguaaacuggaucuacucua

SEQ ID NO: 30479 - RNA, 21 nt, Artificial Sequence
  ELANE RNA Guide
uuuguaaacuggaucuacucu

SEQ ID NO: 30480 - RNA, 22 nt, Artificial Sequence
  ELANE RNA Guide
aaacuggaucuacucuaucauc

SEQ ID NO: 30481 - RNA, 22 nt, Artificial Sequence
  ELANE RNA Guide
aacuggaucuacucuaucaucc

SEQ ID NO: 30482 - RNA, 22 nt, Artificial Sequence
  ELANE RNA Guide
acaguuuguaaacuggaucuac

SEQ ID NO: 30483 - RNA, 22 nt, Artificial Sequence
  ELANE RNA Guide
acuggaucuacucuaucaucca

SEQ ID NO: 30484 - RNA, 22 nt, Artificial Sequence
  ELANE RNA Guide
agaguagauccaguuuacaaac

SEQ ID NO: 30485 - RNA, 22 nt, Artificial Sequence
  ELANE RNA Guide
agcguuggaugauagaguagau

SEQ ID NO: 30486 - RNA, 22 nt, Artificial Sequence
  ELANE RNA Guide
aguagauccaguuuacaaacug

SEQ ID NO: 30487 - RNA, 22 nt, Artificial Sequence
  ELANE RNA Guide
aguuuguaaacuggaucuacuc

SEQ ID NO: 30488 - RNA, 22 nt, Artificial Sequence
  ELANE RNA Guide
auagaguagauccaguuuacaa

SEQ ID NO: 30489 - RNA, 22 nt, Artificial Sequence
  ELANE RNA Guide
aucuacucuaucauccaacgcu

SEQ ID NO: 30490 - RNA, 22 nt, Artificial Sequence
  ELANE RNA Guide
augauagaguagauccaguuua

SEQ ID NO: 30491 - RNA, 22 nt, Artificial Sequence
  ELANE RNA Guide
cacaguuuguaaacuggaucua

SEQ ID NO: 30492 - RNA, 22 nt, Artificial Sequence
  ELANE RNA Guide
caguuuguaaacuggaucuacu

SEQ ID NO: 30493 - RNA, 22 nt, Artificial Sequence
  ELANE RNA Guide
ccucggagcguuggaugauaga

SEQ ID NO: 30494 - RNA, 22 nt, Artificial Sequence
  ELANE RNA Guide
cggagcguuggaugauagagua

SEQ ID NO: 30495 - RNA, 22 nt, Artificial Sequence
  ELANE RNA Guide
cguuggaugauagaguagaucc

SEQ ID NO: 30496 - RNA, 22 nt, Artificial Sequence
  ELANE RNA Guide
cuacucuaucauccaacgcucc

SEQ ID NO: 30497 - RNA, 22 nt, Artificial Sequence
  ELANE RNA Guide
cuggaucuacucuaucauccaa

SEQ ID NO: 30498 - RNA, 22 nt, Artificial Sequence
  ELANE RNA Guide
gagcguuggaugauagaguaga

SEQ ID NO: 30499 - RNA, 22 nt, Artificial Sequence
  ELANE RNA Guide
gaguagauccaguuuacaaacu

SEQ ID NO: 30500 - RNA, 22 nt, Artificial Sequence
  ELANE RNA Guide
gauagaguagauccaguuuaca

SEQ ID NO: 30501 - RNA, 22 nt, Artificial Sequence
  ELANE RNA Guide
gaucuacucuaucauccaacgc

SEQ ID NO: 30502 - RNA, 22 nt, Artificial Sequence
  ELANE RNA Guide
gaugauagaguagauccaguuu

SEQ ID NO: 30503 - RNA, 22 nt, Artificial Sequence
  ELANE RNA Guide
gcacaguuuguaaacuggaucu

SEQ ID NO: 30504 - RNA, 22 nt, Artificial Sequence
  ELANE RNA Guide
gcguuggaugauagaguagauc

SEQ ID NO: 30505 - RNA, 22 nt, Artificial Sequence
  ELANE RNA Guide
ggagcguuggaugauagaguag

SEQ ID NO: 30506 - RNA, 22 nt, Artificial Sequence
  ELANE RNA Guide
ggaucuacucuaucauccaacg

SEQ ID NO: 30507 - RNA, 22 nt, Artificial Sequence
  ELANE RNA Guide
ggaugauagaguagauccaguu

SEQ ID NO: 30508 - RNA, 22 nt, Artificial Sequence
  ELANE RNA Guide
ggcacaguuuguaaacuggauc

SEQ ID NO: 30509 - RNA, 22 nt, Artificial Sequence
  ELANE RNA Guide
guaaacuggaucuacucuauca

SEQ ID NO: 30510 - RNA, 22 nt, Artificial Sequence
  ELANE RNA Guide
guagauccaguuuacaaacugu

SEQ ID NO: 30511 - RNA, 22 nt, Artificial Sequence
  ELANE RNA Guide
guuggaugauagaguagaucca

SEQ ID NO: 30512 - RNA, 22 nt, Artificial Sequence
  ELANE RNA Guide
guuuguaaacuggaucuacucu

SEQ ID NO: 30513 - RNA, 22 nt, Artificial Sequence
  ELANE RNA Guide
uaaacuggaucuacucuaucau

SEQ ID NO: 30514 - RNA, 22 nt, Artificial Sequence
  ELANE RNA Guide
uagaguagauccaguuuacaaa

SEQ ID NO: 30515 - RNA, 22 nt, Artificial Sequence
  ELANE RNA Guide
uagauccaguuuacaaacugug

SEQ ID NO: 30516 - RNA, 22 nt, Artificial Sequence
  ELANE RNA Guide
uccucggagcguuggaugauag

SEQ ID NO: 30517 - RNA, 22 nt, Artificial Sequence
  ELANE RNA Guide
ucuacucuaucauccaacgcuc

SEQ ID NO: 30518 - RNA, 22 nt, Artificial Sequence
  ELANE RNA Guide
ugauagaguagauccaguuuac

SEQ ID NO: 30519 - RNA, 22 nt, Artificial Sequence
  ELANE RNA Guide
uggaucuacucuaucauccaac

SEQ ID NO: 30520 - RNA, 22 nt, Artificial Sequence
  ELANE RNA Guide
uggaugauagaguagauccagu

SEQ ID NO: 30521 - RNA, 22 nt, Artificial Sequence
  ELANE RNA Guide
uggcacaguuuguaaacuggau

SEQ ID NO: 30522 - RNA, 22 nt, Artificial Sequence
  ELANE RNA Guide
uguaaacuggaucuacucuauc

SEQ ID NO: 30523 - RNA, 22 nt, Artificial Sequence
  ELANE RNA Guide
uuggaugauagaguagauccag

SEQ ID NO: 30524 - RNA, 22 nt, Artificial Sequence
  ELANE RNA Guide
uuguaaacuggaucuacucuau

SEQ ID NO: 30525 - RNA, 22 nt, Artificial Sequence
  ELANE RNA Guide
uuuguaaacuggaucuacucua

SEQ ID NO: 30526 - RNA, 20 nt, Artificial Sequence
  ELANE RNA Guide
aacgcuucgaggacaacccc

SEQ ID NO: 30527 - RNA, 20 nt, Artificial Sequence
  ELANE RNA Guide
acagggguuguccucgaagc

SEQ ID NO: 30528 - RNA, 20 nt, Artificial Sequence
  ELANE RNA Guide
acgcuucgaggacaaccccu

SEQ ID NO: 30529 - RNA, 20 nt, Artificial Sequence
  ELANE RNA Guide
acucuaucauccaacgcuuc

SEQ ID NO: 30530 - RNA, 20 nt, Artificial Sequence
  ELANE RNA Guide
agggguuguccucgaagcgu

SEQ ID NO: 30531 - RNA, 20 nt, Artificial Sequence
  ELANE RNA Guide
aucauccaacgcuucgagga

SEQ ID NO: 30532 - RNA, 20 nt, Artificial Sequence
  ELANE RNA Guide
auccaacgcuucgaggacaa

SEQ ID NO: 30533 - RNA, 20 nt, Artificial Sequence
  ELANE RNA Guide
aucgacucuaucauccaacg

SEQ ID NO: 30534 - RNA, 20 nt, Artificial Sequence
  ELANE RNA Guide
caacgcuucgaggacaaccc

SEQ ID NO: 30535 - RNA, 20 nt, Artificial Sequence
  ELANE RNA Guide
cagggguuguccucgaagcg

SEQ ID NO: 30536 - RNA, 20 nt, Artificial Sequence
  ELANE RNA Guide
cauccaacgcuucgaggaca

SEQ ID NO: 30537 - RNA, 20 nt, Artificial Sequence
  ELANE RNA Guide
ccaacgcuucgaggacaacc

SEQ ID NO: 30538 - RNA, 20 nt, Artificial Sequence
  ELANE RNA Guide
ccucgaagcguuggaugaua

SEQ ID NO: 30539 - RNA, 20 nt, Artificial Sequence
  ELANE RNA Guide
cgaagcguuggaugauagag

SEQ ID NO: 30540 - RNA, 20 nt, Artificial Sequence
  ELANE RNA Guide
cgacucuaucauccaacgcu

SEQ ID NO: 30541 - RNA, 20 nt, Artificial Sequence
  ELANE RNA Guide
cgcuucgaggacaaccccug

SEQ ID NO: 30542 - RNA, 20 nt, Artificial Sequence
  ELANE RNA Guide
cuaucauccaacgcuucgag

SEQ ID NO: 30543 - RNA, 20 nt, Artificial Sequence
  ELANE RNA Guide
cucgaagcguuggaugauag

SEQ ID NO: 30544 - RNA, 20 nt, Artificial Sequence
  ELANE RNA Guide
cucuaucauccaacgcuucg

SEQ ID NO: 30545 - RNA, 20 nt, Artificial Sequence
  ELANE RNA Guide
cuucgaggacaaccccuguc

SEQ ID NO: 30546 - RNA, 20 nt, Artificial Sequence
  ELANE RNA Guide
gaagcguuggaugauagagu

SEQ ID NO: 30547 - RNA, 20 nt, Artificial Sequence
  ELANE RNA Guide
gacagggguuguccucgaag

SEQ ID NO: 30548 - RNA, 20 nt, Artificial Sequence
  ELANE RNA Guide
gacucuaucauccaacgcuu

SEQ ID NO: 30549 - RNA, 20 nt, Artificial Sequence
  ELANE RNA Guide
gaucgacucuaucauccaac

SEQ ID NO: 30550 - RNA, 20 nt, Artificial Sequence
  ELANE RNA Guide
gcuucgaggacaaccccugu

SEQ ID NO: 30551 - RNA, 20 nt, Artificial Sequence
  ELANE RNA Guide
ggacagggguuguccucgaa

SEQ ID NO: 30552 - RNA, 20 nt, Artificial Sequence
  ELANE RNA Guide
gggacagggguuguccucga

SEQ ID NO: 30553 - RNA, 20 nt, Artificial Sequence
  ELANE RNA Guide
ggggacagggguuguccucg

SEQ ID NO: 30554 - RNA, 20 nt, Artificial Sequence
  ELANE RNA Guide
gggguuguccucgaagcguu

SEQ ID NO: 30555 - RNA, 20 nt, Artificial Sequence
  ELANE RNA Guide
ggguuguccucgaagcguug

SEQ ID NO: 30556 - RNA, 20 nt, Artificial Sequence
  ELANE RNA Guide
gguggggacagggguugucc

SEQ ID NO: 30557 - RNA, 20 nt, Artificial Sequence
  ELANE RNA Guide
gguuguccucgaagcguugg

(The sequence listing continues in the following parts.)

The invention claimed is:

1. An ex vivo or in vitro method of modifying in a cell a mutant allele of the elastase, neutrophil expressed (ELANE) gene wherein the mutant allele has a mutation associated with severe congenital neutropenia (SCN) or cyclic neutropenia (CyN), the method comprising introducing to the cell a composition comprising:
   (a) a CRISPR nuclease, or a DNA polynucleotide encoding said CRISPR nuclease, wherein said CRISPR nuclease comprises:
      (i) the amino acid sequence of SEQ ID NO: 31123, 31124, 31125, or 31126; or
      (ii) the amino acid sequence encoded by the nucleotide sequence of SEQ ID NO: 31131 or 31132; and
   (b) a first RNA molecule, or a DNA polynucleotide encoding the first RNA molecule, wherein said first RNA molecule comprises:
      (i) a CRISPR RNA (crRNA) molecule and a transactivating CRISPR RNA (tracrRNA) molecule; or
      (ii) a single-guide RNA (sgRNA) molecule,
      wherein the first RNA molecule comprises (I) a guide sequence portion comprising 20, 21, or 22 contiguous nucleotides of the sequence set forth in SEQ ID NO: 5519; or (II) a guide sequence portion comprising SEQ ID NO: 5469, 5482, or 5519, wherein the CRISPR nuclease and the first RNA molecule form a complex, and wherein said complex binds to the mutant allele of the ELANE gene and introduces a double strand break in the mutant allele of the ELANE gene.

2. The method of claim 1, further comprising introduction of a second RNA molecule, or a DNA polynucleotide encoding the second RNA molecule, wherein the second RNA molecule comprises (i) a crRNA molecule and a tracrRNA molecule or (ii) an sgRNA molecule,
   wherein the second RNA molecule and the CRISPR nuclease form a complex, and
   wherein the complex of the second RNA molecule and CRISPR nuclease introduces a second double strand break in the mutant allele of the ELANE gene.

3. The method of claim 2, wherein the second double strand break is within a non-coding region of the ELANE gene.

4. The method of claim 1, comprising obtaining a cell with a mutant allele of the ELANE gene associated with severe congenital neutropenia (SCN) or CyN from a subject with a mutant allele of the ELANE gene associated with SCN or CyN and/or suffering from SCN or CyN.

5. The method of claim 4, comprising obtaining the cell from the subject by (i) mobilization and apheresis, (ii) apheresis, (iii) mobilization, or (iv) bone marrow aspiration.

6. The method of claim 4, wherein a cytokine is introduced to the cell prior to introducing the composition to the cell.

7. The method of claim 4, wherein the cell is expanded by culturing the cell to obtain a larger quantity of the cells, and wherein the cells are cultured with one or more of: stem cell factor (SCF), interleukin 3 (IL-3), and granulocyte-macrophage colony-stimulating factor (GM-CSF);
   wherein the cells are cultured with at least one cytokine.

8. The method of claim 7, wherein the at least one cytokine is a recombinant human cytokine.

* * * * *